United States Patent 11,725,251 (METHYLATION MARKERS AND TARGETED METHYLATION PROBE PANEL) - sequence listing, part 7

SEQ ID NO: 71260 - DNA, 32 bp, Homo sapiens
  misc_feature 1..32: note = chr10:28559044-28559076
  misc_feature 1..32: note = hypo
  source 1..32: mol_type = genomic DNA
acgagactaagatggcgcgttaaaagagtgac

SEQ ID NO: 71261 - DNA, 30 bp, Homo sapiens
  misc_feature 1..30: note = chr10:2871024-2871054
  misc_feature 1..30: note = hypo
  source 1..30: mol_type = genomic DNA
ttcttggtttatcttcgaaatggctactac

SEQ ID NO: 71262 - DNA, 22 bp, Homo sapiens
  misc_feature 1..22: note = chr10:28791009-28791031
  misc_feature 1..22: note = hypo
  source 1..22: mol_type = genomic DNA
gccaccacgccctgccagtatg

SEQ ID NO: 71263 - DNA, 256 bp, Homo sapiens
  misc_feature 1..256: note = chr10:28850452-28850708
  misc_feature 1..256: note = hypo
  source 1..256: mol_type = genomic DNA
atttacattagagcacgtgtgtatttaatggaatttgaccctgtgggaaaaaaggattatggaacttttaagttttttcgctaggtgggataatgggtgaaataatacaggttttttgaaaccccggcgtctttaacccctgggccacagaccagtacctttctgtggcctgttagcaatcaggcttcacagcaggaggtgagcggcagttgagcaagcattggagccggagttccgcctcctgtcagatcagcca

SEQ ID NO: 71264 - DNA, 572 bp, Homo sapiens
  misc_feature 1..572: note = chr10:28957423-28957995
  misc_feature 1..572: note = hyper
  source 1..572: mol_type = genomic DNA
actcccgggctcccacgcggtttatttttaagacgctggtttaaatttctcgagttacggggggaaggggttgcggtgggagcgagactgagaaccacagcgcgaacaggggcgcattggtaccaggatcggtacagggatgtctccagttcctatagactctagcctcggggggagtctgtccagactacaagtgtctgtgcccctgttttattttgagacaagtcggggtcgctcaatgagtcagcacagaggaggcagtgggggagacagacagcggctgggacgcgcgggactggggcgcgccttgcgcgctgggcaccggagctgcgcacgggcggcccggggcgggggccccagagagcccgggagggcgtggactcggccggggaggggcgggctcgggcgcgtctgggttggagctggatgatgtaaaacagcgcggagctccttggcgcctcggcaccattaccttcaattatcataattggtgcctctctccagcgtttgcatttcccccgagggatctctcactagttcccgttccttctcctcgccctctctcgctcact

SEQ ID NO: 71265 - DNA, 86 bp, Homo sapiens
  misc_feature 1..86: note = chr10:28958043-28958129
  misc_feature 1..86: note = hyper
  source 1..86: mol_type = genomic DNA
cgatctttttggatgttctccctgcctaaaacggatgctaatatctcttcgattgaaccgaaatggcgctgcggctgctacttttc

SEQ ID NO: 71266 - DNA, 192 bp, Homo sapiens
  misc_feature 1..192: note = chr10:28965689-28965881
  misc_feature 1..192: note = hyper
  source 1..192: mol_type = genomic DNA
attgagtgtcagtctcggccagtgtcgtctcgttggcgccgggtgcttttggatttgctaattttcgttaagtgtctctagcccgctactcgtcccgcgtacccgggagaacctagcggctcctaacggatcaacagtcagtctgtctgggctttattgatcccatggcgggcagctcgaggcggacacgct

SEQ ID NO: 71267 - DNA, 30 bp, Homo sapiens
  misc_feature 1..30: note = chr10:28967236-28967266
  misc_feature 1..30: note = hyper
  source 1..30: mol_type = genomic DNA
ctggcctgtagctgccgcgtgccctcagcg

SEQ ID NO: 71268 - DNA, 146 bp, Homo sapiens
  misc_feature 1..146: note = chr10:29011016-29011162
  misc_feature 1..146: note = hyper
  source 1..146: mol_type = genomic DNA
tgtaatgagaaccaccgctgagagctgtttagacaaacgggctcagcgctccggagccgcgcgggcctccaaatgcaagggtttgttctgctggggcagcgtctgtcgcgaaagcagcggcggggaggaagcgcagagctgtgttt

SEQ ID NO: 71269 - DNA, 133 bp, Homo sapiens
  misc_feature 1..133: note = chr10:29011504-29011637
  misc_feature 1..133: note = hyper
  source 1..133: mol_type = genomic DNA
tccagctaacatcagcgctcagtctccccgcccaggtgggatcctccaagcgcctcaacgcaccgcccatcccggtgccaggtgtaaatgcgccccagcaacacgtggctctaggagccgcagggatggcatc

SEQ ID NO: 71270 - DNA, 30 bp, Homo sapiens
  misc_feature 1..30: note = chr10:2908213-2908243
  misc_feature 1..30: note = hypo
  source 1..30: mol_type = genomic DNA
cctgggtggagtgcacgcgtgttgcatgcg

SEQ ID NO: 71271 - DNA, 202 bp, Homo sapiens
  misc_feature 1..202: note = chr10:29164926-29165128
  misc_feature 1..202: note = hypo
  source 1..202: mol_type = genomic DNA
gcggacatgaaacagcgattacacggtaggtatttctttgtagttaggcactctctttgccagcatgaaactcaacttgaacttactcaacagtttaaagtcagggattccagagacttagctttggaaaacacgtgaagaaatgttcgggggcaatgctgaaatttacaaggctgatgcgaaagatcgcatgtgtgaatgg

SEQ ID NO: 71272 - DNA, 30 bp, Homo sapiens
  misc_feature 1..30: note = chr10:2921407-2921437
  misc_feature 1..30: note = hypo
  source 1..30: mol_type = genomic DNA
tttatcaaaggctatcgtcctgattagaaa

SEQ ID NO: 71273 - DNA, 38 bp, Homo sapiens
  misc_feature 1..38: note = chr10:29300117-29300155
  misc_feature 1..38: note = hypo
  source 1..38: mol_type = genomic DNA
gctgcgccatccaggtttacagacgtgcactttatgat

SEQ ID NO: 71274 - DNA, 30 bp, Homo sapiens
  misc_feature 1..30: note = chr10:2932563-2932593
  misc_feature 1..30: note = hypo
  source 1..30: mol_type = genomic DNA
tcccccacagcagcacggagggcattctgg

SEQ ID NO: 71275 - DNA, 30 bp, Homo sapiens
  misc_feature 1..30: note = chr10:2969923-2969953
  misc_feature 1..30: note = hypo
  source 1..30: mol_type = genomic DNA
gtggagcgcaaggtgcgcataggcggttgg

SEQ ID NO: 71276 - DNA, 28 bp, Homo sapiens
  misc_feature 1..28: note = chr10:29718763-29718791
  misc_feature 1..28: note = hypo
  source 1..28: mol_type = genomic DNA
aaatatggtagtggccgggcatggtggc

SEQ ID NO: 71277 - DNA, 26 bp, Homo sapiens
  misc_feature 1..26: note = chr10:30025527-30025553
  misc_feature 1..26: note = hyper
  source 1..26: mol_type = genomic DNA
gagagaggacatctccgagaccttcc

SEQ ID NO: 71278 - DNA, 94 bp, Homo sapiens
  misc_feature 1..94: note = chr10:30026076-30026170
  misc_feature 1..94: note = hyper
  source 1..94: mol_type = genomic DNA
gcttaccctggagccctgagaggcccctttgagtctccagaccttccagggataaataaaatctggcgacctgtgccaacgctgtgggccagtt

SEQ ID NO: 71279 - DNA, 30 bp, Homo sapiens
  misc_feature 1..30: note = chr10:30198419-30198449
  misc_feature 1..30: note = hypo
  source 1..30: mol_type = genomic DNA
ggaatagactgtgcacgcatggtgatggct

SEQ ID NO: 71280 - DNA, 121 bp, Homo sapiens
  misc_feature 1..121: note = chr10:30259002-30259123
  misc_feature 1..121: note = hypo
  source 1..121: mol_type = genomic DNA
ttctgcatgcattctcgtctttaggtagacagctctcggaggggagggaaggctgggcgtggctctgctgctgacagctctgtgacctgaggccagtgcttctgcacgtgtggttgggacc

SEQ ID NO: 71281 - DNA, 607 bp, Homo sapiens
  misc_feature 1..607: note = chr10:30348116-30348723
  misc_feature 1..607: note = hyper
  source 1..607: mol_type = genomic DNA
gccccgggacccccgcgctccgagcggggcacctgaggggaggggacgcccctcccgggctggcaggcgccctccaccccgaggctgccgggctaggcaccgcgcggggggcccaggcggggctgcgactgggggtgcagacatcccccaccgccagggtggctggaaccggagcgacgtcccagctggagaagttggggggagtgcgggaggctgcgggtgaggcccgcgaagcgccgtgggagcggccctaatggacggtgggagccaggagggttagacgccgggacttaccgagcggctccctcatgccgcctcgcgccgccaccgccgccgctccggccggccggggaccagcgcgacccgccccgcctgcagccgccgaggccgagcatgcccggagaaccgccgtccgccccgcccaccgcccgggcccgccccgcccaccgcccggggctgcctcctctgcgctgagggcggtatccaggccacgagcttcctaggcttttggggtccgcctgcgtgggtcgcgcagaaggcacaagtgagctgaccaccattccctcttttcttgtcacttgggtttgggccacgtcaaccctgtgga

SEQ ID NO: 71282 - DNA, 30 bp, Homo sapiens
  misc_feature 1..30: note = chr10:30509201-30509231
  misc_feature 1..30: note = hyper
  source 1..30: mol_type = genomic DNA
gttgcacaaacaggacgagaaggcagcaga

SEQ ID NO: 71283 - DNA, 91 bp, Homo sapiens
  misc_feature 1..91: note = chr10:3063272-3063363
  misc_feature 1..91: note = hypo
  source 1..91: mol_type = genomic DNA
ggtttccctcctccacgcctcggcgcgaagccgaggggaccgcaattgagtggtctcagcgcacctcttccaacgccgctctactcccttg

SEQ ID NO: 71284 - DNA, 30 bp, Homo sapiens
  misc_feature 1..30: note = chr10:30736669-30736699
  misc_feature 1..30: note = hypo
  source 1..30: mol_type = genomic DNA
gactgaagttctcaccgtctcacattttta

SEQ ID NO: 71285 - DNA, 32 bp, Homo sapiens; identical to SEQ ID NO: 42573
  misc_feature 1..32: note = chr10:31006068-31006100
  misc_feature 1..32: note = hypo
  source 1..32: mol_type = genomic DNA

SEQ ID NO: 71286 - DNA, 213 bp, Homo sapiens
  misc_feature 1..213: note = chr10:31073224-31073437
  misc_feature 1..213: note = hyper
  source 1..213: mol_type = genomic DNA
tcctgggttgggggacggcgctacgactctaaggttttaagcagtgatcccagcaggttaactggggcagtaagtgctgtctttctcggggagggagggagttcagctccaaaggcggcctggttcgcaggctcctttccctaagatcctttagaaatcgttcccatcccagaaaggaagctggggcgcagctgtgagcgcccccctctcccc

SEQ ID NO: 71287 - DNA, 38 bp, Homo sapiens
  misc_feature 1..38: note = chr10:31073843-31073881
  misc_feature 1..38: note = hyper
  source 1..38: mol_type = genomic DNA
gccgcggcgaagctgcgctgggccgcccgcacacacct

SEQ ID NO: 71288 - DNA, 101 bp, Homo sapiens
  misc_feature 1..101: note = chr10:31074105-31074206
  misc_feature 1..101: note = hyper
  source 1..101: mol_type = genomic DNA
taactctgaaaggctcggcggggctggccctccccgggccgcccagcgccgccccccgcggtgcaggggtgggtgagtgggggccccgagcccagtaccct

SEQ ID NO: 71289 - DNA, 151 bp, Homo sapiens
  misc_feature 1..151: note = chr10:3108902-3109053
  misc_feature 1..151: note = hyper
  source 1..151: mol_type = genomic DNA
gggaaatggcagcttcgtcatggcccagcccgccacgctcaccttttcccaccacctggaggatccactctccgtccgtccttcccgacctcaggctgcagaggaaacctgggggcgggggtcgaggaagccgagccccgaggctcccagc

SEQ ID NO: 71290 - DNA, 114 bp, Homo sapiens; identical to SEQ ID NO: 32854
  misc_feature 1..114: note = chr10:3109054-3109168
  misc_feature 1..114: note = hyper
  source 1..114: mol_type = genomic DNA

SEQ ID NO: 71291 - DNA, 144 bp, Homo sapiens
  misc_feature 1..144: note = chr10:31152656-31152800
  misc_feature 1..144: note = hypo
  source 1..144: mol_type = genomic DNA
ctcccattccagagccggcctcctggctgagcatccacacgcactcccctcatattgtaggttcgcccccttgctgtcttcctacagaaccttgcctagctggccccaccttgtgctctccacttccaccgcctgttatttggt

SEQ ID NO: 71292 - DNA, 30 bp, Homo sapiens
  misc_feature 1..30: note = chr10:31167819-31167849
  misc_feature 1..30: note = hypo
  source 1..30: mol_type = genomic DNA
atctgacaaaggggtcgagaaaaatcctgc

SEQ ID NO: 71293 - DNA, 34 bp, Homo sapiens
  misc_feature 1..34: note = chr10:3118378-3118412
  misc_feature 1..34: note = hypo
  source 1..34: mol_type = genomic DNA
tccatgtggacgggacgcacgtggccagcggctc

SEQ ID NO: 71294 - DNA, 285 bp, Homo sapiens
  misc_feature 1..285: note = chr10:31422831-31423116
  misc_feature 1..285: note = hyper
  source 1..285: mol_type = genomic DNA
ctcagctgctctccccgggagctggggagccgggggcgggcagccgcgtctgtcctgcccctcctcgccccctcccccgcagcctgaggagggcgttaagcaaggggcttcggagaaattagaaccagcgttctaaattaaggggagcagatgtccttgttttgctcgcgaggcctgggtggcctgctgttcagacagaaatcgttgaggcgctgaccttccgggactgctgtcaatctccgcgtgcagatggccagcccggagcctcgccgctcccctgcattg

SEQ ID NO: 71295 - DNA, 672 bp, Homo sapiens
  misc_feature 1..672: note = chr10:31608744-31609416
  misc_feature 1..672: note = hyper
  source 1..672: mol_type = genomic DNA
cgccgcggccccggccggcgccgtcgctgtcgctcgggccccgcgactcgggccgggctgtgggcgcgcggcaggcgggctgcggcggcggcgggacggggcggccgcgggttgcgtggggtttgtgcgcgcgtgtgcgcgggcgccggctgtgcgcgccgcgggcggacagggttcggccggcggcggtaaagttgggacccgcgggccgggcgcgctcgcgtaacggggattagaggcgcgggggcgcgggtccctaagcgcccctcctccctggcgcctcccgctgcccggcccagagccccggcctggggactccgcggcgagccccgcgagtggggtccacgtttggcggggcgcggcggggcggcgcggggaacaaggcaggaaaggtacccacttaacgccgccgggagccgcgcggatgggggcgagctgggcggcgggtgtgtttgcggagttgttacctgggcttagagaccgggaagcaccacagacagatccccctcccggggcagacgaggtctctgcgccgggatgggccggtgtgcgtgcgcctcgcgcttttctctttcggtttttggggaagttgttacctgggccggacgcacggagcgctgaagccggataatggggcttggatggcgctctgggtctcgggtggaaggaggg

SEQ ID NO: 71296 - DNA, 439 bp, Homo sapiens
  misc_feature 1..439: note = chr10:31609668-31610107
  misc_feature 1..439: note = hyper
  source 1..439: mol_type = genomic DNA
gctttctctccctctcgtgcagcagcgaaatgtctgctgattgttattgtctggacagttcctgtggcgagaggggcgagacttgtccgcccgggggcggcgggagcgcagggagagcagcccccgcctgcgccgccccggtacctgtttgtataataatgggcggcaacggccctgccgccggccgcagcccaggctatataaggaattacacgtacatttcggaccgaggggctcgctttggttcctgcgttatttttaaaacgacttttaagagaggggcaataaatgcgtctataatgggaccgctgcagcgtcgagaaaacgaggaaatacgtgtttaggagaaaactctctcgtgctcccccagccccaccccccgcgcctgggctccctttctccctcccctctgggatgcgaaacgcgaggttttgtaacc

SEQ ID NO: 71297 - DNA, 183 bp, Homo sapiens
  misc_feature 1..183: note = chr10:3160988-3161171
  misc_feature 1..183: note = hypo
  source 1..183: mol_type = genomic DNA
gtacttggaagagatcgccacacagatgcgcacgcacagcatcaacgcgctgctgatcatcggtggattcgaggtacgttaccgtttctctcttgccggtcttgcaggtgtgagccgcgccctgtgttggctaaacattaagctacttgttggctactggccacgatccgagatgataggttc

SEQ ID NO: 71298 - DNA, 220 bp, Homo sapiens
  misc_feature 1..220: note = chr10:31769214-31769434
  misc_feature 1..220: note = hypo
  source 1..220: mol_type = genomic DNA
agcacatagtaataacgctttcttgggcataaattataataaaatactataagtaatacatgtaaagaatgtatcagtcactatctaagccttgaagcaaattgtattcatccttcaagattcagttgaacctactctttggaatcattttcaaccagaggtggtgtatgatttagaaaagattgagcacatggcttctagtcttcgctgtaccatctct

SEQ ID NO: 71299 - DNA, 154 bp, Homo sapiens
  misc_feature 1..154: note = chr10:31874052-31874206
  misc_feature 1..154: note = hypo
  source 1..154: mol_type = genomic DNA
tcctggaaatcttgacgtcttccttgcacccctccttcacctttctctccttccttccaacagcaaaggattgctgccaaatggccatagtcattcacattatgtctggtgacactcttttcagaaagttaccacgtggcgtctgctactgaaa

SEQ ID NO: 71300 - DNA, 384 bp, Homo sapiens
  misc_feature 1..384: note = chr10:31892881-31893265
  misc_feature 1..384: note = hypo
  source 1..384: mol_type = genomic DNA
catgctgcaaattcccgtggccagcacccgaggcctgctggctccgatctgggccacgtgtacaaccaggtgtgcccccttagcctcacgccctcctcctgttgcctccccatccctctagccttcgggacttggggttgcaatgaatcttaggttttttccaggagtcttttattcctccagcgtctccgtgcgcctgtccgctccaacacctgacattttccttcaactccaccctcccctccccgagtccacagacacacacccacccacacgcctcttcccttcccctccaccctcagtcagcggcagagtcagtccatccaataggcaggagcccaaaagactgtccacggacagctgtcctctcgcccaggagagtgg

SEQ ID NO: 71301 - DNA, 98 bp, Homo sapiens
  misc_feature 1..98: note = chr10:31951749-31951847
  misc_feature 1..98: note = hypo
  source 1..98: mol_type = genomic DNA
actgcttgcatttgacgctaccaatgtgggtttcagaccctgttgcggctgcaacagagcccgtttcaagtggcacaggtgggcgtccactcactgct

SEQ ID NO: 71302 - DNA, 138 bp, Homo sapiens
  misc_feature 1..138: note = chr10:3216467-3216605
  misc_feature 1..138: note = hypo
  source 1..138: mol_type = genomic DNA
gggaaaaagtcccaacgtgtctaccctaaactctccatagggcagccagttctgggctgcaggtaaacacgtacctccttattgaagagcccaaaggaaccagaacacaggcaataataggagcgacagacacaaaca

SEQ ID NO: 71303 - DNA, 16 bp, Homo sapiens
  misc_feature 1..16: note = chr10:32171091-32171107
  misc_feature 1..16: note = hypo
  source 1..16: mol_type = genomic DNA
tcggcctcccaaagtg

SEQ ID NO: 71304 - DNA, 39 bp, Homo sapiens
  misc_feature 1..39: note = chr10:32176855-32176894
  misc_feature 1..39: note = hypo
  source 1..39: mol_type = genomic DNA
attacaggcgtgagtcaccgcgcccggcctgcccttcct

SEQ ID NO: 71305 - DNA, 198 bp, Homo sapiens
  misc_feature 1..198: note = chr10:32499001-32499199
  misc_feature 1..198: note = hypo
  source 1..198: mol_type = genomic DNA
atcacctgggaagcaggagcaatgcaaattctccagtcccgcctcagacctactgaagcggacacactgtgggtgctgcccagcaatctaggttttaacaagccctccagggcattctgaagcgctggtaaattgagaactgttgctttagattttcgaacgtggttgaactgtaaccagagacggtccaggttctgg

SEQ ID NO: 71306 - DNA, 30 bp, Homo sapiens
  misc_feature 1..30: note = chr10:32621991-32622021
  misc_feature 1..30: note = hypo
  source 1..30: mol_type = genomic DNA
gggcgcggtggctcacgcctgtaatcccag

SEQ ID NO: 71307 - DNA, 30 bp, Homo sapiens; identical to SEQ ID NO: 42577
  misc_feature 1..30: note = chr10:32638913-32638943
  misc_feature 1..30: note = hypo
  source 1..30: mol_type = genomic DNA

SEQ ID NO: 71308 - DNA, 153 bp, Homo sapiens
  misc_feature 1..153: note = chr10:32670730-32670883
  misc_feature 1..153: note = hypo
  source 1..153: mol_type = genomic DNA
tctcaaaaaacaaacagtacagtgttagagaataacagggagggaaataaataaacaaggtggtaaggaagttgtctctagaggagtggggcttaacctaggcttgaaggatgacaaggagacacatttgaaaaatatcggagaagtcacagt

SEQ ID NO: 71309 - DNA, 42 bp, Homo sapiens
  misc_feature 1..42: note = chr10:32736495-32736537
  misc_feature 1..42: note = hypo
  source 1..42: mol_type = genomic DNA
ttttactgaaagcatcgtgtcacaatcggcatgagaaaaatg

SEQ ID NO: 71310 - DNA, 30 bp, Homo sapiens
  misc_feature 1..30: note = chr10:3280167-3280197
  misc_feature 1..30: note = hypo
  source 1..30: mol_type = genomic DNA
atacaatacagataacgctttttcagaaag

SEQ ID NO: 71311 - DNA, 23 bp, Homo sapiens
  misc_feature 1..23: note = chr10:3285542-3285565
  misc_feature 1..23: note = hypo
  source 1..23: mol_type = genomic DNA
aacaaatgagccaggcgtgctgg

SEQ ID NO: 71312 - DNA, 83 bp, Homo sapiens
  misc_feature 1..83: note = chr10:3285685-3285768
  misc_feature 1..83: note = hypo
  source 1..83: mol_type = genomic DNA
tctcaaaaaataataacaataaatagcaaacagcagagagcatcatcttaaggttttgaaaatacatacgtattactattatg

SEQ ID NO: 71313 - DNA, 193 bp, Homo sapiens
  misc_feature 1..193: note = chr10:33233331-33233524
  misc_feature 1..193: note = hypo
  source 1..193: mol_type = genomic DNA
ctacgcggcagcagccgtgatcatgggggccctgggctaggcaacagcactagttgtcgcgcgtcaccaaacactgtgaagcacctctctagcggagacctgctccaggatcaacatgctgcggggcacagaaattaatgtgttagctaacgctttcattgaccaaaggaaactcatccgagatgatgtcatg

SEQ ID NO: 71314 - DNA, 30 bp, Homo sapiens
  misc_feature 1..30: note = chr10:3329449-3329479
  misc_feature 1..30: note = hypo
  source 1..30: mol_type = genomic DNA
ggattttaggctgggcgaggtggctcactc

SEQ ID NO: 71315 - DNA, 270 bp, Homo sapiens
  misc_feature 1..270: note = chr10:3329539-3329809
  misc_feature 1..270: note = hypo
  source 1..270: mol_type = genomic DNA
ctgggcaacaggacgaaacaccgtatctacagaaaaatcaaatcgatcaataaataaaatggatgttgtttttcagagcaagtttagatttgcagaaaaattgcagagcaggtacagagagttctgatgtccaaccttcctcctgtgcgttgttctggtttcacatgttcgtgttgtaattgagtgcgtgcacactcagtaaatgcgaaatggtttcatcacaaccgcaccgatgcagttcctaaaagaaacacacgacagccgattttg

SEQ ID NO: 71316 - DNA, 30 bp, Homo sapiens
  misc_feature 1..30: note = chr10:3330158-3330188
  misc_feature 1..30: note = hypo
  source 1..30: mol_type = genomic DNA
gtatgtgtgtgtgcacgtgtgtggggatac

SEQ ID NO: 71317 - DNA, 204 bp, Homo sapiens
  misc_feature 1..204: note = chr10:3330414-3330618
  misc_feature 1..204: note = hypo
  source 1..204: mol_type = genomic DNA
agaggggaggggcagcgagcaggtgccacgtccacaccgggtgaggcgtgaggtgagggctcccccgcgccgccctggcgtccaggtggtgagggctgcacggaaacgtggacttcggcagaacatgtgtgcgccacggagcggctgcgtgcagcccgcaggtgagaccgtctgcataactctgccaaccgtggagtatccaag

SEQ ID NO: 71318 - DNA, 47 bp, Homo sapiens; identical to SEQ ID NO: 33011
  misc_feature 1..47: note = chr10:33622724-33622771
  misc_feature 1..47: note = hyper
  source 1..47: mol_type = genomic DNA

SEQ ID NO: 71319 - DNA, 206 bp, Homo sapiens
  misc_feature 1..206: note = chr10:33623014-33623220
  misc_feature 1..206: note = hyper
  source 1..206: mol_type = genomic DNA
cagcccaaggatcaacgtcaggagggagcccaaagacctgaaatcctcctgctctaaaccgcctgatctcatttcttcttctctcctcccagataaaagtttccttcgcccgggagtcggttgttcccggctgatcccgggaagccccgcctgagccccggtccggggcgggcagctgggagccggggcgccgctgtcacccgcgc

SEQ ID NO: 71320 - DNA, 394 bp, Homo sapiens
  misc_feature 1..394: note = chr10:33624053-33624447
  misc_feature 1..394: note = hyper
  source 1..394: mol_type = genomic DNA
cgtgggtgcgggcgtcggaggaaggggcgcggaggtcagtgccagccgcagggtctggccagcccacctcgcgtgctcgctctgcacccctagagggagagctgggcagctcctgcaggcgcagatcccgccgccgcgcagtgcggagcgcccgggaggtggcggctgcttctcgcaacttcaaatcccggggcccgcgccctcggcggcgaggaacgcagggtcaccccctgccactcctcatcgcgccatcctgagacctgtggcggggagcagcggggcacccctggacgcccctgcccagagctggagggcgaggaggggaaagccgggctggagtgggagccgcaccgcgaagccgggcgaggggcagcagtgtcgctgtggtgtgaag

SEQ ID NO: 71321 - DNA, 143 bp, Homo sapiens
  misc_feature 1..143: note = chr10:33624698-33624841
  misc_feature 1..143: note = hyper
  source 1..143: mol_type = genomic DNA
gtggaaatcaggggtcgggcggcccccgtttctctgtgcatcccgagggagggaaagagtggcgggggaggggtgctcttcgctgcgccctctcagtgtccgctcccggccacagacaacgtgcacgccggccctggagctcc

SEQ ID NO: 71322 - DNA, 582 bp, Homo sapiens
  misc_feature 1..582: note = chr10:33625288-33625870
  misc_feature 1..582: note = hyper
  source 1..582: mol_type = genomic DNA
cctcggggtgcaggccgttcccgggccagtgggaggtgcacccacggagcccgcactcgccactctcttgccccgggtcaagcctgtcttctcctccccacgcgcctcgggattcccagtcgccaagttggaaactcggcccccccgagcgcctctttcctctgccagtttcctccttcttctcagctgtcggacccctgggaggcgcggggtgggaagtgggcaccgaagggctgggagttaaatgcctaagttgagcggaaggagcactgtcgaagccatgggcagccctgcgcccgggcaggcgggcaggcgggaggcgaggcgggggcgccgaccgcgcccagcgcagaccccgggggagtgagcgccgcagaggcagcctgggctctcggctactacccgcgcgcggtcgccgcctccccaggtgcagccccgccagtcccagcccccggctgcgccgggcgagcggcatcatcagatttagggtgacccggagcgacctcggtccaggctcggagggagaggcgcctctcaggacctggcaggttgacagggaaggggaaccgggagggagcggcg

SEQ ID NO: 71323 - DNA, 59 bp, Homo sapiens
  misc_feature 1..59: note = chr10:34001866-34001925
  misc_feature 1..59: note = hypo
  source 1..59: mol_type = genomic DNA
cccagctccatgctgcgggaagcctgaactccatggagatgccacgtgtcagggctcag

SEQ ID NO: 71324 - DNA, 30 bp, Homo sapiens
  misc_feature 1..30: note = chr10:3438367-3438397
  misc_feature 1..30: note = hypo
  source 1..30: mol_type = genomic DNA
gcaactctccccttccgtcctctgtctcac

SEQ ID NO: 71325 - DNA, 39 bp, Homo sapiens
  misc_feature 1..39: note = chr10:3440138-3440177
  misc_feature 1..39: note = hypo
  source 1..39: mol_type = genomic DNA
ctgcgccccctcacccgattagcccggtgtttgccctgc

SEQ ID NO: 71326 - DNA, 32 bp, Homo sapiens
  misc_feature 1..32: note = chr10:35103047-35103079
  misc_feature 1..32: note = hyper
  source 1..32: mol_type = genomic DNA
gaaaacttttcattccgcgactcttccaaggt

SEQ ID NO: 71327 - DNA, 52 bp, Homo sapiens
  misc_feature 1..52: note = chr10:35103482-35103534
  misc_feature 1..52: note = hyper
  source 1..52: mol_type = genomic DNA
cagactccggggaggcgcccagggccggcctatgcgccgctgcccggctcgc

SEQ ID NO: 71328 - DNA, 39 bp, Homo sapiens
  misc_feature 1..39: note = chr10:35104078-35104117
  misc_feature 1..39: note = hyper
  source 1..39: mol_type = genomic DNA
ctcagctcgcatgcccggcccggccgccctcgcctcgcc

SEQ ID NO: 71329 - DNA, 353 bp, Homo sapiens
  misc_feature 1..353: note = chr10:35104860-35105213
  misc_feature 1..353: note = hyper
  source 1..353: mol_type = genomic DNA
cagttctgcctgaaacgcaagaattaatagtctgctctggggagacagtggggaagccgtgagcgaccgggccttttccagaggccactatttaccttgaagtttcctgttgaccctctgctgacccacccgcttaaatagattagaacttaaacatcgcaattctgatacatttatttctttgaagttctgcagcataaggaatcctaacgcgaatccgtgaacagtctattccgacggcgcagagaaatctcacgcggggatccccacgatgtgccggcgcttaacgcagacgcccgaacccaggggaaggctgcgactccgcgatgagtgacatgcgggcttgagacgtt

SEQ ID NO: 71330 - DNA, 38 bp, Homo sapiens
  misc_feature 1..38: note = chr10:35152333-35152371
  misc_feature 1..38: note = hypo
  source 1..38: mol_type = genomic DNA
agagatgtttcaggccgggcgcggcggctcacacctgt

SEQ ID NO: 71331 - DNA, 38 bp, Homo sapiens
  misc_feature 1..38: note = chr10:35207255-35207293
  misc_feature 1..38: note = hypo
  source 1..38: mol_type = genomic DNA
agttcttactggagccgcagaagcgtattaacctcgcg

SEQ ID NO: 71332 - DNA, 1225 bp, Homo sapiens
  misc_feature 1..1225: note = chr10:35929333-35930558
  misc_feature 1..1225: note = hyper
  source 1..1225: mol_type = genomic DNA
cgctgcacgccaccttctcgtggcccgccaccaggcgcactaggtagcccaccgacacgaagaggtagcaggccgagaggaagataatgggccgctccgggtacttgaagcgctccatgtcgataaggaaggtggagacggtggcgaaggtggacacgaagcagagcaccgaccacaggccgatccagaagacggtgaaggcgcgctcgtcctggctgaaaaaggggttgtggcagggcagcgcgcagttagcgatctggcctgtcttgacgcggttgtagagcgggtggcgctcgctggacacgctcaccataggcgcgcggcactggcacccgggctcgcagggagccgcgccgccgccagggggccgcgccttcccgccaccgccgccgccgcgagctgggggcgccgccgcgtccccgccgccaccgcccctgccgccgccgcggtgcgggggcctggcccccggcgggcggccgtggccgctgcccgaaggcggctgctcgccgggcggcggcggcggcaggcggcgcggcgggctgggcgcggcggtggttaggtcggtgcggttgtagtccatgcacagcgtgtcagggttgccttgctcgggcagccggtcgcagcgcatgcggtcgggccaggcgaagccgtactggcgcatgagcggcgcgcagccggccttggcgcgctcgcacaccgagcggcagggcggcagcggcttcttgtagtcctctaggcagatgggcgtgtacatgctgcacaggaagaacttgagatcgggcgagcactggatctccaccagcggccagaactggtgcacctccaggcccgcctcgtcttgcgtgtcgtggttgaactgattgggcatgtaggtgtagttgtagccgatgcccttacacagcggcacggtgatctcttggcatgccagctccttggccgaggcggccgcagcgccgctagagcgctgcagcagcgccaaggcggccagcagcgaggtcacttccaacaggtaaccccactccatgctgtgcgcctcggcccggtgccctcgccctccaggcggcgcgcagaggggtgccggggggggggcccacgagagagccgcagacgggtacagcgggtgatctggggtctcccttatgcttcgcccgggaggggggtctgccgataatctaaccccttctaggggcgcgtccgcagcggcgcggcccgcagcctgggcagg

SEQ ID NO: 71333 - DNA, 35 bp, Homo sapiens
  misc_feature 1..35: note = chr10:35931026-35931061
  misc_feature 1..35: note = hyper
  source 1..35: mol_type = genomic DNA
gcctggaaaagtcagcgccgcgctccggccgcagt

SEQ ID NO: 71334 - DNA, 30 bp, Homo sapiens
  misc_feature 1..30: note = chr10:35931404-35931434
  misc_feature 1..30: note = hyper
  source 1..30: mol_type = genomic DNA
aaccttgggattgaccgcagagacagagtg

SEQ ID NO: 71335 - DNA, 242 bp, Homo sapiens
  misc_feature 1..242: note = chr10:35931778-35932020
  misc_feature 1..242: note = hyper
  source 1..242: mol_type = genomic DNA
aactggggctggacccgggacggcccgggtgagatgccccggagcccagccttgggcgcgcgaggggcgcgggggacaaatgcccgccagagactctcctcccgcctccgctgcgtgacctgggggagcctcagtttccccacctagagagttgggtgatcatagcacagatctccaagggggctttgataattaggtgagataaaatataggaagccccgagccgccgtgctttcttagga

SEQ ID NO: 71336 - DNA, 30 bp, Homo sapiens
  misc_feature 1..30: note = chr10:35989914-35989944
  misc_feature 1..30: note = hypo
  source 1..30: mol_type = genomic DNA
tcgttttacctaaatcgtgcaagacaagag

SEQ ID NO: 71337 - DNA, 30 bp, Homo sapiens
  misc_feature 1..30: note = chr10:36211085-36211115
  misc_feature 1..30: note = hypo
  source 1..30: mol_type = genomic DNA
tcagatgaactgtcacggacactcaaatga

SEQ ID NO: 71338 - DNA, 83 bp, Homo sapiens
  misc_feature 1..83: note = chr10:3641339-3641422
  misc_feature 1..83: note = hypo
  source 1..83: mol_type = genomic DNA
agtggacctggacagcgcaggaattcactagaaaagcggaggaagttgggagggcgaggcgggcggatcggatcatgaggtca

SEQ ID NO: 71339 - DNA, 82 bp, Homo sapiens
  misc_feature 1..82: note = chr10:3678219-3678301
  misc_feature 1..82: note = hypo
  source 1..82: mol_type = genomic DNA
cattaatttcatagacgattctgaaaagggtttataacatgatattactaggatcgtgttggtttacattgaatagaaatag

SEQ ID NO: 71340 - DNA, 261 bp, Homo sapiens
  misc_feature 1..261: note = chr10:3678601-3678862
  misc_feature 1..261: note = hypo
  source 1..261: mol_type = genomic DNA
gggattacaggcgtgagacaccgtgcctggtccaaagagatgtttttatgtggttcaccttcgaccttcatcagggtgactcaggaggcacattctgaagccactctccaacacttaagttttttgccaggtatttttcacaaagcaacgatttgaacaatgaaggagaaaatgtagcctcgcaacttcattcgtaaataatccagactaaccgcacggagtataatggatcaaagtgagcagaatcgctcactttggatg

SEQ ID NO: 71341 - DNA, 301 bp, Homo sapiens
  misc_feature 1..301: note = chr10:37106743-37107044
  misc_feature 1..301: note = hypo
  source 1..301: mol_type = genomic DNA
gaataaaataatacacgttagataaatgtcactgctttttagccactcatacattaccatttggaattatgtagtatttacaacccaaagttggttctcgaatcttttatttctcatctttgtgtaataattttacaaaatgtcctcttcatttttgaagaaaaagaaatgtgaaacgttcgtgatcgaatgcttccccctgtgttgtattagaggaacccgaagcaaagcctccagagggtgctggagaagctgcggctgcagagcagtgacccgaggcggggggcgcctcacccgccag

SEQ ID NO: 71342 - DNA, 94 bp, Homo sapiens
  misc_feature 1..94: note = chr10:37923450-37923544
  misc_feature 1..94: note = hypo
  source 1..94: mol_type = genomic DNA
tgagttccaggtgggcgcgggctcagtaggccccacgctaggagcggccagccagcaccaccagccccaggcagtgaggggcttagcacctgtg

SEQ ID NO: 71343 - DNA, 94 bp, Homo sapiens
  misc_feature 1..94: note = chr10:37923604-37923698
  misc_feature 1..94: note = hypo
  source 1..94: mol_type = genomic DNA
caaattctcagtgagcctccactgcctccctgcctgcagggctcgaaacctgcagcctgccatgactgagcgtgtggcccgagcatgcgtgtgt

SEQ ID NO: 71344 - DNA, 35 bp, Homo sapiens
  misc_feature 1..35: note = chr10:38078895-38078930
  misc_feature 1..35: note = hypo
  source 1..35: mol_type = genomic DNA
aaacctgcctggggccgggcgccatggctcatgcc

SEQ ID NO: 71345 - DNA, 23 bp, Homo sapiens
  misc_feature 1..23: note = chr10:38301640-38301663
  misc_feature 1..23: note = hypo
  source 1..23: mol_type = genomic DNA
tgaggcaccgtgtctggccaaga

SEQ ID NO: 71346 - DNA, 249 bp, Homo sapiens
  misc_feature 1..249: note = chr10:38445833-38446082
  misc_feature 1..249: note = hypo
  source 1..249: mol_type = genomic DNA
agaggggtcctggctcggcctggaatggggctcggggagggtcagacggtctattgggctcccagcctgaggcctccctccccggcccgtaacccctcctgccgctggggccctcctgcctttccctgcacgccactccctgggaggccgagactcctgcctggcctccctctgccgctggcaccccagactcccggactcacccttggctgggttgccctctcctcctttaagcgctggatgccacaa

SEQ ID NO: 71347 - DNA, 30 bp, Homo sapiens
  misc_feature 1..30: note = chr10:3862581-3862611
  misc_feature 1..30: note = hypo
  source 1..30: mol_type = genomic DNA
ctttaatctttagagcgggggccactgatc

SEQ ID NO: 71348 - DNA, 30 bp, Homo sapiens
  misc_feature 1..30: note = chr10:38690543-38690573
  misc_feature 1..30: note = hypo
  source 1..30: mol_type = genomic DNA
aagcccggcaagtagcggagactacaagtg

SEQ ID NO: 71349 - DNA, 177 bp, Homo sapiens
  misc_feature 1..177: note = chr10:3895354-3895531
  misc_feature 1..177: note = hypo
  source 1..177: mol_type = genomic DNA
gttcccaccacacagcggcggctcaactgcccaggctgtggggtttccagctgtgtcgtgttgacttgaaccgactcagcaggcggtgccctcctggagcacctgaagcctccagagaaatatgatggaaaaccaagaggcctccacctccctgacttgctgcgacctcctgggctt

SEQ ID NO: 71350 - DNA, 163 bp, Homo sapiens
  misc_feature 1..163: note = chr10:3983403-3983566
  misc_feature 1..163: note = hypo
  source 1..163: mol_type = genomic DNA
cctaggccgctaagacgtcaggggagctgatacacacttccaagaacacggagacatcaaagggagctgagagtccacagcggcagcaaaacaggtgctgcttcacatgccctttgctaagagtcctggagtttgaagtctccacggccgatctaaaagcaag

SEQ ID NO: 71351 - DNA, 54 bp, Homo sapiens
  misc_feature 1..54: note = chr10:42777495-42777549
  misc_feature 1..54: note = hypo
  source 1..54: mol_type = genomic DNA
tctaaaactactccacggccgaggaactgcggcctgcagcgggctgggacgagg

SEQ ID NO: 71352 - DNA, 19 bp, Homo sapiens
  misc_feature 1..19: note = chr10:42862078-42862097
  misc_feature 1..19: note = hypo
  source 1..19: mol_type = genomic DNA
ttcctcactgcctctcgta

SEQ ID NO: 71353 - DNA, 59 bp, Homo sapiens
  misc_feature 1..59: note = chr10:43046988-43047047
  misc_feature 1..59: note = hypo
  source 1..59: mol_type = genomic DNA
tcttttaaataaagccgaaatagataacttacagacctttcttgcggctgcacctctga

SEQ ID NO: 71354 - DNA, 30 bp, Homo sapiens
  misc_feature 1..30: note = chr10:43187000-43187030
  misc_feature 1..30: note = hypo
  source 1..30: mol_type = genomic DNA
taccactccagcagccgtgcagtccctgtc

SEQ ID NO: 71355 - DNA, 1582 bp, Homo sapiens
  misc_feature 1..1582: note = chr10:43248537-43250119
  misc_feature 1..1582: note = hyper
  source 1..1582: mol_type = genomic DNA
tggctgctccagcctcgaggccgcaggtcaccgcgcgggccccgtgcctactggcccggcagtcctgcgggtcagctcaggggagtgctctggagagccctgagcccacctcctgcgccccgcccaacctcgggtccccaggcccagcctctgacacgccgctcccagcgcggccacgccacagctccgggctgcgctcccccaggcaaaggcgccgccggcgcgtccagcgcggcctcctcctccaggcggcgcttgtgagtcaatggaaaagtccttggcgaactgagcagccgcctagtatatctctgaagcctcctgcggagacttcacggcttgtcccaggagcttctacaacagcctggcattgagagtagagttgtaatattttccgccagtttttcccagcccggccccgaagcgtctgatcttaaagtccacgtatcagactccggggggcgtccctgcaagagcgccaggtccccgacacccaccagggaatgaatctgcgcccaggtccccgacacccgccagggaatgaatctccgtcccaggagaagggcgtggcgaggggagaagcaacaaccacaggacccgtgacagtggccaagccttagaggccccgcatgcctgccaggcgcccgagcccacgcagtccaggtttccccatccgggcgggaaccagctgtttcccctgcacgggcgagggcgctggggtcacctccgccgacgccaggcgtgagctccagaacccgctcccaaccgcccggtcccgtgagcgcggggagcctggctctcgcctgacaataaagaaatcatcacggacagaaggaaagaggagcgaggctgggaagggagcggctttaatccggggtccgcccccttcaattctccagcgcagcggccccgaaagtggggtggggacggggattgaggctgagctcgcttcttccttgttttccgggtctcgcgcctctgaagcgaactgggcctggaggggtgctggggatcgagggagcggcgttggtgggtgaccgagggaaaggtggggccagcccctgggcaccggtcggaggaggattacgaggcggagccgctgcctgcccgcgcctcacccgcttggtccacccaatagctccgctgtagactcgcggcggcaggagcggcgggccagatggtgattacaacccggggcgctatccctttggaacctgacccccaactccgctcagtaaccggatttccggaagccgcgacctcgaagcccccagcgtttctccaccgacggcggggccggggctcctggaagcctcggagccgcagctccagcctgcagcgcacgccttggcccccagggagcagagaggcagagtacccccctgcatccggagcatagcaagcatgccccaggctgaggacctgcgacttggtgggacttcggtgcccgcccctccgccactacagggagcagaggcggctctggaagtcggtttagtgcggagaccgcgaccggaggagcgcagaacgctcctcccagcgtcctgggctccgcaggcacaatttttaaaccagaggcgaaatc

SEQ ID NO: 71356 - DNA, 644 bp, Homo sapiens; identical to SEQ ID NO: 33022
  misc_feature 1..644: note = chr10:43250136-43250780
  misc_feature 1..644: note = hyper
  source 1..644: mol_type = genomic DNA

SEQ ID NO: 71357 - DNA, 71 bp, Homo sapiens
  misc_feature 1..71: note = chr10:43250854-43250925
  misc_feature 1..71: note = hyper
  source 1..71: mol_type = genomic DNA
cgcccaggccgccggctcggtgagcgcagagaggggcccccggtttatgccaaacgcgtgtcttctccaac

SEQ ID NO: 71358 - DNA, 36 bp, Homo sapiens; identical to SEQ ID NO: 42584
  misc_feature 1..36: note = chr10:43265217-43265253
  misc_feature 1..36: note = hypo
  source 1..36: mol_type = genomic DNA

SEQ ID NO: 71359 - DNA, 30 bp, Homo sapiens
  misc_feature 1..30: note = chr10:43265495-43265525
  misc_feature 1..30: note = hypo
  source 1..30: mol_type = genomic DNA
cctccccacccctttcgttactccctgagg

SEQ ID NO: 71360 - DNA, 30 bp, Homo sapiens
  misc_feature 1..30: note = chr10:43332265-43332295
  misc_feature 1..30: note = hyper
  source 1..30: mol_type = genomic DNA
tggaacgcttcgtggcgctgctgcaaacct

SEQ ID NO: 71361 - DNA, 98 bp, Homo sapiens
  misc_feature 1..98: note = chr10:43332534-43332632
  misc_feature 1..98: note = hyper
  source 1..98: mol_type = genomic DNA
cagcgcggctccccacggcgtgcaggacccgggactgtcgcgccgcgcccggggacgcacaggaggtgggaccccggagcgaagcccctgcagcgtcc

SEQ ID NO: 71362 - DNA, 73 bp, Homo sapiens
  misc_feature 1..73: note = chr10:43332713-43332786
  misc_feature 1..73: note = hyper
  source 1..73: mol_type = genomic DNA
cgttctgggaaagttaaagaacgcgctgcagctacttcacctgctgctgaaaggagcccgggcagggctggtc

SEQ ID NO: 71363 - DNA, 178 bp, Homo sapiens
  misc_feature 1..178: note = chr10:43361545-43361723
  misc_feature 1..178: note = hyper
  source 1..178: mol_type = genomic DNA
ccccacccgaggacccgcagtgcccggccgccgcgagctcgcggggtgtatgcccgccccgaggctccaccgcgcctgtgtgccgggaagcctggctccacaggaccctcaggcactgggcgcgccgtcgctgcagctgccaggagctcctgaggaagtggctcgaggccccggggcg

SEQ ID NO: 71364 - DNA, 350 bp, Homo sapiens
  misc_feature 1..350: note = chr10:43361980-43362330
  misc_feature 1..350: note = hyper
  source 1..350: mol_type = genomic DNA
tgtgaacgcgtcatacgcttgtgaaagacggtgcttgtgcacacgcgtgtgcgtgcgtgtgaacgcgtcagggtacccgaggatgcacacacgcacgtgtgagtgtgcgcgagtgcgtgctcagaggacagctctcagcaggctggggacctccttcctctcacccctgagggttttgggggaccagcccccgtatccgggtgctgcgggatcccctgaggcgagcgcgcaccgctgtgctcgggctccggctttgtggggacccggccttcccggcccgcaccacgaggagttccacgcagtagccacgaggtggcaccgcagactcgctaccgcggagcgcggcggct

SEQ ID NO: 71365 - DNA, 30 bp, Homo sapiens
  misc_feature 1..30: note = chr10:43364192-43364222
  misc_feature 1..30: note = hypo
  source 1..30: mol_type = genomic DNA
catcctcaccaccagcgctcgagtcagtgg

SEQ ID NO: 71366 - DNA, 182 bp, Homo sapiens
  misc_feature 1..182: note = chr10:43393461-43393643
  misc_feature 1..182: note = hyper
  source 1..182: mol_type = genomic DNA
attttcacctttcatcgcaagggtcttcgcggcagaacgtggccgtccccacagccgtcgggggtttcgggttggatcccgcgttcgctccgctgcttggcctgcgcttcagcctctagcgacccagcgggggcgcgacttccgagccgcctccgcctcccgcctctaccgcggggccgggg

SEQ ID NO: 71367 - DNA, 208 bp, Homo sapiens
  misc_feature 1..208: note = chr10:43428369-43428577
  misc_feature 1..208: note = hyper
  source 1..208: mol_type = genomic DNA
cctgctgaggaaagccggtgcctcctgctccccagccctgtgctcccgcgcccccagtctcagcgggttccggcttagtccggcaccctgggggaatgctgcgctctggctggcagcacgccctgcctgcgctcgccccgtctttgctcctggtcaccatgcgtcctgcacagttaccatccgtgcccacatgctgccccggggtcgc

SEQ ID NO: 71368 - DNA, 83 bp, Homo sapiens
  misc_feature 1..83: note = chr10:43428894-43428977
  misc_feature 1..83: note = hyper
  source 1..83: mol_type = genomic DNA
ggagggcaggatgcccgcccggggcggaagagccgagggcaggccctggggcggggcgctgggctatggagaccacgctcctc

SEQ ID NO: 71369 - DNA, 131 bp, Homo sapiens; identical to SEQ ID NO: 33030
  misc_feature 1..131: note = chr10:43429066-43429197
  misc_feature 1..131: note = hyper
  source 1..131: mol_type = genomic DNA

SEQ ID NO: 71370 - DNA, 223 bp, Homo sapiens; identical to SEQ ID NO: 33031
  misc_feature 1..223: note = chr10:43429215-43429438
  misc_feature 1..223: note = hyper
  source 1..223: mol_type = genomic DNA

SEQ ID NO: 71371 - DNA, 30 bp, Homo sapiens
  misc_feature 1..30: note = chr10:43479981-43480011
  misc_feature 1..30: note = hypo
  source 1..30: mol_type = genomic DNA
cactttctgcctgctcgtggtgctgcaccc

SEQ ID NO: 71372 - DNA, 1032 bp, Homo sapiens
  misc_feature 1..1032: note = chr10:43571966-43572998
  misc_feature 1..1032: note = hyper
  source 1..1032: mol_type = genomic DNA
gccgcgctcccactgcgcctctcgcctctgagaaatggcgcagcaagcgctccgcggagagcctggaggcggggcgcccttctctgagtccgcggggtcgcaccccgagccagtcggccagacctgcatcccgcgtagcatccctgccctctctgtgcagcggaaagggcaaaaggcagggactgcaagcgggcgcgcaccgggtaggaagagcggctctgcgtaggtgcgcggacccgggctcctgggttccatccccgccgcgcacctcggggtccgcacccggctcctgccgggcccttttcggccgcaccccgctcccgcaccccgctcctccccaagccccacccggcccaagccgcgcgtcccgcactgagctcctacacgcgccgcgccccggccgcaccccgcgcagccagagcaagcactggagccccgccccttcccgcaccccacccgcctccggccccgcctggcccacccctggaccgcccccgccccgccccgcccctacccgctcctccggcgcagccggcgcttacctcgcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaaggtgagttctgccggccgccggctcccgcaggggccagggcgaagttggcgccgagcagcggagcgggcgcgttcagaagcgcctttctgtttgccgtgggcagcgggctgtgcggtcgccggccacccggcctcggctgggagcgcagtggctgcggcgggcggcgggcgaagggcaggacgcctcgggccgggcgcctcgggccggggctgggcgggt

SEQ ID NO: 71373 - DNA, 52 bp, Homo sapiens
  misc_feature 1..52: note = chr10:43573249-43573301
  misc_feature 1..52: note = hyper
  source 1..52: mol_type = genomic DNA
ctcccccagctctgccgtcctggccagccgagggattcggaggctcttttga

SEQ ID NO: 71374 - DNA, 47 bp, Homo sapiens
  misc_feature 1..47: note = chr10:43600276-43600323
  misc_feature 1..47: note = hyper
  source 1..47: mol_type = genomic DNA
ggggaggcctggggccgcggcggtgtgcgccccgctctgaccgcaga

SEQ ID NO: 71375 - DNA, 81 bp, Homo sapiens
  misc_feature 1..81: note = chr10:43600550-43600631
  misc_feature 1..81: note = hyper
  source 1..81: mol_type = genomic DNA
ggtgaccgtgtacgacgaggacgactcggcgcccaccttccccgcgggcgtcgacaccgccagcgccgtggtggagttcaa

SEQ ID NO: 71376 - DNA, 186 bp, Homo sapiens
  misc_feature 1..186: note = chr10:43615366-43615552
  misc_feature 1..186: note = hypo
  source 1..186: mol_type = genomic DNA
accctgactccaccacgcccctgccatgccacacccccggcccaggtctcaccaggccgctacccgggccacacaccacccctctgctggtcacaccaggctgagccagtgaccgctgctgcctggccatggcctgacgactcgtgctatttttcctcacagctcgttcatcgggacttggcagcc

SEQ ID NO: 71377 - DNA, 109 bp, Homo sapiens; identical to SEQ ID NO: 33035
  misc_feature 1..109: note = chr10:43697887-43697996
  misc_feature 1..109: note = hyper
  source 1..109: mol_type = genomic DNA

SEQ ID NO: 71378 - DNA, 77 bp, Homo sapiens
  misc_feature 1..77: note = chr10:43698279-43698356
  misc_feature 1..77: note = hyper
  source 1..77: mol_type = genomic DNA
gccccaactcagacccgccccacagccccagccaggccacgccccaaccctagccctgaccccgcccccaggcccca

SEQ ID NO: 71379 - DNA, 902 bp, Homo sapiens
  misc_feature 1..902: note = chr10:43724462-43725364
  misc_feature 1..902: note = hyper
  source 1..902: mol_type = genomic DNA
ggtctccataaacagcgtgggaaatgccagtgctccatgctcaggtcctctccaggaccagttctccgcctgcaccctacagcgccctcgccctggagcgcacactcctcgaagccccacggtgggctccactctccctaaacgcacaggcgcgcgtggggctcacaaggcacaggcacggctgcgctccctcccatgtgccgtgaataagcgcgcccgcgcttccgcagccctcccccgcctgcacctcacacagaccacacaccgcggaccacccctcgcccggcacatcctcctcagagcaacaggtggttctgcgcccctcaagtcgtccgggctcctacacgcccgtccccaccccttccaggctcgcaggagccactgtgctctcggcgtccgcgggccgcgccgcgaagggcagggcaggagcagaggcaggctgggcgccgcccaccgggcagtaggtgctccagcggggacgcacagagggcggcgcgcgggtcctcagggcgggcaccctcccgcacgggtcgggatgcaggggaccgtcgcacccctcccgagcccgacagcgcaagaaccctgccccgcggccttgcgcctgggcccgccgcagccctacctggggctccaggaacattctggccgccggctccccgcgccgtcctgcccggtccggcgtccagcgagcggcggctcctctgcccgcgagccaagcaagcacccactcctgcgccggcccctgccgctggacgcctccgctggaggggtgggaccccggaagcagggaaccgaggggctgggctggggaccgcggggtccgggcggggcagaggggccgcgaggccggccaggaacgcggggcggggccgaggctaggagcatggcgcggaggtggggca

SEQ ID NO: 71380 - DNA, 98 bp, Homo sapiens
  misc_feature 1..98: note = chr10:43762179-43762277
  misc_feature 1..98: note = hyper
  source 1..98: mol_type = genomic DNA
gagggaccccgggcccgcgcacgccgcgccctgcccgcgccggcgaccggagggcacggccccaggcgcgggcgggggccccgaggcactgagggtcc

SEQ ID NO: 71381 - DNA, 396 bp, Homo sapiens
  misc_feature 1..396: note = chr10:43762357-43762753
  misc_feature 1..396: note = hyper
  source 1..396: mol_type = genomic DNA
ggccggcgccggcggcggctcatgctcggcgcccgggcccgcggcacccgcccacccgcggccgcccccgcgctgcgccagctgcgggcagagcagctccctccgcagccggcgccggggagcgcgagcgagcgagcgaacgagcgagcgcggagcgagcgccgagcgggcacggagcgggcgcgagagcgcggggagcgggggagcgggcgggcgcgggacgcggagggaggagggtgcggggcaaaggtgcagggggaggtagggcgcgggacggggctcgagcagagggcactgggacagggcgggcgccgggagagggcggccaggctttcatttaaaaaggataaggcatcacgcctgtaatcccagcactttgggaggccgagacgggcg

SEQ ID NO: 71382 - DNA, 69 bp, Homo sapiens
  misc_feature 1..69: note = chr10:43778482-43778551
  misc_feature 1..69: note = hyper
  source 1..69: mol_type = genomic DNA
tgccggccacaaagacgtgcgctgttggtcagcaccgaggacagcacttgggggcggtgctccggggaa

SEQ ID NO: 71383 - DNA, 45 bp, Homo sapiens
  misc_feature 1..45: note = chr10:43800413-43800458
  misc_feature 1..45: note = hyper
  source 1..45: mol_type = genomic DNA
ctggcttcggtttcgcgaacttcctggccgcggagctttcccttc

SEQ ID NO: 71384 - DNA, 30 bp, Homo sapiens; identical to SEQ ID NO: 33040
  misc_feature 1..30: note = chr10:43818377-43818407
  misc_feature 1..30: note = hyper
  source 1..30: mol_type = genomic DNA

SEQ ID NO: 71385 - DNA, 275 bp, Homo sapiens
  misc_feature 1..275: note = chr10:43857593-43857868
  misc_feature 1..275: note = hyper
  source 1..275: mol_type = genomic DNA
agcctccaaggtccccgttaccgaagaccgccaccatcacgacatagcgcagcacatatgggtaaacaaatggactgagactcaagcaaagaagtaacccgagacgcgcgttacacggaaaacgactgcgcaagcgcggtagagcaggggcttgcaggtgagtgggagcagccaatccacgcgaagggggtcgggaccacttccgcggaggaaagccccgcccacacctcctgggccctcgcctcactggcggtttctcccgcgagccagcctca

SEQ ID NO: 71386 - DNA, 151 bp, Homo sapiens
  misc_feature 1..151: note = chr10:43858289-43858440
  misc_feature 1..151: note = hypo
  source 1..151: mol_type = genomic DNA
gggacactcacagggcgggggtccaggcgggagtccagtagtcctcgtggagacagctgggaaaggcctcggggcaagggacctcggatttcctcctctgcctcaaaacagacagtctaagctgggtgcggtagcttgcgcctgtaatccc

SEQ ID NO: 71387 - DNA, 196 bp, Homo sapiens
  misc_feature 1..196: note = chr10:43892774-43892970
  misc_feature 1..196: note = hyper
  source 1..196: mol_type = genomic DNA
gtcaccaatgggaaacgcgtgcctgcaggtgcggccccgtggcccgcgcgctgggcccaggcaggaagtgggggaaggagagagtcagggcggcgggaagacatttctccgagttctcccgaagggagccaggcgcgagcgcgacctggggaaagtccagagtgccagccacggggaagggcgggcagtgcagagt

SEQ ID NO: 71388 - DNA, 45 bp, Homo sapiens; identical to SEQ ID NO: 42587
  misc_feature 1..45: note = chr10:43905839-43905884
  misc_feature 1..45: note = hypo
  source 1..45: mol_type = genomic DNA

SEQ ID NO: 71389 - DNA, 44 bp, Homo sapiens; identical to SEQ ID NO: 42588
  misc_feature 1..44: note = chr10:43906064-43906108
  misc_feature 1..44: note = hypo
  source 1..44: mol_type = genomic DNA

SEQ ID NO: 71390 - DNA, 30 bp, Homo sapiens
  misc_feature 1..30: note = chr10:43915503-43915533
  misc_feature 1..30: note = hypo
  source 1..30: mol_type = genomic DNA
caatccgtctgtctccgttttccaaagtgc

SEQ ID NO: 71391 - DNA, 41 bp, Homo sapiens
  misc_feature 1..41: note = chr10:44069791-44069832
  misc_feature 1..41: note = hyper
  source 1..41: mol_type = genomic DNA
gggggcgcagcagctcggaaatgcggcgccgggacacacgt

SEQ ID NO: 71392 - DNA, 703 bp, Homo sapiens; identical to SEQ ID NO: 33043
  misc_feature 1..703: note = chr10:44185340-44186043
  misc_feature 1..703: note = hyper
  source 1..703: mol_type = genomic DNA

SEQ ID NO: 71393 - DNA, 156 bp, Homo sapiens
  misc_feature 1..156: note = chr10:44197833-44197989
  misc_feature 1..156: note = hypo
  source 1..156: mol_type = genomic DNA
cgagctgcccccccacgctgccaccggcgctgccacctgcccatatccccgccttccgcagaggcttcagcctcccctgtacagaggcggggcatggagccggcggctttcagaactcccagggtctctgctgcggtagaccggctatttaacctc

SEQ ID NO: 71394 - DNA, 30 bp, Homo sapiens; identical to SEQ ID NO: 42590
  misc_feature 1..30: note = chr10:44433895-44433925
  misc_feature 1..30: note = hypo
  source 1..30: mol_type = genomic DNA

SEQ ID NO: 71395 - DNA, 30 bp, Homo sapiens
  misc_feature 1..30: note = chr10:44441910-44441940
  misc_feature 1..30: note = hypo
  source 1..30: mol_type = genomic DNA
agatattgtgctaaacgctttatgcatggg

SEQ ID NO: 71396 - DNA, 595 bp, Homo sapiens
  misc_feature 1..595: note = chr10:44500784-44501379
  misc_feature 1..595: note = hypo
  source 1..595: mol_type = genomic DNA
cgggctctggaagtccgctgttcggggtaaattggcagctgctgaaccctaaagtcgtggggcagggctccgacaggcctttgcgcctcctttccccatcagcgtttagagctaatgggaaaggaattgtttattttcttttgtttttatatttttgggttagctttaccgctacagaaaagtaaggtaaatgaccccgcattcacggagggtgactgtgcaaagcgtgaacatgcgccgagtttatgaagcgggtgtcggagccagcgctgcttctcgctgacccgcatgccccggccggccaggaacctgcgcctgagtgccctggtgtttctcttttttcccacgaaagcacgtgtgaagggcagagccacgtttatcaagaagtcatttttcccgttcgccggcattacaccattagcattacaggggccacctacacctcgtatttcgattccacagctccggagaacctgcggtgctgcggccactctgtgggtgtccccccacccccatctccactgcgagctctccggcctgggcacgcagctgctgacacacatcagcatggtgccctggccggcatctgctctgt

SEQ ID NO: 71397 - DNA, 220 bp, Homo sapiens
  misc_feature 1..220: note = chr10:44547194-44547414
  misc_feature 1..220: note = hypo
  source 1..220: mol_type = genomic DNA
cacattcagagacatcggggctcccagaagcagcagcctcagctttggagaatggggtcaacagcttctggtagctgttcacctggagaaatgggggagagtgggaattctttaaaagatgacacatgctttgttatttctggcactcacggtgctgaactcgtttcagctgagtaagcactagtgactcaactccaaggcacaccgtagacttcatctc

SEQ ID NO: 71398 - DNA, 38 bp, Homo sapiens; identical to SEQ ID NO: 42593
  misc_feature 1..38: note = chr10:44594208-44594246
  misc_feature 1..38: note = hypo
  source 1..38: mol_type = genomic DNA

SEQ ID NO: 71399 - DNA, 30 bp, Homo sapiens; identical to SEQ ID NO: 33044
  misc_feature 1..30: note = chr10:44788550-44788580
  misc_feature 1..30: note = hyper
  source 1..30: mol_type = genomic DNA

SEQ ID NO: 71400 - DNA, 315 bp, Homo sapiens
  misc_feature 1..315: note = chr10:44806359-44806674
  misc_feature 1..315: note = hyper
  source 1..315: mol_type = genomic DNA
ggcggtgatgctgcacgcccctgggggactgcatggagaaggggagggtgcgcggggccggctggtccagtgcactccggcgcggccccggcacccgtgggcaccgccatgtccttcgctcagctccgccgcggctacctgcggggtctgcgcggctgcggtggccaggtgaggacgtctctgcccttgcgcggcctgcgctgtatgcttcctgcctggcccgcgcttcccctgcctgcatcacccgctgcccgcgcggctcggagcgcgccctctgctggaccggccacggccggcgggcggctgcctccaggc

SEQ ID NO: 71401 - DNA, 34 bp, Homo sapiens; identical to SEQ ID NO: 42594
  misc_feature 1..34: note = chr10:44869035-44869069
  misc_feature 1..34: note = hypo
  source 1..34: mol_type = genomic DNA

SEQ ID NO: 71402 - DNA, 245 bp, Homo sapiens
  misc_feature 1..245: note = chr10:44879151-44879396
  misc_feature 1..245: note = hyper
  source 1..245: mol_type = genomic DNA
ttaggcagtccgccacgaccccaggctgcccagcttctccagcccgactcagctgcgctggtcctgctcacaccagcgcacagtccaagccagctaggacgccggggccacgtctgcaccaacccagccaagggctcgaggcgcgctgggcctgcacagcccgcggctgcaagagcactcagagtgtccttcaactctttgcaggaaacttcacagccaaggaagctcagcggcctgagccacag

SEQ ID NO: 71403 - DNA, 632 bp, Homo sapiens
  misc_feature 1..632: note = chr10:44879823-44880455
  misc_feature 1..632: note = hyper
  source 1..632: mol_type = genomic DNA
cctggccaagagccccgcgagggtgtggggagaggatcggcttcgcagggagcggaggctgcgcggctgcatcggacctcacagcctcaagtcgcggcatgaggcgaactttgcaaagcgcgctctcgccatgcaccgcccgacctccagcactgtgcgcagcaggacctcggagcccattcgcctgtggaaaccgagcccgcagcgggaaggcagtgggtggagggtgggcaggcaggggtctggggtccgcggctccccaccctcgcgccttcccgcgccagtcccgaacgctctcttggggcgttcctgcccagttgtcccggctgacctcgctctgcagccagcttgaggtcaggcggtcgctctctgcaggtcacaaaccctcggcgcaaaagtagggctttgaacgcgacaccgcaccagagcgcccagctaagcgagctgcctccacccccactgtgtcgggcggcgcaaactgcgggcgcaggcagaggagccgcggctctgcgccgggcgggagccgaagcccagagcctcgccagggcctccccgccgagcgcacttaccgtcgctgaggcagagcgcggtcagcacgaggaccagcacgaccacgaccttggcgttcatgg

SEQ ID NO: 71404 - DNA, 26 bp, Homo sapiens
  misc_feature 1..26: note = chr10:44880519-44880545
  misc_feature 1..26: note = hyper
  source 1..26: mol_type = genomic DNA
cggctgacggagagtgaaagtgcggc

SEQ ID NO: 71405 - DNA, 99 bp, Homo sapiens; identical to SEQ ID NO: 33049
  misc_feature 1..99: note = chr10:44880546-44880645
  misc_feature 1..99: note = hyper
  source 1..99: mol_type = genomic DNA

SEQ ID NO: 71406 - DNA, 357 bp, Homo sapiens; identical to SEQ ID NO: 33050
  misc_feature 1..357: note = chr10:44880673-44881030
  misc_feature 1..357: note = hyper
  source 1..357: mol_type = genomic DNA

SEQ ID NO: 71407 - DNA, 65 bp, Homo sapiens
  misc_feature 1..65: note = chr10:44882297-44882362
  misc_feature 1..65: note = hyper
  source 1..65: mol_type = genomic DNA
gggcgccctggagctcggagatccgaccctgcgggagccgcgcgcagcctcgcttgcccttaaat

SEQ ID NO: 71408 - DNA, 85 bp, Homo sapiens
  misc_feature 1..85: note = chr10:45374177-45374262
  misc_feature 1..85: note = hyper
  source 1..85: mol_type = genomic DNA
gggaggggaaaaggccgcttggaggtggaggggaggcctcctcgctcaccacccaatggcagagatgaggcgttggaggagcaga

SEQ ID NO: 71409 - DNA, 96 bp, Homo sapiens
  misc_feature 1..96: note = chr10:45565093-45565189
  misc_feature 1..96: note = hypo
  source 1..96: mol_type = genomic DNA
ggtcctcaaatccagcggacatggagtgcacggtagctttctttcaagattccactgcctggaataaaaaattgtgccaagctctttctctgctat

SEQ ID NO: 71410 - DNA, 150 bp, Homo sapiens
  misc_feature 1..150: note = chr10:45568859-45569009
  misc_feature 1..150: note = hypo
  source 1..150: mol_type = genomic DNA
agaaccagttcttatcgtaggcagcaagctctctgtgcttggccggcttgatggtgtccacccattcggtgactttcagcttcccagactttttgagaaaggctgccagagctctgatgaactcctgctggttcacgtcttttataccca

SEQ ID NO: 71411 - DNA, 228 bp, Homo sapiens
  misc_feature 1..228: note = chr10:4599777-4600005
  misc_feature 1..228: note = hypo
  source 1..228: mol_type = genomic DNA
tggtgtcagccaaagcgtttcacagtgcggtgacgatgggatccgcccatgtttgcacgtgccaggagcagcggtagcagcagctccagggaggtgcacacttgtcagcggcagtggggtgctggcgggtgccagagggcctgccgccctaaggtcgttcacgatggtgtcagcggcaatgcagctggggtggagggcctgctggcagctgtgcgtgcagtgacactg

SEQ ID NO: 71412 - DNA, 30 bp, Homo sapiens
  misc_feature 1..30: note = chr10:46009559-46009589
  misc_feature 1..30: note = hypo
  source 1..30: mol_type = genomic DNA
cttaagaatacttttcgcaatttcaagaaa

SEQ ID NO: 71413 - DNA, 67 bp, Homo sapiens
  misc_feature 1..67: note = chr10:46009822-46009889
  misc_feature 1..67: note = hypo
  source 1..67: mol_type = genomic DNA
agtgcagcgcttccccgcaacatggtccctgtgcttgatgccggggaacaggcgctgcctgcacagc

SEQ ID NO: 71414 - DNA, 30 bp, Homo sapiens
  misc_feature 1..30: note = chr10:46092104-46092134
  misc_feature 1..30: note = hypo
  source 1..30: mol_type = genomic DNA
caatatggtctttggcgacggggtattagt

SEQ ID NO: 71415 - DNA, 21 bp, Homo sapiens
  misc_feature 1..21: note = chr10:46098319-46098340
  misc_feature 1..21: note = hypo
  source 1..21: mol_type = genomic DNA
acagagcgaggctccatctca

SEQ ID NO: 71416 - DNA, 28 bp, Homo sapiens
  misc_feature 1..28: note = chr10:46221028-46221056
  misc_feature 1..28: note = hypo
  source 1..28: mol_type = genomic DNA
acaaacaaacaaacgacaacaaaaaaaa

SEQ ID NO: 71417 - DNA, 30 bp, Homo sapiens
  misc_feature 1..30: note = chr10:467990-468020
  misc_feature 1..30: note = hypo
  source 1..30: mol_type = genomic DNA
gatcaggttttcctgcggcagctgagatac

SEQ ID NO: 71418 - DNA, 30 bp, Homo sapiens; identical to SEQ ID NO: 32855
  misc_feature 1..30: note = chr10:4698935-4698965
  misc_feature 1..30: note = hyper
  source 1..30: mol_type = genomic DNA

SEQ ID NO: 71419 - DNA, 30 bp, Homo sapiens; identical to SEQ ID NO: 42428
  misc_feature 1..30: note = chr10:482288-482318
  misc_feature 1..30: note = hypo
  source 1..30: mol_type = genomic DNA

SEQ ID NO: 71420 - DNA, 181 bp, Homo sapiens
  misc_feature 1..181: note = chr10:49393615-49393796
  misc_feature 1..181: note = hypo
  source 1..181: mol_type = genomic DNA
cgtttcagtgtcacacgtacaatttctcggcccggttcagctataaagctcttcctcctattattctttgagcctagaggtagaatcagagcaccacattgtgcttttcccccaaattatttgggagctaatacaaaaggagtaaacagcatttcacacacatgcgcgcacacacattcac

SEQ ID NO: 71421 - DNA, 30 bp, Homo sapiens; identical to SEQ ID NO: 42598
  misc_feature 1..30: note = chr10:49541963-49541993
  misc_feature 1..30: note = hypo
  source 1..30: mol_type = genomic DNA

SEQ ID NO: 71422 - DNA, 154 bp, Homo sapiens
  misc_feature 1..154: note = chr10:49652940-49653094
  misc_feature 1..154: note = hypo
  source 1..154: mol_type = genomic DNA
atcccatcacccagacggctggctcgcgtgtcagtggccgagcaaagacagacgccactctccccagcccctcctgagctccggcatccagaccttgatgctgctgagggccctgagcaggtgcccgcctcctggtggacgagcccctggtagc

SEQ ID NO: 71423 - DNA, 407 bp, Homo sapiens
  misc_feature 1..407: note = chr10:49731394-49731801
  misc_feature 1..407: note = hyper
  source 1..407: mol_type = genomic DNA
ccactatgttcccaacgatcaacagggatcatttcagtcagtcaagggttaagtcggccgggccccagcccccgggaggccggacctccggcggccgccaacgtcctaagcgtgtttctgggctttgggccctctccaagactgctgcattcctcaagcagctctgctcgcaggttgccgccgcgagttttggaaaactctgagtcagggccccaccgtccaagtttgtgacagaggcgggcgagaatgaatggtccctctcccggcagttaagccgcaggggcggcgcagggcgcgcgccgggctcgcggtgcagagacctgcgagcgggtctgggcgccgggggttcctccgtcccggccgtggacttggcggacctgcagccggcgccgcggccagccccgggc

SEQ ID NO: 71424 - DNA, 86 bp, Homo sapiens; identical to SEQ ID NO: 33052
  misc_feature 1..86: note = chr10:49732002-49732088
  misc_feature 1..86: note = hyper
  source 1..86: mol_type = genomic DNA

SEQ ID NO: 71425 - DNA, 160 bp, Homo sapiens; identical to SEQ ID NO: 3561
  misc_feature 1..160: note = chr10:49732155-49732315
  misc_feature 1..160: note = hyper
  source 1..160: mol_type = genomic DNA

SEQ ID NO: 71426 - DNA, 293 bp, Homo sapiens
  misc_feature 1..293: note = chr10:49732316-49732609
  misc_feature 1..293: note = hyper
  source 1..293: mol_type = genomic DNA
cagcgggcatgccggcctccgggcagaccctgctaatcaataggagaacgcgcagatcgcgaccgccgcgccactgcccgcttttatctccgcgcgccggggcggccccgcgctgctccctgccctcgccggcgccctccccacggcccgttactctcccggggtgccgggccgcgcgctctcccaggagccgccagggggcgccacggagccggggctgcctccgcctccctgggagccaagcaggggtggggggccacaccggcctggcctccccgcgcagaatgggaaga

SEQ ID NO: 71427 - DNA, 187 bp, Homo sapiens
  misc_feature 1..187: note = chr10:49857079-49857266
  misc_feature 1..187: note = hypo
  source 1..187: mol_type = genomic DNA
gccgacctctcgccccgctgccatgcaattattcctatgaacattctcatcagatcagtcctgtgcttataaccatcaatagctccctatgcctcacgagaacaagtccaagtttctgaatatggcatccacctaccattcctcccttattaccccattccaactgcttcagcgcccctctctctaa

SEQ ID NO: 71428 - DNA, 30 bp, Homo sapiens; identical to SEQ ID NO: 15370
  misc_feature 1..30: note = chr10:49929928-49929958
  misc_feature 1..30: note = hypo
  source 1..30: mol_type = genomic DNA

SEQ ID NO: 71429 - DNA, 30 bp, Homo sapiens
  misc_feature 1..30: note = chr10:49939380-49939410
  misc_feature 1..30: note = hypo
  source 1..30: mol_type = genomic DNA
agaggccctggtgttcgagctgcactacgt

SEQ ID NO: 71430 - DNA, 20 bp, Homo sapiens
  misc_feature 1..20: note = chr10:50007560-50007580
  misc_feature 1..20: note = hypo
  source 1..20: mol_type = genomic DNA
gctgtaatcccagcacgaag

SEQ ID NO: 71431 - DNA, 34 bp, Homo sapiens
  misc_feature 1..34: note = chr10:50078993-50079027
  misc_feature 1..34: note = hypo
  source 1..34: mol_type = genomic DNA
tttttgatggaggctcgctccttcccccaggctg

SEQ ID NO: 71432 - DNA, 30 bp, Homo sapiens
  misc_feature 1..30: note = chr10:50088696-50088726
  misc_feature 1..30: note = hypo
  source 1..30: mol_type = genomic DNA
accctgtgtgaggttcggctcctggcccag

SEQ ID NO: 71433 - DNA, 30 bp, Homo sapiens; identical to SEQ ID NO: 42602
  misc_feature 1..30: note = chr10:50105263-50105293
  misc_feature 1..30: note = hypo
  source 1..30: mol_type = genomic DNA

SEQ ID NO: 71434 - DNA, 30 bp, Homo sapiens
  misc_feature 1..30: note = chr10:50121842-50121872
  misc_feature 1..30: note = hypo
  source 1..30: mol_type = genomic DNA
gttgcttcagctccacgggcagcccgttgc

SEQ ID NO: 71435 - DNA, 30 bp, Homo sapiens
  misc_feature 1..30: note = chr10:50160854-50160884
  misc_feature 1..30: note = hypo
  source 1..30: mol_type = genomic DNA
gcagctggaccagtgcgtgggcttcccaac

SEQ ID NO: 71436 - DNA, 30 bp, Homo sapiens
  misc_feature 1..30: note = chr10:50300840-50300870
  misc_feature 1..30: note = hypo
  source 1..30: mol_type = genomic DNA
gtcaccggaagaagacgcaagcggcttggt

SEQ ID NO: 71437 - DNA, 432 bp, Homo sapiens; identical to SEQ ID NO: 33055
  misc_feature 1..432: note = chr10:50323255-50323687
  misc_feature 1..432: note = hyper
  source 1..432: mol_type = genomic DNA

SEQ ID NO: 71438 - DNA, 22 bp, Homo sapiens
  misc_feature 1..22: note = chr10:50323824-50323846
  misc_feature 1..22: note = hyper
  source 1..22: mol_type = genomic DNA
cgaccggcggtcctctgcccac

SEQ ID NO: 71439 - DNA, 30 bp, Homo sapiens
  misc_feature 1..30: note = chr10:50340253-50340283
  misc_feature 1..30: note = hypo
  source 1..30: mol_type = genomic DNA
agtaggactggtactcggaggactctgagg

SEQ ID NO: 71440 - DNA, 108 bp, Homo sapiens
  misc_feature 1..108: note = chr10:50373584-50373692
  misc_feature 1..108: note = hypo
  source 1..108: mol_type = genomic DNA
ccctactccctttgacggctgtagcctgtggccctcactcttgtgacacctgcccactggtccagaggaggagagagtgtaaggaggggaccacgaggtgcattctag

SEQ ID NO: 71441 - DNA, 30 bp, Homo sapiens
  misc_feature 1..30: note = chr10:50376617-50376647
  misc_feature 1..30: note = hypo
  source 1..30: mol_type = genomic DNA
tctcgctctgggctgcgtggtatagtgtcc

SEQ ID NO: 71442 - DNA, 41 bp, Homo sapiens
  misc_feature 1..41: note = chr10:50460235-50460276
  misc_feature 1..41: note = hypo
  source 1..41: mol_type = genomic DNA
gatgcaaataaattgcgcaaattttccgaaaacaatttgat

SEQ ID NO: 71443 - DNA, 302 bp, Homo sapiens
  misc_feature 1..302: note = chr10:50507426-50507728
  misc_feature 1..302: note = hypo
  source 1..302: mol_type = genomic DNA
gctgctgggcagagccgggtttctctcccattcccgaggaggcctgagcagctggacacgcagagagcggaaggtacagcccagacacttgtctggctccttagcgtgggcagggaggctcaagttcatggcgggagggatgttcccgctgggccgatgctgtgctggggaagtagttcggtgccagggtgctgtgcagggtggtatgtgtgtgccgggagcccattggtgttggggctaaggttcttggtgtgctggatgggcctcggggaccacgtacccggaaccgtgtacatgtgtga

SEQ ID NO: 71444 - DNA, 420 bp, Homo sapiens
  misc_feature 1..420: note = chr10:50603003-50603423
  misc_feature 1..420: note = hyper
  source 1..420: mol_type = genomic DNA
gtgagagcagcccagcgacgggcccttgtaggctcgtgcagctcgtgatctgggccaggacgcggcgggtccactcgcctttgctttctgggatgtttgcagaagcaccgtgaaagattgatgcggccccctgggttgcggagccccaattagaggcgtgacaccagcatctgtgctgggaggattcggccggtccccgcggcacgcctagcccggggcgtcctggcccaggcggggagggagctgggaggcaggtggcgacggggcggggagctggagcgggcctggagtggggtgtagggaggggtccagggaggcccctactcaccggcaggcggctgcgccccccgcagggcggggacccagccacccaccagccctgctgccgctccggccctttctggccggctctggcttcat

SEQ ID NO: 71445 - DNA, 1141 bp, Homo sapiens
  misc_feature 1..1141: note = chr10:50603748-50604889
  misc_feature 1..1141: note = hyper
  source 1..1141: mol_type = genomic DNA
ggtgtgtccacctcccggacggccgtgccctcaccctggccccagcaccaaaccccgcagcgtagtttctggctctctggggtcccagccagaagccctgcacccgggccaccgcagccaggtccggctagcgcgcaaggccatctgcgagctgcagctcaggccaggaaggcagccgagccccaaggcccggcgctcggggcccggcgagtgggtcaggagccgagcatacctcggcgggcggcggtcgaggaggtcggagcgtgaccgcctccgatccgcaagccctgctcggctggcggcgggcggggctcggcgcggctggcgcccgcaggaccaaagaagtgactcgggaagtggccagatgtcttgctgtctgtctgcagcgcgcgccgccgctcagcactcgcctttataatctcacgcataattggccttaatctgattatttccagcgctgtctacagcgagtaacttggataggtctattgggccttacaaatggcccacgtggtgttaaaaaaaaaatccgtcatttctcagcaaacatcaggaatgctttttcctcttttaaaagagaacgatacaaccaccaccaccatcacccccaaaaacatacattttccgaaaacacactaggccccaccccccacctcatgtcccctcagaggcaaacctttctccgagagagcctggtttgggctgcccttatcaaaggcctggtgactcccgggctgcaaattggcaaagcgctgctaattgtcgccgccggatgggttttggggggactctttgcacacggcttccctttccaaacgatcgtacaaaaggaaagtttgattttgttctcagcaaggggtccctgaatttatgttcgcttctcgatgcaaatgatatgcggtgggaccctttgcaattacttttaaaatgcatccgaggcagacactcaacggagagagaccgcccttctctctgcctgggtgaaaattaaactctaaagtaccgggctgaaattttcaagtcaggggcgcgggattggatcaaatcacataaactgcaaaaaaagcaagtctaatggcgcataattggttctgtaatagcattacaccaggataatagcccgttacggccccctgcacta

SEQ ID NO: 71446 - DNA, 1620 bp, Homo sapiens; identical to SEQ ID NO: 33059
  misc_feature 1..1620: note = chr10:50605142-50606762
  misc_feature 1..1620: note = hyper
  source 1..1620: mol_type = genomic DNA

SEQ ID NO: 71447 - DNA, 85 bp, Homo sapiens
  misc_feature 1..85: note = chr10:50607131-50607216
  misc_feature 1..85: note = hyper
  source 1..85: mol_type = genomic DNA
atttaaagttaaaaccgcggggtcatatttcagcagattcacagtcctccccaccccctcccccgctccccgccctcacctagcc

SEQ ID NO: 71448 - DNA, 86 bp, Homo sapiens
  misc_feature 1..86: note = chr10:50748356-50748442
  misc_feature 1..86: note = hypo
  source 1..86: mol_type = genomic DNA
ttacaggtgtgagccaccacgcccggcttgtaacttgcttttttttttttttaaaggagaaagaattctagcgatttcttggataa

SEQ ID NO: 71449 - DNA, 277 bp, Homo sapiens
  misc_feature 1..277: note = chr10:50815067-50815344
  misc_feature 1..277: note = hyper
  source 1..277: mol_type = genomic DNA
tcagatagaggagtccggaaaggaatttaccaagcgttcaagtgaagaggaagccagaggggcggggcctccgtgggaggcttcttggttgcggtggggccggggccagcaccctggacagctcccggcggctggcggggagaagaggctttgccaggtcccatctcggctcagaccctcccgtagccttttgctgcaggggcctgacgcctccttgcaaccccggcactcccgtatttggagccacgatggattgggggggcgttgccctctgatc

SEQ ID NO: 71450 - DNA, 749 bp, Homo sapiens
  misc_feature 1..749: note = chr10:50817061-50817810
  misc_feature 1..749: note = hyper
  source 1..749: mol_type = genomic DNA
acctccaacctcagccgccctggagcctctctcccgccagtccgcccactggaacacgggttccatgtgccatccagggtcaacgccgctctggggacgcgtcaggcccagcgcacagcctgggcagctcagcctgtcagctgagcacgggcgcctcaaggggtgcggccctctcagaaggaaggtgagtctccctggagcccctgacgacagcgaagcggctgggcgctctccggggagtgggcgcggcacccaagaagggtttcttacagttccaagagaggaccccagccacagtcactccagagcccacccggggcttggaggaggctctggaaaatgagggatgggggagtgtgcagaacagggggcggaggctggcaggagccgagggagggcttggtcgggtgcgaagagtgcctgggaggagttagagtggggagggggtgcggcggcggggagagaagaggcggagctgggggaccagaccgctaaaggagaaagggggattccaggcaaggggaatgtggccaggcagtgcgggagggcggcagcggccaggctaatattcgcgaccccgactggggcgcggcaacttctgccctcagtccccacaagctcccggccgcgattcgcggccgagaaattctgcggaggggccggtgggtcagagccaggccaggcagttgctgagccttcccctcccctcctggcgggagtgtgtgtgcaaggggccagggggcggagtc

SEQ ID NO: 71451 - DNA, 62 bp, Homo sapiens
  misc_feature 1..62: note = chr10:50817811-50817873
  misc_feature 1..62: note = hyper
  source 1..62: mol_type = genomic DNA
gagaaagggttgggggtgtccgtgtccagcgctcctccggacgcggctccacaatccagctg

SEQ ID NO: 71452 - DNA, 480 bp, Homo sapiens; identical to SEQ ID NO: 33063
  misc_feature 1..480: note = chr10:50818152-50818632
  misc_feature 1..480: note = hyper
  source 1..480: mol_type = genomic DNA

SEQ ID NO: 71453 - DNA, 294 bp, Homo sapiens
  misc_feature 1..294: note = chr10:50818986-50819280
  misc_feature 1..294: note = hyper
  source 1..294: mol_type = genomic DNA
cggcgagggccccacccggactcccgaggtgtgggagcccaccctgccgctgcccactccggccaatgccagcgcctacacggccaacacctcggcgtccccgacagctgcgtggccagcgggctcagcccttcggccccgctaccctacggagagcgaagacgtgaagatcggggtgctgtttgcttccaaggctatcctgcagctgctagtgaaccccttgagcgggcccttcatcgaccgcatgagctacgacgtgccgctgctgatcggcctgggcgtcatgttcgcctc

SEQ ID NO: 71454 - DNA, 198 bp, Homo sapiens
  misc_feature 1..198: note = chr10:50819747-50819945
  misc_feature 1..198: note = hyper
  source 1..198: mol_type = genomic DNA
cggcttccgagtgggagatgggcatggcctggctgccggccttcgtgcctcatgtgctgggcgtctacctcaccgtgcgcctggcggcgcgctacccacacctgcagtggctgtacggcgcgcttgggctggctgtgatcggcgccagctcgtgcatcgtgcccgcctgccgctccttcgcgccgctagtggtctcac

SEQ ID NO: 71455 - DNA, 422 bp, Homo sapiens
  misc_feature 1..422: note = chr10:50820239-50820661
  misc_feature 1..422: note = hyper
  source 1..422: mol_type = genomic DNA
tgcttgatgagccaccgcaaggtctgtacgatgcggtgcgcctgcgtgagcgtcctgtgtctggccaggacggcgagcctcgcagcccgcctggcccttttgatgcgtgcgaggacgactacaactactactacacccgcagctagcatccccactcctcctccagcccacccaaccgccttgggtcaagggggctgctctgcaagcccactggccagctctggctcagggcccacctcctccagcgagtaccccagccactcctcaaccttgacttctgcccaaatcccctccctgtgacccgttccatatccctttctctcttgtccaatggggcttggagcaccgaggccagcgaagccatcgcgctccttgcggaggtgaagaggaccctgagtccccacctgcggctcccctgtgta

SEQ ID NO: 71456 - DNA, 197 bp, Homo sapiens
  misc_feature 1..197: note = chr10:50821052-50821249
  misc_feature 1..197: note = hyper
  source 1..197: mol_type = genomic DNA
cgctccagctaggcacgccaggccccgccctttgaggacacgccccacaccagcctcagagctctgaggtgcctgggctgagcttcccttcagaccagaatcccgccccgttgaggctttgagaaaggagtaggagccgagcattccggcagaggaagaaaaacggcccatcttttagagtccgacctctggaaatg

SEQ ID NO: 71457 - DNA, 229 bp, Homo sapiens; identical to SEQ ID NO: 33067
  misc_feature 1..229: note = chr10:50821472-50821701
  misc_feature 1..229: note = hyper
  source 1..229: mol_type = genomic DNA

SEQ ID NO: 71458 - DNA, 750 bp, Homo sapiens
  misc_feature 1..750: note = chr10:50822142-50822892
  misc_feature 1..750: note = hyper
  source 1..750: mol_type = genomic DNA
cctaaatttgttgcccgagttcctccgggaagcgctccgggtagattctgggggccgggagctgagatccctgggcggggagctggggaagggatggggctgaggacagcgaagaagagggggcttgggggaggggggaaatggaagagagaggagggaggaggtacaagaggaaggagagaagtgcggccagcttgctttctccagtcgggtggccgcggggacccgggcgacgtcggaggccctgccgggaacccaggctgcagcccccacccccgcgctgcgacacgccccccaccccttccggctcacacccccgcccacactcctgagtggtgcggtgcagcgtcggccgaggcagcagagccgaggagagcaggtgagaagaagggctgggctgggctggcggagcgcggtgccgggagcaagggcggcggtcgggggctctatccagggacagcaccggggccgagaggccccaggactcgtggagtcctctgagtcctgcgcagcagcggccgtcgggggtcagctaggaagctgcaggattgcgttgcttcggtgcctgggcttggggaggcttaaccatcagggcttcgggactccaagcgcatgttctcacttcacttggcccagcatctgctaagtgaccaggtccgcgctttctgtgtctagtcggagggtccttgggtctgacccgactcgcctgaattgctggttggcaaccgcttctcccgggagcagggggtg

SEQ ID NO: 71459 - DNA, 160 bp, Homo sapiens; identical to SEQ ID NO: 33070
  misc_feature 1..160: note = chr10:50887456-50887616
  misc_feature 1..160: note = hyper
  source 1..160: mol_type = genomic DNA

SEQ ID NO: 71460 - DNA, 137 bp, Homo sapiens; identical to SEQ ID NO: 33071
  misc_feature 1..137: note = chr10:50887617-50887754
  misc_feature 1..137: note = hyper
  source 1..137: mol_type = genomic DNA

SEQ ID NO: 71461 - DNA, 47 bp, Homo sapiens; identical to SEQ ID NO: 33072
  misc_feature 1..47: note = chr10:50887789-50887836
  misc_feature 1..47: note = hyper
  source 1..47: mol_type = genomic DNA

SEQ ID NO: 71462 - DNA, 30 bp, Homo sapiens
  misc_feature 1..30: note = chr10:50966548-50966578
  misc_feature 1..30: note = hypo
  source 1..30: mol_type = genomic DNA
gcgccagccaaacaccgggacgtcatgtgc

SEQ ID NO: 71463 - DNA, 516 bp, Homo sapiens; identical to SEQ ID NO: 33073
  misc_feature 1..516: note = chr10:50969896-50970412
  misc_feature 1..516: note = hyper
  source 1..516: mol_type = genomic DNA

SEQ ID NO: 71464 - DNA, 161 bp, Homo sapiens
  misc_feature 1..161: note = chr10:50976356-50976517
  misc_feature 1..161: note = hyper
  source 1..161: mol_type = genomic DNA
tcgggctgaaggccacgcatccctgcccgtcccctcacaggcggctgcacgctccggccctcgccccagccctcagggccccggcgggaagcccctctctgagcaggcctggccgggttgtgccctcctgcggagtccccaaggggcggggagcccgcgcc

SEQ ID NO: 71465 - DNA, 71 bp, Homo sapiens
  misc_feature 1..71: note = chr10:50977033-50977104
  misc_feature 1..71: note = hyper
  source 1..71: mol_type = genomic DNA
cgctgagcctgtgggccaggcccgcgcccaccacaggaatctctcccgggaaagcccggaaagatgccagc

SEQ ID NO: 71466 - DNA, 30 bp, Homo sapiens
  misc_feature 1..30: note = chr10:518309-518339
  misc_feature 1..30: note = hypo
  source 1..30: mol_type = genomic DNA
gctgggcacaggcaccgtcctggcacaggt

SEQ ID NO: 71467 - DNA, 88 bp, Homo sapiens; identical to SEQ ID NO: 10312
  misc_feature 1..88: note = chr10:52177735-52177823
  misc_feature 1..88: note = hyper
  source 1..88: mol_type = genomic DNA

SEQ ID NO: 71468 - DNA, 306 bp, Homo sapiens
  misc_feature 1..306: note = chr10:52178170-52178476
  misc_feature 1..306: note = hyper
  source 1..306: mol_type = genomic DNA
gggtgtggcccggcagcagagggtttttggaatgcagggtgtggccctctaccacggcaaaaaagaaatgagtcagcccgttcagtcctaaccaataagcatgttcagtgtcggttaaggcggaactttcctttcttgatttataccaagcttagaagcctttcacagccttttctttacgcctttgacaacttcgacacaacttctagaaaagggtaggttgcctttgaaaacgcttgggaaacaaggattaatcttacgaaagatacttcagtggatgtacattagtttcgattagtaaaagtt

SEQ ID NO: 71469 - DNA, 112 bp, Homo sapiens
  misc_feature 1..112: note = chr10:52419113-52419225
  misc_feature 1..112: note = hypo
  source 1..112: mol_type = genomic DNA
agcaggagctggacccgcagaggctgcagatcatcagcaactacacggaggtctacttcccccacatgcaggaggaggaggcctggctgcagcggtgcgcccagtgcatcaa

SEQ ID NO: 71470 - DNA, 163 bp, Homo sapiens
  misc_feature 1..163: note = chr10:524508-524671
  misc_feature 1..163: note = hypo
  source 1..163: mol_type = genomic DNA
tattcccactcatcccgtgtccgggcgtgctggggctgcagacacatccaaattcccatcttattctcaactcatcccgtgtctgggcatgctaggggtgtagacacatccaagttcccgtcttattctcactcatctcgtgtccgggcgtgctgggggtgta

SEQ ID NO: 71471 - DNA, 214 bp, Homo sapiens
  misc_feature 1..214: note = chr10:52750888-52751102
  misc_feature 1..214: note = hyper
  source 1..214: mol_type = genomic DNA
gcctctcctctccatcgcttttagacttctcatcctcccctcggtgcttttagtccattcagcagaagcggatcgaagcaggaggctccccgcgccgcattaggggcgcactccgccgcgctcgagtacttagcgcccattcactcgctcacccgcgctctccgctgccggctgccgtcccagccgccgccgccgccgccgccgccgccgccgc

SEQ ID NO: 71472 - DNA, 179 bp, Homo sapiens; identical to SEQ ID NO: 33079
  misc_feature 1..179: note = chr10:52751383-52751562
  misc_feature 1..179: note = hyper
  source 1..179: mol_type = genomic DNA

SEQ ID NO: 71473 - DNA, 166 bp, Homo sapiens
  misc_feature 1..166: note = chr10:52751795-52751961
  misc_feature 1..166: note = hyper
  source 1..166: mol_type = genomic DNA
tggagagcttcccagcggcgaccccccggactcaggccactggacatgctcagtggggctgtccgagcctcctagggaggggcgactggaggctggacagggttgggctcaacttagggactgaacttgcccagaacccgagctctgctggcggatgcggggacag

SEQ ID NO: 71474 - DNA, 513 bp, Homo sapiens
  misc_feature 1..513: note = chr10:52833568-52834081
  misc_feature 1..513: note = hyper
  source 1..513: mol_type = genomic DNA
agaggcaagtttcttcgcaagcgttagccacctgtgtgaggcgctctgggtgggaaaggtggcgtgggagaagcgacagctcggccacaccgctcgggagctttccttagtgaggccggccgtcaaaatacctccagaactcagagctttgatgatgcagagtcccctatgcctcgtacgtcgctaggatcgtagctcaacattctccaggctggtctgctctggagtcagctgaggcctcccgagtttgcccggggtcctccctgtcccctccctcccacctccccacccccgaagtagcgctcccgcctcgctccacccgcacacccccggcgcgcctcggaggcttatcaggctccccgcacgccccgcaagcttccttgggcgcccggcgcgagggactctgagagcccagccgctgcctcggagcccccattcacgtcccctcctcccgctcccccgccaccgcgcctccgactcttctcccccgcgccgcggcgcccaccgcgtctc

SEQ ID NO: 71475 - DNA, 395 bp, Homo sapiens; identical to SEQ ID NO: 33083
  misc_feature 1..395: note = chr10:52834361-52834756
  misc_feature 1..395: note = hyper
  source 1..395: mol_type = genomic DNA

SEQ ID NO: 71476 - DNA, 464 bp, Homo sapiens
  misc_feature 1..464: note = chr10:54068146-54068610
  misc_feature 1..464: note = hyper
  source 1..464: mol_type = genomic DNA
tctcccacctccccccggacgccggagacaccgcggagcctgatgtccctcagagctttaatcttcccctcagtcgcctttcccctcacccgcctctaattaagtcagaaaggccctgtatttatttgcccatgaactgacacagcaaaccaacagcagccattgtagtgtgaatggatttgcgaccaggcaaggggcttcagccgggattacccgccccgcagccggatgaatgtgctgagcacaaagtctgctcaaagccgagcaaacggactatttgtgaaaatgccatcctggctcaagtctgattaagaccgggggtccccaggccgtttgatcttcgctcatcaaagagagtctttaaacaagcttcattttacactactgtatgctagcgacgggttgtgacacccaagtgcagccaccgtgagcacccggcactgggagcgcgtgaacaataatgg

SEQ ID NO: 71477 - DNA, 833 bp, Homo sapiens
  misc_feature 1..833: note = chr10:54072904-54073737
  misc_feature 1..833: note = hyper
  source 1..833: mol_type = genomic DNA
caccaatttcaatgacgtcaaattcactttctaattcactttcagctcttcttctcctcaaggttgtttcttttctccctagaaagggtattgcgtggtcccgtgcaaggtaagacttgggagcaaaccctgcattcggaagcgttgcgatgtgatatactaatgaggaagtcaggcgctaagccctaagggtttcttatttctccacattagcccaccactgagaagggagaaccggggaaaggcgactgacctggcacgttggaccctgtccgctttggtcccggccactttgatctcacgcgtctgcctaatcaagttcatctaccgccgcgattgccctgattcaaagaacaacattaaatggtttgattatcggatggtcatttccctcttccctccacccctgatctaatttctaaacgccagtctctcgcctccctctctaaacttcccatcaaaagagaattagctcttcttccttcttaccctcgtttgatgtgcaaatttccttctctttgcacatttttctcgcagtggcggggggaggtgggggaggagggcaactgaaggacctcaaagccggggatctaactcagatctgcaaactgcgactctaaagggttaatgagcaacttgcacccgccacctggccctctcagaggcgtcttgctagagccattgaattacagaccggtttgtatttaatactgaatatgacttgtgtgcacagtcagcgagtattggcataaaggagaggggcaaaaagtgcttttgcagagcctatcacccctcggctctgtaaagtatttcagatccggataattcaaccc

SEQ ID NO: 71478 - DNA, 220 bp, Homo sapiens
  misc_feature 1..220: note = chr10:54074198-54074418
  misc_feature 1..220: note = hyper
  source 1..220: mol_type = genomic DNA
tggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtacca

SEQ ID NO: 71479 - DNA, 111 bp, Homo sapiens
  misc_feature 1..111: note = chr10:54074714-54074825
  misc_feature 1..111: note = hyper
  source 1..111: mol_type = genomic DNA
cactgatgagtactgcgctagtcccacccgcggaggggacgcaggcgtgcaaatctgtctcgcctgcaggaagcgccgaaaacgctgcatgcgtcacgctatgtgctgccc

SEQ ID NO: 71480 - DNA, 203 bp, Homo sapiens
  misc_feature 1..203: note = chr10:54700730-54700933
  misc_feature 1..203: note = hypo
  source 1..203: mol_type = genomic DNA
cctaaccaggcaagtcgaaacccacagatttctctctcacagggtttaaaatagctcttctcttaagaatgttttgctacaggctatggcaatgttactaagtaaaatgagcattaggctcagctgccaaatgcgcaaatcagaccagctgttcctagagatgccatttatttctctaccccaacagccgcaggcatgcacgg

SEQ ID NO: 71481 - DNA, 147 bp, Homo sapiens
  misc_feature 1..147: note = chr10:54716651-54716798
  misc_feature 1..147: note = hypo
  source 1..147: mol_type = genomic DNA
ttttctgtaataaaccgtaagcgtgaatacaacagcttttatgtcctgtgagtctttctagtgattcattgagcccaagagtggtctcggggaaccccaccaacaccagtattgtgagactgcagaaagttgcgttgcgctgtctgc

SEQ ID NO: 71482 - DNA, 185 bp, Homo sapiens; identical to SEQ ID NO: 42464
  misc_feature 1..185: note = chr10:5507960-5508145
  misc_feature 1..185: note = hypo
  source 1..185: mol_type = genomic DNA

SEQ ID NO: 71483 - DNA, 30 bp, Homo sapiens; identical to SEQ ID NO: 42465
  misc_feature 1..30: note = chr10:5523260-5523290
  misc_feature 1..30: note = hypo
  source 1..30: mol_type = genomic DNA

SEQ ID NO: 71484 - DNA, 355 bp, Homo sapiens
  misc_feature 1..355: note = chr10:5530764-5531119
  misc_feature 1..355: note = hypo
  source 1..355: mol_type = genomic DNA
gcttccaggtgcagccggggttgggaatcgctggcttatgcaacccagcagagaggcgggaaaggcagagctgagatcgggtggggccacctgtggtggggaaagagatgagctcacacctggagatggtaaacagtgcaaaagcaagaagaagcttacagaaggagtcgttgggcctttgccccagctgcagccacgtgagagggaagccaggggaggagcaaggtgcaggcatctgtgggctgggcagggcctgactgcactgggcccaggctgggaaggcctcacctgcttctccagcgggaacggagggcgacctgcgcagcctaggcactgcggccgtggttcacatgca

SEQ ID NO: 71485 - DNA, 163 bp, Homo sapiens
  misc_feature 1..163: note = chr10:5538775-5538938
  misc_feature 1..163: note = hypo
  source 1..163: mol_type = genomic DNA
cccgcctcagtgccccgggctacccctggccccccaggctttgtgctgaagccgagataaagtggacaggcgcacctcactcctccacaggtgtgccccacccccccacccgcaggtctgcccgagagcacggcaggtgggaaagagacgaatcctgactcca

SEQ ID NO: 71486 - DNA, 877 bp, Homo sapiens; identical to SEQ ID NO: 42469
  misc_feature 1..877: note = chr10:5540651-5541528
  misc_feature 1..877: note = hypo
  source 1..877: mol_type = genomic DNA

SEQ ID NO: 71487 - DNA, 30 bp, Homo sapiens
  misc_feature 1..30: note = chr10:5546861-5546891
  misc_feature 1..30: note = hypo
  source 1..30: mol_type = genomic DNA
gctagttggcaaaagcggtcctcccccaga

SEQ ID NO: 71488 - DNA, 44 bp, Homo sapiens
  misc_feature 1..44: note = chr10:5551853-5551897
  misc_feature 1..44: note = hypo
  source 1..44: mol_type = genomic DNA
cacccagtcctggcacgggcaggggcctgcggaggtggccggga

SEQ ID NO: 71489 - DNA, 47 bp, Homo sapiens; identical to SEQ ID NO: 42470
  misc_feature 1..47: note = chr10:5553281-5553328
  misc_feature 1..47: note = hypo
  source 1..47: mol_type = genomic DNA

SEQ ID NO: 71490 - DNA, 87 bp, Homo sapiens
  misc_feature 1..87: note = chr10:5567123-5567210
  misc_feature 1..87: note = hypo
  source 1..87: mol_type = genomic DNA
ggctgcatcaccacccgcgagctgggcacggtcatgcggtccctgggccagaaccccacggaggccgagctgcgggacatgatgagt

SEQ ID NO: 71491 - DNA, 30 bp, Homo sapiens
  misc_feature 1..30: note = chr10:5567536-5567566
  misc_feature 1..30: note = hypo
  source 1..30: mol_type = genomic DNA
cacagggcaagaacccggggcctcccgcct

SEQ ID NO: 71492 - DNA, 58 bp, Homo sapiens
  misc_feature 1..58: note = chr10:5576230-5576288
  misc_feature 1..58: note = hypo
  source 1..58: mol_type = genomic DNA
ctgccctgctcaccacgtcccactgcgctcccagggcagggcccgccccacccagacg

SEQ ID NO: 71493 - DNA, 30 bp, Homo sapiens
  misc_feature 1..30: note = chr10:5576653-5576683
  misc_feature 1..30: note = hypo
  source 1..30: mol_type = genomic DNA
gacgacagatgtagtcgggaaagagcttct

SEQ ID NO: 71494 - DNA, 211 bp, Homo sapiens
  misc_feature 1..211: note = chr10:5588268-5588479
  misc_feature 1..211: note = hypo
  source 1..211: mol_type = genomic DNA
gggggacagaggggacggtccccagggaagggagccacaaggcagaccacaagctggacagaagtcaggaacgcaggctgaggaaaaccattgcagttctgttctaggagcccagaatgccagagccaaggacaccctcctgaaagacagtgcagccaacagaggcatggccccacctgggcaggagggtgccggccggctgaaggtacca

SEQ ID NO: 71495 - DNA, 30 bp, Homo sapiens
  misc_feature 1..30: note = chr10:5617971-5618001
  misc_feature 1..30: note = hypo
  source 1..30: mol_type = genomic DNA
ccacctgccccagaccgaggcctgttctgc

SEQ ID NO: 71496 - DNA, 30 bp, Homo sapiens
  misc_feature 1..30: note = chr10:56782981-56783011
  misc_feature 1..30: note = hypo
  source 1..30: mol_type = genomic DNA
atgagccaccgcgcccggtttattgcttac

SEQ ID NO: 71497 - DNA, 1116 bp, Homo sapiens
  misc_feature 1..1116: note = chr10:57387425-57388541
  misc_feature 1..1116: note = hyper
  source 1..1116: mol_type = genomic DNA
ctccttcagcagcagcggacgtagggatcccgagcagccacggagcttaggtcccgcagagagctcctgccaagcgcttctctctcgactagttaccaattgagaaaaaaaagggtcagagacacacaaggatggtgatcaaaatccagtgtcaggcaccagggtcccagaaggttccggctcctcttctgcgccttacccagctcttttcgtctggcaaagggtcacccagcgagcccccagcagcagatccttcccttttgctcctcctgatagcgccaatcttcgccgccactgccacactgcgcgcccgctatccactcaccgcacagcgagaaggcctggcggagatagcgcggggggaggagggtggattaaaaggatagatttttggaagggtaagggagaaaaactttgatgttgtaaccacacacaggactgagaagaaaccaaaacaagttgcagcttcaggagcggggaggacgcttttcggggtaaaaaaaaaatcaccccctaccaaaatcagggggaggaagctccctgctccttgagcgatcacccagagcacctcgcaatctctgatcttcgaacccactgaaaaagcacagggcatggggagtcctgttggttcatgcccagggtacgaataccaaaagcgcctcccgctggagaggctgcggggaactcgaggcaaagacagaggcaaacgcaacgctgggaagagtgaggggagtccgagctgccgcctgcaaaagcagagacgcgtcgcccttcgggcaaagtgactgctacaaagtccgttccctcctgcgcagggacagagacatttaaaggcctgaatggacgtcagcaccagtcgagctcgctgggtgagcgccaggtctccccgccccacggattgtagcgcgcacagggcgatctgctgctcgcgaggtagagtggcttacttggggagaaaacagagctggtggcgctgcggagtgtcaaaccctggagcccatcgtcaagacgttatactggtggcagttctgctgtgagtgcacttgccgaattaaaaagagccagagctgcgtggagaggggtctggccactctgcgcgcgcgcacccagtattgg

SEQ ID NO: 71498 - DNA, 119 bp, Homo sapiens
  misc_feature 1..119: note = chr10:57389660-57389779
  misc_feature 1..119: note = hyper
  source 1..119: mol_type = genomic DNA
cacttggtgtgtgtgcgctggcgcgtttatgttgggaaggttgatcactaagagagcttacaaatatctgtaggctctcctgtgtaacctccttctcttcctagccagggccattcacc

SEQ ID NO: 71499 - DNA, 189 bp, Homo sapiens
  misc_feature 1..189: note = chr10:57389780-57389969
  misc_feature 1..189: note = hyper
  source 1..189: mol_type = genomic DNA
gtaggctctcaggcgccacttctagagcatcctctgatgttggtcctgaactgggagagtctgaccaaacttgacgaagaggactgtcaaaaggcgttagaaacttcggaaactggcaacagttacggcatttttgctctgcgaagaatacgcccagaaggttcagaaagaagtcgggagtggggatgg

SEQ ID NO: 71500 - DNA, 501 bp, Homo sapiens
  misc_feature 1..501: note = chr10:57390175-57390676
  misc_feature 1..501: note = hyper
  source 1..501: mol_type = genomic DNA
ggctttcctggattccgcgaccacaacccaccaccccaaaccccacttcccatgtccttgatttttgaggctttttgggagggcatgatttcagggaacattactcttggccagctcaggggagcatagtcggaaatcttcggttgtattcctgactcagcctgggtgcggagcgagcgcggacaggaaccgagatgcaaaggcggacgcaaccagcgcacccgcagacggcgcgcggcaagaaccaccttctagccctgagcctgcggtgccgggcgggctcaggaggctagtggggtattgtgatcactgggacatcaggatgaaggggtcactccaatcccttggagatcagattctcggggactccatggccagacccgaacggcgcccttcacatggtgggtggagagggtactccttggccgaattgacccctccctgtcccgcagggtcagccccgcgcccacccacacatccagtctccgggaacaaaactct

SEQ ID NO: 71501 - DNA, 227 bp, Homo sapiens
  misc_feature 1..227: note = chr10:57391133-57391360
  misc_feature 1..227: note = hyper
  source 1..227: mol_type = genomic DNA
ctagggctcccccagcgcttccgggcgcgccgggaactgcagctggtgcgccactgccttccccgcgcggtgcccaagagcgccagtagaaggaggaggtcggcacacctgctgttcctgcttccttcccaggaggccgattctctccatcccaactcgctccgtggctcctgcttgctcctgttccccctcccgactccccgggtaacagtcgaccttagggtcac

SEQ ID NO: 71502 - DNA, 30 bp, Homo sapiens
  misc_feature 1..30: note = chr10:57478909-57478939
  misc_feature 1..30: note = hypo
  source 1..30: mol_type = genomic DNA
cctgacctcgtgatccgcctgaaatgtggc

SEQ ID NO: 71503 - DNA, 30 bp, Homo sapiens
  misc_feature 1..30: note = chr10:5757140-5757170
  misc_feature 1..30: note = hypo
  source 1..30: mol_type = genomic DNA
actgagaaagattatcgggcttcatggcta

SEQ ID NO: 71504 - DNA, 17 bp, Homo sapiens
  misc_feature 1..17: note = chr10:57918195-57918212
  misc_feature 1..17: note = hypo
  source 1..17: mol_type = genomic DNA
atttgaatgtaaggccg

SEQ ID NO: 71505 - DNA, 30 bp, Homo sapiens
  misc_feature 1..30: note = chr10:58168698-58168728
  misc_feature 1..30: note = hypo
  source 1..30: mol_type = genomic DNA
tcaaacccatgtcaccggggcctagtgtcc

SEQ ID NO: 71506 - DNA, 160 bp, Homo sapiens; identical to SEQ ID NO: 42473
  misc_feature 1..160: note = chr10:5868078-5868238
  misc_feature 1..160: note = hypo
  source 1..160: mol_type = genomic DNA

SEQ ID NO: 71507 - DNA, 570 bp, Homo sapiens; identical to SEQ ID NO: 42474
  misc_feature 1..570: note = chr10:5874775-5875345
  misc_feature 1..570: note = hypo
  source 1..570: mol_type = genomic DNA

SEQ ID NO: 71508 - DNA, 48 bp, Homo sapiens; identical to SEQ ID NO: 42475
  misc_feature 1..48: note = chr10:5952951-5952999
  misc_feature 1..48: note = hypo
  source 1..48: mol_type = genomic DNA

SEQ ID NO: 71509 - DNA, 294 bp, Homo sapiens
  misc_feature 1..294: note = chr10:5998554-5998848
  misc_feature 1..294: note = hypo
  source 1..294: mol_type = genomic DNA
tccatgcaattcccccgattctatgtctaggcaaaaacacattctctttcctgctgagggtgccagctcccagtcgtcccacacctctgctcctcatccttgtccttctcaggcagagtgcctggggtgacggggcagggacggagcaagtcaggagggagcagtaagagcctcaagggcaaagccaagagtgcgatgaggagagagcattcctgctgctaaagccagggttgaaaaagcagacagggacacacccctcctctgctgtccccagtacaacgcccactttgcttc

SEQ ID NO: 71510 - DNA, 45 bp, Homo sapiens; identical to SEQ ID NO: 42476
  misc_feature 1..45: note = chr10:6003482-6003527
  misc_feature 1..45: note = hypo
  source 1..45: mol_type = genomic DNA

SEQ ID NO: 71511 - DNA, 26 bp, Homo sapiens
  misc_feature 1..26: note = chr10:6009733-6009759
  misc_feature 1..26: note = hypo
  source 1..26: mol_type = genomic DNA
agaataggctgggtgcggtagctcac

SEQ ID NO: 71512 - DNA, 30 bp, Homo sapiens
  misc_feature 1..30: note = chr10:6018636-6018666
  misc_feature 1..30: note = hyper
  source 1..30: mol_type = genomic DNA
ttccgtcctccctgccgagatcagagctcc

SEQ ID NO: 71513 - DNA, 44 bp, Homo sapiens
  misc_feature 1..44: note = chr10:6024581-6024625
  misc_feature 1..44: note = hypo
  source 1..44: mol_type = genomic DNA
ctgcagtggcaacaacgttgctttctgggcgttcaatagacaca

SEQ ID NO: 71514 - DNA, 109 bp, Homo sapiens; identical to SEQ ID NO: 33091
  misc_feature 1..109: note = chr10:60272038-60272147
  misc_feature 1..109: note = hyper
  source 1..109: mol_type = genomic DNA

SEQ ID NO: 71515 - DNA, 279 bp, Homo sapiens
  misc_feature 1..279: note = chr10:60272555-60272834
  misc_feature 1..279: note = hyper
  source 1..279: mol_type = genomic DNA
gcgcggctgtaggggcggcgggcggggagggggcgccgagccctgcggatggaggcgcgggcagcgcggcgcgctcattccgcgcgggcgttgctggcggggggcggcgcagccactggacccggaccggggccgcgacccggggtggcgggtggcgtgggcggcgcccggggctgggatgcgccgggggctcagtggcggcggcggcgttggcggtggcgtcggcggctgcagggggacgagctagcgccgcggcgctgggagccagttgagcccggc

SEQ ID NO: 71516 - DNA, 384 bp, Homo sapiens; identical to SEQ ID NO: 33093
  misc_feature 1..384: note = chr10:60272895-60273279
  misc_feature 1..384: note = hyper
  source 1..384: mol_type = genomic DNA

SEQ ID NO: 71517 - DNA, 30 bp, Homo sapiens
  misc_feature 1..30: note = chr10:60273557-60273587
  misc_feature 1..30: note = hyper
  source 1..30: mol_type = genomic DNA
ctcactattgggaaacgctctgcagatgtc

SEQ ID NO: 71518 - DNA, 30 bp, Homo sapiens
  misc_feature 1..30: note = chr10:6041312-6041342
  misc_feature 1..30: note = hypo
  source 1..30: mol_type = genomic DNA
ggctcttgactgaaccgtatccactctgtg

SEQ ID NO: 71519 - DNA, 205 bp, Homo sapiens; identical to SEQ ID NO: 15336
  misc_feature 1..205: note = chr10:6042309-6042514
  misc_feature 1..205: note = hypo
  source 1..205: mol_type = genomic DNA

SEQ ID NO: 71520 - DNA, 28 bp, Homo sapiens
  misc_feature 1..28: note = chr10:6055232-6055260
  misc_feature 1..28: note = hypo
  source 1..28: mol_type = genomic DNA
tgcagttgtgctgtccgataacacagac

SEQ ID NO: 71521 - DNA, 88 bp, Homo sapiens
  misc_feature 1..88: note = chr10:6055320-6055408
  misc_feature 1..88: note = hypo
  source 1..88: mol_type = genomic DNA
tgtatttaatttatttgagtttaaatacacttaagtatccacaggtggctagtggctactgtattggacaatacggtcttagcctttt

SEQ ID NO: 71522 - DNA, 170 bp, Homo sapiens
  misc_feature 1..170: note = chr10:60935826-60935996
  misc_feature 1..170: note = hyper
  source 1..170: mol_type = genomic DNA
acgcctcaggtaatccgctcatttctcacacagacgcagctgtttccgaggaatgtccggccgagcccgcagggtgcgggcagcgagtatcctgggaccttcaggggaggaggtggctcccacaccccaataccgtacagagagtccgaagagtccgggcccttattttt

SEQ ID NO: 71523 - DNA, 421 bp, Homo sapiens
  misc_feature 1..421: note = chr10:60936309-60936730
  misc_feature 1..421: note = hyper
  source 1..421: mol_type = genomic DNA
aagccctatacatcacgttccccgagagcagcgtcccctccccgccgggagcgcgcgcctcccatcctcgcgccgggtcctgctcggtctctcagagccgcacactccgcggagctcctgccacagccgtcgccttcgcggcggctctccagccccgcgcctcagcctcggcgccgcatcaccgcgtcccaggcctccttccctccctctgccactccccctccctttcccgctcttcttgcccacccggccggcagagagagcctggatacgaagcaggcgggcttcagagtgggttggaaaaatggaggtgccgcgcctggatcatgccctcaacagccccaccagcccctgtgaggaggtgatcaaaaacctcagcctggaggccattcagctgtgcgaccgggacggtaagagcggc

SEQ ID NO: 71524 - DNA, 62 bp, Homo sapiens; identical to SEQ ID NO: 33095
  misc_feature 1..62: note = chr10:60937041-60937103
  misc_feature 1..62: note = hyper
  source 1..62: mol_type = genomic DNA

SEQ ID NO: 71525 - DNA, 30 bp, Homo sapiens
  misc_feature 1..30: note = chr10:6109019-6109049
  misc_feature 1..30: note = hypo
  source 1..30: mol_type = genomic DNA
cttggggcttgttaacggtcacttccacaa

SEQ ID NO: 71526 - DNA, 146 bp, Homo sapiens
  misc_feature 1..146: note = chr10:61122490-61122636
  misc_feature 1..146: note = hyper
  source 1..146: mol_type = genomic DNA
tggagagttaccacacgaccccgacctcgccagcccaggcgccgcgtttaatcttgggctctttgtgccagccaccccccgaggctggcaatgagaatgccccagtgtttctgccgaagtgctgaaatacccgggagacttgcttt

SEQ ID NO: 71527 - DNA, 24 bp, Homo sapiens
  misc_feature 1..24: note = chr10:6127024-6127048
  misc_feature 1..24: note = hypo
  source 1..24: mol_type = genomic DNA
gagccaccgcgcccagccttcttt

SEQ ID NO: 71528 - DNA, 35 bp, Homo sapiens
  misc_feature 1..35: note = chr10:61468736-61468771
  misc_feature 1..35: note = hyper
  source 1..35: mol_type = genomic DNA
taggtcaggagtacccgcggcgccccattcccaac

SEQ ID NO: 71529 - DNA, 102 bp, Homo sapiens
  misc_feature 1..102: note = chr10:61469892-61469994
  misc_feature 1..102: note = hyper
  source 1..102: mol_type = genomic DNA
aagcccgccaagggccgtgcgcgtttggggggagccggggtgtacaaatgaatgcgagtgttccttggtctccctggctcccggggccgctggcgccctcct

SEQ ID NO: 71530 - DNA, 205 bp, Homo sapiens
  misc_feature 1..205: note = chr10:6159761-6159966
  misc_feature 1..205: note = hypo
  source 1..205: mol_type = genomic DNA
ggtgtgagccaccgagcccagcctgaaacgcctttttctgtgtggggaacttccttgtttccctcctccccgcaagagactagaaacttgctttcccagcctgtcttgcaggttgagtagggttgtgcgcttgggatctctgatcagaccggcaccgcagtgtgggagagaagctgtgtgaagagtctgtcgtctgactttggca

SEQ ID NO: 71531 - DNA, 87 bp, Homo sapiens; identical to SEQ ID NO: 42482
  misc_feature 1..87: note = chr10:6162138-6162225
  misc_feature 1..87: note = hypo
  source 1..87: mol_type = genomic DNA

SEQ ID NO: 71532 - DNA, 30 bp, Homo sapiens
  misc_feature 1..30: note = chr10:61658400-61658430
  misc_feature 1..30: note = hypo
  source 1..30: mol_type = genomic DNA
gtcaagtgcaatcctcgctatgctaccggg

SEQ ID NO: 71533 - DNA, 24 bp, Homo sapiens
  misc_feature 1..24: note = chr10:6199196-6199220
  misc_feature 1..24: note = hypo
  source 1..24: mol_type = genomic DNA
tttttttttttgagacggagtctc

SEQ ID NO: 71534 - DNA, 18 bp, Homo sapiens
  misc_feature 1..18: note = chr10:6222017-6222035
  misc_feature 1..18: note = hypo
  source 1..18: mol_type = genomic DNA
tgtgtgggccaggctcgg

SEQ ID NO: 71535 - DNA, 152 bp, Homo sapiens
  misc_feature 1..152: note = chr10:6242759-6242911
  misc_feature 1..152: note = hyper
  source 1..152: mol_type = genomic DNA
gacaggaaaagtgcccggtctgcgaaagttcagctggacctccgggacatcaactccctgtgccctaagagctgaccgctgtcagatgcgttatctaggtcaagagatgaatgatgtgccgctgctggggcagacgccgtctctctgctctc

SEQ ID NO: 71536 - DNA, 54 bp, Homo sapiens
  misc_feature 1..54: note = chr10:62493236-62493290
  misc_feature 1..54: note = hyper
  source 1..54: mol_type = genomic DNA
tcctcctgctgtgtccgctgcgaccgccaggtgcccgcgcgggccggtgcgccg

SEQ ID NO: 71537 - DNA, 30 bp, Homo sapiens
  misc_feature 1..30: note = chr10:6261147-6261177
  misc_feature 1..30: note = hypo
  source 1..30: mol_type = genomic DNA
agcctcctcccggcacggggagcattgcgg

SEQ ID NO: 71538 - DNA, 30 bp, Homo sapiens; identical to SEQ ID NO: 33098
  misc_feature 1..30: note = chr10:62702560-62702590
  misc_feature 1..30: note = hyper
  source 1..30: mol_type = genomic DNA

SEQ ID NO: 71539 - DNA, 100 bp, Homo sapiens
  misc_feature 1..100: note = chr10:62704183-62704283
  misc_feature 1..100: note = hyper
  source 1..100: mol_type = genomic DNA
ggttcctcggctctacgcagacccgacgggcccgggcacggaggcggatcgcccgggacaaaccgacacagagcatgggagaccccggccctttccccgc

SEQ ID NO: 71540 - DNA, 51 bp, Homo sapiens
  misc_feature 1..51: note = chr10:62761321-62761372
  misc_feature 1..51: note = hyper
  source 1..51: mol_type = genomic DNA
cccgttccgccacctcgctcccggcccggcagccgccgccctgcggggcgg

SEQ ID NO: 71541 - DNA, 1185 bp, Homo sapiens
  misc_feature 1..1185: note = chr10:63212027-63213212
  misc_feature 1..1185: note = hyper
  source 1..1185: mol_type = genomic DNA
gcaagataggcaggccgttagccaagccccaaagccagcaaacccagacacctgaagctggcgctgtgctagagaacgcgcgacgcgcgcggctggagggaagggaagcggatgaaaccacagacgtgcagcgagggtcttctcgtcttaggagggtggccagtgtgctcagctcttgcgaaggtcgctgatgcccagcgaaggacattcccacatgtgcacgcacgcagagtaacccgcgcacactcacacaccccagtttcagaaggcacactacatggcaacctccttgtcccaagactcccctatttgcgggcacattcagcaaaatagaccagcgcttcctctctttactcatcttccaagtttccaaacctgagactgggtgactcttgcctaggctcacagatcgagccttcccagtgttgcactgggaccctagggtggccctggggtgcccaagagatgcgcaagcatctcgcgccttccaagcgatcagcgaggaaaaacggggtccaaattcgagtagaatctgcgggttgcgggaagatggcctgcgagtgcggtgggggacaataccctagggccccgtgcgccctcgctttcccggggcactctcaccatttgtagcctctgccgcgcttgaacttgagggtgagcgcagtctccaggaagagcaagaggttgagcagcgcaagcagccagtaccgcggctccttcttcacctcggtcactcgccagaccccgaccagcgagtgcagcaggaacagcaaccgagtggccagggcgttaaggaagaccagtccctccatgctggccggagcactctgcctacgtccccttgcctgcgcccccaggaccctgccgggcgtgcccggagcccaccggtgagcaggaatatgacaagcactgagacctgctgctgcttgtggtcccttctcaccctcagcgcccgatgccggtagaactggtgcgcggctcgcccctcccccaaacttcctgagaactcttcaaagaggggtgagtccaaacccagcttttccagactgctgggttttccagggagtctggggctgcgctgccctgtctccagggcgttattctccagcgctgcccatccccctcccaatctcggggccagtctccatccctgtccggtatccccgcccccgggcctctgtgagg

SEQ ID NO: 71542 - DNA, 39 bp, Homo sapiens
  misc_feature 1..39: note = chr10:63656895-63656934
  misc_feature 1..39: note = hyper
  source 1..39: mol_type = genomic DNA
tggaaagcaatgacccgtataacccggttgatcctcctt

SEQ ID NO: 71543 - DNA, 18 bp, Homo sapiens
  misc_feature 1..18: note = chr10:63795861-63795879
  misc_feature 1..18: note = hypo
  source 1..18: mol_type = genomic DNA
gcgcgagccactgcacct

SEQ ID NO: 71544 - DNA, 538 bp, Homo sapiens
  misc_feature 1..538: note = chr10:64133867-64134405
  misc_feature 1..538: note = hyper
  source 1..538: mol_type = genomic DNA
agtgtaatcctgagtcggatcgggctcccggctgggtggcgggggggcagatgatgctcccgccagctgggcagagcaagggtgttccccgcggaggtggcagccctgggccgcggcgttccggaacccccgcacccacggcgcggtgccccacggtgcccgcgagcgccgcccccgctggctagccgcgcctcgctccgccctggacgccgccggtcccggcgcggaggtgcggcggggagtgggagccggcccggctcagtctgatttacggctctgctgaaaaccgcttcgctcccgcagcatcagcaccggaggcggcggctgcagcagcagcagcaacaagtcgggtaagaggcggccgccggccatctgcgcccgcggctcggcggaggggacctgccggggtggccggggctggggagggggtccccgagcccgcagcatggcggggagttgggagagccggcttcccggcccccaccagcaggaactcatgtgcacacgaatccactctggcacccgtgggctggcacgc

SEQ ID NO: 71545 - DNA, 515 bp, Homo sapiens
  misc_feature 1..515: note = chr10:64574553-64575068
  misc_feature 1..515: note = hyper
  source 1..515: mol_type = genomic DNA
aaagcctcatccgcccggagcttttctccctcttttttgcctgggggttccacggctgaggcaccaagacaaacaccacccaagaatcgacctatcccagtcagtgccgtgatggtgccaaaccgagaggagagcccgagaagggggtgggtgatttcccggctgctccccatccccggcgccttgtgcctttttctccctccctctcccgctgcgcttcagccgagggctgctggagcgaatgggggatgtagaggaaggagtccgtaggtttccgtgccctcccaatcttctccgcctttcccgacagccgcgcgtccccgcctcagcccaaggccagtggcccggcctcgaggaaggcgcgggggccgcgagagacgactttccacagcatcgccaaggaaaccggcgtcgccggtgcccccgcgggcctccctcggcagtccgggggctgcttcccgccgttgcgcgccctcctccaccacccactcgctgcctccgccggccggagcccc

SEQ ID NO: 71546 - DNA, 735 bp, Homo sapiens
  misc_feature 1..735: note = chr10:64575127-64575862
  misc_feature 1..735: note = hyper
  source 1..735: mol_type = genomic DNA
cgcaagaagggagcgctccgagattttcccggggtcggctctgcccaggagggagctaccgacgctttcccctggcgcttctccgccgctcggctctccaggcgcgcagctctccccgagagccccgaactttaccgtcactttgcccctgccccgggagaggggaggtcgaagtgctgccggccagagggcctacgcaagcctcgaaacccggggggacgcctcttccacccccatccctgcgctcgcccggggctgggcgcgccggggcgcacgcacgccggtttgctggcgacctggcgcatctgcccgcgcgccctggtctcagctgtcgcaggttcctcctgcacccacttccagtcttcaaagccagtgcagtcagcaccgtccacctggagccccaatcctctcctgcgattcccgcacacccactgcaccccatccaccacctccgggccgcgcaggtccgggcctgcgaagacacgcggcttacctccggccactccgttcatctggtcaaaggggcctcccagttcggcattgggaaagatggtcaccgacgtggcggcgaggtcctccaccgggtagatgttgtcagacagctggtgcacaaaaccactgagagttactgggattttgtctacggccttggcggtcatcatttgctcctcgcacaacctggagacccaactccctcgctacctggagtgtcagaaaagccgttttggagagggg

SEQ ID NO: 71547 - DNA, 342 bp, Homo sapiens; identical to SEQ ID NO: 3567
  misc_feature 1..342: note = chr10:64578287-64578629
  misc_feature 1..342: note = hyper
  source 1..342: mol_type = genomic DNA

SEQ ID NO: 71548 - DNA, 37 bp, Homo sapiens
  misc_feature 1..37: note = chr10:64578651-64578688
  misc_feature 1..37: note = hyper
  source 1..37: mol_type = genomic DNA
cgagggggagctcctggacgcccgagtgcccggccag

SEQ ID NO: 71549 - DNA, 133 bp, Homo sapiens; identical to SEQ ID NO: 42484
  misc_feature 1..133: note = chr10:6462190-6462323
  misc_feature 1..133: note = hypo
  source 1..133: mol_type = genomic DNA

SEQ ID NO: 71550 - DNA, 165 bp, Homo sapiens
  misc_feature 1..165: note = chr10:64812014-64812179
  misc_feature 1..165: note = hypo
  source 1..165: mol_type = genomic DNA
gaatttaacaaaaaacgctgatgtgcatgtattaggaggaggtatgtgggggtggcaggaagtgtcaaagagtgctgctttctcatcttgtataattcaaagtaaatagacaatttctaaagctgaagataacaaaataggctggctgggcacggtggctcacgt

SEQ ID NO: 71551 - DNA, 186 bp, Homo sapiens; identical to SEQ ID NO: 42485
  misc_feature 1..186: note = chr10:6505370-6505556
  misc_feature 1..186: note = hypo
  source 1..186: mol_type = genomic DNA

SEQ ID NO: 71552 - DNA, 130 bp, Homo sapiens
  misc_feature 1..130: note = chr10:6520821-6520951
  misc_feature 1..130: note = hypo
  source 1..130: mol_type = genomic DNA
ggatggcaggtacaccgaaatgtaagataaatatggaggcaatgactcgtgtctcctaatgagggcgccattgaaggtatcatgctgagacaggttagaggggaggtagggttgtcggagcagaagccat

SEQ ID NO: 71553 - DNA, 178 bp, Homo sapiens
  misc_feature 1..178: note = chr10:6527860-6528038
  misc_feature 1..178: note = hypo
  source 1..178: mol_type = genomic DNA
agccaagggcaaggccggtgctcagaaatacatcccggcatttcccatagggctgccacaggtgaagcagcagaagtgcatggacatccttgctgagcggccatggcgggaacgtgtccacggcacatgctcctacctgttgagtgctctcaatcatggccagcgcttcagccattag

SEQ ID NO: 71554 - DNA, 140 bp, Homo sapiens; identical to SEQ ID NO: 42487
  misc_feature 1..140: note = chr10:6531036-6531176
  misc_feature 1..140: note = hypo
  source 1..140: mol_type = genomic DNA

SEQ ID NO: 71555 - DNA, 30 bp, Homo sapiens
  misc_feature 1..30: note = chr10:6531585-6531615
  misc_feature 1..30: note = hypo
  source 1..30: mol_type = genomic DNA
ggtgagcggagcaggcggggtgagcacagt

SEQ ID NO: 71556 - DNA, 163 bp, Homo sapiens
  misc_feature 1..163: note = chr10:6562091-6562254
  misc_feature 1..163: note = hypo
  source 1..163: mol_type = genomic DNA
tgagcaataaagtcacgcattcgactctctcctggaaatctccaaggggaccccaaactcaccaggtcccatacagaactccctgccttccctttcaaacttgccttttccttcattttgccagctcggtgctgggtgccgcgacgcccggccctcacccgct

SEQ ID NO: 71557 - DNA, 118 bp, Homo sapiens; identical to SEQ ID NO: 42489
  misc_feature 1..118: note = chr10:6577643-6577761
  misc_feature 1..118: note = hypo
  source 1..118: mol_type = genomic DNA

SEQ ID NO: 71558 - DNA, 30 bp, Homo sapiens
  misc_feature 1..30: note = chr10:6586370-6586400
  misc_feature 1..30: note = hypo
  source 1..30: mol_type = genomic DNA
agaatatattgttaacggcaaggagagaca

SEQ ID NO: 71559 - DNA, 21 bp, Homo sapiens
  misc_feature 1..21: note = chr10:6586866-6586887
  misc_feature 1..21: note = hypo
  source 1..21: mol_type = genomic DNA
ccactgcgcccagacccacat

SEQ ID NO: 71560 - DNA, 23 bp, Homo sapiens
  misc_feature 1..23: note = chr10:6591880-6591903
  misc_feature 1..23: note = hypo
  source 1..23: mol_type = genomic DNA
accgcgcccggctgaaattcacc

SEQ ID NO: 71561 - DNA, 186 bp, Homo sapiens
  misc_feature 1..186: note = chr10:6622520-6622706
  misc_feature 1..186: note = hyper
  source 1..186: mol_type = genomic DNA
acagccccgggagggcggcgaggcggagcaggagcgccccggctccggccacattctcagagtcaggaaaaggggcgagaggccacatgtctccctctcgcccaactgaaaacgaaacggcgctccagcagattgggtggaaagagctgggtctcttttctctgtttttcacgctagaaagggctt

SEQ ID NO: 71562 - DNA, 30 bp, Homo sapiens
  misc_feature 1..30: note = chr10:66600483-66600513
  misc_feature 1..30: note = hypo
  source 1..30: mol_type = genomic DNA
aatgtcaggacttcacgatgatgatccatc

SEQ ID NO: 71563 - DNA, 30 bp, Homo sapiens
  misc_feature 1..30: note = chr10:6661702-6661732
  misc_feature 1..30: note = hypo
  source 1..30: mol_type = genomic DNA
ttagtggtagtaaagcggtatgggtggcct

SEQ ID NO: 71564 - DNA, 198 bp, Homo sapiens
  misc_feature 1..198: note = chr10:6666769-6666967
  misc_feature 1..198: note = hypo
  source 1..198: mol_type = genomic DNA
agataagcctctcatcgggcagggattttagtattataatgaggcaagggtccggattggtcattctcatggtcttgtgcacatgcaggtgacagggttaactcccttgagtaagatttatagtggaatgctcctgatgttagcttcttcacgcagtttgcaagatctgatcagtgggggtggcgccagctggcgggt

SEQ ID NO: 71565 - DNA, 26 bp, Homo sapiens
  misc_feature 1..26: note = chr10:6680303-6680329
  misc_feature 1..26: note = hypo
  source 1..26: mol_type = genomic DNA
attttcttaagaagtcggtcacgcct

SEQ ID NO: 71566 - DNA, 30 bp, Homo sapiens
  misc_feature 1..30: note = chr10:673796-673826
  misc_feature 1..30: note = hypo
  source 1..30: mol_type = genomic DNA
gcctcgaacagaccacgccctcattacggg

SEQ ID NO: 71567 - DNA, 21 bp, Homo sapiens
  misc_feature 1..21: note = chr10:6781373-6781394
  misc_feature 1..21: note = hypo
  source 1..21: mol_type = genomic DNA
ttgcatagccgggctcggtgg

SEQ ID NO: 71568 - DNA, 39 bp, Homo sapiens
  misc_feature 1..39: note = chr10:679363-679402
  misc_feature 1..39: note = hypo
  source 1..39: mol_type = genomic DNA
gctgcagagcggacgcggggagtccgaggtggtgccgta

SEQ ID NO: 71569 - DNA, 25 bp, Homo sapiens
  misc_feature 1..25: note = chr10:6810214-6810239
  misc_feature 1..25: note = hypo
  source 1..25: mol_type = genomic DNA
attaagcttgtaggccgggcgtggt

SEQ ID NO: 71570 - DNA, 42 bp, Homo sapiens
  misc_feature 1..42: note = chr10:69283867-69283909
  misc_feature 1..42: note = hypo
  source 1..42: mol_type = genomic DNA
agtgttcaaaatagccgggcgcggtggctcacgcctgtaatc

SEQ ID NO: 71571 - DNA, 86 bp, Homo sapiens
  misc_feature 1..86: note = chr10:69310933-69311019
  misc_feature 1..86: note = hypo
  source 1..86: mol_type = genomic DNA
ggagagaaacacatcttggtggaggaatacacaagcagctgaacattgagagggcgtcgagaggaggagatcggtggaagaagaca

SEQ ID NO: 71572 - DNA, 37 bp, Homo sapiens
  misc_feature 1..37: note = chr10:69521314-69521351
  misc_feature 1..37: note = hypo
  source 1..37: mol_type = genomic DNA
tagcttaattgaaaccgccacataaaagaacagaaac

SEQ ID NO: 71573 - DNA, 42 bp, Homo sapiens
  misc_feature 1..42: note = chr10:69571254-69571296
  misc_feature 1..42: note = hypo
  source 1..42: mol_type = genomic DNA
tcacgtcgcacccagcgagaaacccaccgtcttcactgagtc

SEQ ID NO: 71574 - DNA, 65 bp, Homo sapiens
  misc_feature 1..65: note = chr10:69578014-69578079
  misc_feature 1..65: note = hypo
  source 1..65: mol_type = genomic DNA
aaagatccacataaacgttcagaaagttgtattaatgaaaactgagtaaacggatgcttaaatag

SEQ ID NO: 71575 - DNA, 106 bp, Homo sapiens
  misc_feature 1..106: note = chr10:6962043-6962149
  misc_feature 1..106: note = hyper
  source 1..106: mol_type = genomic DNA
cccctgacttccatacgctccccttctgtgccccgtattctccctatgtgtctcgactcggagacatcgcacctgcgcagatgctgacagacgcccatagatggca

SEQ ID NO: 71576 - DNA, 30 bp, Homo sapiens
  misc_feature 1..30: note = chr10:6984700-6984730
  misc_feature 1..30: note = hypo
  source 1..30: mol_type = genomic DNA
taggaagattagaaccggtgatcagcccca

SEQ ID NO: 71577 - DNA, 30 bp, Homo sapiens
  misc_feature 1..30: note = chr10:69896480-69896510
  misc_feature 1..30: note = hypo
  source 1..30: mol_type = genomic DNA
tcattttggtaaggacgagaaatgttctct

SEQ ID NO: 71578 - DNA, 40 bp, Homo sapiens
  misc_feature 1..40: note = chr10:7028274-7028314
  misc_feature 1..40: note = hypo
  source 1..40: mol_type = genomic DNA
gattacaggcgtgagccaccgtgcccggccagccaattca

SEQ ID NO: 71579 - DNA, 120 bp, Homo sapiens
  misc_feature 1..120: note = chr10:70288069-70288189
  misc_feature 1..120: note = hypo
  source 1..120: mol_type = genomic DNA
cgcctcaaaaaaataaaaaataaaaaggcccacaaccttagaaagctctctcctgtctcgtcccttgacctatattgaccactgaccagtaatcgcctatcgcgcttttttttttttttt

SEQ ID NO: 71580 - DNA, 907 bp, Homo sapiens
  misc_feature 1..907: note = chr10:70320021-70320928
  misc_feature 1..907: note = hyper
  source 1..907: mol_type = genomic DNA
tgggtaaatccagctcgcgttttgtctctcgctcaactgtgcagggtccagcgaaggcagagccccagcttcactccctgaggtctgtcctggggagacactgctgctccggggggctgacctggcggggagtggccgcgcagtctgctccggcgccgctttgtgcgcgcagccgctggcccctctactcccgggtctgccccccgggacacccctctgcctcgcccaagtcatgcagccctacctgcctctccactgtggacctttgggaaccgactcctcacctcgggggctcgggccttgactgtgctgggagccggtaggcgtcctccgcgacccgcccgcgcccctcgcgcccgccggggccccgggctccaaagttgtggggaccggcgcgagttggaaagtttgcccgagggctggtgcaggcttggagctgggggccgtgcgctgccctgggaatgtgacccggccagcggtgagttggggccggggcagagggcaggggtgcggggagcgaggactccgacgccgaggcccgaggggggtccgggaggcggcgctcggcgcgggctggatgtggccggggctctgcgtccttggctctcccgctgcctcaggggtgggctcgttccccgcctcgaccccccaccccgggacgctcgggacgcttttgttgccggagataaacaatgcccccggccggaggtatcggccacccgctccggaggccccgccacagcgccgggttgggggcagcgggggcgcctggggctctgaccccgggctgcggtggaagcggggctgggggagggcaagtgtggcgtgggggagatggctgaatataccagcggttggttccctggcccctttggggagttggaggtcggggcgcctcggggtgagg

SEQ ID NO: 71581 - DNA, 35 bp, Homo sapiens
  misc_feature 1..35: note = chr10:70377573-70377608
  misc_feature 1..35: note = hypo
  source 1..35: mol_type = genomic DNA
attacaggcgtgagccaccgcgcctggccaatgga

SEQ ID NO: 71582 - DNA, 105 bp, Homo sapiens
  misc_feature 1..105: note = chr10:70476531-70476636
  misc_feature 1..105: note = hypo
  source 1..105: mol_type = genomic DNA
tgagccactgtgcctggccaagactagaacttgataatcacgaggatgttctatagttttccattgaaactatattgtctctaaaatcaccgttatttttattaa

SEQ ID NO: 71583 - DNA, 20 bp, Homo sapiens
  misc_feature 1..20: note = chr10:70482667-70482687
  misc_feature 1..20: note = hypo
  source 1..20: mol_type = genomic DNA
tactccgtctcaaaaaaaca

SEQ ID NO: 71584 - DNA, 18 bp, Homo sapiens
  misc_feature 1..18: note = chr10:70483311-70483329
  misc_feature 1..18: note = hypo
  source 1..18: mol_type = genomic DNA
taaaagtaaatgggccgg

SEQ ID NO: 71585 - DNA, 75 bp, Homo sapiens
  misc_feature 1..75: note = chr10:7105495-7105570
  misc_feature 1..75: note = hypo
  source 1..75: mol_type = genomic DNA
ccctcgatctctgccttctttctacaagaatctctcatgtcagtctctgccaacccccatcggtatgacaaaggc

SEQ ID NO: 71586 - DNA, 42 bp, Homo sapiens; identical to SEQ ID NO: 33108
  misc_feature 1..42: note = chr10:71267763-71267805
  misc_feature 1..42: note = hyper
  source 1..42: mol_type = genomic DNA

SEQ ID NO: 71587 - DNA, 41 bp, Homo sapiens; identical to SEQ ID NO: 33109
  misc_feature 1..41: note = chr10:71327725-71327766
  misc_feature 1..41: note = hyper
  source 1..41: mol_type = genomic DNA

SEQ ID NO: 71588 - DNA, 229 bp, Homo sapiens; identical to SEQ ID NO: 33110
  misc_feature 1..229: note = chr10:71328773-71329002
  misc_feature 1..229: note = hyper
  source 1..229: mol_type = genomic DNA

SEQ ID NO: 71589 - DNA, 457 bp, Homo sapiens
  misc_feature 1..457: note = chr10:71329076-71329533
  misc_feature 1..457: note = hyper
  source 1..457: mol_type = genomic DNA
cgggctccgggcagagaccgctagcagcgcggtttaaaaagccccaggactcaaaacgccgcaagaagtggaaggcggggacggtggtgcagagctagttggacaggccacccctagaaatgtttccgagcccttcttgctcaggggttctttggaaagaggcatggacgaggtttcccactccagcgtgattccacacacttagacggagctcatccagcacggaaccctaaactttgcctccgtgattcaaagaaaccctaaaccctcctccgccttctcctgacttggagagtggggctgactgctccgggggtctaatccgccccaacccaaggtggcggcctagcagccgagttggttaacccgtacgtgtgtgttttaatttgtggggcggaggaccagtctgtgtgtgttgggtgactaatggctccttaatgagcgccctcaaaagcag

SEQ ID NO: 71590 - DNA, 471 bp, Homo sapiens
  misc_feature 1..471: note = chr10:71331434-71331905
  misc_feature 1..471: note = hyper
  source 1..471: mol_type = genomic DNA
taaaaaaaaaagatgcgcggtgctccaggcacctgcagcgcagctcacgtttcaggcgcagttcgcagggaggctggggagatgctccctggccgggctagcgctttcccagttcacagcctggtcttccgccccgggagggcaatggctccgaaaagtgcacgaggagaaggcagagggtcgccttcgtggctttaaggcagagtgaggcgccctgaaatcccggacctgattgggagtagagcagatcggcagcgtctttggagcaaggcaaggggagtaagcgctgagagaccaaacattggattgaatcacattggaggaggggtggtaagagactgagaggcagacagacttgagtgagggtagggcgacccaagacggtgggcggctccggccgggtagtgctaccattctagtattctttgaatgagattatggggtggtggcagagaggaggcctaaaatgag

SEQ ID NO: 71591 - DNA, 597 bp, Homo sapiens
  misc_feature 1..597: note = chr10:71331949-71332546
  misc_feature 1..597: note = hyper
  source 1..597: mol_type = genomic DNA
cgtgcgttggcgcggctcggagggccggggaatgaacccagcctgccgcccccgtggaggcctgggccggccaggggtcagccagggagaagcagaaggaacaagtgcttttgagggccgccgccgtcggccaccctctacggctcccggctccctccctctcccttacccttagcacccacagcccagcgacagacaggtcctttcacagaaaatctgagaaagccagactgcctgggctcaagcaggcggaaaaggtggcccccagcagcccgggtcgctcctccagcgacgcggcgggactcaggctgccagcctgggagactggggagtagagggacccccagtccccgggggaaccgcctgggctgcccagctccccgcagtgcggcgccggcggctccagcgcgtacaagctgtggtccgctatgcgcagcgtttgagtcagcgcccagatgtagttgtgggcgaagcgcagcgtctcgatcttggtgagcttcgcgtcgtctgggaaggtgggcaggacaccgcgcagggcgtccagtgccgagttgaggttgtgcattcgattgcgctcgcggtcgttggccttctttc

SEQ ID NO: 71592 - DNA, 354 bp, Homo sapiens
  misc_feature 1..354: note = chr10:71332778-71333132
  misc_feature 1..354: note = hyper
  source 1..354: mol_type = genomic DNA
acccgagggttgaggcgtcatcctacggcggggtcagagggaagggtaagtttgagtccgtcactgggcgcagtccgcgattccgaggctaggtgggaaaaaacaaaaacagccatcctcccagcccccgctgggtcagaggatccctctttcccctgcccgtccctcggaggcctccaaatattacctttctaccggcgcaaaagaatagagagcgatgagcagcgagggccgtggggagctcagcgggcttctggtcgccaagttcagctgagctgcaggcgcccccgcctgggagttgccccagccccaaaggagaaaagaagagagaatggggtccgaggcctctgtcac

SEQ ID NO: 71593 - DNA, 96 bp, Homo sapiens
  misc_feature 1..96: note = chr10:71334295-71334391
  misc_feature 1..96: note = hyper
  source 1..96: mol_type = genomic DNA
ctcgaactcctgggctcaagcgttcctttcacttcagtctcccaaggcgctgggaagcagagctgctgtgcccctccccctcgtgtcttttgaact

SEQ ID NO: 71594 - DNA, 129 bp, Homo sapiens
  misc_feature 1..129: note = chr10:71334827-71334956
  misc_feature 1..129: note = hyper
  source 1..129: mol_type = genomic DNA
atatcctgagtctcccggaaactgcaggaggggacaggacccgacttcgagactgtagggtggggtgaggggatgaggtaggtctgtgagtctgccctagtgatagcctcttaccgcctaggctgcttg

SEQ ID NO: 71595 - DNA, 371 bp, Homo sapiens
  misc_feature 1..371: note = chr10:71336120-71336491
  misc_feature 1..371: note = hyper
  source 1..371: mol_type = genomic DNA
atcactcctgctttgcgcaaaaagcagccagggcgaggagcgcgcggtggctgggggcagccgccttcttgagggatgcaaggatttcccgcagtcctcttccagccaggaggccagggccggaggtcaaggagtcttaggcgattagagattgaggatccatgccctctgtctcagctgcaggggacacatagacccctctccaaagttaattcctgtgcctttggctgcggaggcgcaggcggtaatgactccgtgcgcaccggcagtgtttgtgaaatggctcttcccgcagacagcagagtctgttcctgcagctcctggtcatccaccgcccctaagacctccaggactcccgcacccctacacct

SEQ ID NO: 71596 - DNA, 30 bp, Homo sapiens; identical to SEQ ID NO: 33118
  misc_feature 1..30: note = chr10:71337383-71337413
  misc_feature 1..30: note = hyper
  source 1..30: mol_type = genomic DNA

SEQ ID NO: 71597 - DNA, 30 bp, Homo sapiens
  misc_feature 1..30: note = chr10:71337640-71337670
  misc_feature 1..30: note = hyper
  source 1..30: mol_type = genomic DNA
ggcgctcaggagagccggaggtctttattt

SEQ ID NO: 71598 - DNA, 225 bp, Homo sapiens
  misc_feature 1..225: note = chr10:71338101-71338326
  misc_feature 1..225: note = hyper
  source 1..225: mol_type = genomic DNA
tccacccccacctaccgccccaatcttagcagcttcgctgtaggactttattgtcaaatttaacacatgcacatttgttcccagcgcttggccccaaatacacacacacgtacaaacacgcaggcatccacagaaaacgcgactgatgacacagatgcggagcgcgagatgcccatatgtccggctctgcgcccatcccggctggggaaacgaataggctgtgtg

SEQ ID NO: 71599 - DNA, 100 bp, Homo sapiens
  misc_feature 1..100: note = chr10:71338575-71338675
  misc_feature 1..100: note = hyper
  source 1..100: mol_type = genomic DNA
gggctcttgaactctcggatggtgaagactctcccgtcctcctgggattcccaggagttggcgtccacctgaggcgcactaggggcgggcgggtacaccg

SEQ ID NO: 71600 - DNA, 49 bp, Homo sapiens
  misc_feature 1..49: note = chr10:71390060-71390109
  misc_feature 1..49: note = hyper
  source 1..49: mol_type = genomic DNA
cgcctgcaggtgagtcgccgcgccggggagggagcgcatccctcgctgc

SEQ ID NO: 71601 - DNA, 192 bp, Homo sapiens
  misc_feature 1..192: note = chr10:7139938-7140130
  misc_feature 1..192: note = hypo
  source 1..192: mol_type = genomic DNA
tgctgccagtgcctccgggagcccagctcctccagcggggttctctccagatccttgcagaccccaaacagagagatgatggggcctgcagaccttgcctggctgtcagaaattttccacccgctgaagaggtggctggcagtggtctacgctctgcgtgtggccttcctaaattaacgaacatattcacac

SEQ ID NO: 71602 - DNA, 44 bp, Homo sapiens
  misc_feature 1..44: note = chr10:71561793-71561837
  misc_feature 1..44: note = hyper
  source 1..44: mol_type = genomic DNA
tgaaactgactggcccgggagacacgaggcgcccagaaggactg

SEQ ID NO: 71603 - DNA, 687 bp, Homo sapiens
  misc_feature 1..687: note = chr10:71562106-71562793
  misc_feature 1..687: note = hyper
  source 1..687: mol_type = genomic DNA
agagccttttggcagcggctgtcgcctttatttattctatttatttatttattggttctcaagacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgaggtctgtgctctttgttgctggcttttatccctccccgcggcgccccctcgcgcagcctccagactgttcagccggtgtccgcgggcgctcgctctctgcgagccccaggttcgcgcgagttgcctgcgggaggggtcggggacacggacagacgctgccctaccagggattcggaggacctggtgggcaagagcatgacccagcgactcccgcctcgggcaagcgcccccggcttccagcgctgggagcgccctgggcacgccgggcaggtggaggaaggctgggcgcgcggaggctcgcggaggcgggcaagctccact

SEQ ID NO: 71604 - DNA, 30 bp, Homo sapiens
  misc_feature 1..30: note = chr10:7156226-7156256
  misc_feature 1..30: note = hypo
  source 1..30: mol_type = genomic DNA
tcccaccagattctccgggagctctggttt

SEQ ID NO: 71605 - DNA, 30 bp, Homo sapiens
  misc_feature 1..30: note = chr10:7164293-7164323
  misc_feature 1..30: note = hypo
  source 1..30: mol_type = genomic DNA
cagctctgctctgtgcgttctcgattccag

SEQ ID NO: 71606 - DNA, 799 bp, Homo sapiens
  misc_feature 1..799: note = chr10:71813100-71813899
  misc_feature 1..799: note = hyper
  source 1..799: mol_type = genomic DNA
ggtctcctgggaatgcggagtttcgggcgcaggagcgggaggacggaggcgcccggccgccgatgggcacggggcgatgggtggggggctgcgcagggcccgagggagcccggggagggccgctcgggggcctctgaaggtgcccgggcagggcgccggcggctccaggctgacaatggagggggcgcggagcagccgggcggaggttagggacccgagtccgggggcgggccgcgccggggaaggtcaggtcggggacgccgggtggcggggcgagggctgggggttgctgcgcggacacccgggcgccgcgggcgggcgtgcgccccggggccggcgcggaagagggcgcgaggccgggcactccccttcggttccctttccggggcgcccggtgccgacgcgcgctgcgctttcaccgggaaatggcggcccggccgtggctcgcctgggcagtctggctcccgctttgcgcgggaaaaaataataataataaaaatatcgaaaaagggaataaaagtaaactggctgcggcgcaggaaagggctctgccgggcgccggacgccgtgcgtatcgctcgcggggcgcggcggttggggaccagccctgcctcccccggctcccagcctccagccccggcgcacctcagccccagcccggccagccccccggatcgcccgtgggtgtcctcccccgcctttccttgggggggcgccctcagttcttgccctctttgttccttacaacaatggccaaaggggcattggttccccaagggccaaacgagcttcctccagg

SEQ ID NO: 71607 - DNA, 233 bp, Homo sapiens
  misc_feature 1..233: note = chr10:72015162-72015395
  misc_feature 1..233: note = hyper
  source 1..233: mol_type = genomic DNA
cagcgtgaagaacagcgccaccatgaccagcatgtgcaccacgcgcgctctgcgccgcgatgctcgcgggtccgcagcctcctcgcccccgggggccgggcccggggcctggcagagcttgcgcgcgatgcgggcgtacatgaccacgatgagcgccagcggcgccaggtagatgtgcgagaagagcacagtggtgtagaccctgcgcatgcccttctcgggccaggcctccc

SEQ ID NO: 71608 - DNA, 158 bp, Homo sapiens
  misc_feature 1..158: note = chr10:7202969-7203127
  misc_feature 1..158: note = hypo
  source 1..158: mol_type = genomic DNA
atctcctccctggcacgtgcacagacagtgctcacccatggtgaccgcaactgcacagagaaacgctgaagttaaactgtcagggtgaaggatacggagagtcttgggcgcttggctccacgggaagcaaacactttcccctgcgacagtggctgtat

SEQ ID NO: 71609 - DNA, 142 bp, Homo sapiens
  misc_feature 1..142: note = chr10:72043778-72043920
  misc_feature 1..142: note = hyper
  source 1..142: mol_type = genomic DNA
cgccccgggcccgcctcccgcatggcgctctctccacagagcccgagcgcccctccgaagtaggggacacacccctcctcccactgcagccctggcagcggcgtcccgtaattccccacctctctcccgtgcctcatatgcc

SEQ ID NO: 71610 - DNA, 110 bp, Homo sapiens
  misc_feature 1..110: note = chr10:7205677-7205787
  misc_feature 1..110: note = hypo
  source 1..110: mol_type = genomic DNA
aacctttaccaacaccgcatcccagcaataatgggccacctcccgagggcagactcagttggcgtactgggcgtagaaagccactttgactctctcgatctggtggcata

SEQ ID NO: 71611 - DNA, 30 bp, Homo sapiens
  misc_feature 1..30: note = chr10:7209019-7209049
  misc_feature 1..30: note = hypo
  source 1..30: mol_type = genomic DNA
agggcaaaattaaatcgattttgatagagc

SEQ ID NO: 71612 - DNA, 30 bp, Homo sapiens
  misc_feature 1..30: note = chr10:7211951-7211981
  misc_feature 1..30: note = hypo
  source 1..30: mol_type = genomic DNA
aagcagcattcagtacgacacaccagccag

SEQ ID NO: 71613 - DNA, 378 bp, Homo sapiens
  misc_feature 1..378: note = chr10:7212745-7213123
  misc_feature 1..378: note = hypo
  source 1..378: mol_type = genomic DNA
gagggagaagggtctcgcacacctgccgagcagcgccgaagaaccccctcgcaggtgtcacgaggaagccggctaggacacgaggttcatttcagatgcagagtctcagcacatcaaacaatcgacacgcggcaaccaccgtacctgctcctgaaatatcttggccaagggggcacagtctgtcagcttaatgaacctcaccacgtcggtgaccgtccactccaacgggttgctctccagaaccagtctctcctcctcctcctgtttcgtgtcctgcagagaaagggcaggaggagctcagctgcggcacagtcagctggctgggtcctctccagcactctccaggcctcggccgttcctggccggaagccactgcct

SEQ ID NO: 71614 - DNA, 833 bp, Homo sapiens
  misc_feature 1..833: note = chr10:7213624-7214457
  misc_feature 1..833: note = hypo
  source 1..833: mol_type = genomic DNA
cgtccaggaaagaggcgctgtctccaccctgggcactccattctgatgccgaaaggcccctccacccagaggtgaagtgccagcctttgttcctgacttgggaactagctagagcagctgctgctgttggaggtattttaaacaggtttccccacatcgtggccctgaagtgtaacaggtgtgcttcttcagacccagcgggaagccctctgtccccacgcccgggcatcacctctgtcccctcgggcttggtcggcgggcacttctccccttcctctgctgaggaggcagccggcgccccgcggccccttcgtgtcctctctgggggtggccggcgcacgggctctgagccgctccgcagggtgacggccctccggggccgggccgagggcacctccgccgacgaggtgtccgtctggtcatcccggagctcggagccggtctcctcactggcggtgtcatcgtccatggcgtcagcgtcctcctcttcactttcctgggaaggaggaaaaggcatttaaggggctggtggcccgggggcctgtagcggtggccccgcggtcagaccctgggcccagtgcagaccacctagcaaaccctcggaaatggagccagtggtcccacccgtgggccctacgaggcccttcccagccaaagcagctggacacactacatttgttttcagcaagtaaggaggagggggctcttcttcagtgtttctgaccatcttgccacaatctccagggccacctctgctgtgaagcagccacacttgccggccagggccagatgacagagctacaggctggcaggtgccccgggcagaacatacc

SEQ ID NO: 71615 - DNA, 314 bp, Homo sapiens
  misc_feature 1..314: note = chr10:7215974-7216288
  misc_feature 1..314: note = hypo
  source 1..314: mol_type = genomic DNA
ccacctcctcccctgcgtttgatcacagcatggcatttggaaaaactgtcgggaagccgcacagcagcagccctgtaactcccaggaggcacacctgctccgggagccccggcctgttctcatcaatctctcaaaaggagcagctggcaggagagcttggaacaatgtcccgtgtccagttctataaggaccgtgttactcagtgagcaggaataaactgccgtgggcgagcattgctctgtggccatctccaggtacggggcaaatgagcaagcctctgtcccctcccaaaccccaagcgtgcatgacagggc

SEQ ID NO: 71616 - DNA, 166 bp, Homo sapiens
  misc_feature 1..166: note = chr10:7216521-7216687
  misc_feature 1..166: note = hypo
  source 1..166: mol_type = genomic DNA
ttattatatgagatccggagacatctctgagttcatttcggcaatgctgaatgggaggtgtgggaccctgctccttccctgccattcccagtgtcctggaagaacacagaagcccacctggcaggtaagcattcaccgtacacggcaaaggcgagccctcggttag

SEQ ID NO: 71617 - DNA, 43 bp, Homo sapiens
  misc_feature 1..43: note = chr10:7219062-7219105
  misc_feature 1..43: note = hypo
  source 1..43: mol_type = genomic DNA
ttcggttgctttctccgaagcagtaaatcgaatcctttctgaa

SEQ ID NO: 71618 - DNA, 47 bp, Homo sapiens
  misc_feature 1..47: note = chr10:72200018-72200065
  misc_feature 1..47: note = hyper
  source 1..47: mol_type = genomic DNA
agtgaactggaaaagcgctccctcccttctttgccccctcccatccc

SEQ ID NO: 71619 - DNA, 655 bp, Homo sapiens; identical to SEQ ID NO: 896
  misc_feature 1..655: note = chr10:72200117-72200772
  misc_feature 1..655: note = hyper
  source 1..655: mol_type = genomic DNA

SEQ ID NO: 71620 - DNA, 679 bp, Homo sapiens; identical to SEQ ID NO: 33128
  misc_feature 1..679: note = chr10:72200824-72201503
  misc_feature 1..679: note = hyper
  source 1..679: mol_type = genomic DNA

SEQ ID NO: 71621 - DNA, 150 bp, Homo sapiens
  misc_feature 1..150: note = chr10:72218318-72218468
  misc_feature 1..150: note = hyper
  source 1..150: mol_type = genomic DNA
ggcagtgagtgttcccgccgggcgggtggcgttgtcgccgccaagggggacccgcccctctcccctgttccccgcactgccggtcccgccgccggggccgggacaagagcctagtgagacagagacgctccggcgcgagctcctgcccag

SEQ ID NO: 71622 - DNA, 274 bp, Homo sapiens
  misc_feature 1..274: note = chr10:72238584-72238858
  misc_feature 1..274: note = hyper
  source 1..274: mol_type = genomic DNA
cgtcgccggtgagcacgggctccctctcgcgtggcctcgccgggtccgcctggcctgcccacctccggagccacctctgcccccgcatgggctggcgaagttgggaggagcgagctggagccagagcgcgcgccgggcgcgccccgtcgctgcctgactcggcgcccgcagttcgggcgcagcacgccggccgcaggagcacggatgccccccggagccgcgggctggcaggtaccgaagtgtcctgccctggggctggcgaggggagggcaaa

SEQ ID NO: 71623 - DNA, 30 bp, Homo sapiens
  misc_feature 1..30: note = chr10:72297836-72297866
  misc_feature 1..30: note = hypo
  source 1..30: mol_type = genomic DNA
cccacctctttccaccgggcccttgtctct

SEQ ID NO: 71624 - DNA, 30 bp, Homo sapiens
  misc_feature 1..30: note = chr10:7234209-7234239
  misc_feature 1..30: note = hypo
  source 1..30: mol_type = genomic DNA
tccgaggactgacttcgctgaggtcagctg

SEQ ID NO: 71625 - DNA, 155 bp, Homo sapiens; identical to SEQ ID NO: 42498
  misc_feature 1..155: note = chr10:7236090-7236245
  misc_feature 1..155: note = hypo
  source 1..155: mol_type = genomic DNA

SEQ ID NO: 71626 - DNA, 30 bp, Homo sapiens
  misc_feature 1..30: note = chr10:7237870-7237900
  misc_feature 1..30: note = hypo
  source 1..30: mol_type = genomic DNA
caacaatagccttatcgatttctgacaggt

SEQ ID NO: 71627 - DNA, 30 bp, Homo sapiens
  misc_feature 1..30: note = chr10:7240552-7240582
  misc_feature 1..30: note = hypo
  source 1..30: mol_type = genomic DNA
ctgccagtctgaagacggtgaagtagacct

SEQ ID NO: 71628 - DNA, 675 bp, Homo sapiens
  misc_feature 1..675: note = chr10:72431955-72432630
  misc_feature 1..675: note = hyper
  source 1..675: mol_type = genomic DNA
agagagcaggccctgcggccaagaaagggggcggagcagccatagaaagcggctttgggccaccactccggggatcccaggcgtctgaggggacaatcggtccgtgcgccaggaacccctgctctgtctccgcgtggcacttccgatccccggccgcaggcagctgcactccccagccgcgcgccccgcccccgggcgcccggcgccccagctccgacccgcgcccggccccgccccgcccagtgtgcccacccccggcccgtcccgccgccccgtcgcccggctcccgcggagtcccggagcgtcactgcgcgggcgggctgaccgaccagccggcagttggcaccgggtgcgctggcgcgtcagtggccccgctctccagccggcagcctcgcgcgcccggagccagcggtccaggcggcggcgccgcgcaggggacccggagcaggcgggagggaagcagctaggcggggaggcggctgaggcggcagcggcggcagccagccggtgctccgacagcccggggcgcaccctagcctcgccgccctcagcctgggacttggggatcgggcgcttgcccagcccgcgtcccagcgcggccacatggctccactccgcgcgctgctgtcctacctgctgcctttgcactgtgcgctctgcgccgccgcgggcagc

SEQ ID NO: 71629 - DNA, 43 bp, Homo sapiens; identical to SEQ ID NO: 33133
  misc_feature 1..43: note = chr10:72432660-72432703
  misc_feature 1..43: note = hyper
  source 1..43: mol_type = genomic DNA

SEQ ID NO: 71630 - DNA, 148 bp, Homo sapiens
  misc_feature 1..148: note = chr10:72470413-72470561
  misc_feature 1..148: note = hypo
  source 1..148: mol_type = genomic DNA
tttgggggcgagttacgaaccctctggtgtgtctcttctgcactttgaaagcagcattaacagtacttactaccagaggttttggggaggatgaaatgagcgcatggtgcacagcatggccatgcagagcatgcgctgtcagtgggtg

SEQ ID NO: 71631 - DNA, 175 bp, Homo sapiens
  misc_feature 1..175: note = chr10:72489751-72489926
  misc_feature 1..175: note = hypo
  source 1..175: mol_type = genomic DNA
tcctctgggccttagcgttcccatctgtaagtgggaggagagaggcctgctgtttctagggctctgaccctccacgtggctgttggtgctctcccggcccctgcagtccctgagcctgatcgagcgcgggaacccctcacgcagcctggagcaggtgtgtcgctgggcacactcc

SEQ ID NO: 71632 - DNA, 52 bp, Homo sapiens
  misc_feature 1..52: note = chr10:7255513-7255565
  misc_feature 1..52: note = hypo
  source 1..52: mol_type = genomic DNA
attcgtcagccaggacgttcacggagaagagcagagacgggttctgacggtt

SEQ ID NO: 71633 - DNA, 81 bp, Homo sapiens
  misc_feature 1..81: note = chr10:7258531-7258612
  misc_feature 1..81: note = hypo
  source 1..81: mol_type = genomic DNA
ggctcaagtgactaccgagctatcttgctgtcccctccttgccagtgccccatctggctagtgccccgtttgcttctaaaa

SEQ ID NO: 71634 - DNA, 155 bp, Homo sapiens
  misc_feature 1..155: note = chr10:72675717-72675872
  misc_feature 1..155: note = hypo
  source 1..155: mol_type = genomic DNA
gcattcaggctcagccggaaagagtagcatggatgggcgatgtctatccgggtcagggagagggaggctggggtggcttatgtttactttccttgctgaggcttctgggccatgtggccattgttcataccctttgtgcacgcaaaacttctctc

SEQ ID NO: 71635 - DNA, 102 bp, Homo sapiens
  misc_feature 1..102: note = chr10:7271976-7272078
  misc_feature 1..102: note = hypo
  source 1..102: mol_type = genomic DNA
ccctatatatatatatatatatttaagatgggagggtgacagttaagcaaaaaagcagctgtgcttcttgggtcccagagactgacccgtgaccttcccata

SEQ ID NO: 71636 - DNA, 30 bp, Homo sapiens
  misc_feature 1..30: note = chr10:72785075-72785105
  misc_feature 1..30: note = hypo
  source 1..30: mol_type = genomic DNA
accttctcgaaaagccgagagtatagcgtt

SEQ ID NO: 71637 - DNA, 30 bp, Homo sapiens
  misc_feature 1..30: note = chr10:72799450-72799480
  misc_feature 1..30: note = hypo
  source 1..30: mol_type = genomic DNA
cagtcattcactcgccgagctagggacaag

SEQ ID NO: 71638 - DNA, 22 bp, Homo sapiens
  misc_feature 1..22: note = chr10:7288388-7288410
  misc_feature 1..22: note = hypo
  source 1..22: mol_type = genomic DNA
gaatgtgagagaggccgggtgc

SEQ ID NO: 71639 - DNA, 88 bp, Homo sapiens
  misc_feature 1..88: note = chr10:7288706-7288794
  misc_feature 1..88: note = hypo
  source 1..88: mol_type = genomic DNA
ggtgagagacgctaccgctgacaggctatgcacatcaagtctgttgagtttaattgataaataccaggtgaagcgactctgtagcgtg

SEQ ID NO: 71640 - DNA, 67 bp, Homo sapiens
  misc_feature 1..67: note = chr10:7290469-7290536
  misc_feature 1..67: note = hypo
  source 1..67: mol_type = genomic DNA
ctctaggggctgggtcgaagagcgagggaggaaaacccaccttagtcaccgacgcaggagagatgta

SEQ ID NO: 71641 - DNA, 109 bp, Homo sapiens
  misc_feature 1..109: note = chr10:72972434-72972543
  misc_feature 1..109: note = hyper
  source 1..109: mol_type = genomic DNA
gccactgagcggtcgcgcaacttcggaggcacagcgccggagccaggcgagcgctcagagacccggagccagaggggcgcgccggagcctcgttcgagagccggcgcca

SEQ ID NO: 71642 - DNA, 136 bp, Homo sapiens
  misc_feature 1..136: note = chr10:72972814-72972950
  misc_feature 1..136: note = hyper
  source 1..136: mol_type = genomic DNA
caagcaggtaggaagcgatcgggtctgggggcgcggggctaggggacccttgcgcctcactctgtcctgaagttgaggtggtctttcgtcgcatcgatgcgcgcaggaaaagcggcaagggcgcccaagttagaat

SEQ ID NO: 71643 - DNA, 159 bp, Homo sapiens
  misc_feature 1..159: note = chr10:72973223-72973382
  misc_feature 1..159: note = hyper
  source 1..159: mol_type = genomic DNA
ttactagtctggtcccggctcgcctaggctcttacgcgctatagggacagcaatctgcagactagagggagagagcgaaaagacctgctgaacacaggaagcgcttcggtagcctcggcaggccggcttgcagggctcctgaagcggggagggctaagt

SEQ ID NO: 71644 - DNA, 30 bp, Homo sapiens
  misc_feature 1..30: note = chr10:72977387-72977417
  misc_feature 1..30: note = hyper
  source 1..30: mol_type = genomic DNA
ggatgctaatggcagcgaaaatatttgctg

SEQ ID NO: 71645 - DNA, 82 bp, Homo sapiens
  misc_feature 1..82: note = chr10:72977625-72977707
  misc_feature 1..82: note = hyper
  source 1..82: mol_type = genomic DNA
ccagccgagctaaatcggtctgcggagccccgggagctctaacgccaccgcctagcgagtgagtgcacggagccgccctcct

SEQ ID NO: 71646 - DNA, 67 bp, Homo sapiens
  misc_feature 1..67: note = chr10:73156149-73156216
  misc_feature 1..67: note = hyper
  source 1..67: mol_type = genomic DNA
aaagccaacagatggcgcgggctcacctaggccgagcgcccgctcgcccgcccgggcttcccgggag

SEQ ID NO: 71647 - DNA, 15 bp, Homo sapiens
  misc_feature 1..15: note = chr10:73156346-73156361
  misc_feature 1..15: note = hyper
  source 1..15: mol_type = genomic DNA
cgggcttcctccctg

SEQ ID NO: 71648 - DNA, 228 bp, Homo sapiens
  misc_feature 1..228: note = chr10:73156640-73156868
  misc_feature 1..228: note = hyper
  source 1..228: mol_type = genomic DNA
gggggccgagcggggcgggggaagcaagggaaagttgatcgcggacttgagcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccgg

SEQ ID NO: 71649 - DNA, 1045 bp, Homo sapiens
  misc_feature 1..1045: note = chr10:73156912-73157957
  misc_feature 1..1045: note = hyper
  source 1..1045: mol_type = genomic DNA
cgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggtacccggagccacgcaccgcctcttccctcctcgcttccctctccttcccctcgccgttcgcccgccgcgcggcggggaagttggtggtgaccgcggctgccgaaccacttgttcccagcgcggccatcgcccgtggcgggcgctcgcggcatccttcggtcccaggcccctggccctagcctcgcgccccgctccgagctccccgacgcgcggcaactttgattcctgggaactcgaattccattcgcgttggccttgggaggacaggcatcccatcccccatccccggtcctgggaccgcgaacatttgggggctttgctctcggcgctacggagagggtccaggtctggggtggagagattttcgagagtggagcgcgttgggatccaatcccctccccttctgagccctgggtccccatttggacagtggggatggggtggggcgcacccctactgcgggctgggcagaggcgctgaggggaactaaaggcacgtagttctcccctcccctcatcaagtccctgtgcccgcgggagaccccaggggacttacacatcctcccaaattcggtccagctatgggaagacgcgcccctcgaggagccgggagccttttgcggctctcgcttcgccttcctggccctggaactggtccgctacgagcggtgctggctgcccccaggagctggcacccgggagcactgcccctcatctccaccgtaggtcagcccaggactcgagcagagcccgcgtgttccaaggcagtgacggcgccagccggcggggactctgcctggctttctcggagcgggcacctagagaggctgcctccgtgctgtgagcggagatccgatgccagccgccgccccactgcgacc

SEQ ID NO: 71650 - DNA, 30 bp, Homo sapiens
  misc_feature 1..30: note = chr10:7323490-7323520
  misc_feature 1..30: note = hypo
  source 1..30: mol_type = genomic DNA
gaagtggtgctaccacgtaagtcacacaag

SEQ ID NO: 71651 - DNA, 166 bp, Homo sapiens
  misc_feature 1..166: note = chr10:7339896-7340062
  misc_feature 1..166: note = hypo
  source 1..166: mol_type = genomic DNA
acagtgggagcaccacgggctgatgcacattctccactcagggggctctcacttttgcccaaaggcagaatccaccatcactggggctcgcaggtgaggcctggaggtggtcgtgctgctgttggctgctcgcccagcacccagaggccctcgcagcttgtccttc

SEQ ID NO: 71652 - DNA, 137 bp, Homo sapiens
  misc_feature 1..137: note = chr10:73429932-73430069
  misc_feature 1..137: note = hypo
  source 1..137: mol_type = genomic DNA
gtgctctataaaccccgcctcgccccatgcaatccagcaacccctctgtcgctgcttgctgcccaccatggtgtctgatggtggggtatcagccccacagaaggaaggttatgctggccctccgtggctggcagtgg

SEQ ID NO: 71653 - DNA, 123 bp, Homo sapiens
  misc_feature 1..123: note = chr10:73437184-73437307
  misc_feature 1..123: note = hypo
  source 1..123: mol_type = genomic DNA
ttctctccatcctctcggcctggcacaggttctcgctggacaaggacacgggactcatcatgctgattgccaggctggactatgagctcatccagcgcttcaccctgacgatcattgcccggg

SEQ ID NO: 71654 - DNA, 350 bp, Homo sapiens
  misc_feature 1..350: note = chr10:73466313-73466663
  misc_feature 1..350: note = hypo
  source 1..350: mol_type = genomic DNA
gttgtcatgattgtccgtgttgccatggtcgttgttaggtgcgtactggagagaggttctaaggttttctctcctccctttgacagctgagcagcaataagcccccagggcacagggacagcgggagggtctggagcactggtgggcctggtcctggccccggtgggcatggggggccctgggcttatggccaggaggtgttgacacagatgccacttggagcccgtgactcccttgggaattcattccctacttggtctggtgctggagacgctgctctggagctgggtcttctgcggcagaagccaggcctagccccggcgcccgttctgccccgcagtgctggatgt

SEQ ID NO: 71655 - DNA, 43 bp, Homo sapiens
  misc_feature 1..43: note = chr10:73468779-73468822
  misc_feature 1..43: note = hypo
  source 1..43: mol_type = genomic DNA
caggagcagagtccccgcttcccctggccgggagctctgtttc

SEQ ID NO: 71656 - DNA, 73 bp, Homo sapiens
  misc_feature 1..73: note = chr10:734976-735049
  misc_feature 1..73: note = hyper
  source 1..73: mol_type = genomic DNA
ctgctgcaccaaggacgccgcggctccagcgcagagcgcacgggaaggccgatcccgccgggcccgctgcatc

SEQ ID NO: 71657 - DNA, 30 bp, Homo sapiens
  misc_feature 1..30: note = chr10:73505195-73505225
  misc_feature 1..30: note = hypo
  source 1..30: mol_type = genomic DNA
atttccatatcctcccgggacagtgtatat

SEQ ID NO: 71658 - DNA, 30 bp, Homo sapiens; identical to SEQ ID NO: 42614
  misc_feature 1..30: note = chr10:73553133-73553163
  misc_feature 1..30: note = hypo
  source 1..30: mol_type = genomic DNA

SEQ ID NO: 71659 - DNA, 30 bp, Homo sapiens
  misc_feature 1..30: note = chr10:7367191-7367221
  misc_feature 1..30: note = hypo
  source 1..30: mol_type = genomic DNA
aatgctgggattacacgcctgagccaccgc

SEQ ID NO: 71660 - DNA, 119 bp, Homo sapiens
  misc_feature 1..119: note = chr10:73723643-73723762
  misc_feature 1..119: note = hyper
  source 1..119: mol_type = genomic DNA
caggaagatcctctccgggcagagatgatggggaacccgtgcagccagagggtctccctggcaaaggtcgggggagggggcggccgtaacggccccgggcgctccggcacggagaagcc

SEQ ID NO: 71661 - DNA, 514 bp, Homo sapiens
  misc_feature 1..514: note = chr10:73724102-73724616
  misc_feature 1..514: note = hyper
  source 1..514: mol_type = genomic DNA
gaggagaagggctcccggacgccttggacgcggttcaggaatccgccgccgctagccggctcgggcctgagcggggagggcgccaggcaggacctctcgcaggctcgctgcgcaggacggcgcccgcctggcgccgcttcccttccagcgtgccgaccggccccgcagcgcctccatccctccggcccgccccggagaagacgcacagctcgggccgcgcgggcgccggggccgcggaaccgcttctgccgggatcttccaggaggaaagcgaagttgcgagcggatgctgcccgcgccggaccccagccgcggagggtcggggccgccggtggagtctcggcggccggggtaagtggggcgccggcgtcctggaaccgccgcccagcccgggggaggccgcccagccgggagcccccgccttccgcgtccaggcgcgcgcgccagactttggagggagaagggggcgaagcggacggtgggaggtggagttcccagctcggggaaaagcccag

SEQ ID NO: 71662 - DNA, 30 bp, Homo sapiens
  misc_feature 1..30: note = chr10:73724940-73724970
  misc_feature 1..30: note = hyper
  source 1..30: mol_type = genomic DNA
agcagatgttgcagtcggttctcggagttc

SEQ ID NO: 71663 - DNA, 104 bp, Homo sapiens; identical to SEQ ID NO: 33140
  misc_feature 1..104: note = chr10:73847688-73847792
  misc_feature 1..104: note = hyper
  source 1..104: mol_type = genomic DNA

SEQ ID NO: 71664 - DNA, 14 bp, Homo sapiens
  misc_feature 1..14: note = chr10:73848208-73848222
  misc_feature 1..14: note = hyper
  source 1..14: mol_type = genomic DNA
ggtgactggcggag

SEQ ID NO: 71665 - DNA, 30 bp, Homo sapiens; identical to SEQ ID NO: 42503
  misc_feature 1..30: note = chr10:7391910-7391940
  misc_feature 1..30: note = hypo
  source 1..30: mol_type = genomic DNA

SEQ ID NO: 71666 - DNA, 19 bp, Homo sapiens
  misc_feature 1..19: note = chr10:73975138-73975157
  misc_feature 1..19: note = hypo
  source 1..19: mol_type = genomic DNA
agagcgagacttcgtctca

SEQ ID NO: 71667 - DNA, 43 bp, Homo sapiens
  misc_feature 1..43: note = chr10:73976883-73976926
  misc_feature 1..43: note = hypo
  source 1..43: mol_type = genomic DNA
ggtagaaagacttttcgaaggtggcagggtgtttcttaagatc

SEQ ID NO: 71668 - DNA, 36 bp, Homo sapiens
  misc_feature 1..36: note = chr10:7401231-7401267
  misc_feature 1..36: note = hypo
  source 1..36: mol_type = genomic DNA
agccctccatgcacccgaggccgtgatcatctgagc

SEQ ID NO: 71669 - DNA, 30 bp, Homo sapiens
  misc_feature 1..30: note = chr10:74027842-74027872
  misc_feature 1..30: note = hypo
  source 1..30: mol_type = genomic DNA
ggcagggtttatgcacggtcagggccctgg

SEQ ID NO: 71670 - DNA, 127 bp, Homo sapiens
  misc_feature 1..127: note = chr10:7407101-7407228
  misc_feature 1..127: note = hypo
  source 1..127: mol_type = genomic DNA
tgaccctgcgatttgcgtacacagagctggagcgggaactaaaaataaaacctgacttaagaacagccattctccagcactcacctgaatagagaggctggaaatccaggctcgcatgtccagagag

SEQ ID NO: 71671 - DNA, 74 bp, Homo sapiens
  misc_feature 1..74: note = chr10:7409558-7409632
  misc_feature 1..74: note = hypo
  source 1..74: mol_type = genomic DNA
cgtcatgaaggatggcggctcgtaaatcgaagcctttgaaacaggggctcaccgtccggcggcatcaacacctt

SEQ ID NO: 71672 - DNA, 36 bp, Homo sapiens
  misc_feature 1..36: note = chr10:74100577-74100613
  misc_feature 1..36: note = hypo
  source 1..36: mol_type = genomic DNA
tgctggtaggtatagcgcatgcggccgttgctgtag

SEQ ID NO: 71673 - DNA, 19 bp, Homo sapiens
  misc_feature 1..19: note = chr10:7414170-7414189
  misc_feature 1..19: note = hypo
  source 1..19: mol_type = genomic DNA
cgcccggccttcttgaaat

SEQ ID NO: 71674 - DNA, 44 bp, Homo sapiens; identical to SEQ ID NO: 42505
  misc_feature 1..44: note = chr10:7414544-7414588
  misc_feature 1..44: note = hypo
  source 1..44: mol_type = genomic DNA

SEQ ID NO: 71675 - DNA, 30 bp, Homo sapiens
  misc_feature 1..30: note = chr10:741557-741587
  misc_feature 1..30: note = hypo
  source 1..30: mol_type = genomic DNA
gagcagcccacccatcggctcatcacactg

SEQ ID NO: 71676 - DNA, 30 bp, Homo sapiens
  misc_feature 1..30: note = chr10:7424626-7424656
  misc_feature 1..30: note = hypo
  source 1..30: mol_type = genomic DNA
gcaggtactgcaacacgcagtgccctgcct

SEQ ID NO: 71677 - DNA, 186 bp, Homo sapiens
  misc_feature 1..186: note = chr10:7443826-7444012
  misc_feature 1..186: note = hypo
  source 1..186: mol_type = genomic DNA
tttctccacgtgttccgcacaaccatgcatctcattccaacagaataccaactgcaggctatttagaacggtctcctacgaatgtctgtctttaattgaagaactgcaacctaagccatgtaccaattggtaccatttatatccagtgacagatataatgcagacaggagacggagagctcttgca

SEQ ID NO: 71678 - DNA, 148 bp, Homo sapiens
  misc_feature 1..148: note = chr10:74451157-74451305
  misc_feature 1..148: note = hypo
  source 1..148: mol_type = genomic DNA
acgttattaatgtgttctgtttctgtaaatgcacacaaagtcaaatatgataaaatagtgctgtttctggagagtgtgagaatatccgtataaaggtgctgtaaaaatgaattgggtatttgagatgtatacacgtcagttaattcac

SEQ ID NO: 71679 - DNA, 236 bp, Homo sapiens
  misc_feature 1..236: note = chr10:7449954-7450190
  misc_feature 1..236: note = hyper
  source 1..236: mol_type = genomic DNA
aaaacttgggcccttcgagaaccctgtggaatgttctttgtaatcaactgtacatccgcttccacggcacggcctcgtgcaaaatcgcgggtttcggggccttggagcaaattgcgcttgtcagcggcgacgtcaggaggacaaggggaggggttcgcggctgaaactgcagcttcgcagcacagagccattttaggctgctccccacctcgcggggcccatgggaaagccggccc

SEQ ID NO: 71680 - DNA, 2546 bp, Homo sapiens
  misc_feature 1..2546: note = chr10:7450490-7453036
  misc_feature 1..2546: note = hyper
  source 1..2546: mol_type = genomic DNA
cgcgggcccggaggaggtcctcccacctgcccccgccagccccggggaccgtgcgcggcctccgtgtggcccccgcccacgaggtccctcgggcaggaaccgccgcgcgacctctgttcagcggccgcgtcctggccacgggcgacccctgtcgggaaccctgttcccggctaagctgcgttcccgcattccggtggctctcacccgagctcgcgtttgctggctttccctctggctcctctgcctgaccccgattttgtctccgaactccactcccagatcctccccgccctggaacgccgacctttcccccgcacttcgccgcccactcacatcccccggcgactgcccggcctccatgcccgccaagacaagaagatgcccctctccgatgcgccgagagggttcctaagccgagcaagggacaatttcttccccaaacgctgtccccatcccccaccttccctagagcgcgaaacccaaaagtaaggaaggcaacccctcgcctcgaccctacgtgcttgtctcccagagccgcgcgctcccgcccttctgccccaccccaccaccaccaccaccactttggtcttctccaagcttcggtcccggtcccccacctcccaccccagagcggcgtggaggaaagcaggagcccactattaagtgcagcgcgccccctgcacacacgaaatccggctggcgtctgcagcccgattgcacccaatacccgggacagttagtccttttaataagcacctcctcgccccacctactcggggatctacccgcgcaggatccagcacacacaaggcgagagctagctcgtctcctagaaagacaaaataaatcactccctctgccctcatgtactttacaccacgtgtccgcagtttgtcacgtcaaatcatggcagggtctggttccaagacgcacacacacattcggggtggttctctttgacacacacacccaaaaaaactgcgcacacgcaggcctgcacactaatccacaggcacacacgacagttgcgtttcggtgccctggtccgggccaggggcacttctccatccctttcccccctagcaatggacttgacacacagactctaaccacggaaaaaaaaaaccggacagcccattccttctttttttccccacttaattcgctaaagcgcttcctggggtagccaaagagagtcgaaactaaggggtggaaacttcagctgggttttttcccacctcaaaacctttattttcagtttttaaaagccaccttagcccgccatattgaaactggcacggtttctaaagactccttccccgcagttgtggcgcttccaagaaaacacgagtacggatcaggctctggatgagtgtccggccaccgagaatcagccacttcccaccctccaggatcccccagctccctccagccccttcccaccgcccctggtcaaaatcaataaatacatctcgcagttcctacagttgcattttggcggatttctgcaaaacatacacacacatacacatacccacgcacgcatattaaaaaataaactccagaaccagctcaagtcagcaattttgaaagggggtcgaataagaggagacaaccggaaagcccctaagtgacaggatattactttaaagagaaaataatgaacaaaaagaccatcctcgctggagcacgctccaaaactactactgccaattttatttcagttgctcaggcaaatgtttccaagggagcgattccgaatgtctgcacgatttttacccccatgccggtctccgattccccgtcctcaccatctttttctcccacccaaaccaaaagaaaggggagaccccagcgcggaggagacgcgggagcgcggggtaggtagcagcggcggctgcgtcgctaaaatgagtgcagaaacgaggaaggtgggcggcgggaggggacaggctgcgcccggggaaggaggacactttgcaactccggacggactcccgcacggctcggcttttccgagcccggagacgcaggcgaaggggacccgggaagcaaaaatgacaacctggagcgcacagaggagtttgaagcttcgctcaagtgcagtcgctttcttctcctgcccttctctttcgctcccctgcaccctccccagccttcccccacccgccacctccaaccccagctccctcaggcttccttcctttttttttttttccttttttttcctaggctggaaaaagcccctgaccagcgcactcaacctgcgggccgaagggctgctctccggccagcctgggcgccggggacagcagccggcgcggcgtcctacctggtgaagttcgtcctgccctcggcgtggacccaggccccggtcgccgcccgggagggcaccggcctcgctcgcttgctcgctcgcccgcccttgcccgctcgctccccgcccgccgcctccctcgcgcgcccgctccggtcctccggctcccactacagctcattccaatatggcatcctctctgtgcgcatgctcggcgctcttttttttt

SEQ ID NO: 71681 - DNA, 561 bp, Homo sapiens
  misc_feature 1..561: note = chr10:7453096-7453657
  misc_feature 1..561: note = hyper
  source 1..561: mol_type = genomic DNA
gcgaactccttcaacgaccttttccagcgcttgcaaaatttcttaagccaattagcctgcgggacgtgatcggctccttccccagccagctccgcgccattccctgcgcctaagcaggcgggcacccccaggaccctgggaccttccacgcccacgcggcctcctccccaccgcgctccccttcctcctttttgtgagctccctccatacatgatctgcagaaagttcccatcgcgggcgtttccgcacacccctccgcaaggacaactgggcaaactcccgtttccctggctgcggttcgtgagctgggtttccaatggctcagtcgaccgtgtgcacaaacttgcgctttatccgccggggatcgctgggagcggagataaattcaatccccagggcaatcttggccccgcccgccccaccccatcctgtgcttaaatagagcctttcttgaagctgcgaacatttccaggccccttgggcagggctggaggggccgaggagagctattcgagggaaaggtgccccgaggggcaggaaattaagttggggctgcccggg

SEQ ID NO: 71682 - DNA, 175 bp, Homo sapiens
  misc_feature 1..175: note = chr10:7453902-7454077
  misc_feature 1..175: note = hyper
  source 1..175: mol_type = genomic DNA
cgcagagcccaaacgaaatgtccccagtgcggaaaagccggtgacgccctggtagcaagaccaagagcttccgaagaacgctgcgcccttaactagggggcctcgcagagatgcctgtgtgggcctgcattgtatatttctgcgaaatagcgaatggacacgtttgctcagggtt

SEQ ID NO: 71683 - DNA, 308 bp, Homo sapiens
  misc_feature 1..308: note = chr10:7454305-7454613
  misc_feature 1..308: note = hyper
  source 1..308: mol_type = genomic DNA
acagaggtcctcaggcgggccctctcctggacggtggggccggagctgatctagaagaaatacggagggacgtgccgagaagccgctctccttcgccgcgaccctggagagcgcctctccacccaaaggatctgccgagctgagagatccagggcgggcgtccgcagccgtgaggccccctgcgccgccagtatgggaagatcctgcctccttacaccttggagaacgctgggcgacgactaaagcgccttccgccggcctgtcactccatgtgacacaggagccacgtgagacccagaagagtccag

SEQ ID NO: 71684 - DNA, 185 bp, Homo sapiens
  misc_feature 1..185: note = chr10:7454628-7454813
  misc_feature 1..185: note = hyper
  source 1..185: mol_type = genomic DNA
cgcactttaaactctagcctgagtctgcgacccctccagctctccagtccccagctgttggggacatcaagccggagccctgggctctctgccctgtgggtcgctgaaagcagagactcctcaaaccaaccgaaccgggcgcattaaccctctcgcctgcaccccgctgcctcccggttgagccc

SEQ ID NO: 71685 - DNA, 73 bp, Homo sapiens
  misc_feature 1..73: note = chr10:7454891-7454964
  misc_feature 1..73: note = hyper
  source 1..73: mol_type = genomic DNA
cggtttggccccgggtctcaacacccaagtcgcctcttctggctccttcaccacacagcggggcctgtggaaa

SEQ ID NO: 71686 - DNA, 60 bp, Homo sapiens
  misc_feature 1..60: note = chr10:746643-746703
  misc_feature 1..60: note = hypo
  source 1..60: mol_type = genomic DNA
tgtgtgtgcaggcatcggcgtgcacctgtgcgtggtgtgtgtgcacgcataagcatgcac

SEQ ID NO: 71687 - DNA, 40 bp, Homo sapiens
  misc_feature 1..40: note = chr10:7472551-7472591
  misc_feature 1..40: note = hypo
  source 1..40: mol_type = genomic DNA
gagaaatggacatagcggccgagcacggtggctcacgcct

SEQ ID NO: 71688 - DNA, 352 bp, Homo sapiens
  misc_feature 1..352: note = chr10:7488720-7489072
  misc_feature 1..352: note = hypo
  source 1..352: mol_type = genomic DNA
attttgaaccagcctcgattatggatattcgagttattttcagttactgttcttgctgtggcaaacaatgcagcaatggctttgcttttacatacgtctttatgcgcattttcagcatatctgcagaataaattcctaaaactgaaattgctggatcaaagggcgtattcattttctaatttcgttagatatcaccaaataacactctatcttaacacgaaacaaacacttgcaaggatgctgtgctaatttacactctcatctaccgtgcacttgagtgttggtttctcatgcccttgctagcacctaactttgtcaaggtgattggtaaaaaaaccgtgtctcagttcca

SEQ ID NO: 71689 - DNA, 30 bp, Homo sapiens
  misc_feature 1..30: note = chr10:7498536-7498566
  misc_feature 1..30: note = hypo
  source 1..30: mol_type = genomic DNA
cccactcacccctgacgacacacacctgcc

SEQ ID NO: 71690 - DNA, 23 bp, Homo sapiens
  misc_feature 1..23: note = chr10:75011146-75011169
  misc_feature 1..23: note = hypo
  source 1..23: mol_type = genomic DNA
tctttgagatggaatcgccctct

SEQ ID NO: 71691 - DNA, 23 bp, Homo sapiens
  misc_feature 1..23: note = chr10:75011409-75011432
  misc_feature 1..23: note = hypo
  source 1..23: mol_type = genomic DNA
attacaggcgtgagccaccgtgc

SEQ ID NO: 71692 - DNA, 30 bp, Homo sapiens
  misc_feature 1..30: note = chr10:7505493-7505523
  misc_feature 1..30: note = hypo
  source 1..30: mol_type = genomic DNA
gtggagacggctgtgcgtgtctcctcctct

SEQ ID NO: 71693 - DNA, 32 bp, Homo sapiens
  misc_feature 1..32: note = chr10:75118507-75118539
  misc_feature 1..32: note = hyper
  source 1..32: mol_type = genomic DNA
caaccaactacctctcgcgagaacttactttt

SEQ ID NO: 71694 - DNA, 153 bp, Homo sapiens
  misc_feature 1..153: note = chr10:75384262-75384415
  misc_feature 1..153: note = hypo
  source 1..153: mol_type = genomic DNA
gccaaaaagccattattctaattaatgcatttgtgaacctcaacataaaaaaatccagttatataatcacaagagagttatccctttcaaatgtatacctacaaaagatagaaaaatgatcagaaaacttgtatctgtcgattgaaataaatt

SEQ ID NO: 71695 - DNA, 15 bp, Homo sapiens
  misc_feature 1..15: note = chr10:75407398-75407413
  misc_feature 1..15: note = hyper
  source 1..15: mol_type = genomic DNA
cagattctgcacccc

SEQ ID NO: 71696 - DNA, 209 bp, Homo sapiens
  misc_feature 1..209: note = chr10:75407477-75407686
  misc_feature 1..209: note = hyper
  source 1..209: mol_type = genomic DNA
cgtctcctcctttcccggccggaacatctgcttccgggtcccccggcgccgggcctcctgcaggatacccgtgcgggcagctggcacagagatgcgctgctcgcgagcgctggggggctcaggagcccctgggcctggggcaggcgcctctgggcgcgcagagggtcgcaaaggcgcagataggaagatagaagcggtggaggtcatgg

SEQ ID NO: 71697 - DNA, 36 bp, Homo sapiens
  misc_feature 1..36: note = chr10:7542725-7542761
  misc_feature 1..36: note = hypo
  source 1..36: mol_type = genomic DNA
agaatcggctgggcacggtggctcacacctgtaatc

SEQ ID NO: 71698 - DNA, 22 bp, Homo sapiens
  misc_feature 1..22: note = chr10:75488953-75488975
  misc_feature 1..22: note = hypo
  source 1..22: mol_type = genomic DNA
gcaatatctagaggccgggcac

SEQ ID NO: 71699 - DNA, 84 bp, Homo sapiens; identical to SEQ ID NO: 42616
  misc_feature 1..84: note = chr10:75501525-75501609
  misc_feature 1..84: note = hypo
  source 1..84: mol_type = genomic DNA

SEQ ID NO: 71700 - DNA, 37 bp, Homo sapiens
  misc_feature 1..37: note = chr10:75633031-75633068
  misc_feature 1..37: note = hypo
  source 1..37: mol_type = genomic DNA
aacagatgtgggtggcgtgccgcgctcccaccccctc

SEQ ID NO: 71701 - DNA, 30 bp, Homo sapiens
  misc_feature 1..30: note = chr10:75670725-75670755
  misc_feature 1..30: note = hyper
  source 1..30: mol_type = genomic DNA
ccctccgctggagatcgcgcttcccccaaa

SEQ ID NO: 71702 - DNA, 78 bp, Homo sapiens
  misc_feature 1..78: note = chr10:75808858-75808936
  misc_feature 1..78: note = hypo
  source 1..78: mol_type = genomic DNA
catctcaaaaaaacaaacaaacaaacaaacaaacaaaaacttaattgagcatatttaagttcacgtgtataataatat

SEQ ID NO: 71703 - DNA, 224 bp, Homo sapiens
  misc_feature 1..224: note = chr10:75832369-75832593
  misc_feature 1..224: note = hypo
  source 1..224: mol_type = genomic DNA
aaataagtgagcaatcggtttgaactttcatagtatttcataatggatttagactgagaaagccagacccgggattgtttcactactcaccctgcacaatttcttctttgtgccccaggaatgactaagatggccaagatgattgacgagagacagcaggagctcactcaccaggagcaccgagtgatgttggtgaactcgatgaacaccgtgaaagagttgct

SEQ ID NO: 71704 - DNA, 30 bp, Homo sapiens
  misc_feature 1..30: note = chr10:75966942-75966972
  misc_feature 1..30: note = hypo
  source 1..30: mol_type = genomic DNA
gaacccacgtctggacgaggataatatggt

SEQ ID NO: 71705 - DNA, 156 bp, Homo sapiens
  misc_feature 1..156: note = chr10:7608010-7608166
  misc_feature 1..156: note = hypo
  source 1..156: mol_type = genomic DNA
tgctggaaaggccctcgctgttggcaatgtagaaacccaggtggtgtcgctggaagggcgccggctttttgtagaggtggatgaggatgacaaaggctatggagccctggatggtgacggtgacattggcgttggcagacacggacacctccagcc

SEQ ID NO: 71706 - DNA, 30 bp, Homo sapiens
  misc_feature 1..30: note = chr10:7641473-7641503
  misc_feature 1..30: note = hypo
  source 1..30: mol_type = genomic DNA
tggattctagatccccgcatgtttcattgt

SEQ ID NO: 71707 - DNA, 30 bp, Homo sapiens
  misc_feature 1..30: note = chr10:76511158-76511188
  misc_feature 1..30: note = hypo
  source 1..30: mol_type = genomic DNA
aacactccagtttcccgggaacacaccggc

SEQ ID NO: 71708 - DNA, 30 bp, Homo sapiens
  misc_feature 1..30: note = chr10:7673219-7673249
  misc_feature 1..30: note = hypo
  source 1..30: mol_type = genomic DNA
gtggattctaacgggcggcaaagtttggga

SEQ ID NO: 71709 - DNA, 36 bp, Homo sapiens; identical to SEQ ID NO: 42617
  misc_feature 1..36: note = chr10:76784730-76784766
  misc_feature 1..36: note = hypo
  source 1..36: mol_type = genomic DNA

SEQ ID NO: 71710 - DNA, 21 bp, Homo sapiens
  misc_feature 1..21: note = chr10:7678984-7679005
  misc_feature 1..21: note = hypo
  source 1..21: mol_type = genomic DNA
gcctggcgacagaggacttcg

SEQ ID NO: 71711 - DNA, 33 bp, Homo sapiens; identical to SEQ ID NO: 33144
  misc_feature 1..33: note = chr10:76803629-76803662
  misc_feature 1..33: note = hyper
  source 1..33: mol_type = genomic DNA

SEQ ID NO: 71712 - DNA, 30 bp, Homo sapiens
  misc_feature 1..30: note = chr10:7698170-7698200
  misc_feature 1..30: note = hypo
  source 1..30: mol_type = genomic DNA
ggaaagtgatgaaatcgtctttttttagac

SEQ ID NO: 71713 - DNA, 35 bp, Homo sapiens; identical to SEQ ID NO: 42430
  misc_feature 1..35: note = chr10:769828-769863
  misc_feature 1..35: note = hypo
  source 1..35: mol_type = genomic DNA

SEQ ID NO: 71714 - DNA, 23 bp, Homo sapiens
  misc_feature 1..23: note = chr10:76997760-76997783
  misc_feature 1..23: note = hypo
  source 1..23: mol_type = genomic DNA
accgcacccggccaagaatccat

SEQ ID NO: 71715 - DNA, 212 bp, Homo sapiens; identical to SEQ ID NO: 42619
  misc_feature 1..212: note = chr10:77022117-77022329
  misc_feature 1..212: note = hypo
  source 1..212: mol_type = genomic DNA

SEQ ID NO: 71716 - DNA, 447 bp, Homo sapiens
  misc_feature 1..447: note = chr10:7708410-7708857
  misc_feature 1..447: note = hyper
  source 1..447: mol_type = genomic DNA
agactgccccccacgcgtgataaggaaaaaaccttgtaattataataacttttggagctacctcagaaattaacaacgacgaacagaaatctgcgcaatcaacaggagccaagaagaaaaactcggctccgcaggacaagtcccgggcacagttctgcaggaagcctcaggccagatcaggcaccgcggctcacacagaggtgacgcacgagtgacccacagagagggacccctgggcctctggtgggggcctgggagacggtcgaagggggcccgggcagaagctccgcggccgggccggcggagggaagggggcggccgcgcccgggacccggctcccctcggctccacttacctgctccgaagagtggccccagctctgcgcctcttcctgcgaccccacacacagggacagccccaggcacagccccagcagcaggagcatgg

SEQ ID NO: 71717 - DNA, 35 bp, Homo sapiens
  misc_feature 1..35: note = chr10:7708954-7708989
  misc_feature 1..35: note = hyper
  source 1..35: mol_type = genomic DNA
cgcggtcccagcccggaccccgcccaccccacgga

SEQ ID NO: 71718 - DNA, 66 bp, Homo sapiens
  misc_feature 1..66: note = chr10:7709654-7709720
  misc_feature 1..66: note = hyper
  source 1..66: mol_type = genomic DNA
cagtcccaccagagccgcgcctccagcccccagtgctgggctagctctgttcggggagaaggcatt

SEQ ID NO: 71719 - DNA, 90 bp, Homo sapiens
  misc_feature 1..90: note = chr10:77159927-77160017
  misc_feature 1..90: note = hyper
  source 1..90: mol_type = genomic DNA
tcgacttgtcctccacgccgatgtcgctcagcttcagggggcccgatttggtgtccttgtcgcccgcagcaccgccgccggcaccgcccg

SEQ ID NO: 71720 - DNA, 374 bp, Homo sapiens
  misc_feature 1..374: note = chr10:77161032-77161406
  misc_feature 1..374: note = hyper
  source 1..374: mol_type = genomic DNA
gggacgagcctgggccggggccggagctatttccagagagcgcgctggtccaggcagggtctgcaccgccgcctccgcctccgccgccgccgccgccgctgtgcttactgcttcttagggcagaaagcgagggcgctgtgctcatgacccacccgcgcgcatgggagcagcgggggggagggctccgggaggcgcggggcgggctcggggctgcgcgctcgccccgggagcaggagcagcgggaggaggaggagctggcgcggcggccacgggcgcccagcgcgccttctcggcgcctggagccagacgcgagtaatcctgggtggcccgcagcggagccgtggccgggctagaggagccggctggactgcggg

SEQ ID NO: 71721 - DNA, 68 bp, Homo sapiens
  misc_feature 1..68: note = chr10:77161623-77161691
  misc_feature 1..68: note = hyper
  source 1..68: mol_type = genomic DNA
ggatgtgacgcgtcccgcgccgccgccgccgccgctgccaggactctcagtgccggttttaatgggca

SEQ ID NO: 71722 - DNA, 632 bp, Homo sapiens
  misc_feature 1..632: note = chr10:77162706-77163338
  misc_feature 1..632: note = hyper
  source 1..632: mol_type = genomic DNA
tcggtctgttggggtcgcggagttcgggcgcggctccgggtacccgagaccagcggcggcaacttctaacacgggagatttcccgccaccccaccccgccgccgcgagtcctcgcggggcgtgttgcgtgcggaggtcaggctgccaccctctgtagttccctaaccccaaactcggagacttctaagagccacaccaccaaggaacttctagtcctggaggtcaatggtggggcaaacctcgcctcaattctttgaccccctcgggtcgtaagcagggctaagaggctgcgaagaagaggcctggccatgggtgtatgggggaagaaacatctcaggctcactcatgccccctccccgaccttctcccacctgccgccatccccgcaggctggggagccagggtaactcggggctgctctctcgaatttattggaacgccgagtcggaatgagctgcgctaggagagccgagggaaggagcgagagagggagggggcggctgcctgtgggaacgcgggttcttccagggaagcggagcgggactgccgcgttcccctcgatttgcaccgtcactcgggttgtttgggaagaaaaggggaggcgctgtgcgtgccaccgggtacctggacct

SEQ ID NO: 71723 - DNA, 64 bp, Homo sapiens
  misc_feature 1..64: note = chr10:77163662-77163726
  misc_feature 1..64: note = hyper
  source 1..64: mol_type = genomic DNA
tgagccgggtgcgcgcgggggtcgggtctggaactgcccttggtatgctcgccctctcctcttg

SEQ ID NO: 71724 - DNA, 123 bp, Homo sapiens
  misc_feature 1..123: note = chr10:77169095-77169218
  misc_feature 1..123: note = hyper
  source 1..123: mol_type = genomic DNA
ggcctctcccctgcccgcctggcccaggaggcgcccacacctgcgccctcacttgccgagacttttacctgtgcagtccccggcggcgcctgcagccgcgcaggtaaccgagaaatggaaggg

SEQ ID NO: 71725 - DNA, 520 bp, Homo sapiens; identical to SEQ ID NO: 33148
  misc_feature 1..520: note = chr10:77191185-77191705
  misc_feature 1..520: note = hyper
  source 1..520: mol_type = genomic DNA

SEQ ID NO: 71726 - DNA, 58 bp, Homo sapiens; identical to SEQ ID NO: 42508
  misc_feature 1..58: note = chr10:7765067-7765125
  misc_feature 1..58: note = hypo
  source 1..58: mol_type = genomic DNA

SEQ ID NO: 71727 - DNA, 30 bp, Homo sapiens; identical to SEQ ID NO: 42509
  misc_feature 1..30: note = chr10:7780425-7780455
  misc_feature 1..30: note = hypo
  source 1..30: mol_type = genomic DNA

SEQ ID NO: 71728 - DNA, 30 bp, Homo sapiens
  misc_feature 1..30: note = chr10:7786837-7786867
  misc_feature 1..30: note = hypo
  source 1..30: mol_type = genomic DNA
ttggaagaagcatcccgtcaatgttgactt

SEQ ID NO: 71729 - DNA, 30 bp, Homo sapiens
  misc_feature 1..30: note = chr10:77892448-77892478
  misc_feature 1..30: note = hypo
  source 1..30: mol_type = genomic DNA
tcggagtacgagtatcggaggaacaatgag

SEQ ID NO: 71730 - DNA, 187 bp, Homo sapiens; identical to SEQ ID NO: 42620
  misc_feature 1..187: note = chr10:77893300-77893487
  misc_feature 1..187: note = hypo
  source 1..187: mol_type = genomic DNA

SEQ ID NO: 71731 - DNA, 16 bp, Homo sapiens
  misc_feature 1..16: note = chr10:78601007-78601023
  misc_feature 1..16: note = hypo
  source 1..16: mol_type = genomic DNA
ccgccgatgtacatct

SEQ ID NO: 71732 - DNA, 2025 bp, Homo sapiens
  misc_feature 1..2025: note = chr10:79396631-79398656
  misc_feature 1..2025: note = hyper
  source 1..2025: mol_type = genomic DNA
gagcggtgcaaaacacgcacccagctgcccccagcttcctccgtccccgctgagttggctgtccccaccccgcaccacggcacccgagcctgtgagtccccgaccccggccccagccgcagccgccaacaaccctacaataaacaagaggacaggattgagcgtccgcgtcccggagcgcactggctgggggcaactcctcacccccggcgcgccgcccgctgccccgatccgagagcaccgggagagccgagggaagggaaggcggcgaggggaaggcaggcggggatggagggaggcacggcgcggcgcggagcgaggaggtgggctgcaggggacgccgagaagcggtggggctggcgcagagggcgggcgcccggggcgcgcgttaccttcgtcttgcccccgcagtggcagcacacggtccacaggtacttgagcgtccgccagagcaagatgatgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcggggtgcgccgagatatatacagcgagccgccgccgcccgcccgggggggagggggatggagtgcgcgggcagctccccctccccggcccgcgccccgctcgccccgggctgcgctggccccgagcgccgagagccagggggcgccgcgggccgcccgcgcccggggtctgcgccgcccccgggcccgccccggctccgcgcgcggtcccgggtgtcctcggcgccgcgccgcccgccgtgcgccacgggtgtgcgctgcgctcggccggtgacccccttccccgagcgcctcccgcgcggctaacgagccgctctccgcttattaggtggtaactcgttaataatggataatcggccccctccgcccgggcgcccctgcgccagccctcctcccccggctgcgctcggctccggctcgccgcgccagtgcgcgcccggccgcggcaggttcaccgcgtccggccgccggcccgtggccgcctgctagcccatgttctcgggaccccctagtcctgtcgccacgccgctgagcccctcggcctccgctcgctcttcctccttgccgcctccgactcctcctcgtccccgtcctcgccgcccaagcctcttcggcgcgcgccccgcgctccccgcagccgccagcagcagcagctgcagcaactggagcgggcgcggactcaggacgacccaggcgggaggggaggaggctcgccgcgctggctcgcctgggctccgggctgggcaggggtgggcagggcccctcggcagcggcccggcaagcgcccctgacccccagggcgcaaggtagagcgcccccagcccaggcgcggggccaggcgcctctctccaaggtgctgcgcccccagccgagagcggtggggtacactgggaggacggcggggcgccccggtcaggccgtttttttccccaaagagcccccagtggggaggggaggagtggccagctgtcaactggattccacaggctgagctccccaggaccctcgggcttcgggagtgaggaggaccccacgccaggatacacacagctacccacccctacttcgctcttcctgctac

SEQ ID NO: 71733 - DNA, 146 bp, Homo sapiens; identical to SEQ ID NO: 33151
  misc_feature 1..146: note = chr10:79470925-79471071
  misc_feature 1..146: note = hyper
  source 1..146: mol_type = genomic DNA

SEQ ID NO: 71734 - DNA, 178 bp, Homo sapiens
  misc_feature 1..178: note = chr10:79491986-79492164
  misc_feature 1..178: note = hypo
  source 1..178: mol_type = genomic DNA
agtgtctgctgtgaacgaaagtgaagacggcaggatcccgagtcattaatttgaagctcgctaacaacaccacagtgaaagccacagtcatatctgctgcctctgtccagagcgccagcagcgccatcattaaagccgccaacgccatccagcagcaaactgtcgtggtgccggcacc

SEQ ID NO: 71735 - DNA, 30 bp, Homo sapiens
  misc_feature 1..30: note = chr10:79661214-79661244
  misc_feature 1..30: note = hypo
  source 1..30: mol_type = genomic DNA
acccatctggactaacgccggtgtcaggaa

SEQ ID NO: 71736 - DNA, 34 bp, Homo sapiens; identical to SEQ ID NO: 42510
  misc_feature 1..34: note = chr10:7985160-7985194
  misc_feature 1..34: note = hypo
  source 1..34: mol_type = genomic DNA

SEQ ID NO: 71737 - DNA, 30 bp, Homo sapiens; identical to SEQ ID NO: 42511
  misc_feature 1..30: note = chr10:8025070-8025100
  misc_feature 1..30: note = hypo
  source 1..30: mol_type = genomic DNA

SEQ ID NO: 71738 - DNA, 30 bp, Homo sapiens; identical to SEQ ID NO: 42512
  misc_feature 1..30: note = chr10:8067803-8067833
  misc_feature 1..30: note = hypo
  source 1..30: mol_type = genomic DNA

SEQ ID NO: 71739 - DNA, 197 bp, Homo sapiens
  misc_feature 1..197: note = chr10:80683494-80683691
  misc_feature 1..197: note = hypo
  source 1..197: mol_type = genomic DNA
attcgtcaaggtaatcgtgctccttctgcccatcagacagatttattaggagcagcagcaggagcccatcagagcccagtcacagcacccccccactcccatcaatcccaacacagggcgggcgagagacagaatatatgtaaggtcatttggagatggaaaaaaatcattcacagcactcccgaaatagccgatct

SEQ ID NO: 71740 - DNA, 15 bp, Homo sapiens
  misc_feature 1..15: note = chr10:8075930-8075945
  misc_feature 1..15: note = hyper
  source 1..15: mol_type = genomic DNA
gctggcagccaactt

SEQ ID NO: 71741 - DNA, 124 bp, Homo sapiens; identical to SEQ ID NO: 3501
  misc_feature 1..124: note = chr10:8076053-8076177
  misc_feature 1..124: note = hyper
  source 1..124: mol_type = genomic DNA

SEQ ID NO: 71742 - DNA, 1034 bp, Homo sapiens
  misc_feature 1..1034: note = chr10:8076340-8077374
  misc_feature 1..1034: note = hyper
  source 1..1034: mol_type = genomic DNA
cggtccctgggggcggggctctggcacgagggggaccctcccgggtcaagttcacagaggcggaggggcctgggctgcgccccagagccccagggggtcctctgctcccataaaaaacaaagacgggggcggcggagggtgtggaaggaaagaaattgaaaagggagtgcgggcgactgagggaagctggaggggaaataggggcctcggccaccagtggcctatgtccataactgccctttggttttggtggccttgcaggccgggaatcgagtctgccatgttcgctttcagacgggcctcctggcaagctcttggttgactgtccccagatgttccgggaacccacccctcccccacaccctcccgccccaaccctccgcagagaagccgaggaccacatccatccgcttcctaggaacctgcccgcaccagcaggccctgtttcctggacaaactgggcaaagaaacctaagaaccgcgcgatcccggcaggtggctttctgcggagccagggctgccagcgcggccgggcggcgcctcgggacccggcctggcatccgcgggcgcccggggagggccttggcgtcggcgggggtgggggtgggcggcagatccgaagcagggtcggggaaaaacggcgttgcgggagggttggggggtggcctctgaggaagtgggacaaaaggctttatttcagaaggtacgccaggaaaggggcgtgggtcaccaagtcctgcgcagcagagttggcgcggcctgggagccggggtcccttctgaccacagacgtggccaccgcctcttctcatcccgaaggtcccagccatcccgaggtggtcagagaagaccccgacgggcggatcgggcagtggagagacccgtggtcctcgcgcctgctgtgtcgctgtgtcaatgaccgtgacactcagggcaatccttaccaacacagagcaggacaacgataccccgcacccccccgtacaagtgcaaactagtttctgtgttgggggaaaaaagcgaataaaagtttaa

SEQ ID NO: 71743 - DNA, 369 bp, Homo sapiens
  misc_feature 1..369: note = chr10:8077874-8078243
  misc_feature 1..369: note = hyper
  source 1..369: mol_type = genomic DNA
gtccctcctgcctcccggggggacccctgttccgctgcccgtctcctccccggcacccaactgcggggcacgcgcccgttgctcggccctaaaggggcctagagctgcgccccgggggcgcggaaggtgcggggagagggggtgaggaaggacagtgaggggccggtcctgggcccggaggactcagcagccgccttggcagcaaatcctgtaggctgtcccctgccttggttgtctcgatgttccgctcagcgctggggaaataaatcgaacctggtgcacacccctcccccaggttgtaacacaactgcccccccagccaacacacacgcccaagcacgcagactttgcacacgtgacatgggggtc

SEQ ID NO: 71744 - DNA, 63 bp, Homo sapiens
  misc_feature 1..63: note = chr10:8078628-8078691
  misc_feature 1..63: note = hyper
  source 1..63: mol_type = genomic DNA
ggtggggaagctcagcggctctctctgcccgggtttctggccagcccccgagggccaggctag

SEQ ID NO: 71745 - DNA, 30 bp, Homo sapiens
  misc_feature 1..30: note = chr10:8079285-8079315
  misc_feature 1..30: note = hyper
  source 1..30: mol_type = genomic DNA
agtccagcctgaaaccgaagcctcttgaaa

SEQ ID NO: 71746 - DNA, 30 bp, Homo sapiens; identical to SEQ ID NO: 32867
  misc_feature 1..30: note = chr10:8079721-8079751
  misc_feature 1..30: note = hyper
  source 1..30: mol_type = genomic DNA

SEQ ID NO: 71747 - DNA, 42 bp, Homo sapiens
  misc_feature 1..42: note = chr10:8083222-8083264
  misc_feature 1..42: note = hyper
  source 1..42: mol_type = genomic DNA
tacagttcttggtcccggaaatgtagtcgtagtcatggtcct

SEQ ID NO: 71748 - DNA, 449 bp, Homo sapiens
  misc_feature 1..449: note = chr10:8085599-8086048
  misc_feature 1..449: note = hyper
  source 1..449: mol_type = genomic DNA
ttctccctgggtcctcaaaacgcgccaagaacgtggctctgccacttggtggcggaaggcgggaggcacagggcaggaaggtggaggaggggctgcattcgtgacgacgggggagcagagagggaaggacttagggactccccagagggcagacagacctggccagcttggcaaatcataaatccctctccctggaccctcggcctaaacctacccccagggtgtgcagcggaggcgcacaggggttggctgacgggctggggtgcgcctgggtggaggctggtttggggttctggcgtctggaggcaggccatggaaccagaggagagggcaggagggcccaccgcgcagagctgcggcccggctcctagagtggcgcccccagcctgggcatcgcgctcaactgctctctgaaccccatgtccacgagggttcgccctcaaaccacc

SEQ ID NO: 71749 - DNA, 55 bp, Homo sapiens
  misc_feature 1..55: note = chr10:8086685-8086740
  misc_feature 1..55: note = hyper
  source 1..55: mol_type = genomic DNA
ttcttatgcctactccgaggagggtcagagggtagcagcccgtcacccagcatcc

SEQ ID NO: 71750 - DNA, 359 bp, Homo sapiens
  misc_feature 1..359: note = chr10:8087043-8087402
  misc_feature 1..359: note = hyper
  source 1..359: mol_type = genomic DNA
cctgccagaagacagcgggctgtgcaggcgccaggggccggtcacatttcaggccgcctttccccacccccgccagatctgtcagtttcacacacccctgatgtgcggtttgcctgtttgcaaaagggggtgaaattcattccctcgctgtttctccttccctccctccctttccctcttcgcaacccggaagagctccgctctctacagtgagcaggagaaggcggaggggagggggctcccaggaagaacgtacatcgcccaggttttacctctcgctggaagcccgcctgagatgcggtgagcagttccagcggccaggacggcagcggcggccacagtggcgaactctgcctgtc

SEQ ID NO: 71751 - DNA, 334 bp, Homo sapiens
  misc_feature 1..334: note = chr10:8090424-8090758
  misc_feature 1..334: note = hyper
  source 1..334: mol_type = genomic DNA
cggaggagaggtcgggtctagaagtagcaagcccctggctaggagtcactgatgccactgggggcagggtaagatgtccaaagcccgggagacccagggacgccggctgggctgcctccaccccttcttttcctcccgtggcacccacctgtccccccacctgccaaggccaggagggagggagagagctgaaaagggcacttttcctccagggtgactccaattcctttccactcaccctcaaggcgagttccttctctcccacccaacccggggctccccccaactgccactcgcctcacgtgtgagttgttaaacccgaaagcagaaatcc

SEQ ID NO: 71752 - DNA, 99 bp, Homo sapiens
  misc_feature 1..99: note = chr10:80909885-80909984
  misc_feature 1..99: note = hyper
  source 1..99: mol_type = genomic DNA
gagccagggatgaggcgaaacccaaccctggcctggccccgggccgcagccgtgcaggtcactaggcctcggcgagtggccacccgcccacccaacagg

SEQ ID NO: 71753 - DNA, 639 bp, Homo sapiens
  misc_feature 1..639: note = chr10:8091359-8091998
  misc_feature 1..639: note = hyper
  source 1..639: mol_type = genomic DNA
gtattgcccactgcccgactgccttttcttcccgtttaggtcttgctccccgctctccgcatttcagctcgcaagggaaagaaaacgggggcccgagtggcagagacagagataatatgtatttaacctgcgcggtccggggcgccctgccgcagcgggctccccgcggtgtggcccgcgcagccggggccagcggcggcgcctggagccgtgtccccggcataaccctcccgcccggcagccggcgagctgtttatacagctttacctgtgctatagtcctatccagtagaaacccttgcgcggccagggtaacctaatccaggggccgaggcggaggagggggcggtgaggctggctgggttggagacggaggtgtgcgcgctccaatacccgggatctctcctttgcccctcctcccaccatagggaaggaaatatggacatggttcgggtgacagaaatggggacccggggctaaggaggaaggaggccagttttcacggcccggtcctccggcttctctcctttgaacaggcgctggggacctccgcggcggccacagctggacgcgcgccgcgaaaggcgcggcggtcccgcgggcgcccggcgtgggctagagaggccggccctggcctggc

SEQ ID NO: 71754 - DNA, 89 bp, Homo sapiens; identical to SEQ ID NO: 32874
  misc_feature 1..89: note = chr10:8092446-8092535
  misc_feature 1..89: note = hyper
  source 1..89: mol_type = genomic DNA

SEQ ID NO: 71755 - DNA, 104 bp, Homo sapiens
  misc_feature 1..104: note = chr10:8093360-8093464
  misc_feature 1..104: note = hyper
  source 1..104: mol_type = genomic DNA
tcgcctgctcggctgcgggatgcttgctcccaaggtcccaggcgtccaggttgatcgccagccccttaccctggtgagggaggccttgcgccctgcagaagccc

SEQ ID NO: 71756 - DNA, 303 bp, Homo sapiens
  misc_feature 1..303: note = chr10:8093522-8093825
  misc_feature 1..303: note = hyper
  source 1..303: mol_type = genomic DNA
cgagctccgccggctgctccttgggaggaaggggactcgctagaccaggccgaggcccaggtacctgggagggggtcgcgtcaggtctgcgggaaggcgctcaggcttctccgcaggaggccaggatcagctttgtggcggtggcacagggagaatcaggaccacctttcccccttacccccggccaggatccccctttccctcccccgcccgccaagggaggaggaagcccggcctgctcttgccggcgaggcgggtcaggccggcgcctggcctggcccggacccccgcagcccggctctc

SEQ ID NO: 71757 - DNA, 105 bp, Homo sapiens; identical to SEQ ID NO: 10171
  misc_feature 1..105: note = chr10:8093859-8093964
  misc_feature 1..105: note = hyper
  source 1..105: mol_type = genomic DNA

SEQ ID NO: 71758 - DNA, 15 bp, Homo sapiens
  misc_feature 1..15: note = chr10:8094243-8094258
  misc_feature 1..15: note = hyper
  source 1..15: mol_type = genomic DNA
gcccttctccatccc

SEQ ID NO: 71759 - DNA, 261 bp, Homo sapiens; identical to SEQ ID NO: 32879
  misc_feature 1..261: note = chr10:8095198-8095459
  misc_feature 1..261: note = hyper
  source 1..261: mol_type = genomic DNA

SEQ ID NO: 71760 - DNA, 197 bp, Homo sapiens
  misc_feature 1..197: note = chr10:8095492-8095689
  misc_feature 1..197: note = hyper
  source 1..197: mol_type = genomic DNA
cgcggctcggccacagcctcgcccgctgattggtccctccaggccccgcccccgctcgccccgcccctctcgctggggcgcctcggagccgcgtgccctccgccccggggtgcccattgcgcagagcgtggcctggagacccgcgagccggggaaggtcgccgtggagtcccgaccagaggccggggttggggtcgg

SEQ ID NO: 71761 - DNA, 1593 bp, Homo sapiens
  misc_feature 1..1593: note = chr10:8095944-8097537
  misc_feature 1..1593: note = hyper
  source 1..1593: mol_type = genomic DNA
ctgcaacagctgaagcgtgttcactctgggggcttgagagcgcagaaggctcgggaaagaggtgacaatgacaacaaaattgacgcggacgctccagtcaaaggcatctcccctttatccgatgactcaccctcttaggaagtcggcccgagaggcaaatctcaaaataccttgacatgaaacattttgtttttctgatcaatttaacgcgcacgtttccccacatcgatgcgctctcccaaacaccctgcattagatcctaataatgatccatgcgtgcctattttttaaaagtctgaaaaagaaaattctgcccatcgaaatgaacttcatgaatggggcaggctggctgcaccgggacggaatcgtccacccgacccgaatgaattggcaggagccgcggccacatttaaagggccagagcgcgcgttccctcccgtccgcccccaagccccgcgggcctcgcccaccctgcccgccgcccctccgccggcggccgccctctgcggcgcccctttccggtcagtggaggggcgggaggaggggcgggggtgcgcggggcggggggagaagtcctggagcgggtttgggttgcagtttccttgtgccggggatcctgtcccctactcgccagcgccaggctcctcccccccggcgcggatgacactagaacctccttaagttgcgtcgcgccacagctgtctgcgaacactgagctgcctggcgccgtcttgatactttcagaaagaatgcattccctgtaaaaaaaaaaaaaaaatactgagagagggagagagagagagaagaagagagagagacggagggagagcgagacagagcgagcaacgcaatctgaccgagcaggtcgtacgccgccgcctcctcctcctctctgctcttcgctacccaggttggtactggtgactttttttttttttaagtttgattttttgcccccaaccacttgggaggacctaaatcaattttaaaaactcaactctcctcttttggaggttttctaggggctgagaggacggtcccgggaccggtgtccccgagggagggacttgccctccaagtcgtaacagtcagccctgggacttgccctccaagttgctcagccagccccggctcccgcgagccgggctgcagggacgtccccgagagccctgcgggctccgcggccgtgtccccgcgctcccgtgcgggtctcgggtgcgctgggcgggcgggcggcgcgaggggaggttgtgccactccagcaactcaggggctcatccaggtctcccattctctcccttgcaggtgacccgaggagggactccgcctccgagcggctgaggaccccggtgcagaggagcctggctcgcagaattgcagagtcgtcgcccctttttacaacctggtcccgttttattctgccgtacccagtttttggatttttgtcttccccttcttctctttgctaaacgacccctccaagataatttttaaaaaaccttctcctttgctcacctttgcttcccagccttcccatccccccaccgaaagcaaatcattcaacgacccccgaccctccgacggcaggagccc

SEQ ID NO: 71762 - DNA, 40 bp, Homo sapiens
  misc_feature 1..40: note = chr10:81024063-81024103
  misc_feature 1..40: note = hypo
  source 1..40: mol_type = genomic DNA
ggcatttggcactcacgcctcaccacggacactggtgcat

SEQ ID NO: 71763 - DNA, 30 bp, Homo sapiens
  misc_feature 1..30: note = chr10:81037768-81037798
  misc_feature 1..30: note = hypo
  source 1..30: mol_type = genomic DNA
tttgcagtcagagctcggctctcattatcc

SEQ ID NO: 71764 - DNA, 139 bp, Homo sapiens
  misc_feature 1..139: note = chr10:81070800-81070939
  misc_feature 1..139: note = hypo
  source 1..139: mol_type = genomic DNA
ccttcccagcctccccggcagccgccacaggccgctcccagcagccatccacacagcgacctgacctttaacccctcctcagccttagagggtcaggccggagcgcagggagcgtccgacatgccggagccttcgctgg

SEQ ID NO: 71765 - DNA, 51 bp, Homo sapiens
  misc_feature 1..51: note = chr10:81206300-81206351
  misc_feature 1..51: note = hyper
  source 1..51: mol_type = genomic DNA
gctccagccctagcccgccccggtgccttggcgagtcgccaggacaccagc

SEQ ID NO: 71766 - DNA, 30 bp, Homo sapiens
  misc_feature 1..30: note = chr10:81206959-81206989
  misc_feature 1..30: note = hypo
  source 1..30: mol_type = genomic DNA
agttattaatacaaacgacagcatatgtat

SEQ ID NO: 71767 - DNA, 636 bp, Homo sapiens
  misc_feature 1..636: note = chr10:81664437-81665073
  misc_feature 1..636: note = hyper
  source 1..636: mol_type = genomic DNA
ttctggcttttgcaccgcaccaactaatccgcgccaggccgcacagctgctctggccttcggggaggactcctggagcgcggtgtacactgctccggagtccctccgcaggagttgaggcagcgagttccgagggcggggtggggcggaatccggaggcacgcggacccggtggaacgcactgcgcagacggcgccggcgcctgcactcagctgttgacgagtctttcttccagctctaccctgaaagtcctccaggcaccggtcttttttttctgccttttgtttccctcccggcgagtcggcgcgacagtgaatttccgtttcccgcggtgtccaagcggacctgaggagttgcagctgtgagcaggttcggtggtgccgcgggctggggtaggcggcggtggggtccctggctctggggcactgggaagatcgcgagtcgtgcgcgtgggaaggtcctccggctcatctttgctccccaggagcagcatatttcgcatctgccagaggtgtgcccgggggtcgttgggagagggacggggtgaatccctgcagagagccgggacggggagggaaggtgtcggggagacgtggtttcctggcgacgtggtcccggcaggcgacttagacctgag

SEQ ID NO: 71768 - DNA, 565 bp, Homo sapiens
  misc_feature 1..565: note = chr10:81741366-81741931
  misc_feature 1..565: note = hyper
  source 1..565: mol_type = genomic DNA
ttcgtcctcccctggcgcaccgcccgtttttcctctttctccgttaaaaacaactgggtggctgtgggaagagggaaggtggcgccggcggagtctgggcaggcgcctcccactcagccgccagcagccctgggagccggaggatggctgcggtagcagccacagccccagaggaggcggtgcccgacgcccggggcgcccagcgcgcccagaccggcagtggccttcatggcgcaccagaacctaaaccagaggcagccacacggacacctgagccgcctcttcctgctagagccagcgaggtgtgcccgcagccgagaccccttcctctccacgtctcctcgtctccttgtctcccgtgcccgcgtcaggccgccagcctcgcccacctccccaggaagagcgcgccgggcgccgacttcccctggggcggcggccctggacgtgcggggggtctctctgggccggctgctgcgccttggccctgccctctagctcccgcgctcgctcccgccctcctggctctccgggcgcgcctggcggggcagggcggacatgggcacca

SEQ ID NO: 71769 - DNA, 409 bp, Homo sapiens
  misc_feature 1..409: note = chr10:81892268-81892677
  misc_feature 1..409: note = hyper
  source 1..409: mol_type = genomic DNA
gggcggccccttcctcgggaggcgcccaggtggcacgtcggtgcctcagctcccggggtctctgggctccgcgctgcccacggggtgccgaggggcctctggagggggcgggttctctcgagccagaaagtccggagccgcccaggaattttggctcgaactgagtgcatttcctctcgggccggccgggtgcgatccgggaagggcggctgcgggcagacgcggcgctgcgctcggccaggccggcaccatgcggcccctgctctgcgcgctgaccggactggccctgctccgcgccgcgggctctttggccggtgagtggggcgcagggcgcggcaggggacctggagccggggagacccgcagatggcgaggaaggaatgagcgagagagacggagagagagctgg

SEQ ID NO: 71770 - DNA, 172 bp, Homo sapiens
  misc_feature 1..172: note = chr10:81921303-81921475
  misc_feature 1..172: note = hypo
  source 1..172: mol_type = genomic DNA
tgacccatgcgggagcgcgatttacatctgttgaatgaatgagtaaatgaatggcacccagttttattgttatgactgtttcttatgccaggctttggaaaacactggattgggtgctcccgaaggaccctcccaactctgacgttccacattcccacgtacaaagacacca

SEQ ID NO: 71771 - DNA, 123 bp, Homo sapiens
  misc_feature 1..123: note = chr10:81930494-81930617
  misc_feature 1..123: note = hypo
  source 1..123: mol_type = genomic DNA
tgattcctctggccacgcaggtgtggccccagggctgcctcagcaggagagctggactcaccattcccgagagatagtcctggttgaactgccccgcataggtggccacgttatccagcccga

SEQ ID NO: 71772 - DNA, 259 bp, Homo sapiens
  misc_feature 1..259: note = chr10:819352-819611
  misc_feature 1..259: note = hypo
  source 1..259: mol_type = genomic DNA
gctcagcctggcgagatttcattttattgataaatgtaagtttttgcactgaactaaccccagacttcactaacgtgggtaggaagacatggctcctaggtgtagacgcaacccccagggctcttggacggagatcacgtggaatccagagtccagtgactttggcagtaactgaaatgggatatttaatattcacgcatttatttcacaaatgatcccagtgtgcctgtgtgtgcctgggccccggcagcggccagcc

SEQ ID NO: 71773 - DNA, 25 bp, Homo sapiens
  misc_feature 1..25: note = chr10:81966571-81966596
  misc_feature 1..25: note = hypo
  source 1..25: mol_type = genomic DNA
aacaagctgctggttcgattttcct

SEQ ID NO: 71774 - DNA, 626 bp, Homo sapiens
  misc_feature 1..626: note = chr10:82116580-82117206
  misc_feature 1..626: note = hyper
  source 1..626: mol_type = genomic DNA
ggtgagcagagggcacgcggtgggcagcgaagggggaacgcgcagcagagaggagagggcgtgcaggagtaggagcaggcggcagagtagagggggcgcggcagagtagagggggcgcggcagagtggagggggcgtgcaggagtaggagcccgccgcagagtagagggggcgcggcagagaggagggggcgtgcaggcgcggggcgcccggcagagagaaggggtcgtgcggaagggggcgcgcgccaggggagggggccagagaggagggggcgttcaggagtcgggcctgcggcagagatgaggcggtgtgcaggagggagagcgcgcacgagggggcaacgggcagagaggagagggaatgaaagaaggggagcgtggcagagagaagcgggcgcgctccagggggcggggtccagggaggagggggagcgtaggatcggggcgggaggcagagaggagcgggcacgcgggacgggcgtgtgctcgtgaggggtcgaggaaaggcgtatgtggaggcgcgcggggtgggtgagccgaggagacttgctacacagaaacctggaggagtaggggcacacaaaagagcaagggaccctgactggcagcccggcatgctctggga

SEQ ID NO: 71775 - DNA, 353 bp, Homo sapiens
  misc_feature 1..353: note = chr10:821379-821732
  misc_feature 1..353: note = hypo
  source 1..353: mol_type = genomic DNA
gtggccagctttccacgcatctgtgatgcccggcctcagcccctgtgtccagcgtgagggctggtggctgtggagacggatcgcacgctgggtttagaggcgccagccgctggcagcgccggtgccacaagccctcctgagatattgttggaagagagccttggtgtgcctgcctggcacagagaagcctcctgagaaatgtcagatgagtcatgagtctcagagggggcgggcagccagggaggaagcaaggagcgaaaccaggagggagcccgcaggaagctgggggccgggcaggcaccggggtcagtgcagcgagggtcaggggttgctgggtgcgggcagtgggtgca

SEQ ID NO: 71776 - DNA, 60 bp, Homo sapiens
  misc_feature 1..60: note = chr10:82168049-82168109
  misc_feature 1..60: note = hyper
  source 1..60: mol_type = genomic DNA
ttttgccctaggcagcgccctgaagaacgcgtcggggcctcggttcgcggacttgaggag

SEQ ID NO: 71777 - DNA, 239 bp, Homo sapiens
  misc_feature 1..239: note = chr10:82168477-82168716
  misc_feature 1..239: note = hyper
  source 1..239: mol_type = genomic DNA
gaggcagtgcagggccggtagggtgggtgctgggctggtgaggcgcgcccctcgggcccgcgccaactttcttaggagccgccgcagcgctggcgctccctccgaggacgacgacccttccgccaccctgcgtggcggccgatggaaaaaccctgcgcccagacgtcggagaacggagacggggacccggcgctgctgcggcgggctagggccccctctgtccacgcccgcaagccttg

SEQ ID NO: 71778 - DNA, 50 bp, Homo sapiens
  misc_feature 1..50: note = chr10:82383742-82383792
  misc_feature 1..50: note = hypo
  source 1..50: mol_type = genomic DNA
gtgtactttatttaacgacgggggctgatggctctcggaaggctgatcta

SEQ ID NO: 71779 - DNA, 37 bp, Homo sapiens
  misc_feature 1..37: note = chr10:82573954-82573991
  misc_feature 1..37: note = hypo
  source 1..37: mol_type = genomic DNA
ggaggtgtggagggagaggcaccggtgggaaccgggg

SEQ ID NO: 71780 - DNA, 30 bp, Homo sapiens; identical to SEQ ID NO: 42625
  misc_feature 1..30: note = chr10:82607464-82607494
  misc_feature 1..30: note = hypo
  source 1..30: mol_type = genomic DNA

SEQ ID NO: 71781 - DNA, 49 bp, Homo sapiens
  misc_feature 1..49: note = chr10:830731-830780
  misc_feature 1..49: note = hyper
  source 1..49: mol_type = genomic DNA
gagcttccagcctcccgggtctaggggactgggggatgcgtcttcctcc

SEQ ID NO: 71782 - DNA, 95 bp, Homo sapiens
  misc_feature 1..95: note = chr10:830815-830910
  misc_feature 1..95: note = hyper
  source 1..95: mol_type = genomic DNA
cgtccccggcgtccccgcatcgggcttctctggtcctttgtgaatcgggcctgagtcatccccggctcacggctgcgccacgtacccactgggcg

SEQ ID NO: 71783 - DNA, 197 bp, Homo sapiens
  misc_feature 1..197: note = chr10:833140-833337
  misc_feature 1..197: note = hypo
  source 1..197: mol_type = genomic DNA
gaagaacagacaccacgtgctccctgcctgtgcagagggaaggcgcgaggtggctccaggaaccaggtcggccggcaccttggcccggaacttccagcctccagattgtcagaaacaaatccctggtgtctgcggtgttggggctgacacgcgctctgcctggctgccaggtcctctgcaggcggggacggtgccgg

SEQ ID NO: 71784 - DNA, 510 bp, Homo sapiens
  misc_feature 1..510: note = chr10:83633649-83634159
  misc_feature 1..510: note = hyper
  source 1..510: mol_type = genomic DNA
acacttgccttgtaacgtgtgtacctgtgcgtacatttacaggtaaagacaatattttaaggcaagttcacataaatggcttggagatatctgacaggtctgattatacaaaggtcttctgctccacctgcatctctcaggaactcaggcaaaggtggccttccatccagccgcaccgccatccggcaggggagggcacaggcaccctcccacccgcatccgcccccgccccctcgcccagcagcgtcagtctctgaccccactggatccgtacaggagacgactcacaatcggtcggaagctgcttttgcccccccaccccaccgcaaacgggggtttgcttggatcatttatctatcttgtgtgcattaagaaaccagcattagctgctagtgggaggcgctactctgcccgaatcccagcccgccgcggcgattctgcacacacacacgcaccagcctggcagccagagcccgtctggagacgccctcagcccggggtctgcgttcc

SEQ ID NO: 71785 - DNA, 581 bp, Homo sapiens
  misc_feature 1..581: note = chr10:83634918-83635499
  misc_feature 1..581: note = hyper
  source 1..581: mol_type = genomic DNA
tctcggggggaggggcgtgggggcagggagcggatttgcatgcggccgccgcggccgctgcctgcgcccgagcccgccgccgccgccggagcccgcgcccgcgcccgcgcccggcccgcgcggccccatgcctctgccgcggccctcgggggggcgaaggtgaagaccggctcctaggatgagtgaaggggcggccgctgcctcgccacctggtgccgcttcggcagccgccgcctcggccgaggagggcaccgcggcggctgcggcggcggcagcggcgggcgggggcccggacggcggcggcgaaggggcggccgagcccccccgggagttacgctgtagcgactgcatcgtgtggaaccggcagcagacgtggctgtgcgtggtacctctgttcatcggcttcatcggcctggggctcagcctcatgcttctcaaatggatcgtggtgggctccgtcaaggagtacgtgcccaccgacctagtggactccaaggggatgggccaggaccccttcttcctctccaagcccagctctttccccaaggccatggagaccaccaccactaccacttccacca

SEQ ID NO: 71786 - DNA, 103 bp, Homo sapiens
  misc_feature 1..103: note = chr10:83635530-83635633
  misc_feature 1..103: note = hyper
  source 1..103: mol_type = genomic DNA
cgcctcctccaggacgcccaaccggattagcactcgcctgaccaccatcacgcgggcgcccactcgcttccccgggcaccgggtgcccatccgggccagcccg

SEQ ID NO: 71787 - DNA, 148 bp, Homo sapiens
  misc_feature 1..148: note = chr10:83635670-83635818
  misc_feature 1..148: note = hyper
  source 1..148: mol_type = genomic DNA
cggtcccgtccaccacggccccgttcttcagtagcagcacgctgggctcccgacccccggtgccaggaactccaagtacccaggcaatgccctcctggcctactgcggcatacgctacctcctcctaccttcacgattctactccctc

SEQ ID NO: 71788 - DNA, 16 bp, Homo sapiens
  misc_feature 1..16: note = chr10:83636233-83636249
  misc_feature 1..16: note = hyper
  source 1..16: mol_type = genomic DNA
ctgcagacctgctggc

SEQ ID NO: 71789 - DNA, 138 bp, Homo sapiens
  misc_feature 1..138: note = chr10:83636250-83636388
  misc_feature 1..138: note = hyper
  source 1..138: mol_type = genomic DNA
agctgccggatcccgctccagtagagggccagggagggagagagggccttcccgaaggcactgagccccttctccgcccgccggtaggaaggaaagaaagcaaagcacatgcaaattgaccgacgataaaccacaaaa

SEQ ID NO: 71790 - DNA, 403 bp, Homo sapiens
  misc_feature 1..403: note = chr10:8374325-8374728
  misc_feature 1..403: note = hyper
  source 1..403: mol_type = genomic DNA
agtcaggactctgggcggcagcggcagagggaggtgctgggggcggtggcatagcgcccacaccgcgtggtccccgcgcgcggctgggctggcagcgccccaggcagcgcgcacggtaagcaggaagctgcggccgagctgagtcgctcaaaagctactggagctaatagattgtggtcatgaggagagcggcagcatctcggtagtgatgggaacactcaaaagcatcatcaaaacagttgcagaaacatgctgagctctgcactcccgagcccgtgcctgctgcagccggcttggagtttgctggtagccactgcagccccggccccgcgcgtccagcctgggggtgcgatgagcaagagaaatgaggtgcaaaatgttgcatccgcggagctgcttgcaa

SEQ ID NO: 71791 - DNA, 43 bp, Homo sapiens
  misc_feature 1..43: note = chr10:838096-838139
  misc_feature 1..43: note = hypo
  source 1..43: mol_type = genomic DNA
ctgtgacacagccaacggccaagagctgcgggtattgatcaga

SEQ ID NO: 71792 - DNA, 255 bp, Homo sapiens
  misc_feature 1..255: note = chr10:851249-851504
  misc_feature 1..255: note = hypo
  source 1..255: mol_type = genomic DNA
gatgcaaaggacccccgggctgctgcgcggaaaaaggcggacggggatccagggcgcaagcagggatggagggagaggccgacacagacggcggcaggtgtgcgtggtgaggccgccccacgcagggatgggaggggcgcgcaagccgggacttgaacctgcactggctgagctgtggacgcggcctggcggcctctgcggagcgccctctgcggagctgcctctggcacctgtccacagcgtctggacaccggg

SEQ ID NO: 71793 - DNA, 30 bp, Homo sapiens
  misc_feature 1..30: note = chr10:8556196-8556226
  misc_feature 1..30: note = hypo
  source 1..30: mol_type = genomic DNA
tccgcaggtgatcctcgtgcttcccaggca

SEQ ID NO: 71794 - DNA, 76 bp, Homo sapiens
  misc_feature 1..76: note = chr10:85949225-85949301
  misc_feature 1..76: note = hypo
  source 1..76: mol_type = genomic DNA
gacaaaggccatgaccgggaaccaaggcttatgacattgtcagatgcctcttcattcattcattcaatattcctct

SEQ ID NO: 71795 - DNA, 816 bp, Homo sapiens
  misc_feature 1..816: note = chr10:85954289-85955105
  misc_feature 1..816: note = hyper
  source 1..816: mol_type = genomic DNA
gccgctaattggtctcgtcaggcggccggcaggagcagatccgagccgtgtcatcctcttagcgccctcacgccacccgccgctcccgccccgtgccccctcccgccgcggctgcagtcgccgctacccccattgtggtctctgccctccccgcgggcccagggcatgctccgtgcccctgcgcccggtctcggcggcggcaggcgacactccgcgccggcggagacatgaggcgctgccggtgggccgccctggccctggggctgctgcgcctctgcttgggtgagtggccgctgggccgcgctggccgcgtggatggcgagggagatgggcgctggcgtcacccaggtggccagagggacatggtcctggaccacttccagagtgggactcgggctggtggacgggagcggagaagtccttccatcttcctggcccattcggtagtggggagtggggtagcggagtagtggggagctccggggcgcttctccagagctggcatcctagggccccagggtttggcgcccggacccccgctgctctccgcttgctgggaaccagagctgtaggcttggtggcagctccgatgctgcgtggggcaggagatagtgccctgactcgcggcttgaccttggctgggctggggcactgcccctctccgagcgcgggtgcaatctgcccattgatgaaggaggggttggattgctacctgggttctaagcgcccacatgctacgtgtccctgacaagcccgagcccaccgggggcggagtgggggtcaggggcatcctctgggcggcgccccagtggggtc

SEQ ID NO: 71796 - DNA, 73 bp, Homo sapiens
  misc_feature 1..73: note = chr10:86304014-86304087
  misc_feature 1..73: note = hypo
  source 1..73: mol_type = genomic DNA
gggacagagaaactgcgcatactgctcctctccctgtcccataggaagaggtctttagcgtggcccagagcct

SEQ ID NO: 71797 - DNA, 82 bp, Homo sapiens
  misc_feature 1..82: note = chr10:87967280-87967362
  misc_feature 1..82: note = hypo
  source 1..82: mol_type = genomic DNA
agatgcacctcccaacgctgcaacccactgcaccagttttgaagcaaacatctcttactaatggtttatgcgatggcaagga

SEQ ID NO: 71798 - DNA, 190 bp, Homo sapiens
  misc_feature 1..190: note = chr10:88055214-88055404
  misc_feature 1..190: note = hypo
  source 1..190: mol_type = genomic DNA
gtggggatggagcatcgccatccactgccaccttctctctcctcagtgaactatatagggaacaaaactctgctgctcggggctgtggccagcatggaggagagaggaggtgttgcagatgcggaaagagaggggaaggtcagacggagtggagaaagaatggcccggagaaacgcgatatgacggccaa

SEQ ID NO: 71799 - DNA, 144 bp, Homo sapiens
  misc_feature 1..144: note = chr10:88124485-88124629
  misc_feature 1..144: note = hyper
  source 1..144: mol_type = genomic DNA
ctcccatttcctgtacgtctgtcgaggggagtgggggaaggggacttgtgtcctaggcgcctccacgttcagatctagcggagctgggggtcccagaaggagctgctcttgaagggctttctagaaccgcggacagctcctcca

SEQ ID NO: 71800 - DNA, 1645 bp, Homo sapiens
  misc_feature 1..1645: note = chr10:88125208-88126853
  misc_feature 1..1645: note = hyper
  source 1..1645: mol_type = genomic DNA
cccactccccctcggcgcgccccctcctcctctgcgctttcatcttctctcccggttctctctctctatccatctcttcccgctcagcatccccctaccccccgctgcccacgcttcttccctcggctcccaccacccagaccgtctgggcccccaagacttggaccacgcaaaactctaggactgtccaggatggggatgcagtcgccacaaccagatacacacgcactcacacatacaccaagggctacacagacacacaccggagaagcaggcagacactgtgtccactctaacaggctgacagacagtcgtgcacgcaccaacacacgctcagatggccccacacaccccaacaccctctcacagtaacaccgacaccgtgccaggcgcacacagcgacacacgctgacaacacgcacccacacacattcacacacggttccggtccggcctctttgatcttgccctgccaacttggcgagccccccgctgtacctccccctgccccccgctgctctgagctgcgcagaagggccctcccgacccgccgacggccccgctaagggcgcgggtctcgacgcgcgtccatcccggtgttccccgaagcgtcggccctaagtgtcggtagaggccgcggggccccgcgcggagatcggagccccggggagcggcaagcagccagcgggagcgcggcgcggccggtgcacagctcctccgccgggcggcgcggcgcggcccttcgggggagcaccgcccgccgagcccctcggcccagggaaacgccaagtttggacgccgcgcaccccctgccccgttggggcccccgcccagcctcggcccggcctccagccgcgcttaccgatgtggatgatggagtcggcccgcaccgacacgcactggcatatccaggggagaagccacagcgtcagcgcttccatgtcccccgggcgcgcggctcatccacccgggcccggggcgaggccgagggcagcgcgaagcggggaggcgctggtcccggtgcagtcccgggccgctccccgggagagccgagcccgcccgtgcgtcttcccccgcgcgcccgcccctgcgccctgcgcccgccccagcccagcccagcccagcccagcgcggtcgggctcccgctccggctccggtggcggctgcggcggtgctggcagcttgagcccaggccggcgcggcgggggcggcccgcggctgtggcagcggcgcttcccgcggctagagcggcttcgggggaggctgaggcggtggcggcggcggccgggccggcgtggcggctctgggctggctgtgtgtctgagccccggcgaggagcgaactgcggaggacgccccctcccctccccctccccctcagctccgctccccctcccctccctgcccgcctccctcccctccgcccgcctctctaccacgtgactgcggagcctcagcctcgccgcgcggctctcgcccgctcgcggctcggagggggcgccgggtgctccacgctcccggctcgggggacgctcggagaccggcacagcggcggggaccggcctgggctgcggcgcgccgagctctgacggttcgggcctccttctccggttcgccaggggcgggagaatggaggagggccggcc

SEQ ID NO: 71801 - DNA, 279 bp, Homo sapiens; identical to SEQ ID NO: 10374
  misc_feature 1..279: note = chr10:88126854-88127133
  misc_feature 1..279: note = hyper
  source 1..279: mol_type = genomic DNA

SEQ ID NO: 71802 - DNA, 50 bp, Homo sapiens; identical to SEQ ID NO: 33169
  misc_feature 1..50: note = chr10:88127346-88127396
  misc_feature 1..50: note = hyper
  source 1..50: mol_type = genomic DNA

SEQ ID NO: 71803 - DNA, 359 bp, Homo sapiens
  misc_feature 1..359: note = chr10:88149287-88149646
  misc_feature 1..359: note = hyper
  source 1..359: mol_type = genomic DNA
agaacttgcatcaggcgtctctgaccaccgagcctgcgaagacctagctgattacgaccaggaaacaggaggggacatggcccaaggtgggcggggccagtgctgggaagccccgccccgcccccgatcctgtgctcccaggtctgggcgttaggattctctcagtcccggagccacgccggctgaccgcagggctcggggagcgcggctgggccccttttcccgggtccgggaagcgccgggccacgccgggtccgctggagagactgagggccagggtcgccgctgccgccgggaggcgacagagccagctgggcgcacctgggtgctggcggctgcggagtcgcggggcccggtcc

SEQ ID NO: 71804 - DNA, 32 bp, Homo sapiens
  misc_feature 1..32: note = chr10:88280081-88280113
  misc_feature 1..32: note = hypo
  source 1..32: mol_type = genomic DNA
tttgtgccaaaagaccacgtcttttacaaata

SEQ ID NO: 71805 - DNA, 30 bp, Homo sapiens
  misc_feature 1..30: note = chr10:88282807-88282837
  misc_feature 1..30: note = hypo
  source 1..30: mol_type = genomic DNA
tccctccggtataatcggggaaactccaaa

SEQ ID NO: 71806 - DNA, 457 bp, Homo sapiens
  misc_feature 1..457: note = chr10:88391908-88392365
  misc_feature 1..457: note = hyper
  source 1..457: mol_type = genomic DNA
gaggatacagggagccgtttgcctgggttcgcgctcggctgtcctagctcacggggcgacctcggaaacgtccagcgtctgccctgtccccctgcgccgcgtctgagcagccagccccgggccaaagggtcgcgttggttggggcgtggggcagctggagggctgcaggtccccagcgccgcctcccgggcaaggggcggaggcgcggatcgctgaagtcagcccgcccctggttccgcgccctggagcccgagtgcgtcccagggcccgccgcacactgcgctggcccgcggccagtcccccagcctgcggctccaagatgcgcttaacgccgtctctcataccccagaaccctccttagaaacaggcttaccctgccacccattccccatccccccacacacccctgcagggccagcctcaggggtgcatggatttattccgcaggtgcagcagg

SEQ ID NO: 71807 - DNA, 66 bp, Homo sapiens
  misc_feature 1..66: note = chr10:88414219-88414285
  misc_feature 1..66: note = hypo
  source 1..66: mol_type = genomic DNA
gtctgagtgagctggcggcatggagcgactgagcatgtgcagctcccacatcgctatataaagatg

SEQ ID NO: 71808 - DNA, 70 bp, Homo sapiens
  misc_feature 1..70: note = chr10:88446786-88446856
  misc_feature 1..70: note = hypo
  source 1..70: mol_type = genomic DNA
ctccctctccctgcccgtactcccgcacccctcccccagcgccgactaccaggaacgcttcaaccccagt

SEQ ID NO: 71809 - DNA, 30 bp, Homo sapiens
  misc_feature 1..30: note = chr10:88731103-88731133
  misc_feature 1..30: note = hyper
  source 1..30: mol_type = genomic DNA
aggggcttcggggcacggggccgtgcacgt

SEQ ID NO: 71810 - DNA, 58 bp, Homo sapiens
  misc_feature 1..58: note = chr10:89419357-89419415
  misc_feature 1..58: note = hyper
  source 1..58: mol_type = genomic DNA
aacttgaccccaggccgcgtgccgggcgtgccatctgccgctccgctgcaaggtctcg

SEQ ID NO: 71811 - DNA, 145 bp, Homo sapiens
  misc_feature 1..145: note = chr10:89605836-89605981
  misc_feature 1..145: note = hypo
  source 1..145: mol_type = genomic DNA
gagtaatgcattactccatgacgttaggatggctaggttcacaaggcgataggaatttttcagctccattataatcatgggactgccttggtatatgcgggctgttgttgacagaaacgtcattatgtcacgcaagactagataa

SEQ ID NO: 71812 - DNA, 77 bp, Homo sapiens
  misc_feature 1..77: note = chr10:89621759-89621836
  misc_feature 1..77: note = hyper
  source 1..77: mol_type = genomic DNA
gggactctctccccgcgttctgtaagaatcggcggcagccagcaggcggggaggcgggggcacgtgtttggatgtgg

SEQ ID NO: 71813 - DNA, 241 bp, Homo sapiens
  misc_feature 1..241: note = chr10:90342630-90342871
  misc_feature 1..241: note = hyper
  source 1..241: mol_type = genomic DNA
gggccttttcccgggcggcggaagtccccgatcacgtgacgaggcgcgccactcggcgcatgggccgcgctacacggccgctcagggagctgagggtatagcgttttcgccttagactttcttgggtgcaggcccacaccacctcagcagcctgcccggcagtcctcttttcccaggttttggcgtttagacaacccacctgagtcctcagccttgtcccacacagcaaggtacaagggac

SEQ ID NO: 71814 - DNA, 96 bp, Homo sapiens
  misc_feature 1..96: note = chr10:90343138-90343234
  misc_feature 1..96: note = hyper
  source 1..96: mol_type = genomic DNA
cgtccttgaggagcaaacctggggctgcggagaaccggggctgtctgtcttctcgctttgggggccgggcgccctgcccctcgcccagaaaagcct

SEQ ID NO: 71815 - DNA, 19 bp, Homo sapiens
  misc_feature 1..19: note = chr10:9071404-9071423
  misc_feature 1..19: note = hypo
  source 1..19: mol_type = genomic DNA
ttttagacagagtctcgct

SEQ ID NO: 71816 - DNA, 1661 bp, Homo sapiens
  misc_feature 1..1661: note = chr10:90966508-90968169
  misc_feature 1..1661: note = hyper
  source 1..1661: mol_type = genomic DNA
aaaacagttcccagacgctcatatactgcgttgccagcgcgaacgaggacgagttctggtggtgcaccttgtggaaggtgcggtacagccagggcaccttgtggtgcagcaggtgccacacgaagaactccatgtcgaagagtagcaggcagaacaggatgtggtgcagcagcaggagcagctcgggagcttcgtggggcaggagggccgggctgcgggcccaatgcagcagcgtcacggggaacacaaacatcacatgctggtagagggtctgccccaggcaaggtagcagctgctgcgcggatggcgagaagtcagggtggatcttgtagcgccgcagggcgggcacccaggagcacaggatatccaggaccacgaagggcaggcaaaagcccacgtatgtggtgatggagaagatgaccgggaagaagggcgactgtaggagggcctcccagctcctcaggtggtcccagaggggctgcaggaacagctgcccggagctgcaaaggacctgggggtcggagcagttgtggcagctcattgcgaggctgtgcaaggcagctgaggctgctgctcgagtcccatcgacttttcacaggactcacggccccgccccgagtgatgtcagctgcctttccatccctttcccggcgatgcgaagcttgaataagctagcaacccggcagagtggcccttcattgctgtaaatgtgctcatctatagccgcatcttaccggcttttagatatgcgtgtatgcagtggcacttcgtacttttcatgtaagttctgatttttcagttgacgtacaattaacacgggacacaatgtacagatctaccgtgtggagtttctatgagtttggcaactcagttcacgtgtgtcatcacgggtctcaaactagaccgtttacattgccaccagaaagcgctcctttgcaatcaatgcagaattgtttgtgttttttaatgcatacgtataactgcatccatgtgctttcataaagacgcaagcataatcgcattttaaaaactgtttaaagctacatgcggtctgtagctcgggtgttttctgagaacccggttgcggtctatccagcggcgatcgagaaacgagccctttgcacagggaaccgctggtccccgaacgccggcggtgaccgtcagctcaggaaatcagacgggaagggtggccggatgggaacctccgccagctccagcttgtccccagagttttcctggccggcgggcagcaagctagagagaccacgcacgcaggctctccgggagaggccgcagcccggccgcgtagctaccctcggcggcgcgtcccggggcgccgggcccgcgatcggagccggaggcaccgcacagcggaaagagggctccgcggcggccaggctcagctttgccgggaaaatgctggatttaactcccagtctgcgccaatctggctaaaaagcccgttgtatctcaatttggggcgggaacacttaattcagcaaaccacctgcgttgttcgtcaagggaaagagatgtgagttcctgaagcctcccgggaggctattgaaggaccaggtgatgtcgtcactaccctacccttccccttgttggctttgcggggccaacttgcagtcgccctctgccaccggtccttgaatcca

SEQ ID NO: 71817 - DNA, 458 bp, Homo sapiens
  misc_feature 1..458: note = chr10:91294888-91295346
  misc_feature 1..458: note = hyper
  source 1..458: mol_type = genomic DNA
tggtctctattccaccgagaagtctgcatttgaaaaccacaagagatggagatcaaagccgctcgttctccagccacctgcccaaaaactcggccgcagcgcagacccaacccagacagggcaagtgagcacgtgtctccctcccaacccaagctgcgcgccgacgcacccaagttagggtcccaggctcccggcgcgggatgggcgctagggcagcggagaatggagggtccccgtcctcctccagctccaacgacagcgccagcgccccgccgtcccgccgcccttccttgaaggatgcccgtgtcacctgagccaccgcgccctctgcacaaccgtgtcagggagagggaagagggggagccgaggaagcttcttggccagggcgctggggatccgggagcgggggccgccggcgagactgagcccgggacagcccagagctccagcgctccagc

SEQ ID NO: 71818 - DNA, 145 bp, Homo sapiens; identical to SEQ ID NO: 10383
  misc_feature 1..145: note = chr10:91295347-91295492
  misc_feature 1..145: note = hyper
  source 1..145: mol_type = genomic DNA

SEQ ID NO: 71819 - DNA, 295 bp, Homo sapiens; identical to SEQ ID NO: 10384
  misc_feature 1..295: note = chr10:91295584-91295879
  misc_feature 1..295: note = hyper
  source 1..295: mol_type = genomic DNA

SEQ ID NO: 71820 - DNA, 15 bp, Homo sapiens
  misc_feature 1..15: note = chr10:91295923-91295938
  misc_feature 1..15: note = hyper
  source 1..15: mol_type = genomic DNA
cggtgttcccaaaaa

SEQ ID NO: 71821 - DNA, 442 bp, Homo sapiens
  misc_feature 1..442: note = chr10:92617097-92617539
  misc_feature 1..442: note = hyper
  source 1..442: mol_type = genomic DNA
tcttgacgaagcacacggagatcaccaccaggcagttgcccgcgatcgtcagcagcgtgatgagcgtcaggatggagccgatcacaactttctcgactctgccgtagttgatctgttccccacagccggaggcattgtccgggggcgcgtcccaggtgggcgccgggctggctgtcacctcgctcagcaggtgcggcgcccaggagcccgcgaccgggtcggcgccaccgtcggggctcaagtcgggcagcccgcgccccacttctggcagaaggaaagagcggaggtgcccgtagaggtccgggcggccgctgctgttaacgtccatcatcgcgccgccgtgtgccgctgcccatggagccggcgccccggccacgcgcctccggctgccggccccggggcttcacctcaccggttccgctccgcccggcccagccatggg

SEQ ID NO: 71822 - DNA, 30 bp, Homo sapiens
  misc_feature 1..30: note = chr10:92618047-92618077
  misc_feature 1..30: note = hyper
  source 1..30: mol_type = genomic DNA
tagaacccctccagccgaccccagcctccg

SEQ ID NO: 71823 - DNA, 75 bp, Homo sapiens
  misc_feature 1..75: note = chr10:92913398-92913473
  misc_feature 1..75: note = hypo
  source 1..75: mol_type = genomic DNA
aaagccttggacaggcggcgtccagccatgcaagcaagacccagcggcccgaggggatttcggttgctctctgcg

SEQ ID NO: 71824 - DNA, 30 bp, Homo sapiens
  misc_feature 1..30: note = chr10:92993186-92993216
  misc_feature 1..30: note = hypo
  source 1..30: mol_type = genomic DNA
ataaagtgttgtactcggtagaagaaaatg

SEQ ID NO: 71825 - DNA, 56 bp, Homo sapiens
  misc_feature 1..56: note = chr10:93392900-93392956
  misc_feature 1..56: note = hyper
  source 1..56: mol_type = genomic DNA
cctcgagccccagggcgcgaccaaccagcgcccagctggggcgccagccctcgccc

SEQ ID NO: 71826 - DNA, 24 bp, Homo sapiens
  misc_feature 1..24: note = chr10:93628551-93628575
  misc_feature 1..24: note = hypo
  source 1..24: mol_type = genomic DNA
tttctttttttgagacggagtctc

SEQ ID NO: 71827 - DNA, 24 bp, Homo sapiens
  misc_feature 1..24: note = chr10:93628635-93628659
  misc_feature 1..24: note = hypo
  source 1..24: mol_type = genomic DNA
ctaggttcacgccattcaaggagg

SEQ ID NO: 71828 - DNA, 611 bp, Homo sapiens; identical to SEQ ID NO: 33181
  misc_feature 1..611: note = chr10:93647037-93647648
  misc_feature 1..611: note = hyper
  source 1..611: mol_type = genomic DNA

SEQ ID NO: 71829 - DNA, 13 bp, Homo sapiens
  misc_feature 1..13: note = chr10:93647649-93647662
  misc_feature 1..13: note = hyper
  source 1..13: mol_type = genomic DNA
aagcagaaccctg

SEQ ID NO: 71830 - DNA, 467 bp, Homo sapiens
  misc_feature 1..467: note = chr10:94180300-94180767
  misc_feature 1..467: note = hyper
  source 1..467: mol_type = genomic DNA
ctcacaataagaacccgtccttcgcctgcagtatttaaacgattgtcggtggaagttcacgtcgtgctcctctttcgacagccgttgggtaacggatcaaaacccttaacggccgcggctggagcgcgagctcggggcgccgaggggctccgggcccgagcgtccaccgctcatctcctgggctcgggaggttttcgcggcgggggctcagccccagatcccgggactcaggaggagctgggccgagctgcgggaggcgtggaagccccaggagagggttttgcactacgaaaaaaccatatgcaaattgcctgggaagagtttagattctgtggccaaactgcaagcggccgttgctaaaatgggaagcatttacaggaaaaagcaaacggtttcatcgaggtggattcgacgacaaactaagcgaaggcaaaaacgatcgcgggagtcgacgtggagacagataa

SEQ ID NO: 71831 - DNA, 41 bp, Homo sapiens
  misc_feature 1..41: note = chr10:94342632-94342673
  misc_feature 1..41: note = hypo
  source 1..41: mol_type = genomic DNA
gtgctgggattccaggcgtgagccagcgtgcccagcctgct

SEQ ID NO: 71832 - DNA, 143 bp, Homo sapiens
  misc_feature 1..143: note = chr10:94448826-94448969
  misc_feature 1..143: note = hyper
  source 1..143: mol_type = genomic DNA
cgtgcaaaaccagagagccagactgcgcacagctgcgaccctcaagagccagcagaaaagacacggagcggcccccactggattgaagactgcacagcctctgcccggcgctgtaggacccgggcctccccttgattgctgct

SEQ ID NO: 71833 - DNA, 180 bp, Homo sapiens
  misc_feature 1..180: note = chr10:94449138-94449318
  misc_feature 1..180: note = hyper
  source 1..180: mol_type = genomic DNA
cgctctgagctcgggaaacggccggtgtgacagccagcgccactgttaatccagggagcgcacccaccgaggaggcgtcttaggccagcggcctctgctcccgccgagtcccgctgctccccgcctggaaacagctgctgccaccccgggcccaggcctggacggcgcccccgaatttcg

SEQ ID NO: 71834 - DNA, 365 bp, Homo sapiens
  misc_feature 1..365: note = chr10:94449797-94450162
  misc_feature 1..365: note = hyper
  source 1..365: mol_type = genomic DNA
gcgcccacgccgctgctgcaacccgcacacccgacgcccttttacatcgaggacatcctgggccgcgggcccgccgcgcccacgcccgcccccacgctgccgtcccccaactcctccttcaccagcctcgtgtccccctaccggaccccggtgtacgagcccacgccgatccatccagccttctcgcaccactccgccgccgcgctggccgctgcctacggacccggcggcttcgggggccctctgtaccccttcccgcggacggtgaacgactacacgcacgccctgctccgccacgaccccctgggtaaggcggccgggcgagggtgggggcgaggaagcgccacccggcaggtggcagcgcc

SEQ ID NO: 71835 - DNA, 349 bp, Homo sapiens; identical to SEQ ID NO: 33186
  misc_feature 1..349: note = chr10:94450377-94450726
  misc_feature 1..349: note = hyper
  source 1..349: mol_type = genomic DNA

SEQ ID NO: 71836 - DNA, 135 bp, Homo sapiens
  misc_feature 1..135: note = chr10:94451369-94451504
  misc_feature 1..135: note = hyper
  source 1..135: mol_type = genomic DNA
ctgtcggggctggagcgggaccctcagccgggccgggcctgggggctaacgttttcacagtgcgccctgagtttccttgggttactgctgggaccgcgcaggaggaagcaaagagtttttcgagctagaccaaca

SEQ ID NO: 71837 - DNA, 25 bp, Homo sapiens
  misc_feature 1..25: note = chr10:94603312-94603337
  misc_feature 1..25: note = hypo
  source 1..25: mol_type = genomic DNA
aagcatgcatttggccgggcgcggt

SEQ ID NO: 71838 - DNA, 53 bp, Homo sapiens
  misc_feature 1..53: note = chr10:94822354-94822407
  misc_feature 1..53: note = hyper
  source 1..53: mol_type = genomic DNA
agtttaggtctgggccgcttggaagagggagaaaggaccggaactggccttct

SEQ ID NO: 71839 - DNA, 38 bp, Homo sapiens
  misc_feature 1..38: note = chr10:94826099-94826137
  misc_feature 1..38: note = hyper
  source 1..38: mol_type = genomic DNA
ccgcctgccgcctgccgcggcggcgcccaggtgggagg

SEQ ID NO: 71840 - DNA, 97 bp, Homo sapiens
  misc_feature 1..97: note = chr10:94828028-94828125
  misc_feature 1..97: note = hyper
  source 1..97: mol_type = genomic DNA
cgtttccaggtgcctcgtggtcaggctgatctcctcgcctctctgcagggctaccagatccccaagggctggagcgtgatgtatagcatccgggaca

SEQ ID NO: 71841 - DNA, 739 bp, Homo sapiens
  misc_feature 1..739: note = chr10:94828193-94828932
  misc_feature 1..739: note = hyper
  source 1..739: mol_type = genomic DNA
cgcgaagattcccggggcgcctccagccgcttccattacatcccgttcggcggcggtgcgcgcagctgcctcggccaggagctggcgcaagccgtgctccagctgctagctgtggagctagtgcgcaccgcgcgctgggaactggccacacccgccttccccgccatgcagacggtgcccatcgtgcacccagtggacgggctgcggctctttttccaccccctcacgccttcggttgcggggaatgggctatgcctctgacatgcttgcgctctaggacacggcttggccggtggctatggcgcgcacgcagcgccacccatctgccgctccccattgtagcgtcgcgcgcccactctttcactcgttcaacaatctttcaacaaatgttcgccaaacgcggatgtgtgccggactcgaggaaggaggagggcgagccaccgctgccgcgccagagaagcatctaagcccatgggaagatgccttctgcgctccgcgcccagaggaaggaaaatgtcgtgggccaagcaggaatggagggaatagatagatccccacgaggtgctgcttggcttccccttcccgagccaatccagggagggtgcatggatgggggaaggcgaggtaggggtggcaggggagtgggaatattgcaactcggggacattgcagagacccgacgcacgcggtgggacctgcaacccttgtaaggaagcgggcacgccgtgggcgcaaccct

SEQ ID NO: 71842 - DNA, 320 bp, Homo sapiens; identical to SEQ ID NO: 33191
  misc_feature 1..320: note = chr10:94831610-94831930
  misc_feature 1..320: note = hyper
  source 1..320: mol_type = genomic DNA

SEQ ID NO: 71843 - DNA, 408 bp, Homo sapiens
  misc_feature 1..408: note = chr10:94831980-94832388
  misc_feature 1..408: note = hyper
  source 1..408: mol_type = genomic DNA
cgctaggattgtgcgggtccctccgacctctgcagatatttcctgatacctccgggtttggggactaccgcgagaagggcaacgcatttaaactctcaggagcagagttttccacctccaagggacgccttccaaggcgtgcggcgtgcttctgccagagacagtgttcagttttaaacaaatgcaggtcattctgtttcattttcggcgccgcaggtgcgttcagcgcccaaacccaggtagcgtgtgaccctgactggtcccgagccgggaagctccggcaggtggagagcagagagagcaggtgcgcgtcccgcagcgtctgagctccgggcattggcagctcagtagcagctgattgtagatgggcaaagtacagaagacttcccagtacggatcccttcaccc

SEQ ID NO: 71844 - DNA, 30 bp, Homo sapiens
  misc_feature 1..30: note = chr10:94832671-94832701
  misc_feature 1..30: note = hyper
  source 1..30: mol_type = genomic DNA
ttgcccaaggtcacacgcagtacagatgga

SEQ ID NO: 71845 - DNA, 623 bp, Homo sapiens
  misc_feature 1..623: note = chr10:94833026-94833649
  misc_feature 1..623: note = hyper
  source 1..623: mol_type = genomic DNA
cagatctgcctattgcgcccgatgccccgaggctctctcttggactctggccctgagttcttctgcgcgatccttcggagacgtctggaggcctgctttatgcatctctcttggacctcagtttccccacacgtgggaggaggcagctggacgattcctgaaaggactttcccttgcttcctcatcacgtggaagagagcccacccggcacctggaaatggaaagccagtgaaggctgctttgggccggggcagcgggtgggaccgggcgggagggattccaaagagaccgccgggaaggctagagcttggaattccggctcctcggagtcctggccctcccccaccgccgcctcggagctcagcacaccttggatgggggaggcgggcagctcctagccccgcaccccaggaggcgcgctcggagggaagccgccaccgcgccgcctctgcctcggcgcggaacaaacggttaaagattttgggcagcgcctcgcggggggaggagccaggggcccaatccgcaattaaagatgaactttgggtgaactaattgtctgaccaaggtaacgtgggcagcaacctgggccgcctataaagcggcagcgccgtggggtttgaagc

SEQ ID NO: 71846 - DNA, 969 bp, Homo sapiens
  misc_feature 1..969: note = chr10:94834033-94835002
  misc_feature 1..969: note = hyper
  source 1..969: mol_type = genomic DNA
cccacttctctcctccgccttcctcccacagcggaggaagttcctgcagatgaagcgcaggaaatacggcttcatctacaagacgcatctgttcgggcggcccaccgtacgggtgatgggcgcggacaatgtgcggcgcatcttgctcggagagcaccggctggtgtcggtccactggccagcgtcggtgcgcaccattctgggatctggctgcctctctaacctgcacgactcctcgcacaagcagcgcaagaaggtgggggcaggaggcgacggctggacagggagggggaccccatttatgagcggaattccggctgatggatgctaggcgcgggctagcagcttgaggtgggctaggaccctctgccagctccaggttagctttcccagctcggagagtgccatgtgtctggcaggactgggggtgtctggaaggggacggcggtagacgagaggggcggatggaggcttttaacgctgtcccctcctcgggactcaggtgattatgcgggccttcagccgcgaggcactcgaatgctacgtgccggtgatcaccgaggaagtgggcagcagcctggagcagtggctgagctgcggcgagcgcggcctcctggtctaccccgaggtgaagcgcctcatgttccgaatcgccatgcgcatcctactgggctgcgaaccccaactggcgggcgacggggactccgagcagcagcttgtggaggccttcgaggaaatgacccgcaatctcttctcgctgcccatcgacgtgcccttcagcgggctgtaccgggtaagggcggcaaacgggctgcggactaggggcgcgggacctgggcgtctgctcaccgccgcgcgctctctgcgctcagggcatgaaggcgcggaacctcattcacgcgcgcatcgagcagaacattcgcgccaagatctgcgggctgcgggcatccgaggcgggccagggctgca

SEQ ID NO: 71847 - DNA, 30 bp, Homo sapiens
  misc_feature 1..30: note = chr10:95257302-95257332
  misc_feature 1..30: note = hypo
  source 1..30: mol_type = genomic DNA
gtgagccaccgcgcccggccccaatcaacc

SEQ ID NO: 71848 - DNA, 81 bp, Homo sapiens; identical to SEQ ID NO: 33196
  misc_feature 1..81: note = chr10:95326983-95327064
  misc_feature 1..81: note = hyper
  source 1..81: mol_type = genomic DNA

SEQ ID NO: 71849 - DNA, 281 bp, Homo sapiens
  misc_feature 1..281: note = chr10:95361159-95361440
  misc_feature 1..281: note = hyper
  source 1..281: mol_type = genomic DNA
cctccaggacagcctcgggcacagtggagcggccgcgcggggtggcctcggccaggccaaatgcgccagcggccctggctcagttaccctgcactcgtgccagcggccgccagctgcggtctagggtggcctccggggccagtggctctggcaggaggctcgagtcaacctggcgggaagaccgtggcctcacagagcgagagcggacccgcgaggctccctggtgcgtgagtgcccaggccctggccatgccaaattggcgcctccgtctgccttctgag

SEQ ID NO: 71850 - DNA, 276 bp, Homo sapiens
  misc_feature 1..276: note = chr10:95753484-95753760
  misc_feature 1..276: note = hyper
  source 1..276: mol_type = genomic DNA
cagctccgggggaggcggccgggtcctcgctccgcgcccgccttccccgcgcggcaggagccgggggcgggcccggcacaggccgctcccccgcccggccgcccgcggtggcgctagcggcctctcacccggggcgggcgagttctgggaaagcccggcccagggcgggggccccgctgccgcccgcgcagccgccgctgtccgggcagcgcgcacatctcggcgggagcggactgtgaacggcgcgggtccacacggtaacgctgggcaacgtgg

SEQ ID NO: 71851 - DNA, 82 bp, Homo sapiens
  misc_feature 1..82: note = chr10:95754132-95754214
  misc_feature 1..82: note = hyper
  source 1..82: mol_type = genomic DNA
ggaaaagtgtcctcgcgctcccgggggacccgaggcgggcggtcctccagggcatgcaggccgccctcgcaggggctaaagg

SEQ ID NO: 71852 - DNA, 30 bp, Homo sapiens
  misc_feature 1..30: note = chr10:96157039-96157069
  misc_feature 1..30: note = hypo
  source 1..30: mol_type = genomic DNA
ttcataatgtttcatcgatatacctagttt

SEQ ID NO: 71853 - DNA, 120 bp, Homo sapiens; identical to SEQ ID NO: 15380
  misc_feature 1..120: note = chr10:96304080-96304200
  misc_feature 1..120: note = hypo
  source 1..120: mol_type = genomic DNA

SEQ ID NO: 71854 - DNA, 30 bp, Homo sapiens
  misc_feature 1..30: note = chr10:963402-963432
  misc_feature 1..30: note = hypo
  source 1..30: mol_type = genomic DNA
tcttgactggaatggcgtattttaagatat

SEQ ID NO: 71855 - DNA, 30 bp, Homo sapiens
  misc_feature 1..30: note = chr10:9637898-9637928
  misc_feature 1..30: note = hypo
  source 1..30: mol_type = genomic DNA
cttctcttaggcccccgagctgccctggaa

SEQ ID NO: 71856 - DNA, 30 bp, Homo sapiens; identical to SEQ ID NO: 42632
  misc_feature 1..30: note = chr10:97202907-97202937
  misc_feature 1..30: note = hypo
  source 1..30: mol_type = genomic DNA

SEQ ID NO: 71857 - DNA, 267 bp, Homo sapiens
  misc_feature 1..267: note = chr10:978811-979078
  misc_feature 1..267: note = hypo
  source 1..267: mol_type = genomic DNA
ctgggatcaaggccccggcccttccccaaacccccaacccacacccgggaccaaaaggccccggccccacgtttcctagaggcgctgggttcgggcccacgttgcaacgagtcagatgctcttggtagctcagggaggtgttcacactcctgccgtttccgtgaggatggtgacgactccgaactatagcagcatactctacctacccctgatcagtttatggaagaaaaggaaaccaaacaaagtatgttgcgtttcccttaagct

SEQ ID NO: 71858 - DNA, 593 bp, Homo sapiens
  misc_feature 1..593: note = chr10:98129731-98130324
  misc_feature 1..593: note = hypo
  source 1..593: mol_type = genomic DNA
gccgggactgaaagccgggcgtgtctgactccacaactcctgctgtgaatcatcacactctgccccggccccagcgtctccgggacttaccccagagccacagaagcggccgagcctgggcgctgagctgtcgtagccgtcgtaggcttccatgtagtcgtagccgcagtcggcctcctcctcaacctcaaaggtccggaatgtcagctccacgccgtagccgtcctctgccacgatcacccagtcacagcgggcctcgctcgggtagttgttgtccccaaactgggcgtgggaatagagctctttggtctgcacttcagccttcagcctgcccccgcactctggagcagagagaagtgagatgtcccctcagcacaagacaccctcgtgcctcccgcctgcgtctgctcggctttctctacagagcctggtgcgtgcctggcaggagaggccaggtagtctcgtcaccccatttgatggaggagtacacagaggcccctggctcccaggtcagggctccctcgggggtgcaaagtggccctcacaagccaaggtcccctgttcccagcttgagaatacgtgagcatgccatt

SEQ ID NO: 71859 - DNA, 123 bp, Homo sapiens
  misc_feature 1..123: note = chr10:98272645-98272768
  misc_feature 1..123: note = hyper
  source 1..123: mol_type = genomic DNA
gattagagcacctgccggcttccatctccgcccgcccagagcgaccctcaggccggtaccgctacagggaagtttccggctattcgagtcttgctcattctccctcggcgacccctttccttt

SEQ ID NO: 71860 - DNA, 30 bp, Homo sapiens
  misc_feature 1..30: note = chr10:98292766-98292796
  misc_feature 1..30: note = hypo
  source 1..30: mol_type = genomic DNA
attgtgtgaaacaatcgcataagatttagc

SEQ ID NO: 71861 - DNA, 163 bp, Homo sapiens
  misc_feature 1..163: note = chr10:98398908-98399071
  misc_feature 1..163: note = hypo
  source 1..163: mol_type = genomic DNA
gagatgtctcacactcggggacacctaacagatgtctcagtaccacctatcaggtgggtgaggtctttacactggaatactgacacactattccacccacaaagtcgagaattacatcttattttctggtagctcaaattcaagaaatcgctgaacacctatt

SEQ ID NO: 71862 - DNA, 93 bp, Homo sapiens
  misc_feature 1..93: note = chr10:98528133-98528226
  misc_feature 1..93: note = hypo
  source 1..93: mol_type = genomic DNA
ctcacctcctgctgtgtgacgcggttcctaacagaccacggactgatacaggtctctgtaccctggtttaatgggtaccgggtttcagcttgg

SEQ ID NO: 71863 - DNA, 78 bp, Homo sapiens
  misc_feature 1..78: note = chr10:98808749-98808827
  misc_feature 1..78: note = hypo
  source 1..78: mol_type = genomic DNA
cgcttgttggcgaggcgccggggactggcacagcgggcaccactcgtctcgatgggattggtgcgcaggaagtctgcc

SEQ ID NO: 71864 - DNA, 32 bp, Homo sapiens
  misc_feature 1..32: note = chr10:98944809-98944841
  misc_feature 1..32: note = hyper
  source 1..32: mol_type = genomic DNA
gcagctggctcagaacgcggccgtagccccat

SEQ ID NO: 71865 - DNA, 205 bp, Homo sapiens
  misc_feature 1..205: note = chr10:98945047-98945252
  misc_feature 1..205: note = hyper
  source 1..205: mol_type = genomic DNA
gggatggggaaaccacggcgctcctggctcctggctcgggaaagaccccggcaggcactgacccgtctgtgggctgcggagcccggacgggccccaatggtcctgcccccacccccaagtccggaattgcgtctgggtgggagggcaacctcggagccagggagccaggggcggggaccatactcacaggcgctcggtgttccga

SEQ ID NO: 71866 - DNA, 274 bp, Homo sapiens
  misc_feature 1..274: note = chr10:98945472-98945746
  misc_feature 1..274: note = hyper
  source 1..274: mol_type = genomic DNA
gccgctgaccatccccgtccggggccgcctccaggtgcagtcccggggcagagccaccgaagagcccgcgggcttgcgcgcggcgcccctgcgggctgggaggcaccttgctcctccaagcgacggcgcctgtgcgcggacggagggagggcgccttgggcggagggggctcggctcctctgccgtttcgccgcctgcgtctccctctccctccctccagctcccaactgactgctgcgaggaggaaaatgggcaggccccgcgcgcgcacgca

SEQ ID NO: 71867 - DNA, 261 bp, Homo sapiens
  misc_feature 1..261: note = chr10:98945806-98946067
  misc_feature 1..261: note = hyper
  source 1..261: mol_type = genomic DNA
cccggcagtcatccatcaatcgaaaagcacacatccagggccaggctcctccccgccctcccccgccgcagcccccctctcccgacgaccactcagcggctgcaagccgcctacagtttcaaaggtggaacctccgaggcgccgtcagcgggcacggggctgcgggggatgggagaagagggaagggggtgtgactcgacccgccaagtcctggctgtacacacacacacacacacacacacacacacacacacacacaca

SEQ ID NO: 71868 - DNA, 106 bp, Homo sapiens
  misc_feature 1..106: note = chr10:98946094-98946200
  misc_feature 1..106: note = hyper
  source 1..106: mol_type = genomic DNA
cgcaccccggcacccgcggccccagctgctagtccagggtgggagggagatcttattttgccgcttggacgccttcccggggagtcagacccgtttccccccatcc

SEQ ID NO: 71869 - DNA, 71 bp, Homo sapiens
  misc_feature 1..71: note = chr10:98955979-98956050
  misc_feature 1..71: note = hyper
  source 1..71: mol_type = genomic DNA
aacattcaccagccccggcccgcggcgtcggggcagcggcgcggaacccggagtgccggctgggttcgcgg

SEQ ID NO: 71870 - DNA, 30 bp, Homo sapiens
  misc_feature 1..30: note = chr10:98986334-98986364
  misc_feature 1..30: note = hypo
  source 1..30: mol_type = genomic DNA
atgtttactaaaagccgactcagcacaagg

SEQ ID NO: 71871 - DNA, 78 bp, Homo sapiens
  misc_feature 1..78: note = chr10:99051344-99051422
  misc_feature 1..78: note = hypo
  source 1..78: mol_type = genomic DNA
ccggccccgtatgatattttaaataacacactcaaccacgctcatctgggctcaggaagaagccgagtcacaaagtta

SEQ ID NO: 71872 - DNA, 272 bp, Homo sapiens
  misc_feature 1..272: note = chr10:99080175-99080447
  misc_feature 1..272: note = hyper
  source 1..272: mol_type = genomic DNA
gaggaaccgaaaaatcgcgagtgtttcgcgggtaactggggttgagggccaaaatatttggaatgaaggactttggccctatttaaggcagattttacagagcgcacctcaaacgtacaagtcagtaggactccttatttggcgtgacccgacctggccgcggagcctgcatttcctcgcagcctctcagtgccctccagccccgcgaccatgtggccacaatccacgcttctccggatcgcggtgcgccggaaccacggaggatgatgcca

SEQ ID NO: 71873 - DNA, 93 bp, Homo sapiens
  misc_feature 1..93: note = chr10:99080838-99080931
  misc_feature 1..93: note = hyper
  source 1..93: mol_type = genomic DNA
gcacgcactgggttgcgggacagagtagccaggttctgccggtgctcggagaagagcgcagtgttttgcaagtgctggagtctcctgaggaca

SEQ ID NO: 71874 - DNA, 548 bp, Homo sapiens
  misc_feature 1..548: note = chr10:99531097-99531645
  misc_feature 1..548: note = hyper
  source 1..548: mol_type = genomic DNA
cggcgatgcagaggtcgttgtccagggggaacttgtggcagtgcagcatctcaggccaggggaagccgtaggcctccatgagcggcgcgcagccggcgcgcacggcctcgcacagcgagcggcacgggtagatgggccggtcgagacagacgggcgcaaagagcgagcacaggaagacctgcgtatccgagtggcagcgcttggccagcagcggcagccagctgctcgcctgctgcttcacttcggccaggctctcgtgctccagcaggttgggcagccgcatgcgcttgtagcccaccgtgtggcagagcggcaggtcggcagggatgtcaaggcactgcggcggcttggagtaggagcggccgtgcagcggctcggcctgccagccatagtagtcgtactcctcgcagcgcgccggcgcccagtgcagcgcccccagcagcagcgccagcgcggccgtccgcacgcccccccccgccgccgccgcccgcatggctgcgccctctccaggtgcgcgccgcgcagccccccgacgctcggtgcccggc

SEQ ID NO: 71875 - DNA, 233 bp, Homo sapiens
  misc_feature 1..233: note = chr10:99531646-99531879
  misc_feature 1..233: note = hyper
  source 1..233: mol_type = genomic DNA
gcccaggtgttccggcgtgcgcccccggccctgactctacccagccgccgccgccgccgccgcggaggtcgcccaggtgggtggcagcctgcgctgcgggcgccccgactgatcctggcgcctcccacctcggggctccagcccgggcctcgccgtgcgccccagccaatctccggccgcctggccccagctccaaggcggggaggcagtgggggcggccctcagcccctccc

SEQ ID NO: 71876 - DNA, 181 bp, Homo sapiens
  misc_feature 1..181: note = chr10:99531880-99532061
  misc_feature 1..181: note = hyper
  source 1..181: mol_type = genomic DNA
caccctgcccgagcgtcccgcccagcgccaggtcttgcgcccctctcccggctcggctcccctgccgcagccctggcctcgcccagcgtttctccccagggctccctgcctccctgggcattttcctcgaccctcgccttctccatccttcctccttatctctctccgccacagcctctcc

SEQ ID NO: 71877 - DNA, 266 bp, Homo sapiens
  misc_feature 1..266: note = chr10:99789105-99789371
  misc_feature 1..266: note = hyper
  source 1..266: mol_type = genomic DNA
ttccacttggcttcacgtggaaagtcctgcacccatcccagaagacacctcaagtgcaactcaagaatgtgtcctgtcaggagaacggaagcatctcctgggatgtgcagaagccacactgggtgcacccaccagcagcagcagcggcggcggcggcggcggcggcggcggcggcggcggcagcagcagcaatattcattagtcattcctggaggaagcccccccagctctcaaccctaggagaatttccccgccactctgggagg

SEQ ID NO: 71878 - DNA, 371 bp, Homo sapiens
  misc_feature 1..371: note = chr10:99789599-99789970
  misc_feature 1..371: note = hyper
  source 1..371: mol_type = genomic DNA
gggaagaccacacctcgtccagcataaggcggctagcagctacgccgcgcgcggggctggctcccggagctctctgccacccagcgctgtgcccgggaactcggcttcccaggggaggaagagccagcccgcggggctcttccccagcctggaagcgtaggcactcggccgaggccagtggcttcccaggcccgggtctcagcctggctgactgggagactctcccgatagcccggcacatccctcctcacccgctccgccccctccaggccccagaggccccctcccctgacagctgacctccagtgcgcccccaacactttctctgccagctgctggctgtcgcccccacacatcagctcccacctctc

SEQ ID NO: 71879 - DNA, 319 bp, Homo sapiens
  misc_feature 1..319: note = chr10:99790021-99790340
  misc_feature 1..319: note = hyper
  source 1..319: mol_type = genomic DNA
cgcgcgccaatcgagtccagcgcctcccagcaagttaggagcgaagccgccgccttcgcgatcccagtcttcccgggttcccgggcggcgtccccgccacccttgcgggcggatccgggggggcgcgcagagctggagaaactttctccgccttagggtggggggcaccggtgcagatactcacgccggggtcagcgctcggagccatcctcccgctctcggccccgccgcctaggggcgtgggaagcgggcgctcgctgccgcctctgccgccggcgccgccgcctgcttgctcccagccccggtcccgggctggcct

SEQ ID NO: 71880 - DNA, 323 bp, Homo sapiens; identical to SEQ ID NO: 902
  misc_feature 1..323: note = chr10:99790437-99790760
  misc_feature 1..323: note = hyper
  source 1..323: mol_type = genomic DNA

SEQ ID NO: 71881 - DNA, 260 bp, Homo sapiens; identical to SEQ ID NO: 903
  misc_feature 1..260: note = chr10:99790917-99791177
  misc_feature 1..260: note = hyper
  source 1..260: mol_type = genomic DNA

SEQ ID NO: 71882 - DNA, 53 bp, Homo sapiens
  misc_feature 1..53: note = chr11:1001969-1002022
  misc_feature 1..53: note = hypo
  source 1..53: mol_type = genomic DNA
tgcctcagggcgagccggctgtggtggctgctggcacacggctcacaggacag

SEQ ID NO: 71883 - DNA, 50 bp, Homo sapiens
  misc_feature 1..50: note = chr11:1008075-1008125
  misc_feature 1..50: note = hypo
  source 1..50: mol_type = genomic DNA
ggtcaacatagagtgcgtgtccgacttcacggaggcgccagtcctcaaca

SEQ ID NO: 71884 - DNA, 140 bp, Homo sapiens
  misc_feature 1..140: note = chr11:1008417-1008557
  misc_feature 1..140: note = hypo
  source 1..140: mol_type = genomic DNA
gacagccagggcccccgcgccacctgcccggcttggtaccagacgacagctgtggggtgcaggcagctggtttccttcggccccctggcctggggggcgcgttttttgctcagttgagctcagatcgtaccactttgctt

SEQ ID NO: 71885 - DNA, 1086 bp, Homo sapiens
  misc_feature 1..1086: note = chr11:100997659-100998745
  misc_feature 1..1086: note = hyper
  source 1..1086: mol_type = genomic DNA
gctttcggttctggccggccacctctcaagtcccacccctcccgggggaacggtgccttaactcctctccaagacaagcactcctggtaaacgtccttcttctaagaaagaagcatttcataaagcccccaactcgccgcgcactttctgccccactgggctacagcggacctagtgtgacgctgcacgttttaaatcggggttggttctgcttcggaatctggaagattcggaaagttaaaaaacaaacaaaaaaacagctttcagggaggcacgccccaaaaatagtatattctgcgcccaccttcgtgtccccaagagtgaggagaggagggaagaagaagggaggcaactgcccctgtgctgtgtcccgctgcccaccctctccggccgccccggggagcgcagcggtgcgctggggctggggctgagggttggcggccgccgccgccaacggaaccgctactcccggacgcgctgggcgtgccccgtcccgggccctcacctcaggtagttgagatagggcgggtagacctgcggcaggccctccttgagcacggcggcctggtagccgagctgcgggagcccgttgaggccgagtgcagggtagagcgcgggggccgccccggcggcggcggcagaggcggaggtggagggcaggccgtcccgcgggagcaggcagccgctcgcgcccggcgccttgcagggcggcggcgcgaacgggccctgctggggcggcgcgccctccgctttgtacaggatgcactccagggtcgaccccgaggaggacgcagacgagactgaggcactggcgggtgcggccgtcaccgccgcttccccgggtctggatggggtcgctcgcggcggcagcgggggcggtggccccaacgggaaatccgggaaggctgcggggttggcaccggccacaaggtaggaacgcggggagcgcgcggaggcctccgcgccttcctcctcctcctttatctttagagcgggcggctggaagtcgctatagagagggtacgcgtcgtccttgggctcggcgtcgggcgggtacgcgcagtcggggaagtcgcctacagcgac

SEQ ID NO: 71886 - DNA, 40 bp, Homo sapiens
  misc_feature 1..40: note = chr11:100999320-100999360
  misc_feature 1..40: note = hyper
  source 1..40: mol_type = genomic DNA
acacccgctgggtggcgggggcagccggtggatcttcggg

SEQ ID NO: 71887 - DNA, 118 bp, Homo sapiens
  misc_feature 1..118: note = chr11:100999601-100999719
  misc_feature 1..118: note = hyper
  source 1..118: mol_type = genomic DNA
tgtccctggcagggccgagggaagagtagcccgtccagggagataggtatggccgaaacttcaggcaaggtgtccgaggtctggctccccgggaacggacctgcggctgggcgacaca

SEQ ID NO: 71888 - DNA, 74 bp, Homo sapiens
  misc_feature 1..74: note = chr11:101000148-101000222
  misc_feature 1..74: note = hyper
  source 1..74: mol_type = genomic DNA
gagtactcacaagtccggcacttgagtggctgcggctgcgacggcaatttagtgacacgcggctcctttatctc

SEQ ID NO: 71889 - DNA, 43 bp, Homo sapiens
  misc_feature 1..43: note = chr11:1011399-1011442
  misc_feature 1..43: note = hypo
  source 1..43: mol_type = genomic DNA
tcctgtcagagtgggcgtccccaggccacggtgcaggcctgag

SEQ ID NO: 71890 - DNA, 18 bp, Homo sapiens
  misc_feature 1..18: note = chr11:101361883-101361901
  misc_feature 1..18: note = hypo
  source 1..18: mol_type = genomic DNA
ttagaaaatcctaaccgg

SEQ ID NO: 71891 - DNA, 448 bp, Homo sapiens
  misc_feature 1..448: note = chr11:101453090-101453538
  misc_feature 1..448: note = hyper
  source 1..448: mol_type = genomic DNA
tagagctgagaacctcgggaaaccgcttgcgggtggatgtgacaagtcaggaaacttgactacccaatcacccaaaggggcaatgggacagaaatgctatctgcccgctgcacatgtggtcacagcggtgtcggggaagcggagtcttttcttctggagtccactctgcttactccctacctcccctcccgccacccacccagctaaaaaaaaaaataccctagattcataaacaaaagcttgcagttacccacagcccaatacaaacgacccgacgccctcacttctatagcccgtgagtctcccagcccctaacaggctcgtctccccagacgccccgggtgaaaaggttcgcgccgccggtggagagtcctattggttctatttctgtcttcactccaaggccccaggaccggggagaggtcctggtctaactttggctgtccca

SEQ ID NO: 71892 - DNA, 237 bp, Homo sapiens
  misc_feature 1..237: note = chr11:101454510-101454747
  misc_feature 1..237: note = hyper
  source 1..237: mol_type = genomic DNA
gggcagagagggcacaggcggggccgctggtggtagcgaagcgtaagagcggagagcaagggagacggagctgaagagttactatgtcaacagagactctccagccctcagctcccgccttcatcccccgcactctccgtcaagatccccacctttaaagggatccgagcgacgttctagaaagcagccaaagcctgtcctgtagccacaactttcaggaggcggtatgagcctgaa

SEQ ID NO: 71893 - DNA, 330 bp, Homo sapiens
  misc_feature 1..330: note = chr11:101918176-101918506
  misc_feature 1..330: note = hyper
  source 1..330: mol_type = genomic DNA
aggcatccacccagccgagagcacgatggctactggggagctcggggacttgggtggctactacttcaggttcttgcctcagaaaaccttccagtctctgagctctaaggagatcaccagccggctccgccagtggtgaggaaccgaggcacagggagagaagaggcccttggtcttcgcggctgtggaggcgcaggccgggcgtcgaggggcccgcgcgggtcggcgccattctgagtgaaccctgaggcttcctgagtgaaccccgaaccacccgggaagggcggatgctgtgggtgggatcggttatcggtgcgctctgagagggtg

SEQ ID NO: 71894 - DNA, 330 bp, Homo sapiens
  misc_feature 1..330: note = chr11:101981634-101981964
  misc_feature 1..330: note = hyper
  source 1..330: mol_type = genomic DNA
cgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggtaacctcgttgcccctctccccgtttccccgtcgggcgggcctcagaccgggggggcgctcgg

SEQ ID NO: 71895 - DNA, 89 bp, Homo sapiens
  misc_feature 1..89: note = chr11:101982771-101982860
  misc_feature 1..89: note = hyper
  source 1..89: mol_type = genomic DNA
tacagtcggctgaaacgcttttgaattagccacatctgtacgttgcgcaggaactgagttgcgctttacagtaccgaggttttaacaca

SEQ ID NO: 71896 - DNA, 20 bp, Homo sapiens
  misc_feature 1..20: note = chr11:102158481-102158501
  misc_feature 1..20: note = hypo
  source 1..20: mol_type = genomic DNA
gcgcccggcccctgtttact

SEQ ID NO: 71897 - DNA, 96 bp, Homo sapiens
  misc_feature 1..96: note = chr11:1024000-1024096
  misc_feature 1..96: note = hypo
  source 1..96: mol_type = genomic DNA
gggcgtaggcagccacggcatcgcacagacactcacagtccccgccactgtcacacccacatgcgtcgcgcacgcaggcctcgtagtagggcaggt

SEQ ID NO: 71898 - DNA, 344 bp, Homo sapiens; identical to SEQ ID NO: 42870
  misc_feature 1..344: note = chr11:1024866-1025210
  misc_feature 1..344: note = hypo
  source 1..344: mol_type = genomic DNA

SEQ ID NO: 71899 - DNA, 308 bp, Homo sapiens
  misc_feature 1..308: note = chr11:1025881-1026189
  misc_feature 1..308: note = hypo
  source 1..308: mol_type = genomic DNA
aggtgggctgtgagtcgttgacaccacagacgtcctgcagggagagggcgctgaggaggagccctggaggccgtgcctctgggtccccggcccctgcggcctggcacccgatggttaccgtggccaggatgtactcgcagttgccgtcgaatacgaagcgctggccgtcgaaggtgatgacgtggccctccccgtagagggtgcaggtggatgggcagtgggtgccctgctgacaggcccacctcccccttgagcaggagctgtggagacagcaggtgtgggtggtgggcctgcggccctcctgccat

SEQ ID NO: 71900 - DNA, 305 bp, Homo sapiens
  misc_feature 1..305: note = chr11:1027283-1027588
  misc_feature 1..305: note = hypo
  source 1..305: mol_type = genomic DNA
tgacagtggactgctcggccaggatgaacttgtaaccctccagtatgcacgggcactgggccttgcgcacacactcgcccttttggttcaggtaggtgccatcggggcagttgcaaccgtccacgggcacggcgctgtggtggcactcggtggcacggtccgacagcgacaggcaggtgcgctcacaggcttggctgttgtagctgaaggtggtgttacccgtgcaggggatggctgtgggggacccgggcatcagactctccgggagggggcggccgggagggcaatctcgggttcccctgcct

SEQ ID NO: 71901 - DNA, 125 bp, Homo sapiens
  misc_feature 1..125: note = chr11:1028245-1028370
  misc_feature 1..125: note = hypo
  source 1..125: mol_type = genomic DNA
caggggtcagtctcacgctccagagcggccggacagttccccgcccgccaggagtccacaaacagcgaggcggtgccctcggcgatacccatgctagtggtgaagtcatccgttgtgtccccgtt

SEQ ID NO: 71902 - DNA, 447 bp, Homo sapiens
  misc_feature 1..447: note = chr11:1029178-1029625
  misc_feature 1..447: note = hypo
  source 1..447: mol_type = genomic DNA
tggggtcaccgggagcgcccctccccacgggccacagggctcgtcctacctggaggaggatgtaggtgcaggtgccgtggaagcggtagggcctggcgtcaaatgtggtaacaaaggagccaccttccagggagcagtgtccggggcacggccgctccgtgcacacccagcggcccagggtgcaccggctgtgggtgggcgtgggggtagcggcatggtgggcagggccgctggagccagacagcacacccctgcctgccctaggccagtggaacccctgccggccggccagagccccctccggcgcctcactcaccaggtttggcaggcagctattgtgacctccccgggggcatacatggcgccgtggagcacacaggggcactgggtgacgggcacgcaggtgtggttattggagaggtcattcaggaccgtacctgcaggaga

SEQ ID NO: 71903 - DNA, 31 bp, Homo sapiens
  misc_feature 1..31: note = chr11:102961347-102961378
  misc_feature 1..31: note = hypo
  source 1..31: mol_type = genomic DNA
aaagcatttctcagtcgggcgaggtggctca

SEQ ID NO: 71904 - DNA, 66 bp, Homo sapiens
  misc_feature 1..66: note = chr11:102980422-102980488
  misc_feature 1..66: note = hyper
  source 1..66: mol_type = genomic DNA
caacttcttggatgacggcaaccagatgctcctcagggtgcagcgatccgacgcaggaatctcctt

SEQ ID NO: 71905 - DNA, 177 bp, Homo sapiens
  misc_feature 1..177: note = chr11:1030131-1030308
  misc_feature 1..177: note = hypo
  source 1..177: mol_type = genomic DNA
gtgggtggggtctgacgtccccttgtctctgggttctctctaggggtcccggggagagagagtgcctgcgactgccctcaccttccgggcagaagcacccgaaggtgcaggagctggagcagctgtgctgcgggttggagcaggtcttcacgcaggccgagccgcactcctggtaca

SEQ ID NO: 71906 - DNA, 30 bp, Homo sapiens
  misc_feature 1..30: note = chr11:1030716-1030746
  misc_feature 1..30: note = hypo
  source 1..30: mol_type = genomic DNA
agggctccttggacacgctgcactcagggg

SEQ ID NO: 71907 - DNA, 30 bp, Homo sapiens
  misc_feature 1..30: note = chr11:10326950-10326980
  misc_feature 1..30: note = hyper
  source 1..30: mol_type = genomic DNA
cagtcccctctgctccgtcagccaagttcc

SEQ ID NO: 71908 - DNA, 96 bp, Homo sapiens
  misc_feature 1..96: note = chr11:103327717-103327813
  misc_feature 1..96: note = hypo
  source 1..96: mol_type = genomic DNA
tcatgcactgcataacgatgtttgtcaatgacaggttgcacatactacagtggttccataaaattataatgaagctgaaaaattcatattgcccgg

SEQ ID NO: 71909 - DNA, 36 bp, Homo sapiens
  misc_feature 1..36: note = chr11:103327933-103327969
  misc_feature 1..36: note = hypo
  source 1..36: mol_type = genomic DNA
tagtacataatacttgataaccgttcatgctttatg

SEQ ID NO: 71910 - DNA, 712 bp, Homo sapiens
  misc_feature 1..712: note = chr11:104034042-104034754
  misc_feature 1..712: note = hyper
  source 1..712: mol_type = genomic DNA
actgctagattgaaacgcacgatttctcctctcactcgtaaaaataaataaataaataaataaaatttaaataaacgtctatcacccagggaaagctactcttgactccttccacctatcaaaattgcctaagaaaggttgagtctgaccaaggggcggcgcagcttgcaactttcgccaactccgggatgaggcaccgcatcctggtaccagaggcttggacaccaaaatgacttctctagggtgcagcaaggtgagccacctggcttatcctatccccatcagcacgcgtcccacacctctcagtcccattccggaaatggagctctctcaggactggatacaggcaggagacctccctccccaaacaatgcattcagcccgagttcacattcaagattcaaaaagaaaggggaaaaacatagaaagaacaataacaatagcaaacatgatttttttttcagttaaaaaataaaatgagtctcttaccatctcgcctgaggttggcgttgcgcaaagctttgatggatgcgctctgcggggttgcagaagtgtcccgacagctgcaaaagtttgcgcagattagagtgtagacaaagatgagccggtgcatttgggatcagcgactagagacagcgtcgctccaagaaaaagccgggttctgctcccgggaccgacgccgcgccgccctgcgctctcgccgcctgcgctc

SEQ ID NO: 71911 - DNA, 463 bp, Homo sapiens; identical to SEQ ID NO: 3788
  misc_feature 1..463: note = chr11:104034755-104035218
  misc_feature 1..463: note = hyper
  source 1..463: mol_type = genomic DNA

SEQ ID NO: 71912 - DNA, 25 bp, Homo sapiens
  misc_feature 1..25: note = chr11:10405168-10405193
  misc_feature 1..25: note = hypo
  source 1..25: mol_type = genomic DNA
tctctctctaggagtcgtcatttat

SEQ ID NO: 71913 - DNA, 21 bp, Homo sapiens
  misc_feature 1..21: note = chr11:104099607-104099628
  misc_feature 1..21: note = hypo
  source 1..21: mol_type = genomic DNA
agccaccgtgcccggctattc

SEQ ID NO: 71914 - DNA, 51 bp, Homo sapiens
  misc_feature 1..51: note = chr11:1043870-1043921
  misc_feature 1..51: note = hypo
  source 1..51: mol_type = genomic DNA
tgctgccacttctcccggcgtggactggctggatcacgtggttggcgtctg

SEQ ID NO: 71915 - DNA, 84 bp, Homo sapiens
  misc_feature 1..84: note = chr11:10468369-10468453
  misc_feature 1..84: note = hypo
  source 1..84: mol_type = genomic DNA
gaagacaaacctctacgatttttttttcagggattttccaagtcatgcaatacttagttgtgtactttttaaaaattatttttt

SEQ ID NO: 71916 - DNA, 495 bp, Homo sapiens
  misc_feature 1..495: note = chr11:10472027-10472522
  misc_feature 1..495: note = hyper
  source 1..495: mol_type = genomic DNA
ctgggaaaagttgtgcggggaggggaggacgtcgggcaagcccgggcggcacggggagcggtgtggaagcccggcggggccagcgcagttgaggtctggggagcccggctggcatctgctccgggctgcggcgcgggccccgcggagcccaggaggcggcgggtgcttccggccaagggccctggcggccgccgcgcccctgctgctctcaagtttcccgttggcggcgcggcccgggcgcttcaggtagcctctcggctctctctgctccgctccgcgcccaggtagggcaccgacgggggctgcacgcggctggccggcttcctccctgctgaggcggccctccctcctcccgcggggccctcctggccggggatccgcagcgctgcgccctctgaacgcccggcccccgcgcctgctgcggggcgcggcctggccgggccctggccccggctggcctcagtgcccagcagccccgctccgctctgcccagcg

SEQ ID NO: 71917 - DNA, 46 bp, Homo sapiens; identical to SEQ ID NO: 33630
  misc_feature 1..46: note = chr11:10472557-10472603
  misc_feature 1..46: note = hyper
  source 1..46: mol_type = genomic DNA

SEQ ID NO: 71918 - DNA, 214 bp, Homo sapiens
  misc_feature 1..214: note = chr11:10509593-10509807
  misc_feature 1..214: note = hypo
  source 1..214: mol_type = genomic DNA
tggttttgcatccttcgggatcatgtggatttaaagaaaagcctctgatatgctcagatctctgcctctcttctcccaccaaggggatggcagccttgtccggggctcctggcagtctccgcctgcaggggccgcaactgcggtaggagcgaaggttaaatgatcatggccctagcctttccattctcttttgctgaagcgctgtgcagtgagg

SEQ ID NO: 71919 - DNA, 39 bp, Homo sapiens
  misc_feature 1..39: note = chr11:1053231-1053270
  misc_feature 1..39: note = hypo
  source 1..39: mol_type = genomic DNA
gagcctgcacccctacgcgggggacgcctgggcagctcc

SEQ ID NO: 71920 - DNA, 66 bp, Homo sapiens
  misc_feature 1..66: note = chr11:105480721-105480787
  misc_feature 1..66: note = hyper
  source 1..66: mol_type = genomic DNA
ggctctccagattcccgggctgtttgctggtgagaaatctttgctgcagcgaggaccggagtcccc

SEQ ID NO: 71921 - DNA, 459 bp, Homo sapiens
  misc_feature 1..459: note = chr11:105480858-105481317
  misc_feature 1..459: note = hyper
  source 1..459: mol_type = genomic DNA
cgtcctcctcacgaacctgcaaggatgcggcaggggcctgggggcatggggaggtactaaccccccggagcccccgattggggcttgcagacctggcccgtgggcggattttctgcctagcgcagccgagaagcagaggtgccaggaaaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccggtgagcacccagggggtgaagccagccgagcggtgggcgaggggcgtgcggagggagtgcgcgctcgaggaggggacgccaggagggcagcgatgctccgggctggtgcaggcttgctgggggatgtcggctgatgcgagctggagagcgcgtgtggcggcc

SEQ ID NO: 71922-71923 - skipped (2 entries)

SEQ ID NO: 71924 - DNA, 554 bp, Homo sapiens
  misc_feature 1..554: note = chr11:105481323-105481877
  misc_feature 1..554: note = hyper
  source 1..554: mol_type = genomic DNA
ccagtgtttgtgtgtatgtgagaaagcaaggggcgagcgcgagtgcgagtgaggcaaagatagagcgcatgtctcatccctgcgagcagccactagacgctccaccaccatcttttgcatgtgcaacatttgcagccggacagaaaacctctcccagggctatggagactgcgggaaaaatctggcggctcgcgatggattgctaaggagaactagtcataatcttaaaccaccgaaacctctttccttttttttctttcttttctttcttttctttttttttttttttttttggttgattttaattttagcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtaaggtgtgctccgatggggtgtgcatgtggctggttgtagcagatatccgaaagtgagttaaa

SEQ ID NO: 71925 - DNA, 30 bp, Homo sapiens
  misc_feature 1..30: note = chr11:1055284-1055314
  misc_feature 1..30: note = hypo
  source 1..30: mol_type = genomic DNA
ggaccagggtcaatccggggtgccccaggt

SEQ ID NO: 71926 - DNA, 30 bp, Homo sapiens
  misc_feature 1..30: note = chr11:1056507-1056537
  misc_feature 1..30: note = hypo
  source 1..30: mol_type = genomic DNA
ccctgtcgcaccagccgcctgcccacacag

SEQ ID NO: 71927 - DNA, 808 bp, Homo sapiens; identical to SEQ ID NO: 34035
  misc_feature 1..808: note = chr11:106888283-106889091
  misc_feature 1..808: note = hyper
  source 1..808: mol_type = genomic DNA

SEQ ID NO: 71928 - DNA, 798 bp, Homo sapiens
  misc_feature 1..798: note = chr11:106889400-106890198
  misc_feature 1..798: note = hyper
  source 1..798: mol_type = genomic DNA
cgttgctgtcctctgcgcgccctccctgctccgaggaggtgcgcacaggagctcgggtcggactgagggccccaaccccaaacgccttatcctcggccctcgggagcagatgggtcccggcggcgctggtggggagaagggctcggggctggggggcgagaggcctccccctggagccaccttggggaaacctgacagtgtgaagtgggggttagggtccatgttgtcctttctccgagtttatttaggaagttccgaggcaaaagggaaaggccaagcgtccagccagcccactccagaggagacgctttcaggggaagggaaggacaggggcaacattttggcgcccatcctgctggagcagctcctggggacttgtgttccccgcctcgtgcgaggccgtgtgggcgcggagcgagcccagaaaggggcggcagtgaggacagcgtctgctctgacaagacagcactgttgctgagcctcagccgggcggggtgcgcggggctcccggctccgctggctcctcactagtgctggacagctccgcttgccacctatagccgcctttgcaggcgttgagaactggagaacagttcctcctcaaacgacctagcacctggcccgggggaaaccggggaatgatcccacgtccctcatcctcagggctctttgcgccaaatatgcgatctgtttgcacctgactgcaaatgctgctcagaaagctaaggggagtagggataaatgcttctcgaactgactcgccacagcgcgagcatgtcttgccgcgagttttcagct

SEQ ID NO: 71929 - DNA, 30 bp, Homo sapiens
  misc_feature 1..30: note = chr11:107047782-107047812
  misc_feature 1..30: note = hypo
  source 1..30: mol_type = genomic DNA
cgcgggcaagcacagcgtgggcaatattgc

SEQ ID NO: 71930 - DNA, 1339 bp, Homo sapiens
  misc_feature 1..1339: note = chr11:107461396-107462735
  misc_feature 1..1339: note = hyper
  source 1..1339: mol_type = genomic DNA
aaaggcgggggctgccggttggggtgagggatagggttctgcagtcccgggaaggcaggtgaagggtggggatcaggattggaagagtcactgggtgctcggtgagacgagggaggttggagctgaactaaaacaaagtttgacttctggacaattatccagggagagggcggggaacacaccttgcccggactgtctgggaatcccattgacaggtcatctcaggttcaccatcttcctgtcgtgggctcctccagggaggccacccgggagcaattaaactgggccacaccagccacctcccacagcagcggggtccgcagatttaaccctttccccccagattccggcactgggtgccgcgctctctcccccagcaccgcgcccgcgcccccggctcccggactgggcatgctcagtagccgcccgcttcgtgctcccagggaagcctctgcacgccctcccccgctgctctcggtcgcctcctcgccgccagccgccccgggtgcatcccggcttgctccgctccacgcgacccagattcctgccccgcccccgccccttccgcgcccgcagccagtgcggcagccgcggccgcccctgtccagcctcggcgcccgggaccgagcgcgtcgctcgccgccgcggagcgcgtagccggagcgcctggggaaggcggagatgaagaccacgccgccgcgcgccgggagctgctgagcctaccgccgccagagtccaggtgattggcgaccccagaggagcctagggagtaggggcgaatgcccttggggaggagagaggtgcggcgaggacgcgaggcatcacgcaagctgcgctgtgcctgggaggcagcagaaatgctaagcatcgggggcagagagggaacgggaatgaaagtgcactctgccttggtgcaggggctccggggtcacccaggacagtgatttccccttctatcctgtcctcccaattaacacccgagaggctgcaggtcggcgcgagaggctgtttgcatctcggcccgggcgtaggtcgcctagcgacctaacgccgagggctcggggaagggatcccagacagagccaaaatggaaggcgggacaagggcggcctggctggggcgaggggctggtctgggtccctgggaaccccttgccttgtgggcttcggtctccagggaggagctaggcagccgggctgcggggccgccggactgtggggtcctccgcgcagcgagctgggaggagcggtcggctgggctgttgagctgcgcctcctccaactgctgggaaactccgcacttcaatattggagcatctctttcccgggcaggtagaatt

SEQ ID NO: 71931 - DNA, 212 bp, Homo sapiens
  misc_feature 1..212: note = chr11:1075735-1075947
  misc_feature 1..212: note = hypo
  source 1..212: mol_type = genomic DNA
cttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtgtgagtgtggtcggtggcacccctcc

SEQ ID NO: 71932 - DNA, 203 bp, Homo sapiens
  misc_feature 1..203: note = chr11:1077565-1077768
  misc_feature 1..203: note = hypo
  source 1..203: mol_type = genomic DNA
acccaagagtgaccccgatgtgcctccgccagggtcagcaccccgcactacagccccgggctgctcattgagaagagcgatgcctacaccaaagtctactcccgcgccggcctcaccctcatgtggaaccgggaggatgcactcatggtgctcaggggtccccggactcgtggggctggtgggggctccgtcaggcctctggg

SEQ ID NO: 71933 - DNA, 1236 bp, Homo sapiens
  misc_feature 1..1236: note = chr11:107798867-107800103
  misc_feature 1..1236: note = hyper
  source 1..1236: mol_type = genomic DNA
acgcctgtaagaaaacgactctcacttttcattggctgaccctcccggagttgagaccttgcttcattttccttggttgttgctgctgtcacgtcttcccgccacgcccactttcctgccggcgcccagtgagcgttgagggagagtgatttgcagccggtcaggggcgggagttcgcggcagcaaacctgcttccccctcccacgcgccaccgcccccgccccgcccccgtccagaggccccgcccctagccgggcctggccccgcctctctctcccgagagggcgggcaccaggcggcggccgcagccgcaggaatatgctggaaggcggcgggcgggcgcccgcgaggtgctgaaaggacagttcccgccgccgaacttagcccgcgggtggggcggcccgggagccagcggggcacgtgagcgatggagaccatctggatctaccagttccgcctcatcgtgatcggggactccaccgtgggcaagtcctgcctcctgcaccgcttcacccagggccgcttccccgggctgcgctcccccgcctgcgaccccaccgtcggcgtggacttcttctcccgcctgctggagatcgagccgggcaagaggatcaagctacagctctgggacacggcgggacaggagcggttcaggtagggaccccggggaccttgggcaccgcgccgccccctcagcccgcccggacgccccttccccaggcgtccgccccgccggccctggtcgggagaggctctggcccttccctctcgaaagtgcaaacactccattctcgcttcccctttgcccctcctcttccagggacgacttcctcctccgcaatttctcacttctttctttggcgcccatttcctgcgccccctttccatctttcctttcccgcctgaaccggggtcgtcctcgccgccccctcttccccaactctttcagcccctgtgggtatttttatcccctccggctccccggctgccttcttcccaaactcggcttccctggctgcgcacagcatgacccgaccaccctcctccaagcaggcgccccttttcctaccctaacccagcggctcccacgctgtgtggccggggagaaccgcgagggagggttcccagattcgtgatggatcctttagcttcacagcaaggagcgctccaacccaggttcctgcatgagctcactgggcatggttcacagagaggtggatgcggtaatggtttggg

SEQ ID NO: 71934 - DNA, 18 bp, Homo sapiens
  misc_feature 1..18: note = chr11:1078768-1078786
  misc_feature 1..18: note = hypo
  source 1..18: mol_type = genomic DNA
tggggggacactcaccgc

SEQ ID NO: 71935 - DNA, 102 bp, Homo sapiens
  misc_feature 1..102: note = chr11:1079561-1079663
  misc_feature 1..102: note = hypo
  source 1..102: mol_type = genomic DNA
ctcaccgtgggctgagagcccttctcggtgcacttcggggtggagcggctgctgtgccccagcctcaccctcactgcgtggcctctgcggttccagccaaga

SEQ ID NO: 71936 - DNA, 126 bp, Homo sapiens
  misc_feature 1..126: note = chr11:1080203-1080329
  misc_feature 1..126: note = hypo
  source 1..126: mol_type = genomic DNA
tggctggcagcccctcggtggggattctggctctttctgagccagccggggtgacatcgcctccctggctgtcccaggcaccgtatatgacgacatcggggacagtggctgcgttcctgtgagcca

SEQ ID NO: 71937 - DNA, 37 bp, Homo sapiens
  misc_feature 1..37: note = chr11:10811151-10811188
  misc_feature 1..37: note = hypo
  source 1..37: mol_type = genomic DNA
accctaggccgggcacggtgactcacgcctgtaatcc

SEQ ID NO: 71938 - DNA, 29 bp, Homo sapiens
  misc_feature 1..29: note = chr11:10815867-10815896
  misc_feature 1..29: note = hypo
  source 1..29: mol_type = genomic DNA
acatttgaagctgggcgcggtagctcacg

SEQ ID NO: 71939 - DNA, 208 bp, Homo sapiens
  misc_feature 1..208: note = chr11:1081640-1081848
  misc_feature 1..208: note = hypo
  source 1..208: mol_type = genomic DNA
cccctcaggcctctgcgggaacttcaacggcctggaaggtgacgacttcaagacggccagcgggctggtggaggccacgggggccggctttgccaacacctggaaggcacagtcaagctgccatgacaagctggactggttggacgatccctgctccctgaacatcgagagcggtgaggctcggcaacacgggcgcccccacctagcg

SEQ ID NO: 71940 - DNA, 30 bp, Homo sapiens
  misc_feature 1..30: note = chr11:1082664-1082694
  misc_feature 1..30: note = hypo
  source 1..30: mol_type = genomic DNA
ctgcaccgccaagggcgtcatgctgtgggg

SEQ ID NO: 71941 - DNA, 30 bp, Homo sapiens
  misc_feature 1..30: note = chr11:10828053-10828083
  misc_feature 1..30: note = hypo
  source 1..30: mol_type = genomic DNA
tgaccatgttgagtgcgtactactttacta

SEQ ID NO: 71942 - DNA, 68 bp, Homo sapiens
  misc_feature 1..68: note = chr11:1083440-1083508
  misc_feature 1..68: note = hypo
  source 1..68: mol_type = genomic DNA
gcctggggtggggggcgctgagaggcatcaggctcacatctgcggggaagctgcgggctgtctgtggc

SEQ ID NO: 71943 - DNA, 48 bp, Homo sapiens
  misc_feature 1..48: note = chr11:108540610-108540658
  misc_feature 1..48: note = hypo
  source 1..48: mol_type = genomic DNA
agaagctggaaaaggcggggaaatggactctgccgtagagtcatcaga

SEQ ID NO: 71944 - DNA, 30 bp, Homo sapiens; identical to SEQ ID NO: 42882
  misc_feature 1..30: note = chr11:1085664-1085694
  misc_feature 1..30: note = hypo
  source 1..30: mol_type = genomic DNA

SEQ ID NO: 71945 - DNA, 30 bp, Homo sapiens
  misc_feature 1..30: note = chr11:108603360-108603390
  misc_feature 1..30: note = hypo
  source 1..30: mol_type = genomic DNA
agtggagaagtgccacgagtgatgaagcaa

SEQ ID NO: 71946 - DNA, 100 bp, Homo sapiens; identical to SEQ ID NO: 43016
  misc_feature 1..100: note = chr11:10865202-10865302
  misc_feature 1..100: note = hypo
  source 1..100: mol_type = genomic DNA

SEQ ID NO: 71947 - DNA, 57 bp, Homo sapiens
  misc_feature 1..57: note = chr11:109292773-109292830
  misc_feature 1..57: note = hyper
  source 1..57: mol_type = genomic DNA
ggcttggagccctggcggtggctgcctgacgtcaccggcctctctggcaataggctg

SEQ ID NO: 71948 - DNA, 353 bp, Homo sapiens
  misc_feature 1..353: note = chr11:109292891-109293244
  misc_feature 1..353: note = hyper
  source 1..353: mol_type = genomic DNA
cgcggctcggtctctggtccattcactccacgctttctgcagccgccactgcagccgcgcggcgggggctccctccttgcagccagccggcggtccaggtaagagacaaggtgtgagtaaaggcttctgatggccgggtggcctgacggccaggtgcgagtggggaggacagctcacgcggcctgagcagccacccctggccatagctccagcccccgcccctgcccccggcccctgccctggcttgcttgcgcgctacctcgctactccgcagtgcaacagtttgcagctgcctcttgggagcagcaaggaggctctcctgtgcgctgcgggtctaccggctccagtatgcc

SEQ ID NO: 71949 - DNA, 258 bp, Homo sapiens; identical to SEQ ID NO: 34043
  misc_feature 1..258: note = chr11:109293506-109293764
  misc_feature 1..258: note = hyper
  source 1..258: mol_type = genomic DNA

SEQ ID NO: 71950 - DNA, 26 bp, Homo sapiens
  misc_feature 1..26: note = chr11:109293873-109293899
  misc_feature 1..26: note = hyper
  source 1..26: mol_type = genomic DNA
cgcggtgccggcgcagaccccatcct

SEQ ID NO: 71951 - DNA, 76 bp, Homo sapiens
  misc_feature 1..76: note = chr11:109294113-109294189
  misc_feature 1..76: note = hyper
  source 1..76: mol_type = genomic DNA
caaaggaaaggggagcgtggagacgtgttcgaggtggtatcggcgaggatctctcgggcgccgctcactccttggt

SEQ ID NO: 71952 - DNA, 44 bp, Homo sapiens
  misc_feature 1..44: note = chr11:1094014-1094058
  misc_feature 1..44: note = hypo
  source 1..44: mol_type = genomic DNA
aaggcacgttctgggcgcctctctgcccacgaagcttggtcact

SEQ ID NO: 71953 - DNA, 219 bp, Homo sapiens
  misc_feature 1..219: note = chr11:1094942-1095161
  misc_feature 1..219: note = hypo
  source 1..219: mol_type = genomic DNA
agatcgcagtagaagcgtctcaggaggcagcagccgtcgagggtggctgtgtccagggcacggcttcccttgggtggcctctgtggggacctccgctgtggggacctccacggggtccagcggctagccctgcctccggatagccctgcctctggacggtgtgatcgtgggtctgtctcccttcgcaggtgaggaggtgtacaacggcacatacggaga

SEQ ID NO: 71954 - DNA, 116 bp, Homo sapiens
  misc_feature 1..116: note = chr11:10952367-10952483
  misc_feature 1..116: note = hyper
  source 1..116: mol_type = genomic DNA
ctctgctggaagcttcggcagcggctccgaacgcttcccgccgcctcgcccggccgcagccggttcttcgtgctcctcgctcggcgcccactggccgccgtcgccccgaggctgcc

SEQ ID NO: 71955 - DNA, 118 bp, Homo sapiens
  misc_feature 1..118: note = chr11:1095551-1095669
  misc_feature 1..118: note = hypo
  source 1..118: mol_type = genomic DNA
ccgtggaagccacttcggcctccagcctcccggctcagcacccgcccctcctgagcgcagaccaccccatcctgtgccggtccccctgacgtcccttgcctcccgtccccaggagaac

SEQ ID NO: 71956 - DNA, 21 bp, Homo sapiens
  misc_feature 1..21: note = chr11:109661438-109661459
  misc_feature 1..21: note = hypo
  source 1..21: mol_type = genomic DNA
ccaccacgcccggccgatatt

SEQ ID NO: 71957 - DNA, 30 bp, Homo sapiens; identical to SEQ ID NO: 43243
  misc_feature 1..30: note = chr11:109880267-109880297
  misc_feature 1..30: note = hypo
  source 1..30: mol_type = genomic DNA

SEQ ID NO: 71958 - DNA, 170 bp, Homo sapiens
  misc_feature 1..170: note = chr11:110089331-110089501
  misc_feature 1..170: note = hypo
  source 1..170: mol_type = genomic DNA
ttttctagtatttcacggtactaccttctgaatcccaaactttacgttttcaatacaaatgggcagtcccagcacacactccacatccttctgtgactcgatatatttgcatatgcagttacttctttccagaaactttcctatctttgcctcctcgattaagagtaact

SEQ ID NO: 71959 - DNA, 30 bp, Homo sapiens
  misc_feature 1..30: note = chr11:110132980-110133010
  misc_feature 1..30: note = hypo
  source 1..30: mol_type = genomic DNA
tacaaaattaaagggcggaacactgtgaca

SEQ ID NO: 71960 - DNA, 240 bp, Homo sapiens
  misc_feature 1..240: note = chr11:1103974-1104214
  misc_feature 1..240: note = hypo
  source 1..240: mol_type = genomic DNA
gagaccccagggaggcgagaggccagcgctggccccggaaggtcacccctcactccgccctccccccaggtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccgg

SEQ ID NO: 71961 - DNA, 647 bp, Homo sapiens; identical to SEQ ID NO: 34046
  misc_feature 1..647: note = chr11:110581773-110582420
  misc_feature 1..647: note = hyper
  source 1..647: mol_type = genomic DNA

SEQ ID NO: 71962 - DNA, 608 bp, Homo sapiens; identical to SEQ ID NO: 34047
  misc_feature 1..608: note = chr11:110582421-110583029
  misc_feature 1..608: note = hyper
  source 1..608: mol_type = genomic DNA

SEQ ID NO: 71963 - DNA, 1132 bp, Homo sapiens
  misc_feature 1..1132: note = chr11:110583043-110584175
  misc_feature 1..1132: note = hyper
  source 1..1132: mol_type = genomic DNA
cggaggcgcggctgccgtgctcaggcagggagccgagctccgggtgctcgccgcgcgcctcccgtcggggccatgtacctccgcctgcgctcgacaccgcgggctggaggcgagtgcagcggcgacagcccgtcagcgccgcggcccgccccgcctcgggcccgccccctccgctccgggcgccctgcgccggggcccgcccccgcagccctcctcagccctcctccagcctgggccctcctagcctcgtcccagcctgcggcgcgcctggcgggcgtctctctatatatgttagcacaccggccaccggctgaccttttcggtctgtgactccgcgtgggtgcagcccgcaggagctcatcggcctgtgtcacgcacgggggcctctagtgcacggacacgcgcctctcccgccacctgcccactcccaccagaccccatcccttcccgcgccgtgcccgcggcggaaggcgcccctgcagcgcgtgcatccgcggagcggtggcgacctcagcctgagcagaggagttgcagtgattcctgcctcgctttcagcggactgcggagggaatcccccaccccaccccactggggatagggtggcacgtcgcagagtgtcgcagctgtacaaatttggaagcccacagcatcgcctgacctcttgtgcaatcccgaacgctagcctgttcgggtaaccctgagtgggcttctgcagccggtcatgtcagcggcccctgcacatttgcacccgcggtttccgctgtctgcaggctgcagagacgggggcattccaaacgtgaaagagcaatgaaggaaaatgcagacagagcgaggacgccgaaatttggctaagctattgagaaggctacaatatgtggaagtgtttatcagatatctgcgccgagagcataacttcctgtcagcccaaatagaggcaaaaatattttaaaggccaaagaataatcagagggagaggatttggagctgacccgcgttgagctgagtgttgctgcactttgcggggctggttgactggtacggatgattcggtagatggcattcttcccttggagtcaggactagagaagcagtggcggattagtgaggaaggacaccacgctatgatattagg

SEQ ID NO: 71964 - DNA, 30 bp, Homo sapiens
  misc_feature 1..30: note = chr11:111089918-111089948
  misc_feature 1..30: note = hypo
  source 1..30: mol_type = genomic DNA
aagtagaaagggagccgaaagtactggaag

SEQ ID NO: 71965 - DNA, 397 bp, Homo sapiens
  misc_feature 1..397: note = chr11:111154359-111154756
  misc_feature 1..397: note = hypo
  source 1..397: mol_type = genomic DNA
cttatccagacatagcgatctcagataacaggccaggagcacctcttgttaacagttctatgtatatggagaggtagctccgatgttgtgaaaaagatgcttccttggttaaaatatgaatgccaagagattatttcatttatgtcttcctagcacagcgccggtcaccgggaaggtactcagtaaatgtgaatgaatgaacagacacggtactgtctaaaatgaactcacccctaaaggcgacaatgttttcaaacgttagttatttgggctaatgcaggaatatttcacgcttttcaagacatttctctatttccatgttagcgttggagtcaggcacgcgttagtaacatcgtttcccaggcagagactcagctgcaaccgaggccttgaccgc

SEQ ID NO: 71966 - DNA, 100 bp, Homo sapiens; identical to SEQ ID NO: 43245
  misc_feature 1..100: note = chr11:111156679-111156779
  misc_feature 1..100: note = hypo
  source 1..100: mol_type = genomic DNA

SEQ ID NO: 71967 - DNA, 379 bp, Homo sapiens
  misc_feature 1..379: note = chr11:111169972-111170351
  misc_feature 1..379: note = hyper
  source 1..379: mol_type = genomic DNA
ggcactatctccaggcgtccaggctgaacgcgcggtcaccctcggccgccgcacccagcgcacttcccggcgcgattcctggacgcacactgcagggtagtggtcagggccggagccgccccggactcctgcggccacctccaccttgaaagctcgcccggctcggcttggcctaacagccagtccccaacctactcactgcggcttttcggggcccggggctgaggctgcccctgctcccagcgctcaggggtccctcccagcgaacccctcttgagcgcgcccgccacctcccgcgagccggggcagtccgaccgggccccgccagccccggggcggcccctaccgaagggcggcctcccggcggagtgcagggtca

SEQ ID NO: 71968 - DNA, 390 bp, Homo sapiens; identical to SEQ ID NO: 34050
  misc_feature 1..390: note = chr11:111383125-111383515
  misc_feature 1..390: note = hyper
  source 1..390: mol_type = genomic DNA

SEQ ID NO: 71969 - DNA, 16 bp, Homo sapiens
  misc_feature 1..16: note = chr11:111383516-111383532
  misc_feature 1..16: note = hyper
  source 1..16: mol_type = genomic DNA
ggggtcccgctgggcc

SEQ ID NO: 71970 - DNA, 348 bp, Homo sapiens; identical to SEQ ID NO: 3793
  misc_feature 1..348: note = chr11:111383557-111383905
  misc_feature 1..348: note = hyper
  source 1..348: mol_type = genomic DNA

SEQ ID NO: 71971 - DNA, 218 bp, Homo sapiens
  misc_feature 1..218: note = chr11:111385246-111385464
  misc_feature 1..218: note = hyper
  source 1..218: mol_type = genomic DNA
ctcccccactgactccgacaggacacaacccaaagttgacgttttgactctcccatatccaagatttggactggtcctaaaacctgatcaccgcaggggtgggcttccgacggcccccacgcgcgtggcggatcccaacacctacctaggaaaccgagggcagccggcaggggctggtaccaacttggcggttctcggaggggcggggcaggggcggg

SEQ ID NO: 71972 - DNA, 87 bp, Homo sapiens
  misc_feature 1..87: note = chr11:111411112-111411199
  misc_feature 1..87: note = hyper
  source 1..87: mol_type = genomic DNA
cttggctaaggtcagcgggagaggaggggtgagatgtggtgctagttttaggcacactgtgctcgttatcagattgcctaggggccc

SEQ ID NO: 71973 - DNA, 382 bp, Homo sapiens; identical to SEQ ID NO: 34055
  misc_feature 1..382: note = chr11:111411200-111411582
  misc_feature 1..382: note = hyper
  source 1..382: mol_type = genomic DNA

SEQ ID NO: 71974 - DNA, 483 bp, Homo sapiens
  misc_feature 1..483: note = chr11:111411821-111412304
  misc_feature 1..483: note = hyper
  source 1..483: mol_type = genomic DNA
cgtctgagacccacgccagttcccggagctgcgcagttccctgcgcgtcctggaacgctcgaagcccgttcccagtccagagttatgggggtgggttggagaatgtaggagaggtggggcagtgggcaaacctgccccagtgggtgccccttcggcccgctcctttacacgcatcgaatcagtccttgggaccacccccgcggggcaggcttgccagctggcccccgcctaccgcccgctccgggaggcggccgcagagacagcggggtagggatgctggatccccggtgccgtgggaaccctgcctgttactcctcgtctcttctgcggggttggatggctgggtcgagcgcccggtatgagagcgcttagagatcgggaaagaactccagttagtgtgggacgagccccacctgactccggggaatgactctctgcttccttcctcctgttgtgtcactgcagcctcggatttggacctca

SEQ ID NO: 71975 - DNA, 30 bp, Homo sapiens; identical to SEQ ID NO: 34057
  misc_feature 1..30: note = chr11:111412594-111412624
  misc_feature 1..30: note = hyper
  source 1..30: mol_type = genomic DNA

SEQ ID NO: 71976 - DNA, 133 bp, Homo sapiens
  misc_feature 1..133: note = chr11:1115098-1115231
  misc_feature 1..133: note = hypo
  source 1..133: mol_type = genomic DNA
caggagtgctgattgcggcgggtggtaaactgcgggtgcccctttgcggtgcccggatacctggcggggagccctgggggctgcccatgaaccagtgcccactttcctgcccctggcacgggctcggcatggg

SEQ ID NO: 71977 - DNA, 30 bp, Homo sapiens
  misc_feature 1..30: note = chr11:1120833-1120863
  misc_feature 1..30: note = hypo
  source 1..30: mol_type = genomic DNA
gtgtggtgcagctagcgtggaccatgtccc

SEQ ID NO: 71978 - DNA, 30 bp, Homo sapiens
  misc_feature 1..30: note = chr11:112370516-112370546
  misc_feature 1..30: note = hypo
  source 1..30: mol_type = genomic DNA
acaccttgtgggaagcggaggcggccaccg

SEQ ID NO: 71979 - DNA, 30 bp, Homo sapiens
  misc_feature 1..30: note = chr11:112651559-112651589
  misc_feature 1..30: note = hypo
  source 1..30: mol_type = genomic DNA
aggcatgtgttccagcgtgattagagctga

SEQ ID NO: 71980 - DNA, 177 bp, Homo sapiens
  misc_feature 1..177: note = chr11:113258642-113258819
  misc_feature 1..177: note = hyper
  source 1..177: mol_type = genomic DNA
ctccccgtcttcacccgcgacgacttcgagggcgactggcgcctagtggccagcggcggcttcagccaggtgttccaggcgcggcacaggcgctggcggacggagtacgccatcaagtgcgccccctgccttccacccgacgccgccaggtactgccagcctcgccctcccctttct

SEQ ID NO: 71981 - DNA, 56 bp, Homo sapiens
  misc_feature 1..56: note = chr11:113286309-113286365
  misc_feature 1..56: note = hypo
  source 1..56: mol_type = genomic DNA
tggcaatgatgcactcgttctggtctgggggagggagagcccgggcaggcagggag

SEQ ID NO: 71982 - DNA, 744 bp, Homo sapiens
  misc_feature 1..744: note = chr11:113344994-113345738
  misc_feature 1..744: note = hyper
  source 1..744: mol_type = genomic DNA
acagggatagggaagcgctctgtctggtgcttagaggtgtctcttgtctccgcataccaccctagaggggctctcggtccatcatagagccgggccgagagccgggcggtcaccctccgctactgccgccaccgtcgcctgcactgccgggtagaaacgggtctggcacccaagcctccctccccgactaggtgtcaacccaagagaaggcgaaggagaacgaaagttcaggaccaaggacagcggcaaccgtgggagcgggagaatccagccagaatctgcctctcccccatccttagcttctgccttagaaactgaaaagggtcaggtcgcaccaacacagagttgccaaaaacagcccttcttcctccggaagaagtcggaaactctggccgcgagccccgggtctcgcgcttgggtgctgggggaagtgccctcccgagattgtggggagcggcctccctcccgccctccgatgccgcggctccgccgtgctgccctgggcgccccgcggggaggctgccccagctgcgcccgctcgtgctcggggagaggattcccttctaagtggcgaggaggctactgagaaggagggagaggggatagcagccgcgggctccagacgccctctgcccccgcccgacggggagcccatgcagagccggatcccaggcgggcgctcccgagcaggcggccaggagtggccgcacaaacttctggtcctggcctcgctccccttggagg

SEQ ID NO: 71983 - DNA, 102 bp, Homo sapiens; identical to SEQ ID NO: 34060
  misc_feature 1..102: note = chr11:113346239-113346341
  misc_feature 1..102: note = hyper
  source 1..102: mol_type = genomic DNA

SEQ ID NO: 71984 - DNA, 23 bp, Homo sapiens
  misc_feature 1..23: note = chr11:113373844-113373867
  misc_feature 1..23: note = hypo
  source 1..23: mol_type = genomic DNA
cgagactccgtctcaaaaaaaaa

SEQ ID NO: 71985 - DNA, 265 bp, Homo sapiens
  misc_feature 1..265: note = chr11:113552719-113552984
  misc_feature 1..265: note = hypo
  source 1..265: mol_type = genomic DNA
agcccatccagctcccgtacgggcggcaggcccttctcttcctcctcctgagtgggctcaaccactcgaagccagcacctataacatgctgagcccgcaccgggctctaggaaccagaaatcagagtgaccaggggaaactgggacatcgatatgcatggcttgccggagtaacactacacctgactcaccttcctagcctcccgcaaattgccagagaagttctgggcctaggagggccaggctgtttgcgcaaaacattaggt

SEQ ID NO: 71986 - DNA, 262 bp, Homo sapiens
  misc_feature 1..262: note = chr11:113560957-113561219
  misc_feature 1..262: note = hypo
  source 1..262: mol_type = genomic DNA
atgcatcagcccttccgtccaggtagccagcgcaaagcatgcggggggtgagggctccgctgtacacgcaagagctgttgcagagctgagtgctgaacaagggcaccaccgtgtcctggagcatatccgagctgtaagctatgagagacaccgagaaaaactgcagggcacaaagcaaggcccaggcaggcagagcagcaagaggggaggtaattcgaagtcccagagacagggagacccaaagaggcgagcccagggtggg

SEQ ID NO: 71987 - DNA, 30 bp, Homo sapiens
  misc_feature 1..30: note = chr11:11373606-11373636
  misc_feature 1..30: note = hypo
  source 1..30: mol_type = genomic DNA
ctgacatcacattggcgctgctgacgggcg

SEQ ID NO: 71988 - DNA, 93 bp, Homo sapiens
  misc_feature 1..93: note = chr11:113902101-113902194
  misc_feature 1..93: note = hypo
  source 1..93: mol_type = genomic DNA
acttaaattaagcctcggaagtcaggggagctccgcagcatccctaatgcggtgctaaattctcagcagcacagtctccgtgttaaagccttc

SEQ ID NO: 71989 - DNA, 59 bp, Homo sapiens
  misc_feature 1..59: note = chr11:113907046-113907105
  misc_feature 1..59: note = hyper
  source 1..59: mol_type = genomic DNA
ccttctggcctccagcggacggaggtcaggcgctgacttggccccgggctaagagggga

SEQ ID NO: 71990 - DNA, 525 bp, Homo sapiens
  misc_feature 1..525: note = chr11:113929598-113930123
  misc_feature 1..525: note = hyper
  source 1..525: mol_type = genomic DNA
gtttctcccaggactcgaccttggcctccagcaatcgcgacagctaaaaacgggtgtctcgcttcgacaatagatccccgcggaccttctggcacctggttcactagcgcccgcgaactctgcctcgggagacttattgaaatccggatgctcaagccgggaggcgcgcagtaaccaggaggatgagagggccgggtttgggctaggaaagcggccttttaaaacagatgtcagggggactgcagccccgagccatgagaaaaaagttaaaggcgagatgacacgcactgaattggggcaaacattggaagaggagacaaaactgcgtgcttgagcaccggggtgcggggagggggggacaaaacccgtatccagtgcaaattaaaatcttgggagtaggtgggggctgctgcgcgcccttcaccctcagttcccctattaaggattctgagtccccatgcactcctgtcctctggctccttccttcctctccgctcggccggtgagaggcggccgccggcgccc

SEQ ID NO: 71991 - DNA, 434 bp, Homo sapiens
  misc_feature 1..434: note = chr11:113930367-113930801
  misc_feature 1..434: note = hyper
  source 1..434: mol_type = genomic DNA
ggggctcggcgttgacgtgggacgcggcggaggcgcagcagccggtggtgatttgctaacctcgcagcagagaggagttgagggcgatgagagcgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcggtgagtgaggggccgggaagaggcgcaccgcccagcgagcgccgcgcgccggggcttcccggggctggagaggtctggggggcgcgcgctcgcttcggccactcggccgctgggcttgtgccttttttatttggcgtgttcccttcctgccgctgcagccgtcgccgccaccggttgggggtcggctagaaggggga

SEQ ID NO: 71992 - DNA, 37 bp, Homo sapiens
  misc_feature 1..37: note = chr11:113931030-113931067
  misc_feature 1..37: note = hyper
  source 1..37: mol_type = genomic DNA
atttgtgtgtttattcgccggccggctgggaagctag

SEQ ID NO: 71993 - DNA, 821 bp, Homo sapiens
  misc_feature 1..821: note = chr11:113931299-113932120
  misc_feature 1..821: note = hyper
  source 1..821: mol_type = genomic DNA
gctctcggtgggtgccggtctctgcacctgatgcgttcgggatgcctttcccaccctggcgcgcccgccgctagctcgcacagcgcctcgcacactcccgcacgcgcttgaaatgcgcacggtcccgccggcccgcggaaccacccggacgcacggagcgctccgcaccgactcgctcgccgcctccccgagacgctcgcaccgtgcttgggccgggcgcgctggccgctggcgccgctggccagaggcctgggacccagccggtcgctcccagggggtcacggccctgggtcggagagggagggcgggcagaccccttctcgcctttcctcccacaactcgctgcggggcttttgtgcttccccttcgccgcggggcgggtccgcctcccctgccgctctcgccgcggagtccagcccgcccggactgtcgccgttcctccccgtctctttcgctttccctcgtccctagctcagctctccttctttcaggagtctagctcctcgggaaaagttgcttccccaagtttgctgaagtcgtctccaagtctcggtgggggtcgctgggaactgggggggtgtgagagcgcggtcgatccccggagctcgggcgggttatcgccggctcttccccgcgccgcctggctggacgctgcagccagcgccagccggatcgcgggcgccgagcggcgggtgggggagacggctgcccgtgggcgcccagatttccctcaggacccaaaaggcttgtttcagggcgccaagcttccattcttttggctgttccctcctagttctcagaaaccccgatgtctgcgggaa

SEQ ID NO: 71994 - DNA, 112 bp, Homo sapiens
  misc_feature 1..112: note = chr11:1140450-1140562
  misc_feature 1..112: note = hypo
  source 1..112: mol_type = genomic DNA
tcccgctctggaggccgcgtctcttccccggcggaccgtcctctacctgcagagccatcgggagcctctgctctccccgactgcctccctctcctcccgctgtctctgtctg

SEQ ID NO: 71995 - DNA, 48 bp, Homo sapiens
  misc_feature 1..48: note = chr11:114112577-114112625
  misc_feature 1..48: note = hypo
  source 1..48: mol_type = genomic DNA
gtcttagtaccttgccgccttttacataccacccgacacagttgccca

SEQ ID NO: 71996 - DNA, 87 bp, Homo sapiens
  misc_feature 1..87: note = chr11:114112965-114113052
  misc_feature 1..87: note = hypo
  source 1..87: mol_type = genomic DNA
gtccacgcgggcgtgcgcagctacatctgcagtgagtgcaaccgcaccttccccagccacacggctctcaaacgccacctgcgctca

SEQ ID NO: 71997 - DNA, 183 bp, Homo sapiens
  misc_feature 1..183: note = chr11:114115465-114115648
  misc_feature 1..183: note = hypo
  source 1..183: mol_type = genomic DNA
taaattcctaaaaatcggatcaaacaaactcctctgtcttaaccctttgttttttaaattgttagggacccctctggaggggaaaggcacaggcagccgcccccttcccccccaccgccgccttcacccccacccggctgggtggctgccgatgtacgttttaattaccggctccagctgaag

SEQ ID NO: 71998 - DNA, 248 bp, Homo sapiens
  misc_feature 1..248: note = chr11:114120983-114121231
  misc_feature 1..248: note = hypo
  source 1..248: mol_type = genomic DNA
acatggtgccctcaccgccttctgtctgtcctcactttctcctgccctgtccctccgccctcaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagcacatgaagggccacaagcccgaggagatcccgcc

SEQ ID NO: 71999 - DNA, 173 bp, Homo sapiens
  misc_feature 1..173: note = chr11:1142462-1142635
  misc_feature 1..173: note = hypo
  source 1..173: mol_type = genomic DNA
ctactgctgccatgtcgctgcagttcaatgggtttgtgcgttgtgatcacacggtcctgcccacagagctgaatgggctattggggtttccttgggtgagtcccaggctgtgtgtggggtgagtgtggggcctttcttgcaccgtttagcctggcacgcgttgccctctctct

SEQ ID NO: 72000 - DNA, 30 bp, Homo sapiens
  misc_feature 1..30: note = chr11:114314811-114314841
  misc_feature 1..30: note = hypo
  source 1..30: mol_type = genomic DNA
atctttgggacctctcgagatcatcttctc

SEQ ID NO: 72001 - DNA, 136 bp, Homo sapiens
  misc_feature 1..136: note = chr11:114494121-114494257
  misc_feature 1..136: note = hypo
  source 1..136: mol_type = genomic DNA
ggtaccattgttacccgctggataataagtattccctcatgggtaaccactgttatccggtgcataataattatttcctctcgggtaaccactgttacccagtggataataagtattccctcgtggataaacactg

SEQ ID NO: 72002 - DNA, 30 bp, Homo sapiens
  misc_feature 1..30: note = chr11:11465873-11465903
  misc_feature 1..30: note = hypo
  source 1..30: mol_type = genomic DNA
cttactaaaagcctgcgaggacaagtcctc

SEQ ID NO: 72003 - DNA, 30 bp, Homo sapiens
  misc_feature 1..30: note = chr11:114743244-114743274
  misc_feature 1..30: note = hypo
  source 1..30: mol_type = genomic DNA
aggcttagcacagcacgtaagaagcattcg

SEQ ID NO: 72004 - DNA, 81 bp, Homo sapiens
  misc_feature 1..81: note = chr11:1148113-1148194
  misc_feature 1..81: note = hypo
  source 1..81: mol_type = genomic DNA
ctgtctatctgagggcgtaaggagggcaggccttcaggcactcacatgcggccctggccagggtcccggtcacacctgcag

SEQ ID NO: 72005 - DNA, 54 bp, Homo sapiens; identical to SEQ ID NO: 42890
  misc_feature 1..54: note = chr11:1151771-1151825
  misc_feature 1..54: note = hypo
  source 1..54: mol_type = genomic DNA

SEQ ID NO: 72006 - DNA, 249 bp, Homo sapiens
  misc_feature 1..249: note = chr11:1152416-1152665
  misc_feature 1..249: note = hypo
  source 1..249: mol_type = genomic DNA
ggacctcagcactgccgagaccgccacatggcccacccaggtccctcgcccagccctgtccccagcctctggccctctgccaggcagtctcagagcaagaagaaccctctcccggtgtctccgtgccaccctccactgtggcctagtcggactctgccccgccgtccctcgtctgtaccaccctcatctcagaagcaggaattctgtcccggggctgctcccaggagagggcggcgctggggctggggt

SEQ ID NO: 72007 - DNA, 1514 bp, Homo sapiens
  misc_feature 1..1514: note = chr11:115373239-115374753
  misc_feature 1..1514: note = hyper
  source 1..1514: mol_type = genomic DNA
aagttgtaaccacaccggcatcggctgaacccaattatctcgtaactcataaattaagaattcacagaggaaaaacacataaacaacatccggagacagtggcatggaggaaaaaaaccctcagcgctggaattgacgctgctgccagacgccccccaataggtttcccaagccgagctcctttgcaagcctattttgggggcaagcagccaacccggcgtcccccaaatctcaagctagcacccccacacatcccccgtctcctacagcgtgtctcctgcggtgtttacataactgtgtgtcctctagcgtgtaaacaaaaggcacagcccaagcggagaggcgcccctgaagcagcaccgtggccccaacgctgtgcccgcccgggcctggggctccgcaggtgggggctgagctctcggcgtcctccgccacttgttgctcccgggtcctgcagctctggagctgcaaggaggggctttgcaggctcagagccctgctgcatcccctcctgcatcgccgctcgcaccccgcggccccgtgccactcggtcccggcgcccgcctggagcctgcagcaggggccagaggacgccgcgcggctgccaagcgcggcgaggtggcgggaagggaggctgggtgcagcacagccggcctctccgctgaggaagagctccggctcccttttgttagcaaaagcaaacactgccctcttctttcccgaccgcgccaacgcgcccggcacacgggcagccacacatcgggctccagccgagtgctcggtgtcttcagggaaggcaccgggcgtgcagagccgcccctgggcaaattcccaagactgctcttcacgcagggagcgcgcggaggcccgcagggtgcccgcctggccgcagaggccgcgacgccccctccgccaccctcgggccgccgaaagaacgggcagccgggaaatcccgtgtccccactcgtggcagaggacgctgtggggcgggcgggctgcgggctcccggcgccttcccgcagaggcggcgacagcggccgccccccccgcggggccgggccggggaactttccccgcctggagccgggccaaaaagacccgcagcagagccgagggggcggagggctgcgaacggccggagggaaacacgagaggcgtgcagtttggggacaggggagaaaggcagagcgcgttgggggaaggggcaggggagatcagacaagtctggggatgtcctggggaccggggagaaatcacgccgcgggcggctgggagtcagccaccaggaggcttcggggatggagaactgggggggccctctggagaggtgggggcgaatggacagccctgggaggtgggaggacctgcaagttacggggagaacggcgagtttagaagggtccggaagggttgaggttgtctttgaaccatccccttcccccatgctttacagcccccgggccccccattctcactccactctgcaccccgcgccaagccggggagagaaggtg

SEQ ID NO: 72008 - DNA, 443 bp, Homo sapiens
  misc_feature 1..443: note = chr11:115374991-115375434
  misc_feature 1..443: note = hyper
  source 1..443: mol_type = genomic DNA
tggggatcagtgccgcggcggagaagagcaacagcagaagccggagccggagcccgggaggcgccgccgccgccgctgccgccgcacactgggatccgctcggcagcactacactcgccatgtcgggcacctgcctcagactggcggcgttggctgcctccggagcccgagcggacagctaatgagatgctaatgacatgcgctggaggcggagtccgggcagaccaatcacagcgccgcgagcccaacccggctctcggagggcctcgctccctcccccaccccgccccctggcgctggcgttcggcggcgcgcccgcgccacctaggggcggggccaaggggaggggcgtatgcaaatatgtttatgttaaaattcgggttttgctttccccggatcaaggaaaaagtgttctcccgggcgcctggcgtgcaaggactcgg

SEQ ID NO: 72009 - DNA, 62 bp, Homo sapiens
  misc_feature 1..62: note = chr11:115375832-115375894
  misc_feature 1..62: note = hyper
  source 1..62: mol_type = genomic DNA
tcgggaaaggtagatcgaggagggtatgctcaggctcctccgcttgtcgagggtctcctccc

SEQ ID NO: 72010 - DNA, 175 bp, Homo sapiens
  misc_feature 1..175: note = chr11:1155055-1155230
  misc_feature 1..175: note = hypo
  source 1..175: mol_type = genomic DNA
ctgctgactctggaacgtctcctctggctgcggagcccccgccccacgtggggccgtgcgtgaatcctaccagcccctgtctccgcaggggtcccgctccgtggggcgactgtcttcccatctctgaggaccatccctgtggtacgaggtgagtggagcccggaggcctgggtgg

SEQ ID NO: 72011 - DNA, 114 bp, Homo sapiens
  misc_feature 1..114: note = chr11:115529982-115530096
  misc_feature 1..114: note = hyper
  source 1..114: mol_type = genomic DNA
ctcccatctctacagcgactcccctatgaccgtcccccacccggtgctctcgggccacggggaagggacactcgggaaagacaccagagaccgggagggtgcagctgggctctt

SEQ ID NO: 72012 - DNA, 340 bp, Homo sapiens
  misc_feature 1..340: note = chr11:115530221-115530561
  misc_feature 1..340: note = hyper
  source 1..340: mol_type = genomic DNA
cgtcccttagccgtgtgggctgtagcacagagggggcaaacacctccaggggcttgtgccaagtaattaccaagcaaattcccggcgatttcctctcctccccccgcccccccgggcagtgcccgctgcgtgttccctgattcggcccccggctgtgcaatcagctccaggtaacctgcggggacccgtaattgctctggagttgcctgcgagtttgcaaggtaagcacgcgcggcgcttctccctggccctggggcgcgcggtggagcgccttgcgcccgcccccgatgggccggatgccggggacctgcggaagcagaggctgcgggggtagagatcc

SEQ ID NO: 72013 - DNA, 203 bp, Homo sapiens
  misc_feature 1..203: note = chr11:1155596-1155799
  misc_feature 1..203: note = hypo
  source 1..203: mol_type = genomic DNA
cgtcttccgcttccccggcctctgcaactacgtgttctccgagcactgcggtgccgcctacgaggattttaacatccagctacgccgcagccaggagtcagcggcccccacgctgagcagggtcctcatgaaggtggatggcgtggtcatccagctgaccaagggctccgtcctggtcaacggccacccgtgagtctgggttc

SEQ ID NO: 72014 - DNA, 190 bp, Homo sapiens
  misc_feature 1..190: note = chr11:115587766-115587956
  misc_feature 1..190: note = hypo
  source 1..190: mol_type = genomic DNA
cggagggagcctcctcggaaggtaattgcctactcccagggttggccttgctgaaatttatagctccgctcaataaagccattgtgcggctccttaggaagccatgggggtggattattgcttgggagccaggagacatggaacccatgcagggccggggtcccctgctggggcacgtacaggctgagag

SEQ ID NO: 72015 - DNA, 63 bp, Homo sapiens; identical to SEQ ID NO: 34072
  misc_feature 1..63: note = chr11:115630411-115630474
  misc_feature 1..63: note = hyper
  source 1..63: mol_type = genomic DNA

SEQ ID NO: 72016 - DNA, 99 bp, Homo sapiens; identical to SEQ ID NO: 3799
  misc_feature 1..99: note = chr11:115630530-115630629
  misc_feature 1..99: note = hyper
  source 1..99: mol_type = genomic DNA

SEQ ID NO: 72017 - DNA, 259 bp, Homo sapiens; identical to SEQ ID NO: 3800
  misc_feature 1..259: note = chr11:115630630-115630889
  misc_feature 1..259: note = hyper
  source 1..259: mol_type = genomic DNA

SEQ ID NO: 72018 - DNA, 518 bp, Homo sapiens
  misc_feature 1..518: note = chr11:115630890-115631408
  misc_feature 1..518: note = hyper
  source 1..518: mol_type = genomic DNA
gcggccgggtcatcagaagcacagtggagccgccccctgctttgggaggagcaaaagagcctctcgcttgcctcccgctcgagctccttctcctcttccttttcctagcgcttctctccctccctcggcggggtccgcagagacagctgggcaggcggaggctgcgcgcctctcgcacctccacgcccaccctcccgccgcccccccctcggcctgaaagatctgcgtccacaccaccctgcacccagggcccgtcaggttttgcagaagtttgctgagggtcctcacagggggtctcccaggggaaggggtggagggctggaggggccgcggtgggaagaggtggcagacgccgcctggcaacggagaccctaccctttctagaaattcagaacgcagagaaaccagtgcccagccctgctcttcagcaaacggtgtatttcagcccgagtttccttccgggggtttggctgtgagtgtgtgtgacctcccagatggcggcacggttcagatcccat

SEQ ID NO: 72019 - DNA, 163 bp, Homo sapiens
  misc_feature 1..163: note = chr11:115733020-115733183
  misc_feature 1..163: note = hypo
  source 1..163: mol_type = genomic DNA
gcctgacagagggcccgaggcggcacccagcatggaagagcacaggagtctgaatgtcgatgaaggggaaccatgacagagtgaggacatctggacagctgtcagtgggtgagatgttgatgaacacgcagagacataaggttcatttcgaagggtgtagaat

SEQ ID NO: 72020 - DNA, 30 bp, Homo sapiens; identical to SEQ ID NO: 43252
  misc_feature 1..30: note = chr11:115763341-115763371
  misc_feature 1..30: note = hypo
  source 1..30: mol_type = genomic DNA

SEQ ID NO: 72021 - DNA, 30 bp, Homo sapiens
  misc_feature 1..30: note = chr11:115771022-115771052
  misc_feature 1..30: note = hypo
  source 1..30: mol_type = genomic DNA
aggcacagacagacccgttagcgacattgc

SEQ ID NO: 72022 - DNA, 30 bp, Homo sapiens
  misc_feature 1..30: note = chr11:1157863-1157893
  misc_feature 1..30: note = hypo
  source 1..30: mol_type = genomic DNA
cttgccgagtactcccggcagtgcacccat

SEQ ID NO: 72023 - DNA, 42 bp, Homo sapiens
  misc_feature 1..42: note = chr11:116146911-116146953
  misc_feature 1..42: note = hypo
  source 1..42: mol_type = genomic DNA
ctggagggacagtgccgcagccgtgctcgtcaggggtgcgag

SEQ ID NO: 72024 - DNA, 66 bp, Homo sapiens; identical to SEQ ID NO: 33631
  misc_feature 1..66: note = chr11:11642602-11642668
  misc_feature 1..66: note = hyper
  source 1..66: mol_type = genomic DNA

SEQ ID NO: 72025 - DNA, 288 bp, Homo sapiens
  misc_feature 1..288: note = chr11:11643016-11643304
  misc_feature 1..288: note = hyper
  source 1..288: mol_type = genomic DNA
gcacatacacgctggcgatgtagttggtgacccagcccacgtagagcaggcagatgatgttagtcatgccgctcaggatcacgcaagtggacaccaaagttttggtcttcctggtgcacaccattctgggctccttcctccatatagagctcccgggggcccttccttgtcgtgcgccccgaactcccccgcgctcgcaccccgtagcacgtccggagccgctgggcacctcagcacctgagtcccgaggttctccaaagcccggtccgctgccggtgtagccgccgt

SEQ ID NO: 72026 - DNA, 64 bp, Homo sapiens
  misc_feature 1..64: note = chr11:116451313-116451377
  misc_feature 1..64: note = hyper
  source 1..64: mol_type = genomic DNA
agacctggagctttgcggttcgcggcccgggttggagtggccgcacacccgtatcagctgtgtg

SEQ ID NO: 72027 - DNA, 30 bp, Homo sapiens
  misc_feature 1..30: note = chr11:116453617-116453647
  misc_feature 1..30: note = hypo
  source 1..30: mol_type = genomic DNA
gcccactctgtgtggcgctgcaagccccct

SEQ ID NO: 72028 - DNA, 596 bp, Homo sapiens
  misc_feature 1..596: note = chr11:116706286-116706882
  misc_feature 1..596: note = hyper
  source 1..596: mol_type = genomic DNA
tcgtaagcagccaggcgtccagcaggtcctccaacgtcgatcttggccctaagacgtccagtctgggcacggagttgttgagatccggcaggaagtccctgctccagggccaaaggccccacccgggctcccccggatgtccccgcacccccctctattctcccaaaagaaagaagctgcttcccactttggaaacgtttattctgagcaccgggaaggggggcggcggcgggcgcctcactgggtgttgagcttcttagtgtactcctcgagagcgctcaggaagctgaccttgaagctctccagcacgggcagcaggccttggcggaggtcctcgagcgcgggcttggccttctcgctgagcgtgctcagatgctcggtggccttggcgtggtactcggccagtctggcgccgccgttctccttgagagcctcaaggcgcgcggccaagcgctggcgcagctcgtcgctgtagggggccagatgcgtgcgcagcgcgtccacatgggcgcgcgcgcggtcgcgcatctcctcgcccagtgggctcagcttctcttgcagctcgtgcagcttctggcgcgcgccctcttggagct

SEQ ID NO: 72029 - DNA, 32 bp, Homo sapiens; identical to SEQ ID NO: 15607
  misc_feature 1..32: note = chr11:116890012-116890044
  misc_feature 1..32: note = hypo
  source 1..32: mol_type = genomic DNA

SEQ ID NO: 72030 - DNA, 75 bp, Homo sapiens; identical to SEQ ID NO: 43254
  misc_feature 1..75: note = chr11:116952331-116952406
  misc_feature 1..75: note = hypo
  source 1..75: mol_type = genomic DNA

SEQ ID NO: 72031 - DNA, 30 bp, Homo sapiens
  misc_feature 1..30: note = chr11:116976981-116977011
  misc_feature 1..30: note = hypo
  source 1..30: mol_type = genomic DNA
tgaaaaccacaaacccgtataggagccaga

SEQ ID NO: 72032 - DNA, 39 bp, Homo sapiens
  misc_feature 1..39: note = chr11:117010334-117010373
  misc_feature 1..39: note = hypo
  source 1..39: mol_type = genomic DNA
ataccatcatttgagttctctaaacgtgaattctttcta

SEQ ID NO: 72033 - DNA, 30 bp, Homo sapiens; identical to SEQ ID NO: 43256
  misc_feature 1..30: note = chr11:117054963-117054993
  misc_feature 1..30: note = hypo
  source 1..30: mol_type = genomic DNA

SEQ ID NO: 72034 - DNA, 37 bp, Homo sapiens
  misc_feature 1..37: note = chr11:117068532-117068569
  misc_feature 1..37: note = hypo
  source 1..37: mol_type = genomic DNA
gcggcgtttataatccgctcagcgtgcaggccgaggc

SEQ ID NO: 72035 - DNA, 62 bp, Homo sapiens
  misc_feature 1..62: note = chr11:117186235-117186297
  misc_feature 1..62: note = hyper
  source 1..62: mol_type = genomic DNA
gcctgaccaccttaccgtctgcggggggctgcccacggtcatctccacgtagtagccctgcc

SEQ ID NO: 72036 - DNA, 43 bp, Homo sapiens
  misc_feature 1..43: note = chr11:117307989-117308032
  misc_feature 1..43: note = hypo
  source 1..43: mol_type = genomic DNA
caggtccccttgggccggtactccagaacgatggctgtgatag

SEQ ID NO: 72037 - DNA, 30 bp, Homo sapiens
  misc_feature 1..30: note = chr11:117344740-117344770
  misc_feature 1..30: note = hypo
  source 1..30: mol_type = genomic DNA
tttttgatgagtgcacgcagagggaggaga

SEQ ID NO: 72038 - DNA, 190 bp, Homo sapiens
  misc_feature 1..190: note = chr11:117376155-117376345
  misc_feature 1..190: note = hypo
  source 1..190: mol_type = genomic DNA
tgtccctgctcaccacgcacgatgagctggcgctcccggctcacggtggcggctgcgttgctggcgatgcatgtatagttgccgttgtgcttgagggagacgctagagatctgcagggagctcatgaattccttgctctcgatggtcacgcccgagcctgagatgatcacctgtccgtccttcctccagg

SEQ ID NO: 72039 - DNA, 1130 bp, Homo sapiens
  misc_feature 1..1130: note = chr11:117667010-117668140
  misc_feature 1..1130: note = hyper
  source 1..1130: mol_type = genomic DNA
gtccaactggccaggcgcggaagcggagaatctcgcatcttggggcgcgctgcccgaggtggccacggtggcgcaccaagccggggctaaagccggggcagaggggtggggtagggccgggggagggtgacctctgggtttggagaacaaacttgctatccgagggacctccagctctcgggactctcactatccccaccctgcctccagccaatgcgcggataagcgccatgcggtgcgccaacattcgcgccagggctggggtccgcggcgggagagggacgcacggacatagcggaggaatcagccgccgagtccgaggcctgaataagcaaggactcctaggtcaagagtcacggcctgaggacccctcgactcggagggcactccggggtcccagtgccaccaagccgcaggaagagggcaaggggctgggggaggggtccagggcagaactgccgccgtgcagggagcagggagatgaggggctcctttgccaccacccctacgggcgcgccccaaaacggcagacgcgggtggctggcggagcggtcgggggctgactctcactcggcccctgtcagggtgcctgcccctccccgctgcgccccacccggggccttgcaccccggtcggttcccccacgcacctggagcccgccgggcaccccgcctcgccgccagccgcgccaccctggccccgccgcctccgccgcccagccgcccgcgcaggtctcacctttgtgtaaagagtccaggagcaggaggaaagttaccagccacatgccataaagaggccctattctccggggaggtggtcctgtggccggccgtgcggcagcgcctctcccccgctcagcgcgctcccagccgcccgcactcggcgccccgctctctctgctcctcagcccagcgctcggctgcggcggcggctcctccctcctcggctccccggctcctgtcatccgcggggctgggctaggcggccgctctccccgcccccccgcggcaccccgggtggtgagcgccgcgcgagcccggagcccagacggaccccagccccacaagcccaggaacaggagcggcggcccgggccagaccgccccgacccggctccgctgtctgagaggc

SEQ ID NO: 72040 - DNA, 178 bp, Homo sapiens; identical to SEQ ID NO: 34080
  misc_feature 1..178: note = chr11:117746361-117746539
  misc_feature 1..178: note = hyper
  source 1..178: mol_type = genomic DNA

SEQ ID NO: 72041 - DNA, 62 bp, Homo sapiens
  misc_feature 1..62: note = chr11:117747138-117747200
  misc_feature 1..62: note = hyper
  source 1..62: mol_type = genomic DNA
ttcccgctgcccaggcggggaccgcggcgcagctgaccgcggaggaccgcacacacccactg

SEQ ID NO: 72042 - DNA, 257 bp, Homo sapiens
  misc_feature 1..257: note = chr11:117747499-117747756
  misc_feature 1..257: note = hyper
  source 1..257: mol_type = genomic DNA
ggggacagcccactccgtgctgccgtccgctggcttctgggtagcggccgcgcgcagaccccctctcctcctctccctgtccgtcctcccgctctgtgctcgcgcgcgtcctctgctcctctctcctctcgaggggcggagagatttttccaaagggcagtcaagctccgagaagcaacaggagactgccgccgaggaggcgtgcaagcgccggagcggatttgccatcagctgttgcttttcggtttccctctggt

SEQ ID NO: 72043 - DNA, 30 bp, Homo sapiens
  misc_feature 1..30: note = chr11:117973031-117973061
  misc_feature 1..30: note = hypo
  source 1..30: mol_type = genomic DNA
ctctcaacagccctgcgaggcagatattat

SEQ ID NO: 72044 - DNA, 48 bp, Homo sapiens
  misc_feature 1..48: note = chr11:118023387-118023435
  misc_feature 1..48: note = hyper
  source 1..48: mol_type = genomic DNA
tagtcctgttctctccggagcgcgcgggggtcgcggggatgggatact

SEQ ID NO: 72045 - DNA, 450 bp, Homo sapiens
  misc_feature 1..450: note = chr11:118023775-118024225
  misc_feature 1..450: note = hyper
  source 1..450: mol_type = genomic DNA
tgccgcaccccgcctcgcggtcccggagccccgggaccacgccgtgcccccaactccctctccagtggggctgggctgctgcggctggcactgcagggccggcctgcagccacccgcatcatcccatgcgctgagctgccaattaggagcatagttcggggggagtagaggtggagcttttcggttgctggaagactgttttgctttgcttgggggaacacgggaaggttagcggctccctctcccaggaccgccaagggaccgctttaaagtccgcagcggacgctgccgcaacgggtgggcgtgtgcgggcttgcccactgcagcttgcgcctcctcggtggcgtgcgacatggcgcgcgtgcagcctcgggacccgctcccgccaccttctgccccatcgctcagcaactccggcggttgttttaggaagcccggaacagagctttc

SEQ ID NO: 72046 - DNA, 254 bp, Homo sapiens
  misc_feature 1..254: note = chr11:118663050-118663304
  misc_feature 1..254: note = hyper
  source 1..254: mol_type = genomic DNA
gagagggtagcaaaccgagagagcgcaccggggtggtggggggagaagctggactgtaaggtgaagagttagtagggcgcaaccgtcttctcctgccctcgaagggcaagactgaagaaagtaggggcggaggaggccgggccctccactaaagggagggaagctagtgaagcgtcagttataatagaaataggaattcagtaaggaaatggagaagcttaaggcaaagggtgactctccggcctgaccctcac

SEQ ID NO: 72047 - DNA, 32 bp, Homo sapiens
  misc_feature 1..32: note = chr11:118663788-118663820
  misc_feature 1..32: note = hyper
  source 1..32: mol_type = genomic DNA
aatcaagtgatgggtcgcggctgactcttgcc

SEQ ID NO: 72048 - DNA, 52 bp, Homo sapiens; identical to SEQ ID NO: 43257
  misc_feature 1..52: note = chr11:118768516-118768568
  misc_feature 1..52: note = hypo
  source 1..52: mol_type = genomic DNA

SEQ ID NO: 72049 - DNA, 30 bp, Homo sapiens
  misc_feature 1..30: note = chr11:118769490-118769520
  misc_feature 1..30: note = hypo
  source 1..30: mol_type = genomic DNA
gggaggttgggaggccgagagggagtctgc

SEQ ID NO: 72050 - DNA, 41 bp, Homo sapiens
  misc_feature 1..41: note = chr11:118769734-118769775
  misc_feature 1..41: note = hypo
  source 1..41: mol_type = genomic DNA
cacccggtgggtatgcgtcgcccatgcgcccagccatggct

SEQ ID NO: 72051 - DNA, 30 bp, Homo sapiens
  misc_feature 1..30: note = chr11:118780738-118780768
  misc_feature 1..30: note = hypo
  source 1..30: mol_type = genomic DNA
cccaaagagaaaactcgtgacttggggagg

SEQ ID NO: 72052 - DNA, 32 bp, Homo sapiens; identical to SEQ ID NO: 43258
  misc_feature 1..32: note = chr11:118781045-118781077
  misc_feature 1..32: note = hypo
  source 1..32: mol_type = genomic DNA

SEQ ID NO: 72053 - DNA, 40 bp, Homo sapiens
  misc_feature 1..40: note = chr11:118997065-118997105
  misc_feature 1..40: note = hypo
  source 1..40: mol_type = genomic DNA
aaaaaaaaaaaaaaaaaagcacctacggcaaagggtggtg

SEQ ID NO: 72054 - DNA, 30 bp, Homo sapiens
  misc_feature 1..30: note = chr11:119040119-119040149
  misc_feature 1..30: note = hyper
  source 1..30: mol_type = genomic DNA
gatccgaggttaaaccggaacctaggcttt

SEQ ID NO: 72055 - DNA, 30 bp, Homo sapiens
  misc_feature 1..30: note = chr11:119058038-119058068
  misc_feature 1..30: note = hypo
  source 1..30: mol_type = genomic DNA
gcacatgacgtggcccgagctcagctggga

SEQ ID NO: 72056 - DNA, 515 bp, Homo sapiens
  misc_feature 1..515: note = chr11:119191642-119192157
  misc_feature 1..515: note = hyper
  source 1..515: mol_type = genomic DNA
cggacctcaggcctccggcacccagggcctccacccaggggacccggccgcggcgggaaggcgccggcgctaagctccccaggagccggcctcgaggtcccgcccggcggaggcagggggcggggatccggccgctcgccccaacccaaacattaccataaatgctcaggcggctgcgggtggatgggcgcgcggggagcctggggctctccggaagccccagatccagtctccaggcccgacccagcgcgagcccgcgcagtgattcggtctgaccagccgtcccctttacaaagcggtgcagccggggatggcagagctggggtgggcgcggggacagggtggagaaaacccaggccgcagggggcgtctcggggctgcctcctgggtaggcaatgaggctgtgacctctggttaaagaaagagtggggccctctagctagatggcagcgtcggcgccgcggggaggcggctctgtctccctgcagctctgcgggccccgctgctgtcagcgg

SEQ ID NO: 72057 - DNA, 810 bp, Homo sapiens
  misc_feature 1..810: note = chr11:119210435-119211245
  misc_feature 1..810: note = hyper
  source 1..810: mol_type = genomic DNA
tctcggagcgcttggcgctgaaggcggatcgcggaggcaccgagcactccccggcaggcccggtgggccccgcgggtcccgcctctcctcgcggcccggggtcccctcgaggtcccggcagtcctgcggggtaagcggggcggcagggtgagagtagcggcggctcagcccgcagcggggcggcgactctaaggtcaccgtacccctccccgcccctgcctgagcttcggccagcgcctcctcccgcacgggtacctcctccaccccttcccgcagggcagatctggggggctggccaagggggctcccgccgcctgggcccctcccccgctcagggctgcaaagcgcggggagtggcgccccctggcgggagacccgagtcccggacaccgggagctggagctgcggccgcgcctgctcggacatcgccaccgatagccgcggcggtgccttcttacccggcctcccgccctcgcctttctctcccggagccccgggcgcgccgtcgcggccgtcgcggccatcgcggcccggcaagccctggctgccatggtggcccggcgtgcctggaaggccggggtgccccgggcagaggctggggatcttgttgtcgtccagtgggggcgagccggccgccaggcccaggagcagcaggacgaggagtggcctcatagcgctggcaccgggagcccggacgccggggtcctctcgcagtctgtggaccaggcaggactggagtcgggacccagaatcctgggacctgcctctctccccaccccggcgcggcccagtcggtccccaccccactgc

SEQ ID NO: 72058 - DNA, 378 bp, Homo sapiens
  misc_feature 1..378: note = chr11:119234569-119234947
  misc_feature 1..378: note = hyper
  source 1..378: mol_type = genomic DNA
tgagcaggagccccacgaaggtggagagcagcagggacggggagagaggggagcgcggccgcagctccttggcgagggcgggaaagggggcggcgggggggtcctcgggcagggtcacggtgtacgaggtgcgcatgctggggggcgggcggcgggctttggccctcgcttaacgttggcagcgggggcgcggggggagtccccgcgcggtgccacagtccggacgccgaggccggcgagaccgctacaggacagcgtccgcggcgcccgaacgcgcgctcctccgcctcaacctccccggcgtgcgccgccaacagcccgggtcccggctctcgcgctccggccgactggcggccccgccggcgcctcgggccccgc

SEQ ID NO: 72059 - DNA, 158 bp, Homo sapiens
  misc_feature 1..158: note = chr11:119292746-119292904
  misc_feature 1..158: note = hyper
  source 1..158: mol_type = genomic DNA
aggccacagaaggggcgtgcacccgcgagagcgcgcagggcattgcctcggttgagtgcgcccgggtgcgcagggcgcaccactagacgagttcagggtccctggcgctcagccccttgacgggtgaggctaggatcccgcggcggctgcagctacaa

SEQ ID NO: 72060 - DNA, 15 bp, Homo sapiens
  misc_feature 1..15: note = chr11:119293305-119293320
  misc_feature 1..15: note = hyper
  source 1..15: mol_type = genomic DNA
agctctcccctcccc

SEQ ID NO: 72061 - DNA, 33 bp, Homo sapiens; identical to SEQ ID NO: 11021
  misc_feature 1..33: note = chr11:119293352-119293385
  misc_feature 1..33: note = hyper
  source 1..33: mol_type = genomic DNA

SEQ ID NO: 72062 - DNA, 686 bp, Homo sapiens
  misc_feature 1..686: note = chr11:119293386-119294072
  misc_feature 1..686: note = hyper
  source 1..686: mol_type = genomic DNA
cacccagcccgccgcgaggtcacccggcagattccctctagctcgccatcctccatcctctccccgcagtttcatccgtcctcctccccgcctctgcgagctgggtttggggacgtctgggtggaatgtagacccacaggctgtccttggtgcccttcctccctgttctccagcgccccagccccagacaccagtcccccagcgggcgaaagcccgggagcgccttccccgaaagacatcagggtgccacgcggcccctgccctgcagaagcatccccctcccgcccctgcctggaaagcaggcccctccctaagctctgcgcccttcttccctgggcgccctcggaccgtggcccgaagcctagtgttgggaagtcttgcatgggcgcctgacggcggtccccgagccccaggtcccaccggctccagttcccacctggactggggtcttccgctgctgcagcctcctccagacgcgccgccgcctccggttgctgcacccagctcggagcccgcagttttcaccggggatggaggagagggggagcggggagccgggggctcagccaatcagaggcggagattgggggagaaaggacggcagggtggggtggggggtggggaaggaagagaaggcggtcccgcattggtgtgagagtggcaggttgcggcggaagggggccctc

SEQ ID NO: 72063 - DNA, 30 bp, Homo sapiens
  misc_feature 1..30: note = chr11:119354677-119354707
  misc_feature 1..30: note = hypo
  source 1..30: mol_type = genomic DNA
ccctgccgcctcctgcggctctaggaccca

SEQ ID NO: 72064 - DNA, 30 bp, Homo sapiens
  misc_feature 1..30: note = chr11:119487017-119487047
  misc_feature 1..30: note = hypo
  source 1..30: mol_type = genomic DNA
ttgcatcccagcaatcggtaaagcaccagg

SEQ ID NO: 72065 - DNA, 46 bp, Homo sapiens; identical to SEQ ID NO: 43259
  misc_feature 1..46: note = chr11:119524180-119524226
  misc_feature 1..46: note = hypo
  source 1..46: mol_type = genomic DNA

SEQ ID NO: 72066 - DNA, 37 bp, Homo sapiens
  misc_feature 1..37: note = chr11:119600611-119600648
  misc_feature 1..37: note = hyper
  source 1..37: mol_type = genomic DNA
aaaattgaagcaccccgcgccccgcccttgcccaaac

SEQ ID NO: 72067 - DNA, 143 bp, Homo sapiens
  misc_feature 1..143: note = chr11:119608970-119609113
  misc_feature 1..143: note = hypo
  source 1..143: mol_type = genomic DNA
gcgctcagggcatgccgggggctcacacagcccaggcagctgatgattaacaaacaattatactaatcggcctaggaacaggaaggcaggtgtgcacccctatgcatgtgaatgcacacacatgcatgcgcacacacattcag

SEQ ID NO: 72068 - DNA, 30 bp, Homo sapiens
  misc_feature 1..30: note = chr11:119609728-119609758
  misc_feature 1..30: note = hypo
  source 1..30: mol_type = genomic DNA
atctcatttgatcctcgcagcagccctgtg

SEQ ID NO: 72069 - DNA, 234 bp, Homo sapiens
  misc_feature 1..234: note = chr11:119612034-119612268
  misc_feature 1..234: note = hyper
  source 1..234: mol_type = genomic DNA
gcatggacaaatgcacgaatgaatgagactgcgggaatgctgcccccacctcctctccgcctccccacctcgcctccaggtaccctgggcgcctgggaccctgcggggcctcctggaggcgggacgggcacggcgccacctagcggtcgtgggccgcggagagagcgtccctgtccttccccgtgtgggacctgcaaccgccccatagcgcagagtccgggaggctccagccac

SEQ ID NO: 72070 - DNA, 109 bp, Homo sapiens; identical to SEQ ID NO: 34093
  misc_feature 1..109: note = chr11:119612323-119612432
  misc_feature 1..109: note = hyper
  source 1..109: mol_type = genomic DNA

SEQ ID NO: 72071 - DNA, 27 bp, Homo sapiens
  misc_feature 1..27: note = chr11:119612791-119612818
  misc_feature 1..27: note = hyper
  source 1..27: mol_type = genomic DNA
aggcacacacagaggcgcacacacaca

SEQ ID NO: 72072 - DNA, 446 bp, Homo sapiens
  misc_feature 1..446: note = chr11:119612998-119613444
  misc_feature 1..446: note = hyper
  source 1..446: mol_type = genomic DNA
tacaccccgcctcctgccgcgcctgacactccgcagggcccgggggtgggtgggcaggggtgcgagggggcgtggggctgggcgcgccggcctggggggaaagccccgcctcccggatgtcgtctcttcgccccctactagctcttgtctcctccccaacccctcgccccaccccctgcctaatttttgccagtggatcatcggcctttggatgaatccgcagcaaatggctcattcggggcgggcccgcctccccatccccccagtgtgcggtctcctctccccagcaaagatgttcggtggcacttacggcccctttttaacaccaggcgaagccaatattgttaggaaggaagaactgctgtggcagctgctgcaaagacaaatcatatgcagtaatgcatcacgggctgagggagggtctgagtgtgcggcagggcagcgcg

SEQ ID NO: 72073 - DNA, 147 bp, Homo sapiens
  misc_feature 1..147: note = chr11:119884295-119884442
  misc_feature 1..147: note = hyper
  source 1..147: mol_type = genomic DNA
aagttgtgctgctgccggtgctcggatggaccccggggagcagcagccactgctcagagcagtctgttttgcctgttgccggaggctggggggtgcaggagcagccctggaggggcttggcactatcagtggcggaggggtctgtgt

SEQ ID NO: 72074 - DNA, 652 bp, Homo sapiens
  misc_feature 1..652: note = chr11:120008071-120008723
  misc_feature 1..652: note = hypo
  source 1..652: mol_type = genomic DNA
cgggcctcaaagtcccggatgggctcgagcagctggtggtctcggaaggcggcgccctccaggtggggcttgagatgcagctcgcagaaggaggcctggcacaccaggcaggacttgaccgccttctgcttgttgccgatgcaggagtcgcacagcacctcctcggagccggacttggaccgtgaaaaaaggcccgtgtcggcccgggggtagctgttccgccgggtctccccgggctccatgatggacaccgtgggcttccgggactccgagaaaatggacttgcgcagctcgcccttttcggcaaaggtaacgggtggcttcttggcagcccccagctggagccctgcgtacggcgacctcttgccttccatagagtccatgctgaagtagttggagttcttgtcgtccccggactcgacaaactggatgatgggtcgccgccactcattgcccgcgaacagggcgctcctaccttcccctggcttcagggcgctgcccaggctcttgccctcagctgcctccccgccgtgcccgttggtggtcttggcatccttgccgtcagccttggtgccattctccaggctgccactggggcccgacgggctccgggcatccctggcttctgggctcgacccgttgctcctggagg

SEQ ID NO: 72075 - DNA, 222 bp, Homo sapiens
  misc_feature 1..222: note = chr11:120039752-120039974
  misc_feature 1..222: note = hyper
  source 1..222: mol_type = genomic DNA
aatgcgggcaggatgcgagcaaaagacccggcaaagagggcgccgagggggcgcagccggggcgctgggcggacccagaggggacatggagaggaacgcggaaggtacgcggtagagacggggaggtggcgcgaggcgggacatggtgagcgacccgaggggcgcgcggactgggctcgcggacggggctcgcggacgtagagcagtcgaggcgcggagggg

SEQ ID NO: 72076 - DNA, 30 bp, Homo sapiens
  misc_feature 1..30: note = chr11:120081073-120081103
  misc_feature 1..30: note = hyper
  source 1..30: mol_type = genomic DNA
tgaatgcgggaagcacgggaggcaggactg

SEQ ID NO: 72077 - DNA, 118 bp, Homo sapiens; identical to SEQ ID NO: 34096
  misc_feature 1..118: note = chr11:120110849-120110967
  misc_feature 1..118: note = hyper
  source 1..118: mol_type = genomic DNA

SEQ ID NO: 72078 - DNA, 380 bp, Homo sapiens
  misc_feature 1..380: note = chr11:12029892-12030272
  misc_feature 1..380: note = hyper
  source 1..380: mol_type = genomic DNA
cccgcgccgccagggcgcacccacctcttccaccgcgctgcgcaatttgtgctgcgtgtcctccatcagttcctcaacctcgcggaacatctcattgagggtggcctcctcctgcgggtagctgagagccgggccgggcttgactggagccgaggtcgccgtcggagcgggcgcgggggccgtggggaccgccgccgccagcagcaggcacagcagggtggccccaagccgctgcatctccgctctgcgcccgcagccgccgcctgtgtgtcccggaacgcgatcagaggcgcgcggaccacccccctcgctgggcccgccgccccgccccgttccgccccgccgcccgcccctggcgcccctctttcccgcacccgccc

SEQ ID NO: 72079 - DNA, 288 bp, Homo sapiens; identical to SEQ ID NO: 33634
  misc_feature 1..288: note = chr11:12030273-12030561
  misc_feature 1..288: note = hyper
  source 1..288: mol_type = genomic DNA

SEQ ID NO: 72080 - DNA, 172 bp, Homo sapiens
  misc_feature 1..172: note = chr11:12030834-12031006
  misc_feature 1..172: note = hyper
  source 1..172: mol_type = genomic DNA
gagcgcggcggggtgcggcagcgccggtacccgagggagcccgcaagacgcgccccgcccgcccaccaggctccctctccgcccccgccccgagccccgcccgcccaccaggcccaccccgccccgcggaggggccgcagcccggccattggccagccggggcgccggccac

SEQ ID NO: 72081 - DNA, 93 bp, Homo sapiens
  misc_feature 1..93: note = chr11:120367603-120367696
  misc_feature 1..93: note = hypo
  source 1..93: mol_type = genomic DNA
ccctctactgtccatcgtgagccctcttccccagtaaggcttaggctcctccaagtctccccacctcacattctaggccgggactccaccttt

SEQ ID NO: 72082 - DNA, 80 bp, Homo sapiens
  misc_feature 1..80: note = chr11:120382368-120382448
  misc_feature 1..80: note = hyper
  source 1..80: mol_type = genomic DNA
agttccccagctgcccgccgggcggcgccccgcgcctcgctgcgctcctcccgcgctccccgcgccgggctcgctcgcag

SEQ ID NO: 72083 - DNA, 131 bp, Homo sapiens; identical to SEQ ID NO: 34097
  misc_feature 1..131: note = chr11:120382817-120382948
  misc_feature 1..131: note = hyper
  source 1..131: mol_type = genomic DNA

SEQ ID NO: 72084 - DNA, 148 bp, Homo sapiens
  misc_feature 1..148: note = chr11:120383999-120384147
  misc_feature 1..148: note = hypo
  source 1..148: mol_type = genomic DNA
ccgggaaactgcgggcgtggtatctccggggagagaggccgcctgggttggtagtgggcatctgagagacaaatccggtcctgcctgactccctgactgtctgtgctcgcgtggtcaggggcgaggggcttgtcgaggtccactgtgt

SEQ ID NO: 72085 - DNA, 30 bp, Homo sapiens; identical to SEQ ID NO: 43264
  misc_feature 1..30: note = chr11:120410117-120410147
  misc_feature 1..30: note = hypo
  source 1..30: mol_type = genomic DNA

SEQ ID NO: 72086 - DNA, 15 bp, Homo sapiens
  misc_feature 1..15: note = chr11:120434954-120434969
  misc_feature 1..15: note = hyper
  source 1..15: mol_type = genomic DNA
cgggggaaaatgctc

SEQ ID NO: 72087 - DNA, 787 bp, Homo sapiens
  misc_feature 1..787: note = chr11:120435208-120435995
  misc_feature 1..787: note = hyper
  source 1..787: mol_type = genomic DNA
gacccaggaaggagacgggtgcctcccagagaggaccccatcccctccgaggtccgggcggctcccggcctctccctggggtgccgtagcccccctcgacccgccttcccgcagccgcagtcgttcgggcctggaggtggccgggcatcggtgccgacgccgcgagggcagcgcccgcggcgggaatactaatgcaccctaaagggcacggccgccgccgcagcaggtaattagctggaccgcggcggagcgcgcggaggtggctgctggctgcaaggactgcgcccagcctccgcctcgcccctcgaggctcccgcgtgggccggcgggcagtgcgtgggccacaggaagcgggctgactggacccggctcaggacttcgcacaagggcagctctttgtttacagctcctctcccagctccccgctttcctttcgcccaccgcctcccttttccggcgatcggctccgccggctgcgggggggtggggggggtggggtgtcctgtgtagccgcccacctcctgtcccggcctcgtgctcccgctggggactgtttgcggtgagtctgtcgcacgcacgtcagggccgaggcagtgatgcggggcagcgtgggaggacgggctgcggagcccgcgtcatcctgcctgtggggagcgctgtgcctgctctcctgccagcgcgcccagctgtcccggccgccgccacgcgggactgcctgccatgtcgccaccggctgctgacctcattaggcctcatgtcatggaggagccggcgattaaaggactct

SEQ ID NO: 72088 - DNA, 30 bp, Homo sapiens
  misc_feature 1..30: note = chr11:120449384-120449414
  misc_feature 1..30: note = hypo
  source 1..30: mol_type = genomic DNA
tcagccactgcccctcggccttgggagctg

SEQ ID NO: 72089 - DNA, 109 bp, Homo sapiens; identical to SEQ ID NO: 43265
  misc_feature 1..109: note = chr11:120748772-120748881
  misc_feature 1..109: note = hypo
  source 1..109: mol_type = genomic DNA

SEQ ID NO: 72090 - DNA, 321 bp, Homo sapiens
  misc_feature 1..321: note = chr11:120772435-120772756
  misc_feature 1..321: note = hypo
  source 1..321: mol_type = genomic DNA
ccagcctctcagagccgggaattacaccgtgcttggagttctggcacagatccacagctacgccaagtccacagggtcctgttgctagtctgggaaagtcaccctgatttgtgcatgtgtgcacgtgtgcttattcacatacgtgcacgtgctcatgaggggtggggtgcaggccggacactggtgtgtgaggtgacatttaacaacatggtaagtacaactcaaacaactattagccttggttcttttcttgcgcgtgtgtgcctacagtggctgatccaattcgatagctcttaccaggaatgacgatcttaattcagt

SEQ ID NO: 72091 - DNA, 30 bp, Homo sapiens
  misc_feature 1..30: note = chr11:120773074-120773104
  misc_feature 1..30: note = hypo
  source 1..30: mol_type = genomic DNA
ttgggctttccaacgcgtctccaagaccgg

SEQ ID NO: 72092 - DNA, 179 bp, Homo sapiens
  misc_feature 1..179: note = chr11:120837755-120837934
  misc_feature 1..179: note = hypo
  source 1..179: mol_type = genomic DNA
tgggctcgccccacccgctgcatctgtctgtcccctctcgaggtgaaagcaggcagggtggccaggaggtgtgccgggaaggggagcagagtgacacctaacagggcattcacaacctgtgtcctgggctctcccgtaacccccgcaggctcggttttccgggacgagtttgatctggc

SEQ ID NO: 72093 - DNA, 30 bp, Homo sapiens
  misc_feature 1..30: note = chr11:120937707-120937737
  misc_feature 1..30: note = hypo
  source 1..30: mol_type = genomic DNA
acagccttcctagctcggttccccgagctt

SEQ ID NO: 72094 - DNA, 231 bp, Homo sapiens
  misc_feature 1..231: note = chr11:120998602-120998833
  misc_feature 1..231: note = hypo
  source 1..231: mol_type = genomic DNA
cagcaccagccagtgcgtccctctgcacaagtgcggctgcgacttcgacggccactactacaccatgggggagttcttctgggccacggccaactgcactgtgcaatgcctgtgcgaggagggcggggacgtctactgcttcaacaagacctgcggcagcggggaggtgtgcgccgtggaggacggctaccagggctgcttccccaagcgggagaccgtgtgcctgctcag

SEQ ID NO: 72095 - DNA, 30 bp, Homo sapiens; identical to SEQ ID NO: 43269
  misc_feature 1..30: note = chr11:121000904-121000934
  misc_feature 1..30: note = hypo
  source 1..30: mol_type = genomic DNA

SEQ ID NO: 72096 - DNA, 209 bp, Homo sapiens
  misc_feature 1..209: note = chr11:121023611-121023820
  misc_feature 1..209: note = hypo
  source 1..209: mol_type = genomic DNA
ccattacgagagctgcgtgagtgtctgccagccccgctgcgccgccatccgcctgaagagtgactgcagccactactgcgtggagggctgtcactgcgacgctggctacgtcctcaacggcaagagctgcatcctgccccacagctgcggctgctactccgatggcaaatattacgaggtatgggaggccagcccggccttttcctcct

SEQ ID NO: 72097 - DNA, 139 bp, Homo sapiens
  misc_feature 1..139: note = chr11:121152146-121152285
  misc_feature 1..139: note = hypo
  source 1..139: mol_type = genomic DNA
gtgtgcttccagagctcggggacttcgcagcctccatagtagcgttcactccctggagccactttatgtactcttaacttgtcttgtctcattcctttgactatgccagactttgtagcccccacggcctggtgttggg

SEQ ID NO: 72098 - DNA, 30 bp, Homo sapiens
  misc_feature 1..30: note = chr11:121192536-121192566
  misc_feature 1..30: note = hyper
  source 1..30: mol_type = genomic DNA
tacagtgaagaaatacgatgactggttggg

SEQ ID NO: 72099 - DNA, 316 bp, Homo sapiens
  misc_feature 1..316: note = chr11:121297857-121298173
  misc_feature 1..316: note = hyper
  source 1..316: mol_type = genomic DNA
cacactagagagccacgcattctcctgtttctggaggaggcttctctgaaggcagctcacatgagtaaaagtcactttttcaggtcgcagtcccgcgcaaggggcggaaggggcggcggcgcctgcaaacgccgcgggagggcgagcgcgcggtcgcagagctccaagaccaggtcccggccccgcagcgcccggcccagcccggcccgcccacctcgcgcggaaacttcgagctgcgcagccgccgcgccggcgcctccccagcaaagctccgctaagtgcggccggcgggggtgcggggcgttgggcacctgac

SEQ ID NO: 72100 - DNA, 350 bp, Homo sapiens
  misc_feature 1..350: note = chr11:12131862-12132212
  misc_feature 1..350: note = hyper
  source 1..350: mol_type = genomic DNA
cccgcttaccaacaccgggggtttcatctcgcagcgccaccacgccccactcccagcagccctcccctggtctccgccctgtgcgggtcagggtgggagcgcccggccactccctgcgttctgggccgggctacagcccacgtgcgccggcggcagcggcggtgacagccggccccacgggggcggggcgggctccgtgctgtcctgtcattggccgcgccgctgtcgggggcgttccccagcccggtccaccgcgcggcgcagaaccgcaggcgctcggctggctaagcctgcgccgggccgcctcgctcgctcccagctctgtcagtggcccgcggggcccgatcgct

SEQ ID NO: 72101 - DNA, 112 bp, Homo sapiens
  misc_feature 1..112: note = chr11:12132499-12132611
  misc_feature 1..112: note = hyper
  source 1..112: mol_type = genomic DNA
ataaaagcctcccaccggcacgccgaactacctcttactccgctccgcaacacccaaaccctgcagttccaagcctagaaaatcgcaagcgccaaaacggggtgggagtgac

SEQ ID NO: 72102 - DNA, 319 bp, Homo sapiens
  misc_feature 1..319: note = chr11:1214648-1214967
  misc_feature 1..319: note = hypo
  source 1..319: mol_type = genomic DNA
aaccaaggggtgccccggagatcgggagaggccggaccctgcaggtctctgtgcttctgcagaaaggtgagacctgggccacacccaactgctccgaggccacctgtgagggcaacaacgtcatctccctgcgcccgcgcacgtgcccgagggtggagaagcccacttgtgccaacggctacccggctgtgaaggtggctgaccaagatggctgctgccatcactaccagtgccagtgtgagtggagcgccgagcgggacccagggcagccggggcagccactccccacccaggtggaaatgggcggggcagaggaggg

SEQ ID NO: 72103 - DNA, 34 bp, Homo sapiens
  misc_feature 1..34: note = chr11:1215395-1215429
  misc_feature 1..34: note = hypo
  source 1..34: mol_type = genomic DNA
tcctggacaactgcacgtacgtgctggtgcagca

SEQ ID NO: 72104 - DNA, 202 bp, Homo sapiens
  misc_feature 1..202: note = chr11:121546780-121546982
  misc_feature 1..202: note = hypo
  source 1..202: mol_type = genomic DNA
ggtgcaaagtgctggcggcatgagctgggaaagggcccttgaagccttctcccatgccttgctggagatgcagtaaacagatctattcggtgtctagccctcacctggagtttgcagctcatctctgccatgccttggctgagagtcccagttgttctacatacttgccaacatttggtattgtgtgcggtgataatttatt

SEQ ID NO: 72105 - DNA, 329 bp, Homo sapiens
  misc_feature 1..329: note = chr11:1215733-1216062
  misc_feature 1..329: note = hypo
  source 1..329: mol_type = genomic DNA
gtcagccccggcttccggaaaaacggcatcgtggtctcgcgcatcggcgtcaagatgtacgcgaccatcccggagctgggagtccaggtcatgttctccggcctcatcttctccgtggaggtgcccttcagcaagtttgccaacaacaccgagggccagtgcggtgaggccacagggctcccgggcatcgtctggcattcgcgggggcgggggtgccgggcaggggcgaggccaccacgtgccgcgtgtgccggtgtctctgctttctggctgctctgctgagtgcaggccacaggcatgaggcttacgcctgccggtacctgcagctc

SEQ ID NO: 72106 - DNA, 257 bp, Homo sapiens
  misc_feature 1..257: note = chr11:121593379-121593636
  misc_feature 1..257: note = hyper
  source 1..257: mol_type = genomic DNA
gggagcgcagagctccgccaggagagggccgggcctgcgcactctaatttttcactgcagtttaaacactccgtgaggctctcaggaagcggcgggggtggggggcggccggagagaaggggcccgcgtctccgccgcttccatcaccgccctggaaatagcatctgaacgcgcacggcccgaccaggcttcccccaagctgctaagatttcatttcacctccgacaggcttcatggggactcgctgttaaaagatc

SEQ ID NO: 72107 - DNA, 120 bp, Homo sapiens
  misc_feature 1..120: note = chr11:1216277-1216397
  misc_feature 1..120: note = hypo
  source 1..120: mol_type = genomic DNA
tagggggacggtggtcgcttcctgctccgagatgtccggctctggaacgtgagcataccctgaccagccagcctgccaccggcctcacccgacgcccaccacggtcgggcccaccacagt

SEQ ID NO: 72108 - DNA, 50 bp, Homo sapiens
  misc_feature 1..50: note = chr11:1216937-1216987
  misc_feature 1..50: note = hypo
  source 1..50: mol_type = genomic DNA
tgtgtggaaggagcccgtccggggatacaggagggcggccacacaccagt

SEQ ID NO: 72109 - DNA, 35 bp, Homo sapiens
  misc_feature 1..35: note = chr11:1217246-1217281
  misc_feature 1..35: note = hypo
  source 1..35: mol_type = genomic DNA
atcgattggagaggccggaccggccacatgtgccg

SEQ ID NO: 72110 - DNA, 30 bp, Homo sapiens
  misc_feature 1..30: note = chr11:1217534-1217564
  misc_feature 1..30: note = hypo
  source 1..30: mol_type = genomic DNA
gatgttggtgcccagcggcccgcgttgctc

SEQ ID NO: 72111 - DNA, 30 bp, Homo sapiens; identical to SEQ ID NO: 43272
  misc_feature 1..30: note = chr11:121910451-121910481
  misc_feature 1..30: note = hypo
  source 1..30: mol_type = genomic DNA

SEQ ID NO: 72112 - DNA, 161 bp, Homo sapiens
  misc_feature 1..161: note = chr11:1219739-1219900
  misc_feature 1..161: note = hypo
  source 1..161: mol_type = genomic DNA
ggctccggggggctccgggggactttgcctctcctggcaccacagcacagccaggcctggatcccacggctctgtcctgagccggctgagtatgtggccctgcagagtgtgtggccttgttgggcaccccatccaagggggtgcagcgtggggctctgctc

SEQ ID NO: 72113 - DNA, 173 bp, Homo sapiens
  misc_feature 1..173: note = chr11:1221703-1221876
  misc_feature 1..173: note = hypo
  source 1..173: mol_type = genomic DNA
tgctgccaggagctgcggacctcgctgaggaatgtgaccctgcactgcaccgacggctccagccgggccttcagctacaccgaggtggaagagtgcggctgcatgggccggcggtgccctgcgccgggcgacacccagcactcggaggaggcggaacccgagcccagccagga

SEQ ID NO: 72114 - DNA, 30 bp, Homo sapiens
  misc_feature 1..30: note = chr11:12231039-12231069
  misc_feature 1..30: note = hypo
  source 1..30: mol_type = genomic DNA
gtagaaattggctggcgggcagaatttctc

SEQ ID NO: 72115 - DNA, 30 bp, Homo sapiens
  misc_feature 1..30: note = chr11:122311181-122311211
  misc_feature 1..30: note = hyper
  source 1..30: mol_type = genomic DNA
tgaggtttcctaaaacgacaaagaaataaa

SEQ ID NO: 72116 - DNA, 157 bp, Homo sapiens
  misc_feature 1..157: note = chr11:122402591-122402748
  misc_feature 1..157: note = hypo
  source 1..157: mol_type = genomic DNA
agtagtgtttgaaatcgcaaaacattgcaaacaactggcctggcaatagagtatgggttaaattattgtatatgcatccaatagaatattaagcatctcttaaagaagaatgaggaagccttttgtgtactgatgtgaaatgtgtttcaagacatat

SEQ ID NO: 72117 - DNA, 98 bp, Homo sapiens
  misc_feature 1..98: note = chr11:122511898-122511996
  misc_feature 1..98: note = hypo
  source 1..98: mol_type = genomic DNA
tatttttcagactaacggagacaagcagcagtatgggcttcattaatatctggcttgagccgggcgaggtggctcacacctgtaatcccggcactttg

SEQ ID NO: 72118 - DNA, 75 bp, Homo sapiens
  misc_feature 1..75: note = chr11:122575506-122575581
  misc_feature 1..75: note = hypo
  source 1..75: mol_type = genomic DNA
gtgccccgtcaacaattttttttttaatagaaaactttattatgaggtttctttaagggccgcactttctcgaag

SEQ ID NO: 72119 - DNA, 30 bp, Homo sapiens
  misc_feature 1..30: note = chr11:122659896-122659926
  misc_feature 1..30: note = hypo
  source 1..30: mol_type = genomic DNA
gcagaccagcaccagcgagggttggatcta

SEQ ID NO: 72120 - DNA, 139 bp, Homo sapiens
  misc_feature 1..139: note = chr11:122752920-122753059
  misc_feature 1..139: note = hypo
  source 1..139: mol_type = genomic DNA
gcatgcacaggagcacgcacttcttagggtaaatacctaaaagtgaaattgctggatcccaaggcatacatatcctggctaatgtcaaaccattttccaaaatggttggttgcatcggttctcacgtccgcccgcagaa

SEQ ID NO: 72121 - DNA, 473 bp, Homo sapiens
  misc_feature 1..473: note = chr11:122753630-122754103
  misc_feature 1..473: note = hyper
  source 1..473: mol_type = genomic DNA
ggaggatgcggggcccgtccgggtcgcggccgcggaggagcgccgggcaggtgacgggcggtggcctcccggatctggggtgggcggcgcgcccggggagggaaacgggaagggcttactggggatggggacggcaggaaaccacccaagcaagctggggaggagccggcgcgggagccttcgggacggagtggggagcgacaagggggcgaggccgcgacaaggggctggggggccgccatgcgaggcttcggcgcccgggcacccagagcagccctgttcccggtcaattaggaccggtcccgggcaccaggcccgccgacttgtcacttcctggacctccaaacgccccttgtgacaggccttgttcctcaggaacaagcaaaggtagaaaaccgaacgcctcccctgggcagcttccggcctgtttcaaaccagggttcgttcctttttctttacgattcatcttggtg

SEQ ID NO: 72122 - DNA, 1184 bp, Homo sapiens
  misc_feature 1..1184: note = chr11:122847129-122848313
  misc_feature 1..1184: note = hyper
  source 1..1184: mol_type = genomic DNA
taatgaaaggttattcgcaagttcatttctacagggactaggaaactgcctagggccgaggggagggggcgtacgcgtaggagaacgcggtggcaaaccattcctggaaacgcgtgatcattcccagttttgccctgcgagcctacaaacccggtaaaagaataagagacctcccaggggaaaaggagaggggtaaagcgcaaagtcaatcagacccccgccccatctattccccaaacaggtgcacgcccggaacgcctttagccttaaccctttggccttcatcttgatttcctaaaatgcactgagaatgaatatttccacacacaacccgaggaacactcacttttaaaatatcagtagcccgtggaacgtggaagcgttgcgggacaggagcgcaacaagttcgggaagcagaaattgctctaggggttttctgtgcccaagtttcccgccgcgcgctggcgccgcgcagtacgcgggaggcagggcgtaaggggcgtctgcgcctgggggctacaaactcaggaagggtgccaggatgcagaaccgcgagctctagaggagaacagggacgggagaggatggaagcgccgcccagagaaggagggagtcgccttagtatttgagtcagagatgggactctggggatgggggatgggggcgagtgggaggttagtgacgagcagtgcacgagtctgtcctgaaactggacgttttaaagatcagattgtggttctatctggatctcggcggagcggaggccccagagacctggtccctttgcagccaaacggactgcccaagaacgggcaaggacttggcgtggagaggaaagaacagagctaggggcaagttgctgaaaggcgagggagaaaggggtctatgatcggagaaaacagagagccgagagctgaatttccagtctgggacgcggtacttgggctggtccctgaccccaaggacgacggacgcaggaaaatgggcgcccgggcgcacagtctcccgtggctgggaccgggagggctagaggggaggcgggaggccgggccgcgggccgtgctggctccgcaccggcctggaggacaggtgggttttgtttgtcttccaggagcggatttccaaggcccgccacgagactggagtctgagtcttccggtccaggagggaaccgcgctcggccc

SEQ ID NO: 72123 - DNA, 402 bp, Homo sapiens
  misc_feature 1..402: note = chr11:122848368-122848770
  misc_feature 1..402: note = hyper
  source 1..402: mol_type = genomic DNA
cggccctgagcccagctccccctcgtctccaatgtccacctcgtcctctggctcggtcagcacgaagggaccggcgggcaggctcagccgagcctcggcggcggtggcggcctctgaaccgcgggggctgccctcggggctttctggcccgtctggtgctttgggttcgtcttggcttttccgcagttgctttttatgcttcatccgccggttctggaaccacgttttcacctgatttcggggagataaaaataaaatcatgtcattcctccaaatctgagccatcgctggggtttaggaaaatgggctgcagtccgttgatgaagtatccaagagcggtgatagcctcaactgctcataagttatcgccttaagccgaatgagaatcgaacagtctgaggc

SEQ ID NO: 72124 - DNA, 317 bp, Homo sapiens
  misc_feature 1..317: note = chr11:122849807-122850124
  misc_feature 1..317: note = hyper
  source 1..317: mol_type = genomic DNA
ggccaggtgtaggtaattttacgaaagctcttgggaaaggcttagaataagcgtcagcggggtctatttctactcgaactccacaaggtcccgaaggtattaagacttgaaggcagagaggaacgaagcagagatcagggcctccctctcctcccgcccacctgcgtctcggacaggctgagggccgtggccagctccactcgttctggcgtggacaggtagcgctggatctcgaacctcttctccaagcccgagagctgcgagtcagagaaaaccgtgcgggctttgcggcggcggcagtgcttccccggcagctc

SEQ ID NO: 72125 - DNA, 1144 bp, Homo sapiens
  misc_feature 1..1144: note = chr11:122850148-122851292
  misc_feature 1..1144: note = hyper
  source 1..1144: mol_type = genomic DNA
cgctgggactggcatccctgcagagagaagagcaaccaagtgggcagagcgtgggtcgccggagagcaatctccgctccgctcccctcccctcccctagcccccagtgccttcctccgcccctcgcctccgtcagtctgctcgccccaaagcccctcaagcctttctctcaggaatccagggcagaggaagaaaaaaaaaaaaagccgcaagaatagcgcttggagatctttatctggaaagtcatctagaaatacaaacaacaaacagtaaataaaacagaaaagaaaatcggaaaatagatccggaggctgtttaaaaatgtcttcttggagagacttccgtagggtcggccagcgcggagtcttcagttgcgcctggccaagttttttgcaaacgtcaaatggcccaggagcagtcctgtccccagcccccacctatcctcctagacccctgatgacactcattgctgttctggggctggtagatgcatggatataatcttgcctccaaaccttactgaaaaatacctttctgtttcccaagccacccctatccccctgcagccaaagggagagcaaaactgccttatccggagaagccccggagccgaaacagaggagcatttctcgcctctcacgtctcctcgtccgtttcggggtcgcgctagggacccagctacctaatatagtcctcattctttttctcattctttccctctcactccaagcccagcgaagcagaagggtttgaggggtttttccatggccgggtccggggagacttgtctttcctgaccctcgcaggcttgactctgtctgagacgcaccaagcagagagaagctgccacaagcaacatcggccaatcccagagaaaataaacaaacataacaacaaccagtgcgggtacttagggctttggccactgctgtatgggaggaccaccggagcagctgagaatagattgtcaccggcgggtggtgaagccagtgcagagatgcggacctggatttacaaacacttttagctttgttctggattccagcgcgcacaaactgcctcctgtcttgcccccagcccctccaccgaccatggttgttgccgcctctgagctatgagtctggactcaacgaattattctattc

SEQ ID NO: 72126 - DNA, 482 bp, Homo sapiens; identical to SEQ ID NO: 34105
  misc_feature 1..482: note = chr11:122852370-122852852
  misc_feature 1..482: note = hyper
  source 1..482: mol_type = genomic DNA

SEQ ID NO: 72127 - DNA, 30 bp, Homo sapiens
  misc_feature 1..30: note = chr11:122854391-122854421
  misc_feature 1..30: note = hyper
  source 1..30: mol_type = genomic DNA
aggggccaggggtgtcggtccacacttcac

SEQ ID NO: 72128 - DNA, 114 bp, Homo sapiens; identical to SEQ ID NO: 11039
  misc_feature 1..114: note = chr11:122854915-122855029
  misc_feature 1..114: note = hyper
  source 1..114: mol_type = genomic DNA

SEQ ID NO: 72129 - DNA, 27 bp, Homo sapiens
  misc_feature 1..27: note = chr11:122855030-122855057
  misc_feature 1..27: note = hyper
  source 1..27: mol_type = genomic DNA
ccccgcctctgccggggccccaggagg

SEQ ID NO: 72130 - DNA, 137 bp, Homo sapiens
  misc_feature 1..137: note = chr11:122855295-122855432
  misc_feature 1..137: note = hyper
  source 1..137: mol_type = genomic DNA
ggtgccctgaggaaccgcggcggggactcgccgctggcagcctgcgggtcctggtgccagcgcgcatgggcgggctgtgcggacgtggctggtcctccaaaggtttcagatcccgtccgggccgctcagtcccttaa

SEQ ID NO: 72131 - DNA, 97 bp, Homo sapiens
  misc_feature 1..97: note = chr11:122855721-122855818
  misc_feature 1..97: note = hyper
  source 1..97: mol_type = genomic DNA
cgcgggccccagggctgcccagggaaggagtacatttttagacatttttagatagcttgcaaaggttgtctgtggcagggaacggggacagggaaac

SEQ ID NO: 72132 - DNA, 53 bp, Homo sapiens
  misc_feature 1..53: note = chr11:1228830-1228883
  misc_feature 1..53: note = hypo
  source 1..53: mol_type = genomic DNA
cctcctctcccggggcgtctcagctgtccccggggccacgtccccccctcact

SEQ ID NO: 72133 - DNA, 30 bp, Homo sapiens; identical to SEQ ID NO: 43017
  misc_feature 1..30: note = chr11:12288561-12288591
  misc_feature 1..30: note = hypo
  source 1..30: mol_type = genomic DNA

SEQ ID NO: 72134 - DNA, 36 bp, Homo sapiens
  misc_feature 1..36: note = chr11:1229945-1229981
  misc_feature 1..36: note = hypo
  source 1..36: mol_type = genomic DNA
cccctctgccagcctcgcaggcgctaagtcaacatc

SEQ ID NO: 72135 - DNA, 768 bp, Homo sapiens
  misc_feature 1..768: note = chr11:123065429-123066197
  misc_feature 1..768: note = hyper
  source 1..768: mol_type = genomic DNA
gacaatctcgatggccgactgggcggccctcggttgccagatgtgctcctccgtggccaggaggcagggactgaaaagccggctgactccaggggctgcagggacacccggtcagaaccggcgtctttcccggacgcagggctgcgtttgcccacggccatccaaactcccgccctcccagaggcactcacctagcaagaggagaaggaggagggacatcccgatccccggacgcgggcgcttccccgctcagctgctgcttggctccggggcggccgggcgcctccgacggacctcgggcgagctgggcgcggcgcctcggggtgcgcgcgaggtggctgcagccatgtgccgggcgggagccggccccgcgccccgtgcccctgggggcagatgggctcccggcgctcgccccaccagctggcgcccggacgggagccgggaccagggtcagggaggaaaacgcgaggcgaaaaggcgctaccgcttcgtggaacacttttccctgtttggaaagaaaaaggagtgaagaaagagagagggaaaaaaaaaattcagctggaaccacatggttgcctcctaccgcagcccctccctctctctctcgctgttccctccttccctccctccctcccgcgcggcgtttggggtttgcggtgggggccggtcggggagaagcgtgagctggccgggcagggagggccgggggagacctggggccgtgcagaggcgggtgggttgagaggcgccgggcgtaggattgattct

SEQ ID NO: 72136 - DNA, 63 bp, Homo sapiens
  misc_feature 1..63: note = chr11:123066400-123066463
  misc_feature 1..63: note = hyper
  source 1..63: mol_type = genomic DNA
ttgcctctccctcctcgtctcctcatgccctctcccctctgtcctctgcgctcttctcgcctc

SEQ ID NO: 72137 - DNA, 183 bp, Homo sapiens
  misc_feature 1..183: note = chr11:123169348-123169531
  misc_feature 1..183: note = hypo
  source 1..183: mol_type = genomic DNA
agtgggaggcacagccggaactgcgccctccatggagcaggtggagctgggaacaggtgggagggagccctgcctccttccgagttggcagggtgggaacccctccctctgtggctgcagacccagggatcgctgcgctctcagggacctgggaagccccccttcccccgcaggctcagaagt

SEQ ID NO: 72138 - DNA, 409 bp, Homo sapiens
  misc_feature 1..409: note = chr11:123172454-123172863
  misc_feature 1..409: note = hyper
  source 1..409: mol_type = genomic DNA
cgcagcgggcagggacggaggcgcccaggggcaggcggcagcacgggaagaggccagcaggtggcgcggtcgcccaacccggccgccccccgggcgccgagggaagcgggtcaggggcgtccccacctgcccaagcgccggctctcccaggcagcaggggcggcggcggcctggctggctgcgctgcagagcggagagcaggagcggcgtgggaggaattcggagcactttcgccgcctgcctccttttactgctggttgccctcaaaggagccctctccctccacacgcctttgggccttaccagccgccggaagcggcggcatccatcccagcaaagcgtgcattccatcctctggaaaaaaagtctttgagcttcctttacagtgaccttactttggggactgaac

SEQ ID NO: 72139 - DNA, 114 bp, Homo sapiens
  misc_feature 1..114: note = chr11:123172915-123173029
  misc_feature 1..114: note = hyper
  source 1..114: mol_type = genomic DNA
cgtggttgacgaagccattccctccttgctacttgccttgtgtgatacactgtcacggcccgggcttctggcttggtggaggggacaccaccgcggctccggctgcggacttcg

SEQ ID NO: 72140 - DNA, 93 bp, Homo sapiens
  misc_feature 1..93: note = chr11:123228623-123228716
  misc_feature 1..93: note = hyper
  source 1..93: mol_type = genomic DNA
cagatgcttccccatcgtgaagatcctccgggtcacctatgcactcctgctaatctctgccatttgccttcttacaccctttccataccttcc

SEQ ID NO: 72141 - DNA, 392 bp, Homo sapiens; identical to SEQ ID NO: 999
  misc_feature 1..392: note = chr11:123228788-123229180
  misc_feature 1..392: note = hyper
  source 1..392: mol_type = genomic DNA

SEQ ID NO: 72142 - DNA, 226 bp, Homo sapiens; identical to SEQ ID NO: 1000
  misc_feature 1..226: note = chr11:123229181-123229407
  misc_feature 1..226: note = hyper
  source 1..226: mol_type = genomic DNA

SEQ ID NO: 72143 - DNA, 130 bp, Homo sapiens
  misc_feature 1..130: note = chr11:123229461-123229591
  misc_feature 1..130: note = hyper
  source 1..130: mol_type = genomic DNA
cgcccgaaccgggtgtccacatgagtgcctctcccagcagatccaggtaagaacttcctgaccttcctgagccctaggaggaacacacatggatgccgagtgatggtgagggatccgggtgaaactggag

SEQ ID NO: 72144 - DNA, 144 bp, Homo sapiens
  misc_feature 1..144: note = chr11:123300811-123300955
  misc_feature 1..144: note = hyper
  source 1..144: mol_type = genomic DNA
cctttacttggaggtcgagtccctccccgagggaatccgtgtacagttacactagcggtcgctgccagtgctagcccattcaggatagcccccctcaccccgcccccagcccccgctcctcctcctccttttttgtttttatcc

SEQ ID NO: 72145 - DNA, 14 bp, Homo sapiens
  misc_feature 1..14: note = chr11:123301015-123301029
  misc_feature 1..14: note = hyper
  source 1..14: mol_type = genomic DNA
ctgcctcttcctcc

SEQ ID NO: 72146 - DNA, 1037 bp, Homo sapiens
  misc_feature 1..1037: note = chr11:123301082-123302119
  misc_feature 1..1037: note = hyper
  source 1..1037: mol_type = genomic DNA
cgcaaaccgctgagagtttgctgcaccgccccctggggcccctggctgccgagtcccgctaaggcaaagacgccagcaagcgaggaagcgcagcggaagaaaaacaagcgggcgcgcgaggggagccccaggagggctgccgagtggctggcaggcggctcccgcccctcccgggtggcctcgccggcggctgacggcccggaggacgcgcgctccgaaaagttagactccgggcggcggcgcgctacgccgcgtcccctcgcgtcccttcctcgctgcgctccgggaaaggaacttgttccttcggccccaggattggggagtgtgccgcggggccgagggtggggaacagccagagggagacgcgaaccaggccgctggcggagggctcagggggagcgcagaggcgacggcccccatgccggcggccaacatgatggagaaccggccgctgcccgccctgcaggtgcccgagccgcagggtgcgcccgagggcagcccggtctggtccagttcgtcgacccccacgcttcgccgccggcgcttcaagatgcgccgcatgaagaacgtacaggagcagagcctggaggccgggctggcccgggacctgcccgccgtcttggcccccggcaaggagttcctgcagctgccgtccatcgagatcacgccctccagcgacgaggacaccccgtggtccaactgctccacacccagcgcgtccccgcgccgaaaacgcttcctcctccgcaagtggctgagggtgagggagcggaaggagtgcagtgaaagcaggtacgtccccgttccgcccgtctccttcccttccctcccgtcctctccagagccgtccagggccccggggcattctgggggaaacgtcctgggggagaacaggagcccgtcaccagaggcgcttctggagggcgctgcgcctggtcccagggatggtggcattcagcttccacgcgtgccacccgctccccaactcagggtgaggggcttcatgttgcacgacacgtttacgtggggctttacgc

SEQ ID NO: 72147 - DNA, 74 bp, Homo sapiens
  misc_feature 1..74: note = chr11:123443648-123443722
  misc_feature 1..74: note = hypo
  source 1..74: mol_type = genomic DNA
tggctggggcaggggcgcaggtagaccccgatagctgaggcagaggcgcagataggccccgatggctggggcag

SEQ ID NO: 72148 - DNA, 47 bp, Homo sapiens
  misc_feature 1..47: note = chr11:123457217-123457264
  misc_feature 1..47: note = hypo
  source 1..47: mol_type = genomic DNA
tctcctggactcatgcggtccctctgggggtccgccctcgggtgaca

SEQ ID NO: 72149 - DNA, 439 bp, Homo sapiens
  misc_feature 1..439: note = chr11:123524538-123524977
  misc_feature 1..439: note = hyper
  source 1..439: mol_type = genomic DNA
acagagagattccctcggtcaaggactgcgccctctcagattctttcgaggaaaccctttgggacgaactgcccccagggggcgactttctgaccgaaggaagggccgagcaccggtgcctggggaggccctgggagcttttggagccgggtgggggctttgggccctaagcgaccccactggacctccccagttcgagggagccgatcagccgctccgcgcccgctctcgccggcgctcagcaccacggacagtcgcctccccgcccaccccggaactccagcttccactcgcgcccctgcctcgctcgtttgcgcccagggtaagctcagctcggaagggagtcgcactgctggcctagcagccaggctgtggaagggtccaggttgattcacctctcgcctccccaggatcggttgcgttccgactggaatcctcc

SEQ ID NO: 72150 - DNA, 79 bp, Homo sapiens
  misc_feature 1..79: note = chr11:123525394-123525473
  misc_feature 1..79: note = hyper
  source 1..79: mol_type = genomic DNA
ccctcccaggcccagcgccgcgccgagcgggggcggagccgggagcggcgcagacacttccagccgggatatctttgct

SEQ ID NO: 72151 - DNA, 30 bp, Homo sapiens
  misc_feature 1..30: note = chr11:123543339-123543369
  misc_feature 1..30: note = hypo
  source 1..30: mol_type = genomic DNA
gcaaatgagaaaagacggatactcaagtgc

SEQ ID NO: 72152 - DNA, 78 bp, Homo sapiens
  misc_feature 1..78: note = chr11:123885065-123885143
  misc_feature 1..78: note = hypo
  source 1..78: mol_type = genomic DNA
tccataacactgctgcgaggcacaatgtcataaaactcactatcatttatcaagcagttattacctgccagggatagt

SEQ ID NO: 72153 - DNA, 59 bp, Homo sapiens
  misc_feature 1..59: note = chr11:12398995-12399054
  misc_feature 1..59: note = hyper
  source 1..59: mol_type = genomic DNA
ttccagggcagagggcggcgcgagggagggagcgagggagggagcgagggaagggaaag

SEQ ID NO: 72154 - DNA, 106 bp, Homo sapiens
  misc_feature 1..106: note = chr11:12399277-12399383
  misc_feature 1..106: note = hyper
  source 1..106: mol_type = genomic DNA
cttcttggggaaactcggagggaccctggcccggaggaagaaagccaaggagggtgagtgcggccaggccggccgggcgggcggtaggagccgggggtgccgtagg

SEQ ID NO: 72155 - DNA, 30 bp, Homo sapiens; identical to SEQ ID NO: 42898
  misc_feature 1..30: note = chr11:1241768-1241798
  misc_feature 1..30: note = hypo
  source 1..30: mol_type = genomic DNA

SEQ ID NO: 72156 - DNA, 30 bp, Homo sapiens
  misc_feature 1..30: note = chr11:1243139-1243169
  misc_feature 1..30: note = hypo
  source 1..30: mol_type = genomic DNA
ccccatggggccggacgaggccacaccacc

SEQ ID NO: 72157 - DNA, 199 bp, Homo sapiens
  misc_feature 1..199: note = chr11:1244348-1244547
  misc_feature 1..199: note = hypo
  source 1..199: mol_type = genomic DNA
ccaggatgggtgccccgagcgcgtgccggacgctggtgttggctctggcggccatgctcgtggtgccgcaggcaggtaagagccccccactccgccccctctcgatgctgtcttcacggcgggggtctctgcaggtcgcttgcctgggagcttctcctgcagagtgcacgggcagatccccctacgactccctgagtgt

SEQ ID NO: 72158 - DNA, 30 bp, Homo sapiens
  misc_feature 1..30: note = chr11:124522134-124522164
  misc_feature 1..30: note = hypo
  source 1..30: mol_type = genomic DNA
tgttaccttgcatggcgaaaggcactttgt

SEQ ID NO: 72159 - DNA, 30 bp, Homo sapiens; identical to SEQ ID NO: 43276
  misc_feature 1..30: note = chr11:124526915-124526945
  misc_feature 1..30: note = hypo
  source 1..30: mol_type = genomic DNA

SEQ ID NO: 72160 - DNA, 68 bp, Homo sapiens
  misc_feature 1..68: note = chr11:124588270-124588338
  misc_feature 1..68: note = hyper
  source 1..68: mol_type = genomic DNA
ccacacacttgtcagcggcggtattattgttgtggtttagcgcctggcagcgccgcctccccccgctg

SEQ ID NO: 72161 - DNA, 20 bp, Homo sapiens
  misc_feature 1..20: note = chr11:124629399-124629419
  misc_feature 1..20: note = hyper
  source 1..20: mol_type = genomic DNA
ctcggccctctgcctcggag

SEQ ID NO: 72162 - DNA, 63 bp, Homo sapiens
  misc_feature 1..63: note = chr11:124629499-124629562
  misc_feature 1..63: note = hyper
  source 1..63: mol_type = genomic DNA
cgccctaggagagccaggctgaaggcctctaagggctgggagccgatccggccaggatgcaag

SEQ ID NO: 72163 - DNA, 408 bp, Homo sapiens
  misc_feature 1..408: note = chr11:124631502-124631910
  misc_feature 1..408: note = hyper
  source 1..408: mol_type = genomic DNA
gctggggaattgacacgaagtgcgtgtgtcaagcctggggaccaggggtatttccccgggggatcttcctcatcagcttgtatgtggggtcggggatgagagggggctagagttaagtccttaagctctttagccagtgtctcatctagcggctcagctcatccggctctgctgggtggggggtggggagtggacagggtgaggaatggttccgataactcaccccagaggtatccaggtcttccgagagatgcccttacctccccccgccatccgcccccacacccaaactgggggctgtccccgacaaagcgagaagtcagcgccagccagtgatgccctggagtgggattaggaggtcaggggaggagggcgagtcgtgggacccagttccgcagcagtggccaa

SEQ ID NO: 72164 - DNA, 30 bp, Homo sapiens
  misc_feature 1..30: note = chr11:124639029-124639059
  misc_feature 1..30: note = hypo
  source 1..30: mol_type = genomic DNA
agacttttcctgctacgttctcataccttc

SEQ ID NO: 72165 - DNA, 46 bp, Homo sapiens; identical to SEQ ID NO: 34126
  misc_feature 1..46: note = chr11:124709117-124709163
  misc_feature 1..46: note = hyper
  source 1..46: mol_type = genomic DNA

SEQ ID NO: 72166 - DNA, 374 bp, Homo sapiens
  misc_feature 1..374: note = chr11:124709482-124709856
  misc_feature 1..374: note = hyper
  source 1..374: mol_type = genomic DNA
cgcctaatccccgcacgcggacacctgggtgggagcgcgggcgagtggagggcgcgcctgcacgcaggatcccgggctgggcaacggcctagaccgcctctcgccaaacctcccacgccagcgccagtccgacgaacaggagctggtccagcgaacaataaaaggccccggggctggggagggatggaagcgcccttggagcgcgcaggctacgggcgcccccggcagcgcccccgcgccttcccctcccgccccgcggccgctgattgcctattgtgcgtcccctctgcggccgcccgcgcgatgcactctgcgagctggccccttcgtttctaaatgagcagccagcgccgcagacacgtgccaagggaagg

SEQ ID NO: 72167 - DNA, 156 bp, Homo sapiens; identical to SEQ ID NO: 34128
  misc_feature 1..156: note = chr11:124712781-124712937
  misc_feature 1..156: note = hyper
  source 1..156: mol_type = genomic DNA

SEQ ID NO: 72168 - DNA, 336 bp, Homo sapiens; identical to SEQ ID NO: 34129
  misc_feature 1..336: note = chr11:124713057-124713393
  misc_feature 1..336: note = hyper
  source 1..336: mol_type = genomic DNA

SEQ ID NO: 72169 - DNA, 30 bp, Homo sapiens
  misc_feature 1..30: note = chr11:124733379-124733409
  misc_feature 1..30: note = hyper
  source 1..30: mol_type = genomic DNA
ggcctggtaccaggacgtggggtttctatc

SEQ ID NO: 72170 - DNA, 349 bp, Homo sapiens
  misc_feature 1..349: note = chr11:124735003-124735352
  misc_feature 1..349: note = hyper
  source 1..349: mol_type = genomic DNA
cagaagggcagagtccgacagagcctcgtccctcatcttgggtgctttgagacagggaaaatctctcgccgcgtccagaacggaacgctgggcttggggtgcggggcggggactccaactcgcgcgctacgctactcgtgtctcctgctcggatagtgactgtagaggtaagggtgggagggtggagggaggcggattaatcccttaattacgccgtgatcggcgtggcacctgctttccgcctgcccagctcccaggggactccggcactagggggtggagagaaggacgagggaaggaggagggcacgaagaggcaccgaccgtacccaggcgcaccggcaggagag

SEQ ID NO: 72171 - DNA, 1083 bp, Homo sapiens
  misc_feature 1..1083: note = chr11:124735374-124736457
  misc_feature 1..1083: note = hyper
  source 1..1083: mol_type = genomic DNA
cgcagaggctgtggaggggcttacggctcccagcccacgggtctcagacccaggggctgggcccccagcccccagtcccgatcccagctgggtcgagccatgctgcgctacctgctgaaaacgctgctgcagatgaacttgttcgcggactctctggccggggacatctccaactccagcgagctgctcttgggcttcaactcctcgctggcggcgctcaaccacaccctgctgcctcccggcgatccctctctcaacggtgagaccctgcctcttggggatatgggatcctgggatggggatgaggtgagagggcggcgtggaagggaaggagaagcgctcctgtcccgaggtccgggattgagtggcgcctcccagcgcctccctgggtcgtggggtctaagggataatttggagcttcgagcacatgagtgggggtacccgcgggaggtcgagggcttgggagaagatggctactgagtctttttacacctccttcccttcccctacaacgcccaccccaggtgagaagaaccgttgctggtaacgggcagggaagtccgagctaagaaaggcccgggcccagcgcagggagggcagaggagggggcacagtctcccgccggcctcggccaagccaggtcactcggtgacccacccaggcagctggtcttcggaaccccgaagtttcccaagaactcacttaggaccagaggaagccaaaatgctggatgtgtttgctacggaggggataggggcggcgatcattttaaggaaacttagaagtttgtctttcagcggcgggactctcagccggcccaccccggcagagctgtggcgggcgggcggagctggcggcgaggtcgttaccgctaattacggtgattaataaatgactgggacagcgcgctctcccctagcgccgcggggaagctgcgggagccggccgccgccagcctgcggagaggccggagcgcgccccctgcctgccgcatcgggaacccccgctttaccgggcgctttcgcgtgtggttccctccaggtgcacgcggtccccatccctctgcctcgacccactcgagtc

SEQ ID NO: 72172 - DNA, 579 bp, Homo sapiens
  misc_feature 1..579: note = chr11:124738445-124739024
  misc_feature 1..579: note = hyper
  source 1..579: mol_type = genomic DNA
tagaagtttgtgtcccgatccctctactaaccggcctgtctgtaggcatcttcctttgagacgaggaacgcggaacgtctgccaataaggacatattggatcctgcagagggagagggtaggcaggtggggactgagctccgcagagaagcataggagatggaacgaccagaggattctctttccctctggagcctcaatctctccccacaatttccctgtctgaacgctctgcgccaccccctgtccccagggtcaagggtaggaccggaggacgctatgccccgcatcgtggagcagccgccagatctgctggtctcccgaggcgagcccgccacgttgccctgccgcgctgaaggccgaccccgacccaacattgagtggtacaagaacggggcgcgtgtggccactgtgcgggaggatccgcgtgcgcaccgcctgctgctgcccagcggcgccctcttcttcccgcgcatcgtgcacgggcgccgcgcgcggccggacgaaggtgtctacacttgcgtggctcgcaactacctgggggcagcagcgagcagaaacgcctcgctggaagtggcag

SEQ ID NO: 72173 - DNA, 247 bp, Homo sapiens
  misc_feature 1..247: note = chr11:124739234-124739481
  misc_feature 1..247: note = hyper
  source 1..247: mol_type = genomic DNA
aattccagtctgcagcgatcaaccccttcccaagacaacactttccctgtgtcctcagccagttatgtcactctacaccctgcttatttcgccccccaccgccccgcccagtcctccgtgatgatttccggcagtctcctggaaacgtggtggtggcagtgggggagccagcagtactggaatgcgtgcccccccgcggccacccggagccttccgtgtcctggaggaaggacggtgcaagactcaa

SEQ ID NO: 72174 - DNA, 151 bp, Homo sapiens
  misc_feature 1..151: note = chr11:124743216-124743367
  misc_feature 1..151: note = hypo
  source 1..151: mol_type = genomic DNA
gggcttctacagctgcgtggccaagagttccacaggggaagccacatggagcggctggcttaagatgcggggtgagttttttctttcttcccttattttgataataccttcctccaaacctgcttcaacaggtagtcgatacctcctcaaa

SEQ ID NO: 72175 - DNA, 337 bp, Homo sapiens
  misc_feature 1..337: note = chr11:1247782-1248119
  misc_feature 1..337: note = hypo
  source 1..337: mol_type = genomic DNA
caggggaggctaccccgtggggggctggcatggggatgggcctcatcccgcgctccccacagccctgaacccggcgcacaatgggcgggtgtgcagcacctggggtgacttccactacaagaccttcgacggcgacgtcttccgcttccctggcctttgcaactacgtgttctctgagcactgccgcgccgcctacgaggacttcaacgtccagctacgccgaggcctagtgggctccaggcctgtggtcacccgtgttgtcatcaaggcccaggggctggtgctggaggcgtccaacggctccgtcctcatcaatgggcagcggtgagccggccac

SEQ ID NO: 72176 - DNA, 39 bp, Homo sapiens
  misc_feature 1..39: note = chr11:124791254-124791293
  misc_feature 1..39: note = hyper
  source 1..39: mol_type = genomic DNA
gagacacggagtagccgggcgggccgggctccgtcgcgc

SEQ ID NO: 72177 - DNA, 315 bp, Homo sapiens
  misc_feature 1..315: note = chr11:124933396-124933711
  misc_feature 1..315: note = hyper
  source 1..315: mol_type = genomic DNA
gagatcaccccagatcggccccggcgtcgccgcgtggccaggggtgctggggggacttggtcccgagctcctccagcggcgcccgcctcggaggttgataaccctccctgcccaactccgcccgcgctcccccagaccccgcgacgctggctcggtgacactggggaagaacaggctgccagggagggtctccatcgtttcccgtttccatcctcccctcctaacacacatccggggcgccttcagagcgcctttctgtcgttgggcagctggggaacctgggctcgaaggctggggaaccgaggccaggggatg

SEQ ID NO: 72178 - DNA, 30 bp, Homo sapiens
  misc_feature 1..30: note = chr11:1249828-1249858
  misc_feature 1..30: note = hypo
  source 1..30: mol_type = genomic DNA
ctttgcggagtgccacgcactggtggacag

SEQ ID NO: 72179 - DNA, 140 bp, Homo sapiens
  misc_feature 1..140: note = chr11:125034165-125034305
  misc_feature 1..140: note = hyper
  source 1..140: mol_type = genomic DNA
gaaggatttcttgcccgttttaagtttcatcatttctggggagttctcttggggtccacagaaaatctcacctcatctcggtcccctcagcaccggtgatatcttggaactcggccccggttgttcgctaaggaggactt

SEQ ID NO: 72180 - DNA, 354 bp, Homo sapiens
  misc_feature 1..354: note = chr11:125034624-125034978
  misc_feature 1..354: note = hyper
  source 1..354: mol_type = genomic DNA
taggctgtgttgtcacgccggtgtcagtctgatgaagattggcatcaggtaagctgtcattcatttccatgtcagagacgcttttgcaggcggcggcggcggcgcggcggcggctgctgctgcgggcggctgcctcagagcgcgtgtgttttattccagtccccaagccagagtattattcattgcgacagggcaaggaggagagagggagagagggaggcagcagggaggagagagagggaggcagcagggaggagggaggcagggagcagcgagggacggcgggagcgtgcagagagaagctggggaagcgccgggagagcgcggagcggagcagcgcgaggggcggcgagg

SEQ ID NO: 72181 - DNA, 979 bp, Homo sapiens
  misc_feature 1..979: note = chr11:125035358-125036337
  misc_feature 1..979: note = hyper
  source 1..979: mol_type = genomic DNA
ggagatgctttccagcggctggaggcgggagcggtcccaggctggggccaggtgaccggaggagtcgaggagccgcggccgcggcctggggaggcagggcgaatgagggtttgcagacggatcagtggagacaggggaacaccggcggggcccgggaagccaggatccgaggggctacacgcacggaccctcacccagggaggagcgagaatgtgtagggtcaccggctttccatgattgctggggatctttggtgaggcgggcgtaggggcccgcgcgaggcttgggaatcgggagcccttctggctcgagaactaggggatgagttcgtaaaagagggaactgaaagcgatcgagagcggagagctgagggggatggcgcaggatcccgaatctgccgctcaaagtttgcatttctttcgggttaggagacgggctttcctggctcccgatccccaggaagaaacgagcgaaatgggccgtcctttcccggggctcttcacgggggagccgggggtttccgcgcggtggggagactcgggttgggaattgaggggtaggggcttgtggatcggcctgaattagggctgggttttaggaccagtctagagttcggtttataggatccagactgtttacggaatcgggatcgaggggccgataagtagtttacacgccggccagagcagagggctggaggtcggagttgggggctggaggaacgggtggcgtttttaggattcagtaacaggatcacagctttttcttgtggtggaagctattggaatttggggagggtagcacgaggggtcctgcagctccgcgtgtgaaaaagcgtttaggtaggcgatgaaagtagttgatctgagccatggcaggcgagccccgaatttttgctgcttccccctgaaagtgtttctttaggaggagaggacttgggccacacaggacccggtcctaagagagcgattccgggaag

SEQ ID NO: 72182 - DNA, 571 bp, Homo sapiens
  misc_feature 1..571: note = chr11:1250780-1251351
  misc_feature 1..571: note = hypo
  source 1..571: mol_type = genomic DNA
gagtgcagctcagggcgggggcggtgtcctggagcaggaattcctccccaagggaggcagcttgtccccaaggccggtgtcttctgaccttggtgtcccccgtgcatgggccggccctgcctcacgccgcgccccacaggcacggtgctggatgacatcacgcactctggctgcctgcccctcgggcagtgcccctgcacccacggcggccgcacctacagcccgggcacctccttcaacaccacctgcagctcctggtacttatgagcccaccagcctccgcctggggtggggtgtggagctcctggtatttatgaacccgccagcctctgcctggggtgggggtgtggagctcctggtgtgcacccaccagcctccgcctgcggtgggggtgtggagggtggggcccacctcctcccgacatgccggttctgctcacggcctccctccccagcacctgctccggggggctatggcagtgccaggacctgccgtgccctggcacctgctctgtgcagggcggggcccacatctccacctatgatgagaaactctacgacctgcatggtga

SEQ ID NO: 72183 - DNA, 52 bp, Homo sapiens
  misc_feature 1..52: note = chr11:125133192-125133244
  misc_feature 1..52: note = hyper
  source 1..52: mol_type = genomic DNA
cagccgctcccttcccgtccctagcagtgggggaagccgcatgaggaggagc

SEQ ID NO: 72184 - DNA, 33 bp, Homo sapiens
  misc_feature 1..33: note = chr11:1251802-1251835
  misc_feature 1..33: note = hypo
  source 1..33: mol_type = genomic DNA
gacgctcagcctggacggcggggacacggtgag

SEQ ID NO: 72185 - DNA, 182 bp, Homo sapiens
  misc_feature 1..182: note = chr11:125220500-125220682
  misc_feature 1..182: note = hypo
  source 1..182: mol_type = genomic DNA
ccatagtcacaagcccgagtctgggaaagtacaggagtagaccggcattccctgcctctttcccttccccaaggcctccaggcagccaccctggggctacagtctgaggacgggtccaggccgtcctccgtctcacagtctgaggacgggtgagccctggggaggggcgagcttggtgcttg

SEQ ID NO: 72186 - DNA, 30 bp, Homo sapiens
  misc_feature 1..30: note = chr11:125221866-125221896
  misc_feature 1..30: note = hypo
  source 1..30: mol_type = genomic DNA
cagatcagacacagccgccccccaagatct

SEQ ID NO: 72187 - DNA, 182 bp, Homo sapiens
  misc_feature 1..182: note = chr11:125259900-125260082
  misc_feature 1..182: note = hypo
  source 1..182: mol_type = genomic DNA
gaggcctcaggccagcggcattcagagacttagccactttggccttcagtccgggctctctttgcctagacaggagcagaaaatcccacagacaccaggaaagggaaaggaaatgggaatcctcaacgctagtaataatgaacatttatagagcacttaccaggtgccgggtaccgttccaa

SEQ ID NO: 72188 - DNA, 16 bp, Homo sapiens
  misc_feature 1..16: note = chr11:125271700-125271716
  misc_feature 1..16: note = hypo
  source 1..16: mol_type = genomic DNA
gcgggcacatgcattc

SEQ ID NO: 72189 - DNA, 255 bp, Homo sapiens
  misc_feature 1..255: note = chr11:1252832-1253087
  misc_feature 1..255: note = hypo
  source 1..255: mol_type = genomic DNA
cggggcctggactagcgccaggctgcagggaggggcaggcagaggcgggcaggggaccggggagggggctgcccccagggcatggcggagatcctggtgccagcgcaggacaccagcattggaccagcggccccggaagcagccagctgggaggatggagcgggcagccctgccctggctcaggccgactttgcacaggggctggctttgcacaggggccgactgcacaggggcgccccccgccagggcttatct

SEQ ID NO: 72190 - DNA, 42 bp, Homo sapiens
  misc_feature 1..42: note = chr11:125304472-125304514
  misc_feature 1..42: note = hypo
  source 1..42: mol_type = genomic DNA
ccatcttttcaaccacgctgccaactgaaagtgggtttcttt

SEQ ID NO: 72191 - DNA, 1267 bp, Homo sapiens
  misc_feature 1..1267: note = chr11:125365065-125366332
  misc_feature 1..1267: note = hyper
  source 1..1267: mol_type = genomic DNA
ctcctccccccagtccggtggggtaaagaaagcctcctccaggcagcacaatggctggcactctgaggaagccggactcatcccgtgcaggccgcatacacactccactgcccttccggccaaacaagcccggacacgggagagggatgagagtcggggatgcctagcggcgaggagagaagggataggcaaaagggaagaagagcgggctgtgatacctcctcgacgccgtcaaacactgctccccgcattccagagcccggggcccacccgacggcagcgcgccccgccaccgcgcagccgccccggtcccttctcccgcccgtctgtagtaaaacaatcgctctcccggcgtctgcggccgctgccagcggttctgacactgcaggaatgcgcggtctggggaaggctccgcactctggggaggggcacgagcggggtcgggggtaagtttttagggacaaagatgatcttggggcgtttacggtgactggaccagataacggtcccgggacgaggtaccgacccactgccccagcgcgatcgggcggcgttcccttcttcccccagcccccatacctcgccgccctgccttcacacgcgcgcacacacgcgggcacacacacgcggacacacacacacacacacacacacacacacacacaccaggcctggctggagggccgatgctgagatgatactggaagtgcccatcatcccacatctccagggcctggcgcggcgtcccagctgcgctccctgaagggctgggcaggaaggcgacggcctcccgttgttcctttctaatcccagaatgggaccaggtgaggggagctgcggcgaccccagaccgtcctgtcagagaatcccggggcctccttaccacccccaccagaccccacccccagcagtgagtcgggtcctaactaaagtcaacccccgcgacggcacctgtgcgggtcctggcggagggaggcggatcccggggctcagccggacacccccatccacgggccgcgggagcggccggagcgcagcgcagcgcagcggagagccagccagccagccagccagcgagcgctccccgcgcagctccggcggcgcccggctccgctcccgcctccaccccaccccttccccgcgctcgtgcccgggctccgggggcgcgcccgcgctcgggcacccacccaactggcacgcgcgggagctggacgtcatcccctcgttaacattcatagccttcctccgagcacgtgggcttgccttt

SEQ ID NO: 72192 - DNA, 30 bp, Homo sapiens
  misc_feature 1..30: note = chr11:1253832-1253862
  misc_feature 1..30: note = hypo
  source 1..30: mol_type = genomic DNA
ggctggggtccctgacgccccgatgcctcc

SEQ ID NO: 72193 - DNA, 84 bp, Homo sapiens
  misc_feature 1..84: note = chr11:1254339-1254423
  misc_feature 1..84: note = hypo
  source 1..84: mol_type = genomic DNA
ctgcagcgtttccttcgtgcctgtggacggctgcacctgccccgcgggcaccttcctcaatgacgcgggcgcctgtgtgcccgc

SEQ ID NO: 72194 - DNA, 321 bp, Homo sapiens; identical to SEQ ID NO: 42904
  misc_feature 1..321: note = chr11:1254973-1255294
  misc_feature 1..321: note = hypo
  source 1..321: mol_type = genomic DNA

SEQ ID NO: 72195 - DNA, 164 bp, Homo sapiens
  misc_feature 1..164: note = chr11:1256353-1256517
  misc_feature 1..164: note = hypo
  source 1..164: mol_type = genomic DNA
ctgcctgggcacctgcgtggcctacggggatggccacttcatcacctttgatggcgatcgctacagctttgaaggcagctgcgagtacatcttggcccaggtacgccgccccctcgcccactcctgcaggccgggcacactccagcccgcggccagcagcttgt

SEQ ID NO: 72196 - DNA, 158 bp, Homo sapiens
  misc_feature 1..158: note = chr11:125755569-125755727
  misc_feature 1..158: note = hypo
  source 1..158: mol_type = genomic DNA
ccaacccccaggccacggacaggcacctaggaaccaggccgcaaggcagggggtaagccgtaggagcttcatctgtttctacagccactccccatctggcattactgcctgagctctgccttccgtcgcatgaacaggggtgttagagtctcacaaga

SEQ ID NO: 72197 - DNA, 36 bp, Homo sapiens
  misc_feature 1..36: note = chr11:125757373-125757409
  misc_feature 1..36: note = hyper
  source 1..36: mol_type = genomic DNA
tcccgggcatgctcccgccggcggagaaggcccaga

SEQ ID NO: 72198 - DNA, 31 bp, Homo sapiens
  misc_feature 1..31: note = chr11:125759609-125759640
  misc_feature 1..31: note = hypo
  source 1..31: mol_type = genomic DNA
gcgacagagagagactcgtctcaaaaaacaa

SEQ ID NO: 72199 - DNA, 256 bp, Homo sapiens
  misc_feature 1..256: note = chr11:1257652-1257908
  misc_feature 1..256: note = hypo
  source 1..256: mol_type = genomic DNA
cggtggcgagagggccgggtggggacccaccctacaagatacgctacatggggatcttcctggtcatcgagacccacgggatggccgtgtcctgggaccggaagaccagcgtgttcatccgactgcaccaggactacaaggtgagctcgggccgtgcactcctaggccctgcaggaccctctcacagtgacagaaaccctggtgccaggtggggtctgtgggactcgctgacccgtgggtgcgtgagcctggctgg

SEQ ID NO: 72200 - DNA, 399 bp, Homo sapiens
  misc_feature 1..399: note = chr11:125773662-125774061
  misc_feature 1..399: note = hyper
  source 1..399: mol_type = genomic DNA
ggaatttggttctttcgtccaaattgagcggtcattaaatcattagtaccagggatccagggatctataccggattatgcaaacgcatgtaggacgtagaggttataccgaaaggtaatgtttttaacaagagaccacatttcagaataaaagctttaaaaagcctatgtggaacatcacaggtatctagggcaggaacagcagttagagcttgaacagttctgcttcctttccgcaactgtggcattcgaggtcattcgtcatatcaaattcatcagattttgtctccactttgctaaccaattcgctaacctttctgacatcttgtgatgtggaggcggaaatttccagggaaaccgacacggggcgtaaagcgcggcggggagtccggggggctcc

SEQ ID NO: 72201 - DNA, 327 bp, Homo sapiens; identical to SEQ ID NO: 34142
  misc_feature 1..327: note = chr11:125774122-125774449
  misc_feature 1..327: note = hyper
  source 1..327: mol_type = genomic DNA

SEQ ID NO: 72202 - DNA, 42 bp, Homo sapiens
  misc_feature 1..42: note = chr11:125774480-125774522
  misc_feature 1..42: note = hyper
  source 1..42: mol_type = genomic DNA
cgccaccgagccggggggccacagccgcgggggtggagctcc

SEQ ID NO: 72203 - DNA, 30 bp, Homo sapiens
  misc_feature 1..30: note = chr11:1260620-1260650
  misc_feature 1..30: note = hypo
  source 1..30: mol_type = genomic DNA
gtgagggctggtgggcgcctccttagcctc

SEQ ID NO: 72204 - DNA, 184 bp, Homo sapiens
  misc_feature 1..184: note = chr11:126083469-126083653
  misc_feature 1..184: note = hypo
  source 1..184: mol_type = genomic DNA
ctgaagttttgacatcgggacttaaattcatatcattacattaattaaaaacttgttttgggtacaggacttttatggttttgtgtcggggatgggagaggctgtttctaccctaaccttatggcattcaagaaactacacctgttcttgcagagttggccttctgtggcgggaaacaaaatga

SEQ ID NO: 72205 - DNA, 94 bp, Homo sapiens
  misc_feature 1..94: note = chr11:126083885-126083979
  misc_feature 1..94: note = hypo
  source 1..94: mol_type = genomic DNA
tccttaatgtttctccggtgagtctaggcacttggtgatttaaagtagagttgttctcagtataaagaatttatgtggccgggcgcggtggccc

SEQ ID NO: 72206 - DNA, 215 bp, Homo sapiens
  misc_feature 1..215: note = chr11:126085129-126085344
  misc_feature 1..215: note = hypo
  source 1..215: mol_type = genomic DNA
acttctctttcagcccgaattagtgggatttatttcagatttatcttgaatacatttagcattgatactaagaaactggattctgctcttgtccccagaatttaactttttgccactgagctaatgtttatgtttggaggttacttcattgagtggtgttggaatatacttttaagatttctggccaggcgcggtggcttacgcctgtaacccta

SEQ ID NO: 72207 - DNA, 28 bp, Homo sapiens
  misc_feature 1..28: note = chr11:126154206-126154234
  misc_feature 1..28: note = hypo
  source 1..28: mol_type = genomic DNA
gcgtgaaccactgcgcccagcccttcat

SEQ ID NO: 72208 - DNA, 30 bp, Homo sapiens
  misc_feature 1..30: note = chr11:126225281-126225311
  misc_feature 1..30: note = hyper
  source 1..30: mol_type = genomic DNA
gcatacccaccctggcgccattcacaggca

SEQ ID NO: 72209 - DNA, 109 bp, Homo sapiens
  misc_feature 1..109: note = chr11:126226052-126226161
  misc_feature 1..109: note = hyper
  source 1..109: mol_type = genomic DNA
cacctccagcatcctcgagcgatggtttctcccacaactaccccggtcaggtccagcacttgggagctgactgtgctggaggtgacaggctttgcggggtccgcctgtg

SEQ ID NO: 72210 - DNA, 231 bp, Homo sapiens; identical to SEQ ID NO: 43282
  misc_feature 1..231: note = chr11:126273042-126273273
  misc_feature 1..231: note = hypo
  source 1..231: mol_type = genomic DNA

SEQ ID NO: 72211 - DNA, 584 bp, Homo sapiens
  misc_feature 1..584: note = chr11:1263180-1263764
  misc_feature 1..584: note = hypo
  source 1..584: mol_type = genomic DNA
tccacccttccaacacgctcagcccttccagggacgacggggagcttgggcacatggcgcccctcacagccacccacgctggccccaacaacaatggcaacctccagagctcgcccgacaggcacagccagcaccgcttccaaagagccgctgaccacgagcctggcgccaacactcacgagcgagctgtccacctctcaggccgagaccagcacgcccaggacagagacgacaatgagccccttgactaacaccaccaccagccagggcacgacccgctgtcaaccgaagtgtgagtggacagagtggtttgacgtggacttcccaacctcaggggttgcaggcggggacatggaaacttttgaaaacatcagggctgctgggggcaagatgtgctgggcaccaaagagcatagagtgccgggcggagaactaccccgaggtaagcatcgaccaggtcgggcaggtgctgacctgcagcctggagacggggctgacctgcaagaacgaagaccagacaggcaggttcaacatgtgcttcaactacaacgtgcgtgtgctttgctgtgacgactacagccactg

SEQ ID NO: 72212 - DNA, 30 bp, Homo sapiens
  misc_feature 1..30: note = chr11:126320587-126320617
  misc_feature 1..30: note = hypo
  source 1..30: mol_type = genomic DNA
tggtgcgtgcatgtgcgagtttgtgcatgt

SEQ ID NO: 72213 - DNA, 30 bp, Homo sapiens
  misc_feature 1..30: note = chr11:126713464-126713494
  misc_feature 1..30: note = hypo
  source 1..30: mol_type = genomic DNA
gctagtgagtgggaccgtcagaggtgtttg

SEQ ID NO: 72214 - DNA, 30 bp, Homo sapiens
  misc_feature 1..30: note = chr11:126719627-126719657
  misc_feature 1..30: note = hypo
  source 1..30: mol_type = genomic DNA
gacagaaggtggagacggtgtgaaatgggc

SEQ ID NO: 72215 - DNA, 30 bp, Homo sapiens
  misc_feature 1..30: note = chr11:126786457-126786487
  misc_feature 1..30: note = hypo
  source 1..30: mol_type = genomic DNA
tcaaactcaactgatcggtacagaaagcca

SEQ ID NO: 72216 - DNA, 255 bp, Homo sapiens
  misc_feature 1..255: note = chr11:126870174-126870429
  misc_feature 1..255: note = hyper
  source 1..255: mol_type = genomic DNA
ccattttgttgcattcgcaaaggcgaagaggcaatgccagagcatctcagcccggcaccgagagacgcatccatcagtccgagttcccgaagcctgcccacgttcctgcccacagcctcccgcgccctgacaacccagccgactttcttccaactccagcagcgcaggggtcctaccttgactgaagaggaagaagcagacgaagagcagatcgagctggaagggtttcattccttagcgcagcgaaggaaagcc

SEQ ID NO: 72217 - DNA, 71 bp, Homo sapiens; identical to SEQ ID NO: 34147
  misc_feature 1..71: note = chr11:126870430-126870501
  misc_feature 1..71: note = hyper
  source 1..71: mol_type = genomic DNA

SEQ ID NO: 72218 - DNA, 227 bp, Homo sapiens
  misc_feature 1..227: note = chr11:126870524-126870751
  misc_feature 1..227: note = hyper
  source 1..227: mol_type = genomic DNA
cgtccgtgggtccctccgggtggcttcggtctctttgtgcctctgggtatctgcagccagccgacacaaactgcctgttcttagccgcctcgggaagccgggattgtcagcaatgtccccactcggagaagatccattctctggctcttggcatcccaggcacacggcttcctcaggcgggctcctcccacagtgagcgagcgagctagtgacgagtgacagaagga

SEQ ID NO: 72219 - DNA, 30 bp, Homo sapiens
  misc_feature 1..30: note = chr11:126870952-126870982
  misc_feature 1..30: note = hyper
  source 1..30: mol_type = genomic DNA
gactttttgtccacacgatgtcctgtttaa

SEQ ID NO: 72220 - DNA, 764 bp, Homo sapiens; identical to SEQ ID NO: 34149
  misc_feature 1..764: note = chr11:126873058-126873822
  misc_feature 1..764: note = hyper
  source 1..764: mol_type = genomic DNA

SEQ ID NO: 72221 - DNA, 97 bp, Homo sapiens
  misc_feature 1..97: note = chr11:12695399-12695496
  misc_feature 1..97: note = hyper
  source 1..97: mol_type = genomic DNA
gctgggaatctggcccggagacggcgtccaccgcgctcgagagcaacaatctgcatcaccagaaaggcaacttctctaccctacacttgcagacttc

SEQ ID NO: 72222 - DNA, 1116 bp, Homo sapiens
  misc_feature 1..1116: note = chr11:12695572-12696688
  misc_feature 1..1116: note = hyper
  source 1..1116: mol_type = genomic DNA
cgtcgcgcgcaactcccgcctcggcgcctgccccctggaagaaacccaggcttccagagttcttcgcgcgagcgcagggacttccaagccgcgcagctcccgtccgccccgccccgccccgccccggctcgggacaaagcccggagcccgcgccgggagacggagggcggctcccgcgcgagccacgctcccccgtgggcgcgagactccgcccagctgccgaaagcccgcgccccaacggcgaagcagccgcgccggtccgccccgattccccatgacgtcaccggcggcggcaggccccgcctccagccccgggcggcaggccgcatgacgtcaccgaggccccacccctccggagcgagttcggtcctggcgttcatttcattcctgtcctcattccgaacattcttagcatcgctcgcgccgcgccgcgccgcctgagccgagccgagcctctgctgccgccgccgcggccccgccgcccgccgcgggcgcccaccaagcactttgcagactcgcttccaccctgcgggccattccgcgcggcggggcccgggcccggggcggccgcgtccaggcacaggccatgcagtgacgcccccccacccctccacctttgcccggagcgcgggcagcagcccagcgcgccagccggccccggggcaggagcggtgctaggcaggggtggggtggccgggcccagggaccgggagccggggagggagccgggcaccgagcagagggcgggggaagcggcgccgaagtttgcctcggactcgccgggcgctgcggtggctccctgggccgaggtaagttggcgcgcggggcggatgctggggtgcggggggcgcacggggcagcggggggccggcggcgcgtccctcgcgggccgctctttctttgcgggctctgctttgtgtgcgacggcgggcgggcacgcggagggccgcggccgggcccccacacccgcctccccgcgccccctccgaggtgagcggccgggcgccgccgcgcgacttgccaggacgccaagttgggccgcgcgctgggagcccgcgcggcaacaggcggcccccggccggccgcgccgcgccccccgcgcgccccctctcccgc

SEQ ID NO: 72223 - DNA, 30 bp, Homo sapiens
  misc_feature 1..30: note = chr11:127009561-127009591
  misc_feature 1..30: note = hypo
  source 1..30: mol_type = genomic DNA
caaagatcttgttttcgtctctagaactcc

SEQ ID NO: 72224 - DNA, 30 bp, Homo sapiens
  misc_feature 1..30: note = chr11:127013703-127013733
  misc_feature 1..30: note = hypo
  source 1..30: mol_type = genomic DNA
aatatcggtcaccctcgtccaggaggataa

SEQ ID NO: 72225 - DNA, 30 bp, Homo sapiens; identical to SEQ ID NO: 33642
  misc_feature 1..30: note = chr11:12715647-12715677
  misc_feature 1..30: note = hyper
  source 1..30: mol_type = genomic DNA

SEQ ID NO: 72226 - DNA, 44 bp, Homo sapiens
  misc_feature 1..44: note = chr11:1273678-1273722
  misc_feature 1..44: note = hypo
  source 1..44: mol_type = genomic DNA
accgccagtgtcctccgccccgctgtcctcgccctcccctgccc

SEQ ID NO: 72227 - DNA, 281 bp, Homo sapiens
  misc_feature 1..281: note = chr11:1274002-1274283
  misc_feature 1..281: note = hypo
  source 1..281: mol_type = genomic DNA
tggtccaggtgaggacgtgcatgttccctgccccaggtgaatgagacctggaccctggagaactgcacggtggccaggtgcgtgggtgacaaccgtgtcgtcctgctggacccaaagcctgtggccaacgtcacctgcgtgaacaagcacctgcccatcaaagtgtcggacccgagccagccctgtgacttccactatgagtgcgagtgtgagtgcgtcggtggccgcgggattaccccgggggcaggtggagcagagtgcaccgtcggctaggctggcag

SEQ ID NO: 72228 - DNA, 30 bp, Homo sapiens
  misc_feature 1..30: note = chr11:12745696-12745726
  misc_feature 1..30: note = hypo
  source 1..30: mol_type = genomic DNA
ccacactgtcccctccgcaacaaacactga

SEQ ID NO: 72229 - DNA, 152 bp, Homo sapiens
  misc_feature 1..152: note = chr11:1275246-1275398
  misc_feature 1..152: note = hypo
  source 1..152: mol_type = genomic DNA
cgctggctgccatgacgcctggggagcgagggcaccaccacggagcctgccagcccgtccatctctgtcccgcaggcatctgcagcatgtggggcggctcccactattccacctttgacggcacctcttacaccttccggggcaactgcacc

SEQ ID NO: 72230 - DNA, 119 bp, Homo sapiens
  misc_feature 1..119: note = chr11:1275636-1275755
  misc_feature 1..119: note = hypo
  source 1..119: mol_type = genomic DNA
aggccgactgcaggccggggtgacccaggtgccgcagcgatggcccagtgcccaagacagctcccagggggcagggaaggcctgtggagccgcctaaggccgagcgcaccctgtggcct

SEQ ID NO: 72231 - DNA, 509 bp, Homo sapiens
  misc_feature 1..509: note = chr11:1276280-1276789
  misc_feature 1..509: note = hypo
  source 1..509: mol_type = genomic DNA
caacaaccagagggacgactgtctccagcgggacggaaccactgccgccagttgcaaggacatggccaagacgtggctggtccccgacagcagaaaggatggctgctgggccccgactggcacaccccccactgccagccccgcagccccggtgtctagcacacccacccccaccccatgcccaccacagccgctctgtgatctgatgctgagccagtgagtcctcccctcgggggttgcaggccctggggcgcccccgcccgcccgcatgcacgcacgcacgcagctccctggggctgggggccctccgtcctgatcgctttgccccacagggtctttgctgagtgccacaaccttgtgcccccgggcccattcttcaacgcctgcatcagcgaccactgcaggggccgccttgaggtgccctgccagagcctggaggcttacgcagagctctgccgcgcccggggagtgtgcagtgactggcgaggtgcaaccggtggcctgtgcgg

SEQ ID NO: 72232 - DNA, 232 bp, Homo sapiens
  misc_feature 1..232: note = chr11:1278648-1278880
  misc_feature 1..232: note = hypo
  source 1..232: mol_type = genomic DNA
tcactctgggccactcgggtaccagcccgagggagggggtggctggacagatgcccagggttgacctgtgtctgtccaggagccctcagggacccccttgatccattccagcccggggagcggtgggtcagcaactgccagtcctgcgtgtgtgacgagggttcagtgtcggtgcagtgcaagcccctgccctgtgacgcccagggtcagcccccgccgtgcaaccgtcccg

SEQ ID NO: 72233 - DNA, 30 bp, Homo sapiens
  misc_feature 1..30: note = chr11:1279716-1279746
  misc_feature 1..30: note = hypo
  source 1..30: mol_type = genomic DNA
caggggccctggacacgtcagagctgggac

SEQ ID NO: 72234 - DNA, 23 bp, Homo sapiens
  misc_feature 1..23: note = chr11:128110182-128110205
  misc_feature 1..23: note = hypo
  source 1..23: mol_type = genomic DNA
tacaaaaaaattagccgggcctg

SEQ ID NO: 72235 - DNA, 173 bp, Homo sapiens
  misc_feature 1..173: note = chr11:128419104-128419277
  misc_feature 1..173: note = hyper
  source 1..173: mol_type = genomic DNA
tacaggctgtccctgcggcgcagcccgcccccaccctccactctcacgcgcccctcgcccctcgcccctcgcccctcgcccctctcctgggctccggctcccacctcatcggcccacccgaagatgtccattcacccagtgccgcggccggagccgagcggggcctgacgcca

SEQ ID NO: 72236 - DNA, 124 bp, Homo sapiens
  misc_feature 1..124: note = chr11:128556976-128557100
  misc_feature 1..124: note = hyper
  source 1..124: mol_type = genomic DNA
atgtgtgcatgcgtgcgcctgtttgcatgtgggcgtgtgtatgtggggttgtgtgcgggtatgcgggcgccacgcgcttctcctacaggtgagacacgcgctcagtcctcgagcccaccttctt

SEQ ID NO: 72237 - DNA, 423 bp, Homo sapiens; identical to SEQ ID NO: 34151
  misc_feature 1..423: note = chr11:128562763-128563186
  misc_feature 1..423: note = hyper
  source 1..423: mol_type = genomic DNA

SEQ ID NO: 72238 - DNA, 482 bp, Homo sapiens
  misc_feature 1..482: note = chr11:128563336-128563818
  misc_feature 1..482: note = hyper
  source 1..482: mol_type = genomic DNA
cggttttcgtccgagtcttccccggcagtaggcgctgggttacccgcagccctagccaactctccctccataccccccctaccccacccccaaaaagtttgtctccggctggaaaaagcattaatgaacgtatctgtgggaagaaacggaaagtgaatgagtcaggagggccaccttcggccaaccgcctcaggaaaagcaaagaagccaaaggtctttggctttggattttgggggaaggtgatggggggaggttcagacttcgggaatcagggcgcggacgctgggcgtggaccccgtcattgttcccggctagctcttatctcccaggagcaagtatcctgtgtgcgcagcgcatgaatgtgtctgggcatctccgcgtatatttatatagtgtgtgatgcgaaaagcaggaccagcaggggaggaagagggggtgtggggggggagggaagacgagggagagcagaggggagagaaga

SEQ ID NO: 72239 - DNA, 666 bp, Homo sapiens
  misc_feature 1..666: note = chr11:128563878-128564544
  misc_feature 1..666: note = hyper
  source 1..666: mol_type = genomic DNA
gagagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggtaagcggcggggcaacggacgcgggcggcggggaccggccggggaggcgaagcggcgggcgggtaggtgcggggcccgcgtcccggaagacgtggcctctctcccttccctccgcgccccggcttcgcgccggctcctccggcgctcgggtggcgagtcctactcgcgggccagccggccaggcgcccgcattgagggcgaccctcccccgaaatcccagcccccaaagtggagccccggcccccctcccacctcgctgcccgccggggctgcaggaggggacggcgggaaaccgggggaccccagggtacggaacggagtcaagggcgagagacctcggggtccaccactcccaccgacacccggggctcc

SEQ ID NO: 72240 - DNA, 272 bp, Homo sapiens
  misc_feature 1..272: note = chr11:128564602-128564874
  misc_feature 1..272: note = hyper
  source 1..272: mol_type = genomic DNA
cgggggctgcagtcgcccgggctcgggtccctgcctggtgggccctggggtgggtaagtggcctcgttgcacgagggtaggggtgcaagtgagtgtgtcgggggatctatctgagcgggctcctccagatggaagcccctgtttacatgtcagcgctttcccttcctctcggcactcagtcgcccggctctaggcgctggagagccgccggctccgcgggactcctgggccggcctcgccgcctctccggcggggaaccttccccagccccc

SEQ ID NO: 72241 - skipped

SEQ ID NO: 72242 - DNA, 542 bp, Homo sapiens; identical to SEQ ID NO: 34156
  misc_feature 1..542: note = chr11:128564991-128565533
  misc_feature 1..542: note = hyper
  source 1..542: mol_type = genomic DNA

SEQ ID NO: 72243 - DNA, 98 bp, Homo sapiens
  misc_feature 1..98: note = chr11:128634531-128634629
  misc_feature 1..98: note = hypo
  source 1..98: mol_type = genomic DNA
agccttcttcacaggcgccagctgcctcattaaagagcagccttttatgctgggcttcacctgtacccaccctgagcggcagccgtggagccccatgg

SEQ ID NO: 72244 - DNA, 34 bp, Homo sapiens
  misc_feature 1..34: note = chr11:128634871-128634905
  misc_feature 1..34: note = hypo
  source 1..34: mol_type = genomic DNA
ggagaaacaccctggcgggcgagcggccaaaccg

SEQ ID NO: 72245 - DNA, 30 bp, Homo sapiens
  misc_feature 1..30: note = chr11:128635204-128635234
  misc_feature 1..30: note = hypo
  source 1..30: mol_type = genomic DNA
gccacctgtgcctaccgtacatggccataa

SEQ ID NO: 72246 - DNA, 182 bp, Homo sapiens
  misc_feature 1..182: note = chr11:128647566-128647748
  misc_feature 1..182: note = hypo
  source 1..182: mol_type = genomic DNA
agccttgcaccctcccgctcctgcacactcagccagagctgttgatatagcagtgcagcccagagaaaagagagacctggattcaataggctggctgtgagggggcactggtgaattctatggtcacagcgaggcaggagacaaaggctttggcactgggacgcttgcgccccctggcccag

SEQ ID NO: 72247 - DNA, 180 bp, Homo sapiens
  misc_feature 1..180: note = chr11:128657932-128658112
  misc_feature 1..180: note = hypo
  source 1..180: mol_type = genomic DNA
ctgacctcatgatctgcccgcctcggcctcctaattacagtatcccgctaattacagtatttttgagggtttaccagatgttaacaccgtaccaagggtcgtgaaggatactatacatagatagccaagctgctttaaaacttattcgggggccgggcatggtggttcatgcctgtaatc

SEQ ID NO: 72248 - DNA, 37 bp, Homo sapiens
  misc_feature 1..37: note = chr11:128665419-128665456
  misc_feature 1..37: note = hypo
  source 1..37: mol_type = genomic DNA
gagttctgtaggatgcgttagaatatagaaagcaatt

SEQ ID NO: 72249 - DNA, 462 bp, Homo sapiens; identical to SEQ ID NO: 34157
  misc_feature 1..462: note = chr11:129242780-129243242
  misc_feature 1..462: note = hyper
  source 1..462: mol_type = genomic DNA

SEQ ID NO: 72250 - DNA, 339 bp, Homo sapiens
  misc_feature 1..339: note = chr11:129243304-129243643
  misc_feature 1..339: note = hyper
  source 1..339: mol_type = genomic DNA
cggacggcgatgccagggctgagcggtgagctgtcccgggtcccgcgctttgaccgcggaccagcctcagggtcccgccgcggaagcagggggcgcgcctggggccagcctgtagaccccagagtccggcggcaggacccccggcgccacccggacacctggcagcagttctcgcctgccctgcagccgcctctgcatggagaaagagaatgaaagaaaacaattctagatggagaggaggggaggggaggccagtttgcaaatacttcgggaatgaagttcctcaaagacgcgttgcgggccttgtctaatgctaggctgtgacttggcctcttaaca

SEQ ID NO: 72251 - DNA, 358 bp, Homo sapiens
  misc_feature 1..358: note = chr11:129243943-129244301
  misc_feature 1..358: note = hyper
  source 1..358: mol_type = genomic DNA
ctaacagcctaatgattagtcctctgggcgtgtccctccctcctagtttaatcaccggcccaggcgccctcatttacttgcttccgcggccaccagggccccctgggcaagcagctccgcagagagcccgccggcactcgcggacgcttctaggctgggagcggggaggaaatgtcaccggccccaaactcggccctagggaaggccatccgcgtctatacttctcagtgtccctgtcgtgcgttttccttccaaccccatgcacactcattccaacataaagtcgtggaaacgggcgtgcactgggctgttcccgccgaacaccgggcgcgactcaggctgccggaggcttcccggg

SEQ ID NO: 72252 - DNA, 223 bp, Homo sapiens
  misc_feature 1..223: note = chr11:129244440-129244663
  misc_feature 1..223: note = hyper
  source 1..223: mol_type = genomic DNA
cgactctctaacccggtcgtatcgcgagggatccggatattgaaagcccctttgccggaagactcgggcgctgggagaagcccgcatgggacaggctgccccagtgcccgccggctccctagaatcgtgcagctctgaccctttccaacgaggaaaaaatgtttttataaacaatgttttaaaaaaaaccgcacacttttttaaaaagtcagaatctcgctct

SEQ ID NO: 72253 - DNA, 127 bp, Homo sapiens
  misc_feature 1..127: note = chr11:129245832-129245959
  misc_feature 1..127: note = hyper
  source 1..127: mol_type = genomic DNA
gcggggcccaggccccgccgtcgcgccagccccgcggccccagcgggccgggcactcgcagccgcgctcgggccggcggacgctcgcgccggctcaccatgcactgccacgccgagctgaggctgag

SEQ ID NO: 72254 - DNA, 206 bp, Homo sapiens; identical to SEQ ID NO: 34162
  misc_feature 1..206: note = chr11:129565510-129565716
  misc_feature 1..206: note = hyper
  source 1..206: mol_type = genomic DNA

SEQ ID NO: 72255 - DNA, 32 bp, Homo sapiens
  misc_feature 1..32: note = chr11:129685906-129685938
  misc_feature 1..32: note = hyper
  source 1..32: mol_type = genomic DNA
ctgcgggggaggggacgcggacagggaggggc

SEQ ID NO: 72256 - DNA, 30 bp, Homo sapiens
  misc_feature 1..30: note = chr11:129732116-129732146
  misc_feature 1..30: note = hypo
  source 1..30: mol_type = genomic DNA
aaaggcccatttccccgcactgcatcctac

SEQ ID NO: 72257 - DNA, 66 bp, Homo sapiens; identical to SEQ ID NO: 43284
  misc_feature 1..66: note = chr11:129866993-129867059
  misc_feature 1..66: note = hypo
  source 1..66: mol_type = genomic DNA

SEQ ID NO: 72258 - DNA, 40 bp, Homo sapiens
  misc_feature 1..40: note = chr11:129907763-129907803
  misc_feature 1..40: note = hypo
  source 1..40: mol_type = genomic DNA
gataaatgaattatgtaaatattgtcggggcttggtaact

SEQ ID NO: 72259 - DNA, 207 bp, Homo sapiens
  misc_feature 1..207: note = chr11:129993552-129993759
  misc_feature 1..207: note = hypo
  source 1..207: mol_type = genomic DNA
gcctcgttggtacttcgacctctccaagggaaagtgcgtgcgctttatatatggtggctgcggcggcaacaggaacaattttgagtctgaggattattgtatggctgtgtgtaaagcgatgagtaagtcctgcctcgcgctggtcccgtgcggcagcaccgtcctgtctggcgtccgtctccctgccgtcttcgtggctgcatctgt

SEQ ID NO: 72260 - DNA, 120 bp, Homo sapiens
  misc_feature 1..120: note = chr11:130017420-130017540
  misc_feature 1..120: note = hypo
  source 1..120: mol_type = genomic DNA
gattacaggtgtgagccaccgcgcctggctgggggcatgacattcttgaggaatctgtcagagatctgtggccaagatacaagataacccagatctgattgatttttttttttttttttt

SEQ ID NO: 72261 - DNA, 55 bp, Homo sapiens
  misc_feature 1..55: note = chr11:130058066-130058121
  misc_feature 1..55: note = hypo
  source 1..55: mol_type = genomic DNA
tggaaaagcatggcccggggcgctgggtggtgctggcagccgtgctgatcggcct

SEQ ID NO: 72262 - DNA, 120 bp, Homo sapiens
  misc_feature 1..120: note = chr11:130059618-130059738
  misc_feature 1..120: note = hypo
  source 1..120: mol_type = genomic DNA
ccgctctctccccagcgagggcagcgtcatcgcctactactggtctgagttcagcatcccgcagcacctggtggaggaggccgagcgcgtcatggccgaggagcgcgtagtcatgctgcc

SEQ ID NO: 72263 - DNA, 149 bp, Homo sapiens
  misc_feature 1..149: note = chr11:130060258-130060407
  misc_feature 1..149: note = hypo
  source 1..149: mol_type = genomic DNA
tgaggtccacacccacggggtctcagggtcctcccccagctctgcccagccctgcccccacacgtgccctccttcttgtctcctgcgcagacagctgcagctttggcctgcacgcccgcggtgtggagctgatgcgcttcaccacgccc

SEQ ID NO: 72264 - DNA, 60 bp, Homo sapiens
  misc_feature 1..60: note = chr11:130079328-130079388
  misc_feature 1..60: note = hypo
  source 1..60: mol_type = genomic DNA
ctccccaggcactggcgcgctgatcctgcaaaagggtgagatccgcgtcatcaaccagac

SEQ ID NO: 72265 - DNA, 51 bp, Homo sapiens
  misc_feature 1..51: note = chr11:130089830-130089881
  misc_feature 1..51: note = hypo
  source 1..51: mol_type = genomic DNA
accgctgggatcctccgaataacgcctggagggcagcgaggtgcagggagg

SEQ ID NO: 72266 - DNA, 30 bp, Homo sapiens; identical to SEQ ID NO: 43287
  misc_feature 1..30: note = chr11:130090184-130090214
  misc_feature 1..30: note = hypo
  source 1..30: mol_type = genomic DNA

SEQ ID NO: 72267 - DNA, 24 bp, Homo sapiens
  misc_feature 1..24: note = chr11:130242942-130242966
  misc_feature 1..24: note = hypo
  source 1..24: mol_type = genomic DNA
tacaaaggacagatgcgtgaatta

SEQ ID NO: 72268 - DNA, 39 bp, Homo sapiens
  misc_feature 1..39: note = chr11:130285847-130285886
  misc_feature 1..39: note = hypo
  source 1..39: mol_type = genomic DNA
actaatctaaattagcgcagaactcggctgctggaagat

SEQ ID NO: 72269 - DNA, 30 bp, Homo sapiens
  misc_feature 1..30: note = chr11:130286135-130286165
  misc_feature 1..30: note = hypo
  source 1..30: mol_type = genomic DNA
acagcggtgccatcacgtggtgcttgccca

SEQ ID NO: 72270 - DNA, 973 bp, Homo sapiens
  misc_feature 1..973: note = chr11:130297447-130298420
  misc_feature 1..973: note = hyper
  source 1..973: mol_type = genomic DNA
gctctcagtcctacctgcaggtcggccccgtagaaggcagccatggacgcatcggccaccagcagcgtctccacgaagcgcgcctcagacacaaaccgcttggtcctactcgtggcccccaggggcggtggcggctcgctagcgccttctgcctcctcttcttggctctcctcctcgctgtcctcctggtggtctcctctctcctgcctctgaccctctcccgtctccacctcccactcgggtcctcgcgggagggggcgggctccggcgggaccccagcgctgcaggcggtgcggctgagccagggagccccccgcgccctgcggctggatggtgaactcctcgccgtccagcaggaaggagccgctcagcccgcggcacaggctgaccgccgccagcgactcgggctccccattcacggtgccggagaagaagcagccgcgcagcccccgctcgcccccggtcgcccggccggagcccccgaggcgctcgatcttgaactcgggcgctaggaagctgtcgtcgggcgccaggcgcagcacgaagcccttgccgaaggcggacaggtggagcgcgagctcgcccgcgctgccgggcaaccgcgtgggcaccaccagctccgaggcctgccccccggctgcgggccgggccggggcgccgcgggccagcggcagcagcagcagcagcagcagcaggagcggaggccaccggggggcggcgggggcggggagcatgggggctgcggcggtggctgcgcgcaggagagggaagaagcccgccaggcgcgggcaggtgctggcggcccgagcgcggcccggccgctctctccaggaaaagcggaatcaatcgggtgcaaggccgactcggcccgcggggcccggcggcgggagcgctcccccggcggcccctctggctggcgcagcccgctcctcccgcgccgccgcccccgagccgagcgcgagcagctggcccc

SEQ ID NO: 72271 - DNA, 397 bp, Homo sapiens
  misc_feature 1..397: note = chr11:13030293-13030690
  misc_feature 1..397: note = hyper
  source 1..397: mol_type = genomic DNA
aatattgcttcctgtcgagaaggactgggaggccttccgctttagaggcagcgcttatagcgctagctggtcgtggaatgcgattacagcgtctccattggagaccgctgagtgcctcggtttccctgtctgtgcaaagtgcactccccagacgccgctgcctcgagggaccaggaaatgcgtctgggggcgccaggaaagatgagaagataaagtcacgatgcgtccagctagctatagacacaagcagaggagccagtaggccaaaggagacgcacagctgatccgtgccgaggcgcgggctccactccctgaagtggagggacccttgaatctttccttgcgtaggcgcgcggcagagcagcgatttggcgaaaagggccgagactcaggatgc

SEQ ID NO: 72272 - DNA, 380 bp, Homo sapiens; identical to SEQ ID NO: 33644
  misc_feature 1..380: note = chr11:13031244-13031624
  misc_feature 1..380: note = hyper
  source 1..380: mol_type = genomic DNA

SEQ ID NO: 72273 - DNA, 932 bp, Homo sapiens
  misc_feature 1..932: note = chr11:130318226-130319158
  misc_feature 1..932: note = hyper
  source 1..932: mol_type = genomic DNA
agagtgaacgctgtccgcgggggcagaagcgagtgaggcgtcgggacagtggggcataaccaagagcaaaacgcaaactgagacttcagcgccggtttctcgggccagcccacgcctcctgcctcagctcaatgccactccctccccgccaagtggctctccgctctggaggcgggaccgagttctccggtggcccctggaggctccggcagcgagctctgggaggctgggaggggagtgaggggaggggcgctgactgggccgtccaaagaggagggggcctttaataggctcgcccagcgcctggcttgctgcgctgcgagtggctgcggttgcgagaagccgcccggcaccttccgctagttctcggctgcaaatcttcgtccttgcacttgacagcgattgtacttaagctcccagggcgcgctttgcttggaaaggcacaggtaggaagcgcgggctgccgggtgcacgctcgccgccctgggaggagtctccctcccttggctctcctttctgggaactgccggctgtcccgtagcgttggcggttccagagtgcgggctgcacggagaccgcggcagcggccggagagcccggcccagccccttcccacagcgcggcggtgcgctgcccggcgccatgcttctgctgggcatcctaaccctggctttcgccgggcgaaccgctggaggctctgagccagagcgggaggtagtcgttcccatccgactggacccggacattaacggccgccgctactactggcggggtcccgaggactccggggatcagggactcatttttcagatcacagcatttcaggaggacttttacctacacctgacgccggatgctcagttcttggctcccgccttctccactgagcatctgggcgtccccctccaggggctcaccgggggctcttcaga

SEQ ID NO: 72274 - DNA, 116 bp, Homo sapiens
  misc_feature 1..116: note = chr11:130319517-130319633
  misc_feature 1..116: note = hyper
  source 1..116: mol_type = genomic DNA
cgcggtacgtggagacgctggtggtcgcggacgagtcaatggtcaagttccacggcgcggacctggaacattatctgctgacgctgctggcaacggcggcgcgactctaccgccat

SEQ ID NO: 72275 - DNA, 59 bp, Homo sapiens
  misc_feature 1..59: note = chr11:13031956-13032015
  misc_feature 1..59: note = hyper
  source 1..59: mol_type = genomic DNA
ggttggggcaggcatcgagctcgacgggtccagaccgggagaggagccagaagaggtgg

SEQ ID NO: 72276 - DNA, 219 bp, Homo sapiens; identical to SEQ ID NO: 33646
  misc_feature 1..219: note = chr11:13032093-13032312
  misc_feature 1..219: note = hyper
  source 1..219: mol_type = genomic DNA

SEQ ID NO: 72277 - DNA, 104 bp, Homo sapiens
  misc_feature 1..104: note = chr11:13032656-13032760
  misc_feature 1..104: note = hyper
  source 1..104: mol_type = genomic DNA
gcggggggcggggggcgggaacagggggattcttttttcttgcagaatgcagtgggccagccggctcgcggacttgaaaccaggctgttgcgagcccagagctc

SEQ ID NO: 72278 - DNA, 17 bp, Homo sapiens
  misc_feature 1..17: note = chr11:13032789-13032806
  misc_feature 1..17: note = hyper
  source 1..17: mol_type = genomic DNA
cgcgctcatctggctcc

SEQ ID NO: 72279 - DNA, 192 bp, Homo sapiens
  misc_feature 1..192: note = chr11:130515653-130515845
  misc_feature 1..192: note = hypo
  source 1..192: mol_type = genomic DNA
taaaatcctagactccgcttctgtttcggtattcagtatctaccacagtgcacggcacacattaggccctcaacaatatttgctgaatgaaaaaaacatgggaggaggcaaaactcagaagtggcagagccaggaattaaaaccaggacctcttactcctgaccccatgttctcccgcggacatcccccaag

SEQ ID NO: 72280 - DNA, 30 bp, Homo sapiens; identical to SEQ ID NO: 15616
  misc_feature 1..30: note = chr11:130717573-130717603
  misc_feature 1..30: note = hypo
  source 1..30: mol_type = genomic DNA

SEQ ID NO: 72281 - DNA, 226 bp, Homo sapiens; identical to SEQ ID NO: 43290
  misc_feature 1..226: note = chr11:130785458-130785684
  misc_feature 1..226: note = hypo
  source 1..226: mol_type = genomic DNA

SEQ ID NO: 72282 - DNA, 48 bp, Homo sapiens
  misc_feature 1..48: note = chr11:131068439-131068487
  misc_feature 1..48: note = hypo
  source 1..48: mol_type = genomic DNA
cacacaggatgtgcccgcagcaagacagcactccgatttctgtgctct

SEQ ID NO: 72283 - DNA, 30 bp, Homo sapiens
  misc_feature 1..30: note = chr11:131422789-131422819
  misc_feature 1..30: note = hypo
  source 1..30: mol_type = genomic DNA
attcattcaacggaacgtcaaacagcattg

SEQ ID NO: 72284 - DNA, 112 bp, Homo sapiens; identical to SEQ ID NO: 43291
  misc_feature 1..112: note = chr11:131522754-131522866
  misc_feature 1..112: note = hypo
  source 1..112: mol_type = genomic DNA

SEQ ID NO: 72285 - DNA, 30 bp, Homo sapiens
  misc_feature 1..30: note = chr11:131542213-131542243
  misc_feature 1..30: note = hypo
  source 1..30: mol_type = genomic DNA
tgaaggcagaggcggcgacttgagcaaatg

SEQ ID NO: 72286 - DNA, 64 bp, Homo sapiens
  misc_feature 1..64: note = chr11:131558038-131558102
  misc_feature 1..64: note = hyper
  source 1..64: mol_type = genomic DNA
tgcagctccccagaacggccaccggagggcacccgcgccccccgagccgcgaggctgcctccac

SEQ ID NO: 72287 - DNA, 39 bp, Homo sapiens
  misc_feature 1..39: note = chr11:131564961-131565000
  misc_feature 1..39: note = hyper
  source 1..39: mol_type = genomic DNA
gtctgccaggggaaacgcacgatgcgttgtccaggacat

SEQ ID NO: 72288 - DNA, 169 bp, Homo sapiens; identical to SEQ ID NO: 43292
  misc_feature 1..169: note = chr11:131631013-131631182
  misc_feature 1..169: note = hypo
  source 1..169: mol_type = genomic DNA

SEQ ID NO: 72289 - DNA, 88 bp, Homo sapiens
  misc_feature 1..88: note = chr11:131766898-131766986
  misc_feature 1..88: note = hypo
  source 1..88: mol_type = genomic DNA
aagaaaaaggtttcactcacctaaatgtctggcaggcatttgacgtccgtggctgaatagccatgcgttgctgcgtctctaacctctg

SEQ ID NO: 72290 - DNA, 71 bp, Homo sapiens
  misc_feature 1..71: note = chr11:131780260-131780331
  misc_feature 1..71: note = hyper
  source 1..71: mol_type = genomic DNA
ttcctaatttggaagcgcgtaaatggttaaactcctggcctgggctgggctggtgcacagcctgggcccgg

SEQ ID NO: 72291 - DNA, 203 bp, Homo sapiens; identical to SEQ ID NO: 1012
  misc_feature 1..203: note = chr11:131780876-131781079
  misc_feature 1..203: note = hyper
  source 1..203: mol_type = genomic DNA

SEQ ID NO: 72292 - DNA, 42 bp, Homo sapiens
  misc_feature 1..42: note = chr11:131781293-131781335
  misc_feature 1..42: note = hyper
  source 1..42: mol_type = genomic DNA
gcaccccacccacttcctgtgctcgcccggggggcgtgtgcc

SEQ ID NO: 72293 - DNA, 15 bp, Homo sapiens
  misc_feature 1..15: note = chr11:131781572-131781587
  misc_feature 1..15: note = hyper
  source 1..15: mol_type = genomic DNA
tggtttgtatggggt

SEQ ID NO: 72294 - DNA, 153 bp, Homo sapiens
  misc_feature 1..153: note = chr11:131799626-131799779
  misc_feature 1..153: note = hypo
  source 1..153: mol_type = genomic DNA
tcgtgaaggtttcctcgaaggatcgtgaaattccacgaagtccgcttgctttcctgggtgaataaacaccaggccgctccctggactttccttgtcgtttgtgatcaaaggctcagctacctcgtgctcatggtcctgcgatggctgaaatcc

SEQ ID NO: 72295 - DNA, 30 bp, Homo sapiens
  misc_feature 1..30: note = chr11:131996346-131996376
  misc_feature 1..30: note = hyper
  source 1..30: mol_type = genomic DNA
gctgacaaaatgaggcgatcagattggaaa

SEQ ID NO: 72296 - DNA, 30 bp, Homo sapiens
  misc_feature 1..30: note = chr11:132031455-132031485
  misc_feature 1..30: note = hypo
  source 1..30: mol_type = genomic DNA
cgggcactgtgcacccgggctcatgcgtcc

SEQ ID NO: 72297 - DNA, 32 bp, Homo sapiens
  misc_feature 1..32: note = chr11:132311339-132311371
  misc_feature 1..32: note = hypo
  source 1..32: mol_type = genomic DNA
gcgtgagccaccgcgcccggcccaccaaggac

SEQ ID NO: 72298 - DNA, 48 bp, Homo sapiens; identical to SEQ ID NO: 43295
  misc_feature 1..48: note = chr11:132484374-132484422
  misc_feature 1..48: note = hypo
  source 1..48: mol_type = genomic DNA

SEQ ID NO: 72299 - DNA, 30 bp, Homo sapiens; identical to SEQ ID NO: 43296
  misc_feature 1..30: note = chr11:132792371-132792401
  misc_feature 1..30: note = hypo
  source 1..30: mol_type = genomic DNA

SEQ ID NO: 72300 - DNA, 139 bp, Homo sapiens
  misc_feature 1..139: note = chr11:132813619-132813758
  misc_feature 1..139: note = hyper
  source 1..139: mol_type = genomic DNA
ccggtcggcgactcgcggccagccgggggagcgccgcccggcgcaggctccgggcgcacggggagctgggcggacggcggcccccgcctcctccggggacgcggcacgagacgcggggacgcgcggacgccacgctcag

SEQ ID NO: 72301 - DNA, 342 bp, Homo sapiens
  misc_feature 1..342: note = chr11:132813907-132814249
  misc_feature 1..342: note = hyper
  source 1..342: mol_type = genomic DNA
cgcggactgcgcgctcatcccgacgggcgggcgcccaccttaacctccgccgcgcccaccgggctggggatgcctgcggggatgagcccgcaccgcgcccacttcgctccgtcccgacacccgcgccagcggagagaacgcggcgcccctcgcagcggcttcccctacagaggggcggggtggggggagcggggagggagaggggagggcgggagagggagttctggggaaagcagcaaactgaaaactgacactggcaccttccctcgccgatgccagcgcagaagttgacaaaccccgccctggagagctgaactaccctgcccacgccagatggggcac

SEQ ID NO: 72302 - DNA, 141 bp, Homo sapiens
  misc_feature 1..141: note = chr11:132864068-132864209
  misc_feature 1..141: note = hyper
  source 1..141: mol_type = genomic DNA
aaataagattcagggcgggagtccccgcgccgcagcggctggtgcgctcctgccaggagccggcgcgcgcgggagcacgtccggggcttttacggccggaactcgggctattaaaaagcccaggcgcgattttctaattaa

SEQ ID NO: 72303 - DNA, 30 bp, Homo sapiens
  misc_feature 1..30: note = chr11:132933115-132933145
  misc_feature 1..30: note = hypo
  source 1..30: mol_type = genomic DNA
acacatgtcatacaacggcggagagaagca

SEQ ID NO: 72304 - DNA, 95 bp, Homo sapiens
  misc_feature 1..95: note = chr11:132934044-132934139
  misc_feature 1..95: note = hyper
  source 1..95: mol_type = genomic DNA
gagtgaggggtggagcggagcccagccgagggagggaaggagaggaacgccggcccactagccgaccccagcgcaacccagcgcggttcccagac

SEQ ID NO: 72305 - DNA, 468 bp, Homo sapiens
  misc_feature 1..468: note = chr11:132934140-132934608
  misc_feature 1..468: note = hyper
  source 1..468: mol_type = genomic DNA
ctgccgggtaactgatgccgccggcacagcttctgttctcacttgtggagctttgtctcccctcgctgggcagcccctggtaccgcaacccgcctggccgccttcccggctgaggcccccgggcagagctcctccgcagggagcattcccgtggacaaacacccctttccctggtagctgtggcaacagttgatctgtggcagcggaccaggaggagggtcaaatgggagaagggacggccagctggtcctaccagagactgtcgctggcgtcctcaggggccgctgcagggccaccttgtgtgcttgccctttccccacggtagactgccccgggagggggactgtgctgcctgaattcttgtccgggtgggactggcctcggtgaaggatccgggaatgggacttccgggccgggccggaggggaagtgtcaggaagagctcaggctttagcgagcctggagggaa

SEQ ID NO: 72306 - DNA, 497 bp, Homo sapiens
  misc_feature 1..497: note = chr11:132952506-132953003
  misc_feature 1..497: note = hyper
  source 1..497: mol_type = genomic DNA
ccctcttactacccccgccccaccccgttctgcgccgagtggcacagccctcggcacggcacggccctgtcagctacgaagccgggcgaggggctcaaggcccctctggagaccgcttctcccccgcggcccgtcccgccgctgcggaccccatgcgcggcctccccgccccggcgcctgggcctcctcgcggcccgggcggggcccaccaacccggagaggtcgccagcctgcagggtgccgggggcccctccgagccgacctcgtcccaggcagacgcgctgcccggagaccgccgcaagggggcgccaggggccggggcggacgtcgcgccagtgcctcgccgggaccgcacctcgtccgcgcggccgccagagggcgcccgtcagcgccggagcccgcggcggacgccccagccgagcccagccactgcctggtggagccacagggcacccgcccggaaacaccgcctgcgccccgacggcacccgtgtgcgc

SEQ ID NO: 72307 - DNA, 88 bp, Homo sapiens; identical to SEQ ID NO: 34177
  misc_feature 1..88: note = chr11:132953232-132953320
  misc_feature 1..88: note = hyper
  source 1..88: mol_type = genomic DNA

SEQ ID NO: 72308 - DNA, 281 bp, Homo sapiens
  misc_feature 1..281: note = chr11:13300434-13300715
  misc_feature 1..281: note = hyper
  source 1..281: mol_type = genomic DNA
gaaggtagaggtgaacgtcgaccttgtggggcgcatgttagcctccccgaggggtcgcgagagccggcagcggggtgagctcaggtgcccgccggcaggagctggggagggaaggggagtgctggacaccggcgcctgctgtcaagttctcgccggccggtgagagacccgctgccgccgcgcaccccgcacctcctgacccctctcccctctccgcctcggccccttcccggtcacctagcgttgttttggcgctttggcgcttgcggtctcttccttct

SEQ ID NO: 72309 - DNA, 194 bp, Homo sapiens
  misc_feature 1..194: note = chr11:133231266-133231460
  misc_feature 1..194: note = hypo
  source 1..194: mol_type = genomic DNA
ctggggccagcccaacgtcggggtcactgtgccaggcaccccctccaggtcctggcggtgtcgatcaggacaccaccaatgcgttcttgcagacaaaatgcacctatgctgtgggaggaagagcaagcggttcgcccgccgcgcatcagtgcacccgtgtcccggcgcgcagacaggtccggggcacctgcagc

SEQ ID NO: 72310 - DNA, 104 bp, Homo sapiens; identical to SEQ ID NO: 15619
  misc_feature 1..104: note = chr11:133231728-133231832
  misc_feature 1..104: note = hypo
  source 1..104: mol_type = genomic DNA

SEQ ID NO: 72311 - DNA, 101 bp, Homo sapiens
  misc_feature 1..101: note = chr11:133309666-133309767
  misc_feature 1..101: note = hypo
  source 1..101: mol_type = genomic DNA
taagtcttataataaaaccaaactaaaggagcacttttctttctctaagattcctaaataaaatatgagcaagtccaatccagctacgaattaaaagaata

SEQ ID NO: 72312 - DNA, 30 bp, Homo sapiens
  misc_feature 1..30: note = chr11:133374504-133374534
  misc_feature 1..30: note = hypo
  source 1..30: mol_type = genomic DNA
cccccagctttgttgcggcgatgtttttct

SEQ ID NO: 72313 - DNA, 192 bp, Homo sapiens; identical to SEQ ID NO: 43298
  misc_feature 1..192: note = chr11:133386010-133386202
  misc_feature 1..192: note = hypo
  source 1..192: mol_type = genomic DNA

SEQ ID NO: 72314 - DNA, 303 bp, Homo sapiens
  misc_feature 1..303: note = chr11:133401987-133402290
  misc_feature 1..303: note = hyper
  source 1..303: mol_type = genomic DNA
gtgagtgtgtgtgtgcgtgcacacagcaagcctacctctttcactcacatgcatctcacactccctgtcctcaccccttcctccttgcctctccatctccccactgcctctcctgctctcacgtcgtacaatcaccccagggagagaaaacacccttcccctgtacggtacctgggatgaagagcagggcagttgtcgccgagaagacgacccagtaggcaggatggtacatctcgacgctgcggtgctctcagctgccgggcttgctactgcttctgctgctgctaccgctgctgccttcct

SEQ ID NO: 72315 - DNA, 37 bp, Homo sapiens
  misc_feature 1..37: note = chr11:133519102-133519139
  misc_feature 1..37: note = hypo
  source 1..37: mol_type = genomic DNA
catgattgattcactcgccgctcgtctgctcagccag

SEQ ID NO: 72316 - DNA, 33 bp, Homo sapiens
  misc_feature 1..33: note = chr11:133559539-133559572
  misc_feature 1..33: note = hypo
  source 1..33: mol_type = genomic DNA
atgagccaccacgcccggcgaacattgacaaac

SEQ ID NO: 72317 - DNA, 30 bp, Homo sapiens
  misc_feature 1..30: note = chr11:133703684-133703714
  misc_feature 1..30: note = hypo
  source 1..30: mol_type = genomic DNA
tgggtgtctaaactccgcctctcgggatgg

SEQ ID NO: 72318 - DNA, 30 bp, Homo sapiens
  misc_feature 1..30: note = chr11:133773053-133773083
  misc_feature 1..30: note = hypo
  source 1..30: mol_type = genomic DNA
gaacctgccctagttcgcaaaataaatcca

SEQ ID NO: 72319 - DNA, 62 bp, Homo sapiens
  misc_feature 1..62: note = chr11:133777783-133777845
  misc_feature 1..62: note = hypo
  source 1..62: mol_type = genomic DNA
agtcggcaggcagcacgtggtgagtgcgggaaagccacaggcggctccgcacaagtggtaat

SEQ ID NO: 72320 - DNA, 90 bp, Homo sapiens
  misc_feature 1..90: note = chr11:133790279-133790369
  misc_feature 1..90: note = hypo
  source 1..90: mol_type = genomic DNA
ggacagggcccctgccgggcgacttgcctgcccaacccttcggtgcctccagagacaggatgcccgggtaggccgcgggcacctgcaggg

SEQ ID NO: 72321 - DNA, 30 bp, Homo sapiens; identical to SEQ ID NO: 43299
  misc_feature 1..30: note = chr11:133805206-133805236
  misc_feature 1..30: note = hypo
  source 1..30: mol_type = genomic DNA

SEQ ID NO: 72322 - DNA, 330 bp, Homo sapiens; identical to SEQ ID NO: 34179
  misc_feature 1..330: note = chr11:133825189-133825519
  misc_feature 1..330: note = hyper
  source 1..330: mol_type = genomic DNA

SEQ ID NO: 72323 - DNA, 183 bp, Homo sapiens; identical to SEQ ID NO: 34180
  misc_feature 1..183: note = chr11:133825520-133825703
  misc_feature 1..183: note = hyper
  source 1..183: mol_type = genomic DNA

SEQ ID NO: 72324 - DNA, 955 bp, Homo sapiens
  misc_feature 1..955: note = chr11:133825704-133826659
  misc_feature 1..955: note = hyper
  source 1..955: mol_type = genomic DNA
tctcccccagctcagacccaggaaagcggaaagagaaaatcccccctccgctcggattcacagcgtggggacccccccttccccgcccctcccctcccccgccgccgcccccagccagctctgcctcgcagcctggggagggcggcgtggggcccgcgcggctgcggcgcgctcccggggaacttttgcctggccggggcccaggtgcggctgagaggcgcgggggccggcggggtccagccaaaagcggacacacctcgaagctggcctcatcaatcctcctctcaccgggcgcccctgctagggggatccgacctccagctgccaagatgtgtgggcaggaggggcgcgagcggagcgatggacgcccgcagggccgcgcgaacccggggccttagacgcgggtgccgccagtcccagggatcctccgggtcgcgcctccctgcaggcgctcctcgcggcgcggggctctagcgtgctgcagcctgcccggagaccgcaaactcccgcagccagagtttcccgcagctctgggaggcggccgccgggcaggaggcgacgggctaggcgcgccggtgtgcaccgtggggcccgtggtgggcgaagtcgacccaggttccactgcgtcctttccccgagtgcccggcagcccgtgggctctggccccttcccgcccgcccctccagcccacggcccccaggccctccccggcaatgctcccgggccgcctggcccgcgtcggagcccaagcctcacccgcgggaaggcgcgccggggagctggggaaccggggggccaaggagccgggaaaccgaggggccgggcgcgaggggccgagggcgccgggaggggcaggggagggacgccgcacttcaactcaccttcagccgcaagccctcgggtgccgatcacacttgctatgaaagtggccacataccaaatcatagtactaccg

SEQ ID NO: 72325 - DNA, 738 bp, Homo sapiens
  misc_feature 1..738: note = chr11:133826702-133827440
  misc_feature 1..738: note = hyper
  source 1..738: mol_type = genomic DNA
cgcacgcgcctcgcgcccgagcgcccgcctcgcgcccgcctcgcgccgcctacgccccgcgccggtgctcctgcagcccgggtggccagctctccatccctcctaggctccgctcggctcggcgcgcgcctccccggccccggcgcagcggcacctgcactactcgcccgggcggagcgcagccaggtccacggtgaagcctagccgggccgggcctccggaaccgcccccgccgcccgcctattgggcgccgcccgcaagccgggggtccgattggctcagccttccgcccgtcgcggcgcgaaggaggcgagcccatttcaaggtgcgttgaagtgtggcgagcacagagccgcagaatcatgcgcattgccggggagaaggtggtatagcgtctctgcccgcttctctctcggctcacactgcgtggcaagtttctggtgagggaaatggtagcttctaacgggaccctggcgggtctcaattaccccggacaggtctgagggaagtggagcccccgcccactcatggaacccaacatccggtttccatccggcaaaaagcagttcccgagaggaccatgctgattctatgatggggaaacccaggagccggcggcccgggagagccggggaacgtccttcgccggagatcttttcaaagaggtcacgcgccgcctccccaccccgtctccctccgcacccagacacgtccccagagcagcgcaccaccccctcc

SEQ ID NO: 72326 - DNA, 173 bp, Homo sapiens
  misc_feature 1..173: note = chr11:133845226-133845399
  misc_feature 1..173: note = hypo
  source 1..173: mol_type = genomic DNA
agcgacataaagctgcggggcgtgttttttaccctaccacaaacagagctgttgtttagatgccagtgaattctgccctgtgtggtgggacctgtgcactgccaatgggcaccagggcacggcacagggaagacgccccactctccctgaaagctctgcgtatcttctgagta

SEQ ID NO: 72327 - DNA, 408 bp, Homo sapiens
  misc_feature 1..408: note = chr11:133906570-133906978
  misc_feature 1..408: note = hyper
  source 1..408: mol_type = genomic DNA
ccgaaacctcagtcccgagcagatcaattgccgctgataacatttaaattctggcctggaggtgccgaggcggccctgggaaagaggaagggaaaggtggcacggatttcaagggagggactcggagttaacagatctgatccttccgagcctgcagtctctagccgcgcgcccccgcccccacccccaccgccaagccgaaaacccaatcctgggcccacccatttgcgtggatgccacagctcggccggaaggcttcagcgtgggagggggtgggggtgacaccagggctgccccttgagagcgacaccggcctgaaccccgtcctccccgcgccccccagccccgcctcgctgcagacggttcgccttgtccactcttctcgactcttctcgactcttctccact

SEQ ID NO: 72328 - DNA, 30 bp, Homo sapiens
  misc_feature 1..30: note = chr11:133912264-133912294
  misc_feature 1..30: note = hypo
  source 1..30: mol_type = genomic DNA
gagaacacgagccttcgttactccagacac

SEQ ID NO: 72329 - DNA, 16 bp, Homo sapiens
  misc_feature 1..16: note = chr11:133938772-133938788
  misc_feature 1..16: note = hyper
  source 1..16: mol_type = genomic DNA
agagaacccatgtgcc

SEQ ID NO: 72330 - DNA, 275 bp, Homo sapiens; identical to SEQ ID NO: 3830
  misc_feature 1..275: note = chr11:133938789-133939064
  misc_feature 1..275: note = hyper
  source 1..275: mol_type = genomic DNA

SEQ ID NO: 72331 - DNA, 372 bp, Homo sapiens; identical to SEQ ID NO: 34186
  misc_feature 1..372: note = chr11:133939065-133939437
  misc_feature 1..372: note = hyper
  source 1..372: mol_type = genomic DNA

SEQ ID NO: 72332 - DNA, 50 bp, Homo sapiens; identical to SEQ ID NO: 34187
  misc_feature 1..50: note = chr11:133994694-133994744
  misc_feature 1..50: note = hyper
  source 1..50: mol_type = genomic DNA

SEQ ID NO: 72333 - DNA, 61 bp, Homo sapiens
  misc_feature 1..61: note = chr11:133995063-133995124
  misc_feature 1..61: note = hyper
  source 1..61: mol_type = genomic DNA
tcgtgccgccgccaccgccgctgcacgggcagccaaaagcagctcccgccccctcttctct

SEQ ID NO: 72334 - DNA, 219 bp, Homo sapiens; identical to SEQ ID NO: 43300
  misc_feature 1..219: note = chr11:134011075-134011294
  misc_feature 1..219: note = hypo
  source 1..219: mol_type = genomic DNA

SEQ ID NO: 72335 - DNA, 130 bp, Homo sapiens
  misc_feature 1..130: note = chr11:134011733-134011863
  misc_feature 1..130: note = hypo
  source 1..130: mol_type = genomic DNA
gtacacatgcaggctcgtgcatgagtcggagcctgtggagttctcagagaagttgagagttgagagggatttgtggaagcagctccaacacagtcttgctttgggttctcagtgtcgccgggagcctgag

SEQ ID NO: 72336 - DNA, 953 bp, Homo sapiens; identical to SEQ ID NO: 34188
  misc_feature 1..953: note = chr11:134145474-134146427
  misc_feature 1..953: note = hyper
  source 1..953: mol_type = genomic DNA

SEQ ID NO: 72337 - DNA, 232 bp, Homo sapiens; identical to SEQ ID NO: 1015
  misc_feature 1..232: note = chr11:134146444-134146676
  misc_feature 1..232: note = hyper
  source 1..232: mol_type = genomic DNA

SEQ ID NO: 72338 - DNA, 419 bp, Homo sapiens
  misc_feature 1..419: note = chr11:134146677-134147096
  misc_feature 1..419: note = hyper
  source 1..419: mol_type = genomic DNA
tcccgggctgcccaccaccccggcgcgtgcccgggagcctccaccctccccgggttctgtggccggccacgcgccccaggcacgcgccgcgccgggccgcgccaccaagcccgctgtccccagctttcctcggcagatcccctggctacccccaccctgcggaggggccgttcaccagatgccagaaaatcagggtggggcacgcaggccaggggctccagcggctgggcaccgtgtccttcccgaacctggtgctggaagtgcgcccgcctccgcctctcccaggcacccaccggcactgcccagccctgtctggagggtctaggactgaacgtctgtccccggccttcatcctggctgcagaggactggccgggtgatgccgcgctgtcctggccctgggcccgcctggaagacccg

SEQ ID NO: 72339 - DNA, 118 bp, Homo sapiens
  misc_feature 1..118: note = chr11:134201431-134201549
  misc_feature 1..118: note = hyper
  source 1..118: mol_type = genomic DNA
gttgcccctgctttgcggacgccttttgtacgttcttcctgatgtagcgctgcgaggggcgactttacctcggcgtttgacaggtacgcagcattcccgcacccgcctgcgcctcgcg

SEQ ID NO: 72340 - DNA, 364 bp, Homo sapiens
  misc_feature 1..364: note = chr11:134201790-134202154
  misc_feature 1..364: note = hyper
  source 1..364: mol_type = genomic DNA
gcctagggctgcaggcgcggagccgcgagccccagccaatgagcgccggcgggccggttgcccaggcgaccagtgcgcggctccgccccccgcggcgaggctcccgcgcgcggctgagtgcggactggagtgggaacccgggtccccgcgcttagagaacacgcgatgaccacgtggagcctccggcggaggccggcccgcacgctgggactcctgctgctggtcgtcttgggcttcctggtgctccgcaggtgagagagagcttcgcgcagcacctgccggaccccacattccccagccctccgcacctcgggttctctcctcccgcgacccgcgaatcccgagttcccggggggagcagccc

SEQ ID NO: 72341 - DNA, 38 bp, Homo sapiens
  misc_feature 1..38: note = chr11:134274891-134274929
  misc_feature 1..38: note = hypo
  source 1..38: mol_type = genomic DNA
gtcctccccgtgccacgagcggccgtctctcccactct

SEQ ID NO: 72342 - DNA, 208 bp, Homo sapiens
  misc_feature 1..208: note = chr11:134281335-134281543
  misc_feature 1..208: note = hyper
  source 1..208: mol_type = genomic DNA
ccctgactcctcatccggccaccagaaaccacctgctgagggggccgggaactgacgactgagagcccgggccgattgttagaagctgctgagaaccagctcttcccctaatcccggtcgacgagggcaggctgtgccgggttttgtttcgcagcccctcggcagcagcgcctcccagcccgagctcggttctcggccccctttccag

SEQ ID NO: 72343 - DNA, 40 bp, Homo sapiens
  misc_feature 1..40: note = chr11:134281603-134281643
  misc_feature 1..40: note = hyper
  source 1..40: mol_type = genomic DNA
gcgcgcgcccgggaggacatggcgtgggcaccgatgggga

SEQ ID NO: 72344 - DNA, 104 bp, Homo sapiens
  misc_feature 1..104: note = chr11:134281706-134281810
  misc_feature 1..104: note = hyper
  source 1..104: mol_type = genomic DNA
cgacgagtccggagcgtctccggtgcggtccatcgcgggcaacggcccctacgccccggccccggcgcccctagaccgctgccctgggccgcgtgcggctccct

SEQ ID NO: 72345 - DNA, 30 bp, Homo sapiens
  misc_feature 1..30: note = chr11:134282306-134282336
  misc_feature 1..30: note = hyper
  source 1..30: mol_type = genomic DNA
gtatcacctccccaccgccccccaccctcc

SEQ ID NO: 72346 - DNA, 82 bp, Homo sapiens
  misc_feature 1..82: note = chr11:134282850-134282932
  misc_feature 1..82: note = hyper
  source 1..82: mol_type = genomic DNA
cccgggcctctgccgcggtgtgttggtcggcgggggacggaggccagtgagtgggcgcgcacttggacgtatgtgggtgcac

SEQ ID NO: 72347 - DNA, 69 bp, Homo sapiens
  misc_feature 1..69: note = chr11:134395375-134395444
  misc_feature 1..69: note = hypo
  source 1..69: mol_type = genomic DNA
actcctcggatgttccgagaccattggcccctcctctgaagccacacccagcttcgtgctctttttccc

SEQ ID NO: 72348 - DNA, 202 bp, Homo sapiens
  misc_feature 1..202: note = chr11:134458477-134458679
  misc_feature 1..202: note = hypo
  source 1..202: mol_type = genomic DNA
cgagtgctgcacctgcgatgtgaacctgtgctggattccctgccgagagctgcacctgcgatgtgaacctgtgctggattccctgccacgtgctgcacctgcgatgtgaacctgtgctggattccatgccacgtgctgcacctgcgatgtgaacctgtgctggattccctgccgagtgctgcacctgcgatgtgaacctgtg

SEQ ID NO: 72349 - DNA, 32 bp, Homo sapiens
  misc_feature 1..32: note = chr11:134526234-134526266
  misc_feature 1..32: note = hypo
  source 1..32: mol_type = genomic DNA
aggcccggaggctggcgcgtaggaggctaaag

SEQ ID NO: 72350 - DNA, 117 bp, Homo sapiens
  misc_feature 1..117: note = chr11:134534227-134534344
  misc_feature 1..117: note = hypo
  source 1..117: mol_type = genomic DNA
tgaaggtcacccacacgccgtccaccgagggcaggtcgcccacacgccgtccaccgagggcaggtcgcccactcgccgtccacagagggcaggtcgcccacacgccgtccaccgagg

SEQ ID NO: 72351 - DNA, 77 bp, Homo sapiens
  misc_feature 1..77: note = chr11:134607452-134607529
  misc_feature 1..77: note = hypo
  source 1..77: mol_type = genomic DNA
gacaggaggcacaggcggtcatcacctgtgggatctcctgggagggacaggcaaagtcataccgaagcctcaggctc

SEQ ID NO: 72352 - DNA, 200 bp, Homo sapiens
  misc_feature 1..200: note = chr11:134608540-134608740
  misc_feature 1..200: note = hypo
  source 1..200: mol_type = genomic DNA
tccttgagctcacagcgatggcgtgtgtgtctgtgtgagtctgtgtgtctctctgtgcgtgtctgtgtgagtccgtgtgtctctccatgagtgtctgtgcgagtctgtgtgtctctccgtgcgtgtctgtgcgagtccacgtgtctctccgtgcgtgtctgtgcgagcctgtgtgtctctccgtgcgtgtctgtgtgagt

SEQ ID NO: 72353 - DNA, 30 bp, Homo sapiens
  misc_feature 1..30: note = chr11:134670064-134670094
  misc_feature 1..30: note = hypo
  source 1..30: mol_type = genomic DNA
ctcttcttatcaacacgctaagcccggagc

SEQ ID NO: 72354 - DNA, 98 bp, Homo sapiens
  misc_feature 1..98: note = chr11:134909746-134909844
  misc_feature 1..98: note = hypo
  source 1..98: mol_type = genomic DNA
gccatgtctttccttcgtggaaatgtccaaagcaggccaggtgaagctaagaagagaagagtacctgagttggcatttccccatcaccaggtgtgtcc

SEQ ID NO: 72355 - DNA, 30 bp, Homo sapiens
  misc_feature 1..30: note = chr11:1357330-1357360
  misc_feature 1..30: note = hyper
  source 1..30: mol_type = genomic DNA
ggtggggagggaggtcgcaagcaatgccat

SEQ ID NO: 72356 - skipped

SEQ ID NO: 72357 - DNA, 37 bp, Homo sapiens
  misc_feature 1..37: note = chr11:1359722-1359759
  misc_feature 1..37: note = hypo
  source 1..37: mol_type = genomic DNA
ggaggtgactggatcatgcggtcgggtcccccatgct

SEQ ID NO: 72358 - DNA, 81 bp, Homo sapiens
  misc_feature 1..81: note = chr11:1368283-1368364
  misc_feature 1..81: note = hypo
  source 1..81: mol_type = genomic DNA
agagggcctagacaccgggataccccagtaccaaaggaagcacagggtgcaggtctcggtccccgacgtcaccctccagtg

SEQ ID NO: 72359 - DNA, 19 bp, Homo sapiens
  misc_feature 1..19: note = chr11:13687132-13687151
  misc_feature 1..19: note = hypo
  source 1..19: mol_type = genomic DNA
agtacgagactccttctca

SEQ ID NO: 72360 - DNA, 30 bp, Homo sapiens
  misc_feature 1..30: note = chr11:1371601-1371631
  misc_feature 1..30: note = hypo
  source 1..30: mol_type = genomic DNA
ccaggcccacctgaccggtcaggctcaaac

SEQ ID NO: 72361 - DNA, 155 bp, Homo sapiens
  misc_feature 1..155: note = chr11:1374898-1375053
  misc_feature 1..155: note = hypo
  source 1..155: mol_type = genomic DNA
tcacacccagacacccgtccctgcctctgccccagcacctccgcctggaatgtgaatccgcagctacctgtggagccggcgccttctctccgtccttctcacactgaggggcacccccagagaggtcaccatggcccgaacgtctatccccagaa

SEQ ID NO: 72362 - DNA, 30 bp, Homo sapiens
  misc_feature 1..30: note = chr11:1375352-1375382
  misc_feature 1..30: note = hypo
  source 1..30: mol_type = genomic DNA
tcctggccacaaaagcggcagggcctgccc

SEQ ID NO: 72363 - DNA, 183 bp, Homo sapiens; identical to SEQ ID NO: 42915
  misc_feature 1..183: note = chr11:1382225-1382408
  misc_feature 1..183: note = hypo
  source 1..183: mol_type = genomic DNA

SEQ ID NO: 72364 - DNA, 30 bp, Homo sapiens
  misc_feature 1..30: note = chr11:1392807-1392837
  misc_feature 1..30: note = hypo
  source 1..30: mol_type = genomic DNA
cagcctggctctggccgtcctcccgggggg

SEQ ID NO: 72365 - DNA, 120 bp, Homo sapiens; identical to SEQ ID NO: 42916
  misc_feature 1..120: note = chr11:1393300-1393420
  misc_feature 1..120: note = hypo
  source 1..120: mol_type = genomic DNA

SEQ ID NO: 72366 - DNA, 250 bp, Homo sapiens; identical to SEQ ID NO: 33583
  misc_feature 1..250: note = chr11:1410104-1410354
  misc_feature 1..250: note = hyper
  source 1..250: mol_type = genomic DNA

SEQ ID NO: 72367 - DNA, 92 bp, Homo sapiens
  misc_feature 1..92: note = chr11:1411442-1411534
  misc_feature 1..92: note = hyper
  source 1..92: mol_type = genomic DNA
cgggcggacgctgggcggcccctccctgcccgcgcgcccgggcgcccctggccggcgccgggccccagagcgatgacatcgacggggaagga

SEQ ID NO: 72368 - DNA, 236 bp, Homo sapiens
  misc_feature 1..236: note = chr11:1411549-1411785
  misc_feature 1..236: note = hyper
  source 1..236: mol_type = genomic DNA
cgcgcagtatgttgggccctaccggctggagaagacgctgggcaaggggcagacaggtgcgtgcggccggggcggggaccggggccggggaggccgcgctggcagcgcgctgggtggggggcgcccgagggaggccccggccgcgaagccgcaggcccggcccgggccccggccgcgaacaatgggcggcccgtgcgcccccgtccgctcgtgcgccccggttccgccgcggatcc

SEQ ID NO: 72369 - DNA, 518 bp, Homo sapiens
  misc_feature 1..518: note = chr11:1411841-1412359
  misc_feature 1..518: note = hyper
  source 1..518: mol_type = genomic DNA
cggggcgcgcaggcggacaggggcgcacgggacggcgcccctcgggccccgctgcaggtgcgcggcccgggccgcattgtgcgccccagcgaccgggcccattgtgccgcgggaggagggggccgcgcgggcgcccatctgccgtctgccgcggccgcgctaataggcgtgctgcccgagcagctgcgcccccggcgggactcccacctccgcgcgccggccaccggggcctccgggcaggcccgatctccctccgcggtgggggcgggagagtgcggggacctgcagagggctggacagcgccttgcgctgctccggctcgggctcgggcgggcggagcgtctgtgacctgcattcccacggggcagggagaggccattggtgctgggaccagaagtgcgtgggacctgacccgtggagcagccccgcggcctgccggtggagggggcttcccggtggggcctggctgtcattctagggaacaggccgggtccctgcggggccgaacccaggccaga

SEQ ID NO: 72370 - DNA, 30 bp, Homo sapiens; identical to SEQ ID NO: 42917
  misc_feature 1..30: note = chr11:1420766-1420796
  misc_feature 1..30: note = hypo
  source 1..30: mol_type = genomic DNA

SEQ ID NO: 72371 - DNA, 78 bp, Homo sapiens
  misc_feature 1..78: note = chr11:1422084-1422162
  misc_feature 1..78: note = hypo
  source 1..78: mol_type = genomic DNA
cctccccaggctcctcgtggtgctgggaccctgtggcgtctgctcctctggcccagtggctgccggcggcggggccgt

SEQ ID NO: 72372 - DNA, 512 bp, Homo sapiens
  misc_feature 1..512: note = chr11:1430689-1431201
  misc_feature 1..512: note = hypo
  source 1..512: mol_type = genomic DNA
tttcccccagttcaccggggctcccctgctcagggtgtgccgggggctttgagtcacttctgtgtctccttggaggctgtgtggcgtccgcggaagttggtgtctgtgcggtgtggttctgtttatgggtgttgtagagaaggcgccgtccagagacagagccactgctgaggtgggtggggggtgtatgaagggcacaaggacgctttgggggtgtcaggtatgatggccctcaggtcatggtttcacacgcgtgtgctttaaatgcgtgctggctgtcacgtgtcagtcgtgcctccacagagcttcaggaaccaccgagatggggagcctgccggagacacaggttttctgagcgcaccagcggctccaaaagcagagggaagagccctgcgtgcaggtggggcgctcatggcgtcggcctcgcagagcggtgacggacacagagtccgtgtttgggggggtttgggacgtcggcctcgcagagcggtgacggtcgcagagtctgtgtt

SEQ ID NO: 72373 - DNA, 288 bp, Homo sapiens
  misc_feature 1..288: note = chr11:1432883-1433171
  misc_feature 1..288: note = hypo
  source 1..288: mol_type = genomic DNA
ctggccagggcccctcgagggaggagtgtgttcatgtgtgagggatgcagcccccacggcagggacgggggacctcgccagcactggtgggctgcacctgctgggagggccagctgtgcgggttcctacgctggcgctgcctgcccctatgtggagaggcgcctgcccctatgtggagaggctcctgcccactggcccggcctggcatccgggccctcatcttgccctcccaaaaagagctctgccccctgtgctgccccatcctgtggggaacgtggccttggtcac

SEQ ID NO: 72374 - DNA, 193 bp, Homo sapiens
  misc_feature 1..193: note = chr11:1433665-1433858
  misc_feature 1..193: note = hypo
  source 1..193: mol_type = genomic DNA
gtggagtctcagctgcgccgccccgtcctgtggtgggtggagtctcagctgtgctgccccgtcctgtgattggtgaactctgagctgtgctgctctgtcctctctggtctgtgaagtctgagctgtttggtaggcggggccgagggagcaggcgccctcagaaaatgcgagacagggtcgggttgcggggagg

SEQ ID NO: 72375 - DNA, 41 bp, Homo sapiens
  misc_feature 1..41: note = chr11:1434266-1434307
  misc_feature 1..41: note = hypo
  source 1..41: mol_type = genomic DNA
catgttaggagcctgcgttcagaacccgcattcctggggag

SEQ ID NO: 72376 - DNA, 160 bp, Homo sapiens
  misc_feature 1..160: note = chr11:1442699-1442859
  misc_feature 1..160: note = hypo
  source 1..160: mol_type = genomic DNA
gccaggcagaggcagcggagcggctgcagtgcgtgtgaaatgcttcagggtggcacgaatttaactagagaggttcttttccaacgtgagcagttgtctcccaagagatgcgccgccccttccctctgcacctggcactggtgggcggtggaggctgtgg

SEQ ID NO: 72377 - DNA, 373 bp, Homo sapiens; identical to SEQ ID NO: 42923
  misc_feature 1..373: note = chr11:1444579-1444952
  misc_feature 1..373: note = hypo
  source 1..373: mol_type = genomic DNA

SEQ ID NO: 72378 - DNA, 70 bp, Homo sapiens
  misc_feature 1..70: note = chr11:1446330-1446400
  misc_feature 1..70: note = hypo
  source 1..70: mol_type = genomic DNA
tgatgggaagcctgacgtctgcatcgtcctgcgctgcgtggccggtcggtcccggcgctctcagcacttg

SEQ ID NO: 72379 - DNA, 135 bp, Homo sapiens
  misc_feature 1..135: note = chr11:1447374-1447509
  misc_feature 1..135: note = hypo
  source 1..135: mol_type = genomic DNA
cccagctgcatgggacgggcagggccacgtggccatcagggcctggatgggggcctggcacacagcgggcactggggatgtgtgtggggcgtgctccggggatgtgtgtggggcgtgctccggggatgtgtgtgg

SEQ ID NO: 72380 - DNA, 24 bp, Homo sapiens
  misc_feature 1..24: note = chr11:1450725-1450749
  misc_feature 1..24: note = hypo
  source 1..24: mol_type = genomic DNA
gccctgctgctctgtcgccagcat

SEQ ID NO: 72381 - DNA, 33 bp, Homo sapiens
  misc_feature 1..33: note = chr11:14520450-14520483
  misc_feature 1..33: note = hypo
  source 1..33: mol_type = genomic DNA
gcatacgttctcagccgccgtcatggtttctgg

SEQ ID NO: 72382 - DNA, 18 bp, Homo sapiens
  misc_feature 1..18: note = chr11:14542771-14542789
  misc_feature 1..18: note = hypo
  source 1..18: mol_type = genomic DNA
gggcggaggatcgcttga

SEQ ID NO: 72383 - DNA, 87 bp, Homo sapiens
  misc_feature 1..87: note = chr11:1455198-1455285
  misc_feature 1..87: note = hypo
  source 1..87: mol_type = genomic DNA
cacagatgaaactgacggaaagggcaaaataaagctaaaagccgatggggccgggggaatggaggtttgacgcgtgagacaaaggat

SEQ ID NO: 72384 - DNA, 75 bp, Homo sapiens
  misc_feature 1..75: note = chr11:1455520-1455595
  misc_feature 1..75: note = hypo
  source 1..75: mol_type = genomic DNA
atctgggtgtctgggcgcacctaggagtggggtcccctgtgataacctgggccggctctgcgtgtctgggggcac

SEQ ID NO: 72385 - DNA, 23 bp, Homo sapiens
  misc_feature 1..23: note = chr11:14558164-14558187
  misc_feature 1..23: note = hypo
  source 1..23: mol_type = genomic DNA
tttttatttttgagacggagtct

SEQ ID NO: 72386 - DNA, 124 bp, Homo sapiens
  misc_feature 1..124: note = chr11:1456146-1456270
  misc_feature 1..124: note = hypo
  source 1..124: mol_type = genomic DNA
gctcaggggtgtggccgggctgtcctgggcaggggcaagtatctggctgtgaaaagagtggggagaggagaaagggagggtgggccgaggcgcggagggggaccgggaccgtgtgcccagccaa

SEQ ID NO: 72387 - DNA, 79 bp, Homo sapiens
  misc_feature 1..79: note = chr11:14564357-14564436
  misc_feature 1..79: note = hypo
  source 1..79: mol_type = genomic DNA
atctttgcaggttggcgaagctaatggattccttctcagaatgatttttttctttctttcttgagacggagtctagctc

SEQ ID NO: 72388 - DNA, 54 bp, Homo sapiens
  misc_feature 1..54: note = chr11:1459467-1459521
  misc_feature 1..54: note = hypo
  source 1..54: mol_type = genomic DNA
agtgtctgtggggagcgatgcgtgccccagccctgtgagcgtgatgttctctgg

SEQ ID NO: 72389 - DNA, 65 bp, Homo sapiens; identical to SEQ ID NO: 42929
  misc_feature 1..65: note = chr11:1461955-1462020
  misc_feature 1..65: note = hypo
  source 1..65: mol_type = genomic DNA

SEQ ID NO: 72390 - DNA, 35 bp, Homo sapiens
  misc_feature 1..35: note = chr11:1463756-1463791
  misc_feature 1..35: note = hypo
  source 1..35: mol_type = genomic DNA
gagaagaacaacatccgcatcgcagactttggcat

SEQ ID NO: 72391 - DNA, 794 bp, Homo sapiens
  misc_feature 1..794: note = chr11:1464177-1464971
  misc_feature 1..794: note = hypo
  source 1..794: mol_type = genomic DNA
ctcctcccaaaagcccgcctggggatgcagggaatgtgggggcgtctggcaccacagccctggaggcctccttgagggccctgcggtgcaccatcaccctggggggagggcctggcagcgcccggagccccgccgctgacctctgcccttgcccgcaggtccccccactacgcctgccccgaggtgatccgggtgagtcagcgccgccgcgtgcagctctgtggggcccagggtggcggggacctgaccctggtgggaccccagcctgccgcacccccaggtgctgctaggctgcctgtccccgggccgactccctctgagcccaggccctccaaggcccccgccctgccctgcgccccccaacagcccgggcactgctgtccacagggggagaagtatgacggccggaaggcggacgtgtggagctgcggcgtcatcctgttcgccttgctggtggtgagaccctggccccctcaaccctgccctggcctctccccaaacctgcccccccacgctgacccccacacccggccgcccgcagggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacggtgcgtgccctcggagcggggcggccccagagcgtggcgggggggcgcgggggcgggcgtgtgcctgtgtgtgcacaggtgtgtgcccagacgtgtgggcacccag

SEQ ID NO: 72392 - DNA, 198 bp, Homo sapiens
  misc_feature 1..198: note = chr11:14665073-14665271
  misc_feature 1..198: note = hyper
  source 1..198: mol_type = genomic DNA
cttctctttcagtcccggtgggtcttcggactgccgccgccgcgctttcctcggcctgggcacgctgggtcggcgtggtcccggctcgcgtccctgttgggcggccgcggcgcgggtggcggcgggacaagtcgtgagcgcgcgctgggcgcgcgcccggccggggcagtcgcgggggaggagcgcccgcccgccgct

SEQ ID NO: 72393 - DNA, 34 bp, Homo sapiens
  misc_feature 1..34: note = chr11:14665617-14665651
  misc_feature 1..34: note = hyper
  source 1..34: mol_type = genomic DNA
agccatgaggagggacgagcgagacgccaaagcc

SEQ ID NO: 72394 - DNA, 30 bp, Homo sapiens
  misc_feature 1..30: note = chr11:14666026-14666056
  misc_feature 1..30: note = hyper
  source 1..30: mol_type = genomic DNA
ctcacccggaccaagcggggacccggcccg

SEQ ID NO: 72395 - DNA, 35 bp, Homo sapiens
  misc_feature 1..35: note = chr11:14666496-14666531
  misc_feature 1..35: note = hyper
  source 1..35: mol_type = genomic DNA
gaggaggtccagctgcgtgtcgttaggagaaactg

SEQ ID NO: 72396 - DNA, 508 bp, Homo sapiens
  misc_feature 1..508: note = chr11:1466703-1467211
  misc_feature 1..508: note = hypo
  source 1..508: mol_type = genomic DNA
ctcccgggtggggcacggggcctgaggtgggagcgctgccccggaggagccggcggccccgtgtgccagcgcgtctcgcgcctctcgcccgctgtagggagaaccaggagaagatgatttacttcctcctcctggaccggaaagaaaggtacccgagccaggaggatgaggacctgcccccccggaacgagataggtatgggtccaggggtggcctccagcccggcctgcactgccccaccggggtccgggggctgtctggcctgaccttcgtctgtactcagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtgtgtgtgccccgaggctgctgggcctccctccctgggccctggctgcgcggcactgccgcctggctcatcgc

SEQ ID NO: 72397 - DNA, 510 bp, Homo sapiens; identical to SEQ ID NO: 42933
  misc_feature 1..510: note = chr11:1469123-1469633
  misc_feature 1..510: note = hypo
  source 1..510: mol_type = genomic DNA

SEQ ID NO: 72398 - DNA, 136 bp, Homo sapiens
  misc_feature 1..136: note = chr11:1471324-1471460
  misc_feature 1..136: note = hypo
  source 1..136: mol_type = genomic DNA
gcctccccaccctcccgctcccgcctgtttctttctggtcctcctgtgccgtgtgcatgcgggggactggggtgcatgtgccgcgcggctgcccccaccccgctcgctccctgcgcctccccgtagcctattagga

SEQ ID NO: 72399 - DNA, 193 bp, Homo sapiens; identical to SEQ ID NO: 42935
  misc_feature 1..193: note = chr11:1471865-1472058
  misc_feature 1..193: note = hypo
  source 1..193: mol_type = genomic DNA

SEQ ID NO: 72400 - DNA, 150 bp, Homo sapiens
  misc_feature 1..150: note = chr11:1473510-1473660
  misc_feature 1..150: note = hypo
  source 1..150: mol_type = genomic DNA
ccagtggcctttctgcgccgatcaggtggcccttccagctgggtgcccaggtcggaggtgtgtaggtattgtcgcaagcccagatgcacagggctcagcagacttgggaaccttccgcctaggccctgacattgccgtttctgctgctac

SEQ ID NO: 72401 - DNA, 108 bp, Homo sapiens
  misc_feature 1..108: note = chr11:1475964-1476072
  misc_feature 1..108: note = hypo
  source 1..108: mol_type = genomic DNA
gtgggcctgcctggccgccttcactggacaggcgctctctcctgcccaccctcgtgagggaggggtcactgcccatctggggtgcttggcctgcggagggagtcaggg

SEQ ID NO: 72402 - DNA, 595 bp, Homo sapiens
  misc_feature 1..595: note = chr11:1477752-1478347
  misc_feature 1..595: note = hypo
  source 1..595: mol_type = genomic DNA
tctcaggtgagctggcgcccccagggcggctccgggcccaggcccgtccagggcataaccccctgtctcccctaggccccagccgtcgcttcaagagggtggtggagaccatccaggcccagctgctgagcacacacgacccgcctgcggcccagcacttgtcaggtgaggcgggctcagctccggccaacctgcggcctgcgagtggggcgtggccagctggtgctgcgcggacgggaggcgtgaggacccgggcgcagcctcctggcccctcttgacggacgcccccacctccctgccccgagctgtggctgcacccctcagggagcagagcccctccctggcctggcgggaccacccgcctcgcctctgcacgccagggacatagggcgcagccgcaccacactgaaaggcgcctcttgtccaccgtagaaccccccccaccagcgccaggactaagctggggtgctgggcttaagggccagaaggtggccaccagctacgagagtagcctctgacgctggcaggtaaggcgcccggcctgtgctggggcggggaggggctgcgggcaggtcctcggcggagccaggctggc

SEQ ID NO: 72403 - DNA, 47 bp, Homo sapiens
  misc_feature 1..47: note = chr11:1482019-1482066
  misc_feature 1..47: note = hypo
  source 1..47: mol_type = genomic DNA
ccccgagtggacccgcggccgcgccgcccgtccgtccagactgttct

SEQ ID NO: 72404 - DNA, 432 bp, Homo sapiens
  misc_feature 1..432: note = chr11:1483506-1483938
  misc_feature 1..432: note = hypo
  source 1..432: mol_type = genomic DNA
caggcgggcacagcccgggtgcggcggccgtgggggacggcgggtctgatgcatgcctctgccatggagtcgtctgtctgcttcggtgcctgcccctgcctcccacccacctcgtgtatagattttaacgcttctgttaacattagacctctgccacaggctgggatttctatacataagaacaaaagcaaacacctaggacagcaaacgccaggcggtacaggcgggaaggggctctccacggagatcgaggacacgaagcaaactgcctcttgcttgccttccccttttgtgcttcggacacacgcggactccagcaggcgccacggaaatgggcaagcccctgcagtgtacccctgtcataactgtgagcagctgcagctccggaacaataaatcccttccgcaaagacagcgacgcaggtcttcatct

SEQ ID NO: 72405 - DNA, 84 bp, Homo sapiens; identical to SEQ ID NO: 43021
  misc_feature 1..84: note = chr11:15084438-15084522
  misc_feature 1..84: note = hypo
  source 1..84: mol_type = genomic DNA

SEQ ID NO: 72406 - DNA, 413 bp, Homo sapiens
  misc_feature 1..413: note = chr11:15136043-15136456
  misc_feature 1..413: note = hyper
  source 1..413: mol_type = genomic DNA
cagctccaagggaaacgatcgcggcacattcccttcccctctccagatgttggcatgcggggcaccttgtgggcgaccccgcctggacggcttcgcggctcccgggcgatcaccctggtgcctgccgcctggcccgggggagcccggtctctaattaggcctgaccgcgtccccattccagcgctcctgcagatgggagggagggccatgtttccccccccaggggcaccgaaatagcctcgtagtcccgcggagacagcaggcagccgtggctgacgcgggaccaaggcttggcagggagcgcgctgctgtggaaggtccttgggaggctgcgaccgcctcggagagggcgggcgggggagaacggggcggggggtggggcgggggccaggggcggcctctcgggctgggcc

SEQ ID NO: 72407 - DNA, 101 bp, Homo sapiens; identical to SEQ ID NO: 33651
  misc_feature 1..101: note = chr11:15136457-15136558
  misc_feature 1..101: note = hyper
  source 1..101: mol_type = genomic DNA

SEQ ID NO: 72408 - DNA, 30 bp, Homo sapiens; identical to SEQ ID NO: 42940
  misc_feature 1..30: note = chr11:1517598-1517628
  misc_feature 1..30: note = hypo
  source 1..30: mol_type = genomic DNA

SEQ ID NO: 72409 - DNA, 36 bp, Homo sapiens
  misc_feature 1..36: note = chr11:1536547-1536583
  misc_feature 1..36: note = hypo
  source 1..36: mol_type = genomic DNA
ggcactgatgccagccggcgccgactcaggtgagca

SEQ ID NO: 72410 - DNA, 154 bp, Homo sapiens
  misc_feature 1..154: note = chr11:1553679-1553833
  misc_feature 1..154: note = hypo
  source 1..154: mol_type = genomic DNA
ggagttaggagcttccgtagacggtgcaggccaaaccccgagacaacagccccacctgggctcctgagattgcattgctgtggggatagggtctgccagcccacagcctgcacagccaccatgtctggaggggaaaaggcgctgctgaaagggt

SEQ ID NO: 72411 - DNA, 35 bp, Homo sapiens; identical to SEQ ID NO: 42942
  misc_feature 1..35: note = chr11:1560806-1560841
  misc_feature 1..35: note = hypo
  source 1..35: mol_type = genomic DNA

SEQ ID NO: 72412 - DNA, 148 bp, Homo sapiens
  misc_feature 1..148: note = chr11:1585143-1585291
  misc_feature 1..148: note = hypo
  source 1..148: mol_type = genomic DNA
tgtctgcggccagcacgctggcgtcccgcgtgctctggtcatagaccaccacgtcctgtggctccgtagcctccacctgggggccatggggcagagatcagcatgccgcctccacctatcgatgccctggccccgtcccagatatgct

SEQ ID NO: 72413 - DNA, 23 bp, Homo sapiens
  misc_feature 1..23: note = chr11:16255262-16255285
  misc_feature 1..23: note = hypo
  source 1..23: mol_type = genomic DNA
aacataaaacaggcccggtgcgg

SEQ ID NO: 72414 - DNA, 214 bp, Homo sapiens
  misc_feature 1..214: note = chr11:16625964-16626178
  misc_feature 1..214: note = hyper
  source 1..214: mol_type = genomic DNA
gaagaccctagtgggcgggagtagaggggccctctctcatctctactcccccgggttgctggctgggccgtgcagccagggccaaagcccggccgcaggagtacgcggctagcaccggcgcccgggacgcggacgtcatccgagcgcccattgacagtacagcgggaggtccggagcccagcccagtttgccgcaaggacggcttcgggccacc

SEQ ID NO: 72415 - DNA, 57 bp, Homo sapiens
  misc_feature 1..57: note = chr11:16626439-16626496
  misc_feature 1..57: note = hyper
  source 1..57: mol_type = genomic DNA
tatcttaaagctctgcggagcgccggggaagcagcccggcaccgagctaatctgccc

SEQ ID NO: 72416 - DNA, 46 bp, Homo sapiens
  misc_feature 1..46: note = chr11:16627364-16627410
  misc_feature 1..46: note = hyper
  source 1..46: mol_type = genomic DNA
ctccgaacactgtggcgtctcagtcacacagcgaatcaacccaaca

SEQ ID NO: 72417 - DNA, 606 bp, Homo sapiens
  misc_feature 1..606: note = chr11:16628305-16628911
  misc_feature 1..606: note = hyper
  source 1..606: mol_type = genomic DNA
tgccttaatgtcctacgcacagttatctacggctacaacatgtgttttctcagggtggattttttggaggggaggtgaaggggagaaaaacagacccccgccacgcagatctgtcactccggaacaaggcgcaactctccaagagggggacgcatcctcgggatcagcgcgtccaccagcgagcggcgggcgcccgggcccctttctctccctccactccccctccgcgtcggcccctcggagcgccctcctcccgctcctcctcctcctttcccctccccagccaagtacgcaaacccgccccggcccggcagccgcggctcccggccacccgcgccctctcggggctccgctcgctcggctctcgtccctctgcctgtcctgccccagcccctcggtcccagctcacagaaactaaccctggagtgcccggaagggcaggagcggaagacgccgggggacggcggcccggccctgggctcctgccccctgccccctccggcgccccaacaggtagctcacagcgggccgcgcgccctggctctgcctccctcgctctcgagatcgctcgctccgtcccggttacctgggcgggctccaggatgg

SEQ ID NO: 72418 - DNA, 156 bp, Homo sapiens; identical to SEQ ID NO: 33655
  misc_feature 1..156: note = chr11:16629373-16629529
  misc_feature 1..156: note = hyper
  source 1..156: mol_type = genomic DNA

SEQ ID NO: 72419 - DNA, 15 bp, Homo sapiens
  misc_feature 1..15: note = chr11:16632413-16632428
  misc_feature 1..15: note = hyper
  source 1..15: mol_type = genomic DNA
gctcggagaagttcc

SEQ ID NO: 72420 - DNA, 157 bp, Homo sapiens; identical to SEQ ID NO: 33656
  misc_feature 1..157: note = chr11:16632513-16632670
  misc_feature 1..157: note = hyper
  source 1..157: mol_type = genomic DNA

SEQ ID NO: 72421 - DNA, 313 bp, Homo sapiens
  misc_feature 1..313: note = chr11:16634139-16634452
  misc_feature 1..313: note = hyper
  source 1..313: mol_type = genomic DNA
ggagtggggggatggcgatgaagaaaaggagaaaaagcctggagtatactaccttgctcaaaaagctcccaaaggcagcgtggagcggcacagacacgaactaagacaatgtgtgtctgcggagcctgtacagggtccatttctcccccacgtcaccctcctccattcccctctaatgagacgcggatcaccctccactctcaccgacactgcagctctgcacaagggcagctggaatctgggaaccttacctgcagcaccaatacctaagagaaatcgcgcttccctgacactaacacgccatgccatcccc

SEQ ID NO: 72422 - DNA, 30 bp, Homo sapiens
  misc_feature 1..30: note = chr11:16635126-16635156
  misc_feature 1..30: note = hyper
  source 1..30: mol_type = genomic DNA
cccatcaccacttcccgctgcctccacgcg

SEQ ID NO: 72423 - DNA, 132 bp, Homo sapiens; identical to SEQ ID NO: 33658
  misc_feature 1..132: note = chr11:16635795-16635927
  misc_feature 1..132: note = hyper
  source 1..132: mol_type = genomic DNA

SEQ ID NO: 72424 - DNA, 222 bp, Homo sapiens
  misc_feature 1..222: note = chr11:1669519-1669741
  misc_feature 1..222: note = hypo
  source 1..222: mol_type = genomic DNA
aaatgctcctgaaggcggggaggcggcccggcccgcactgagcttctcaccggccagagggcgcagccacccggccttcccgaagcaggacagcggcctttccaagaccgcggagtccccgtgagggatggtgcctccggagcctggcatctcgggcggatgagaagctgagcgcggtcagatggcccgcagggtcccactgcgggccgagccctggctggg

SEQ ID NO: 72425 - DNA, 21 bp, Homo sapiens
  misc_feature 1..21: note = chr11:16762253-16762274
  misc_feature 1..21: note = hypo
  source 1..21: mol_type = genomic DNA
ccacctcgcccagccagtact

SEQ ID NO: 72426 - DNA, 30 bp, Homo sapiens
  misc_feature 1..30: note = chr11:16935834-16935864
  misc_feature 1..30: note = hypo
  source 1..30: mol_type = genomic DNA
ataattagaaaacatcgacatttaaagtgg

SEQ ID NO: 72427 - DNA, 219 bp, Homo sapiens
  misc_feature 1..219: note = chr11:16978351-16978570
  misc_feature 1..219: note = hypo
  source 1..219: mol_type = genomic DNA
acctgaggtctctggcggttataatgttctgcaaggactggccagccctgtcaactcaatctaaagcagtttaaccagtcaatgcaaaagttacactgccttgaagaacagaaagataaagacagcccagatgatcccaaggaaagtggtaggtttaagttttgtgtaatgtgaggcattatcacctccccccgtggctttaggcgcagcattagtcac

SEQ ID NO: 72428 - DNA, 108 bp, Homo sapiens; identical to SEQ ID NO: 43023
  misc_feature 1..108: note = chr11:16988399-16988507
  misc_feature 1..108: note = hypo
  source 1..108: mol_type = genomic DNA

SEQ ID NO: 72429 - DNA, 21 bp, Homo sapiens
  misc_feature 1..21: note = chr11:17037323-17037344
  misc_feature 1..21: note = hypo
  source 1..21: mol_type = genomic DNA
tcgcgccgctgccctgcaacc

SEQ ID NO: 72430 - DNA, 154 bp, Homo sapiens; identical to SEQ ID NO: 43025
  misc_feature 1..154: note = chr11:17100671-17100825
  misc_feature 1..154: note = hypo
  source 1..154: mol_type = genomic DNA

SEQ ID NO: 72431 - DNA, 279 bp, Homo sapiens
  misc_feature 1..279: note = chr11:17373126-17373405
  misc_feature 1..279: note = hyper
  source 1..279: mol_type = genomic DNA
tctcaatttactaagcgaacccagaggatgccccgagtcctggaccgcagagccgctcgcgagaggcaccggggctgtaaccgcgcaacctcgtgccgcgggcggaggcgagggaggattccccggccggtgcccgcccccgggctaaagtgcggcgcgggtggggctggtcacgcgcctggcttcctgcagtgcgaacctgggaaatccaggcgacttcgcagttgccgaagggatctgaagaagtgggatgtgcaaaagcgccggctggaaatcccg

SEQ ID NO: 72432 - DNA, 30 bp, Homo sapiens
  misc_feature 1..30: note = chr11:1742866-1742896
  misc_feature 1..30: note = hypo
  source 1..30: mol_type = genomic DNA
tgaactcctctcttgcggccccatgattcg

SEQ ID NO: 72433 - DNA, 73 bp, Homo sapiens; identical to SEQ ID NO: 33659
  misc_feature 1..73: note = chr11:17497448-17497521
  misc_feature 1..73: note = hyper
  source 1..73: mol_type = genomic DNA

SEQ ID NO: 72434 - DNA, 152 bp, Homo sapiens
  misc_feature 1..152: note = chr11:17497545-17497697
  misc_feature 1..152: note = hyper
  source 1..152: mol_type = genomic DNA
cgcagagcctgagaagttgcgctctggagacacatgcccgggtggggtggcgggggaagggaatccaagtccctagctctcgcctctcctcgcccagggcgcgggcctgggactgtcagagatcacggaccactgcgcggctcagcccggtg

SEQ ID NO: 72435 - DNA, 314 bp, Homo sapiens
  misc_feature 1..314: note = chr11:17497951-17498265
  misc_feature 1..314: note = hyper
  source 1..314: mol_type = genomic DNA
gtccgctgtgtttggcgcgggatcgggggcaccgggggagtgaagggatgagctggtgtgcgagtgcggggaccggcgggcaggacacagggcaggggaccccgggaacgaggcggacggcggtcgcgggccggaaggggacgccgagcggtgcggcgcgcagcgcctcctcctccctccctgctctcccgtcccctcctccgcggctcgctgcgcgcactcaccaatgaagaggatggggaaggtgatgaagagtaggaagacgtgcggcaccacgttgagcgcgtccacaaagcagccgttgttgaggaccc

SEQ ID NO: 72436 - DNA, 218 bp, Homo sapiens
  misc_feature 1..218: note = chr11:17565786-17566004
  misc_feature 1..218: note = hyper
  source 1..218: mol_type = genomic DNA
cccagaagcctggggcgccctgcagctctgaccttatgccggaattctcgggccacttttcggtccatggctgggccaggtccagctgcgtcgttgcacgacccgttccttcgggtgcccggctgccaggagctggaaagagccgcgaccgcgaccgggccagccgccctcggagctgggggcggggcctgagcgcggaggggcggggccaggcctct

SEQ ID NO: 72437 - DNA, 98 bp, Homo sapiens
  misc_feature 1..98: note = chr11:17566237-17566335
  misc_feature 1..98: note = hypo
  source 1..98: mol_type = genomic DNA
cggaaactatttacacgggcggggggcggggcaatctagtccgttttctctggatattctttttttttcccccccgagacggagtctcgctctgtcgc

SEQ ID NO: 72438 - DNA, 46 bp, Homo sapiens
  misc_feature 1..46: note = chr11:17591817-17591863
  misc_feature 1..46: note = hypo
  source 1..46: mol_type = genomic DNA
cgtgcgggtgctctacgaccgtgaagggctccgactgtacctgcaa

SEQ ID NO: 72439 - DNA, 84 bp, Homo sapiens; identical to SEQ ID NO: 42944
  misc_feature 1..84: note = chr11:1760346-1760430
  misc_feature 1..84: note = hypo
  source 1..84: mol_type = genomic DNA

SEQ ID NO: 72440 - DNA, 117 bp, Homo sapiens
  misc_feature 1..117: note = chr11:17633792-17633909
  misc_feature 1..117: note = hypo
  source 1..117: mol_type = genomic DNA
ggtgctgctccccctcgctgtgggatcctgggcctcgccgtgcgggtgggtggggaccgctgctgcccactctgggagtgtgcctgtgagtcatgggatcagcggagcctcctgcat

SEQ ID NO: 72441 - DNA, 30 bp, Homo sapiens
  misc_feature 1..30: note = chr11:17653699-17653729
  misc_feature 1..30: note = hypo
  source 1..30: mol_type = genomic DNA
ggccctgactgtgtacgtggccatgtgcca

SEQ ID NO: 72442 - DNA, 457 bp, Homo sapiens
  misc_feature 1..457: note = chr11:1770262-1770719
  misc_feature 1..457: note = hyper
  source 1..457: mol_type = genomic DNA
cgcgcggccggaccccctgagcctcggtgcgcgcgtccttccgccgtcccgcgggccgctgtctgtccactgatccgcctcccagcggcccaaccttgagggggtggggagcgcgcggggctcggcggcggcgccgctgcctcccccgccgcctgcgctccctccgcagcgccagaccggccgcgcggctgcagcccagagcctgactcacggcggcagcgggcacagccacctccccgcctccgcctcctcctgccaggagggtgggggcctcggaagccgcgaccctggggagttgcaaggtcccgcagggatgggacccctacagcccccgaccagggtgtccgcgccacctccatctccccggacccactgcgtcttcctccccaccccacccggccccatccctctcgcggagcccccagccccgtggaagactggacgctcccggaaccct

SEQ ID NO: 72443 - DNA, 465 bp, Homo sapiens
  misc_feature 1..465: note = chr11:17717315-17717780
  misc_feature 1..465: note = hyper
  source 1..465: mol_type = genomic DNA
ggagagacgggggtgcgagcacagggtcagtgggcggggagggactggagagcgctgggcagggcgaggaggtgggagccgcgctagagcgtggggaggggacccgcagtgggcgcgcggccttagagaggggccagggccggggccggggccgggccggggctgcggtgaggggaggcgcgtggccggccgcccccagctgtggcgtcgttcaggcccggcttagcggtgccggggcgagggattaggggcagtggccgcacctggcggggcggccgcagggctaatgctgtgtgaccgccgcggccccgcccgacaactggcttcatcccgccctggaggcctgtgggctcgttagccccgccggcgtgtgcgcggggtgcggctgcgggcggcgagtgcacgtgtgccgcggggggccctgccgctggcgctgacggccaccggctgcgcccagctccaggg

SEQ ID NO: 72444 - DNA, 806 bp, Homo sapiens
  misc_feature 1..806: note = chr11:17740381-17741187
  misc_feature 1..806: note = hyper
  source 1..806: mol_type = genomic DNA
tttagcagcaatctccgattcctgtacaaccatagctgggtttctaagcgtctagggaagaaggactgggcccacgacctgctgagcaactcccaggtcggggactggcggaatatcagagcctctacgacccgtttgtctcgggctcgcccacttcaactctcggggtctctccgcctgttgttgcactcgtgcgtttctctgcccctgacgctctaagctttctgctttctgcgtgtctctcagcctctttcggtccctctttcacggtctcactcctcagctctgtgcccccaatgccttgcctctctccaaatctctcacgacctgatttctacagccgctctacccatgggtcccccacaaatcaggggacagaggagtattgaaagtcagctcagaggtgagcgcgcgcagccagcgtttcccgcggatacagcagtcgggtgttggagaggtttggaaagggcgtgccggagagccaagtgcagccgcctagggctgccggtcgctccctccctccctgcccggtaggggacctagcgcgcacgccagtgtggaggggcgggctggctggccagtctgcgggcccctgcggccaccccggggacccccccaagccccgccccgcagtgttcctattggcctcggactccccctcccccagctgcccgcctgggctccggggcgtttaggctactacggataaatagcccagggcgcctggcgagaagctaggggtgaggaagccctggggcgctgccgccgctttccttaaccacaaatcaggccggacaggagaggga

SEQ ID NO: 72445 - DNA, 70 bp, Homo sapiens
  misc_feature 1..70: note = chr11:17741528-17741598
  misc_feature 1..70: note = hyper
  source 1..70: mol_type = genomic DNA
cggcggtgcacccggccccgggcgcacgtgaggacgagcatgtgcgcgcgcccagcgggcaccaccaggc

SEQ ID NO: 72446 - DNA, 84 bp, Homo sapiens; identical to SEQ ID NO: 949
  misc_feature 1..84: note = chr11:17741806-17741890
  misc_feature 1..84: note = hyper
  source 1..84: mol_type = genomic DNA

SEQ ID NO: 72447 - DNA, 532 bp, Homo sapiens; identical to SEQ ID NO: 33668
  misc_feature 1..532: note = chr11:17741952-17742484
  misc_feature 1..532: note = hyper
  source 1..532: mol_type = genomic DNA

SEQ ID NO: 72448 - DNA, 10 bp, Homo sapiens
  misc_feature 1..10: note = chr11:17742518-17742528
  misc_feature 1..10: note = hyper
  source 1..10: mol_type = genomic DNA
cgcccagcgg

SEQ ID NO: 72449 - DNA, 32 bp, Homo sapiens
  misc_feature 1..32: note = chr11:17742779-17742811
  misc_feature 1..32: note = hyper
  source 1..32: mol_type = genomic DNA
taaccgagccctccccgcgcagaacccaggcc

SEQ ID NO: 72450 - DNA, 32 bp, Homo sapiens
  misc_feature 1..32: note = chr11:17743213-17743245
  misc_feature 1..32: note = hyper
  source 1..32: mol_type = genomic DNA
agggcaaggacacagcgcggttttttccacgc

SEQ ID NO: 72451 - DNA, 76 bp, Homo sapiens
  misc_feature 1..76: note = chr11:17743716-17743792
  misc_feature 1..76: note = hyper
  source 1..76: mol_type = genomic DNA
atccggaggaaaatccgcaaactgggccagctgtccctcagcgacgcctgtaggcggcaggcggattgcaaggagg

SEQ ID NO: 72452 - DNA, 431 bp, Homo sapiens
  misc_feature 1..431: note = chr11:17756235-17756666
  misc_feature 1..431: note = hyper
  source 1..431: mol_type = genomic DNA
ctttttaggacccagcgcggcgccttcctccgggggcgagtgcggctgcgcgcgccgtgtgcccgtgtccggagagcggcgggctggacgcggaccgcgcgaacgagcaggcgacgggcgagcagcaagcggagcagcagcccgggcggcagcagcgtcgcggcggcggcggcagcggccgctccgcgcctcgcctcaccggcctcgctggcctcacctcgccgcgcccggacccgccacccccgcctccccgcccgacctccgcagcccccgtctcggccggcagcgcccaccgcctgcccgaagcgaggagcggagtgcggggcgcagaggcaccggagccagtgcccgccggccccgcaaatcaaacccagccaggagaacccccgcctggccccgtgcagctccgcgaccgccgggagctgtccctt

SEQ ID NO: 72453 - DNA, 86 bp, Homo sapiens; identical to SEQ ID NO: 33671
  misc_feature 1..86: note = chr11:17756886-17756972
  misc_feature 1..86: note = hyper
  source 1..86: mol_type = genomic DNA

SEQ ID NO: 72454 - DNA, 150 bp, Homo sapiens
  misc_feature 1..150: note = chr11:17756993-17757143
  misc_feature 1..150: note = hyper
  source 1..150: mol_type = genomic DNA
cgaccacctcacagaggagcgcgaatttcccggccctgtctcctcccctccccctcctgggggctggcctctagtccggccccgggagcggctgacctttcccccaaaagctttgtgccgatttctccattttcccgcggagatggggac

SEQ ID NO: 72455 - DNA, 77 bp, Homo sapiens; identical to SEQ ID NO: 33673
  misc_feature 1..77: note = chr11:17757704-17757781
  misc_feature 1..77: note = hyper
  source 1..77: mol_type = genomic DNA

SEQ ID NO: 72456 - DNA, 28 bp, Homo sapiens
  misc_feature 1..28: note = chr11:17758041-17758069
  misc_feature 1..28: note = hyper
  source 1..28: mol_type = genomic DNA
cctggcggcttttggcgccgctggcagc

SEQ ID NO: 72457 - DNA, 44 bp, Homo sapiens; identical to SEQ ID NO: 43028
  misc_feature 1..44: note = chr11:17784927-17784971
  misc_feature 1..44: note = hypo
  source 1..44: mol_type = genomic DNA

SEQ ID NO: 72458 - DNA, 30 bp, Homo sapiens
  misc_feature 1..30: note = chr11:1788149-1788179
  misc_feature 1..30: note = hypo
  source 1..30: mol_type = genomic DNA
cacctggggttatcacgtgctttccagtgg

SEQ ID NO: 72459 - DNA, 59 bp, Homo sapiens
  misc_feature 1..59: note = chr11:1788433-1788492
  misc_feature 1..59: note = hypo
  source 1..59: mol_type = genomic DNA
gggccagaagcacaacgtggcagcgagctgtggggtgtgtgggccggtgctagccaggc

SEQ ID NO: 72460 - DNA, 62 bp, Homo sapiens
  misc_feature 1..62: note = chr11:1790206-1790268
  misc_feature 1..62: note = hypo
  source 1..62: mol_type = genomic DNA
tgaggcaaagggagccggcctggaggtggggaggaaaggaagcagtccgaggtcagagagag

SEQ ID NO: 72461 - DNA, 91 bp, Homo sapiens; identical to SEQ ID NO: 42946
  misc_feature 1..91: note = chr11:1795195-1795286
  misc_feature 1..91: note = hypo
  source 1..91: mol_type = genomic DNA

SEQ ID NO: 72462 - DNA, 30 bp, Homo sapiens; identical to SEQ ID NO: 42947
  misc_feature 1..30: note = chr11:1801108-1801138
  misc_feature 1..30: note = hypo
  source 1..30: mol_type = genomic DNA

SEQ ID NO: 72463 - DNA, 39 bp, Homo sapiens
  misc_feature 1..39: note = chr11:18033384-18033423
  misc_feature 1..39: note = hypo
  source 1..39: mol_type = genomic DNA
agccagccagactaccgcaggtcacgccatgctctccct

SEQ ID NO: 72464 - DNA, 30 bp, Homo sapiens
  misc_feature 1..30: note = chr11:18231515-18231545
  misc_feature 1..30: note = hypo
  source 1..30: mol_type = genomic DNA
ctacacttgcacttacgtttggtctgtatg

SEQ ID NO: 72465 - DNA, 141 bp, Homo sapiens
  misc_feature 1..141: note = chr11:1824116-1824257
  misc_feature 1..141: note = hypo
  source 1..141: mol_type = genomic DNA
gcctagaagcatttgcggtggaggatggaggggccaggctcgtcatacgcctgcttgctgatccacatctgctggaaggtggatggcgaggccgggatggagccgctgatccacgcagagtatttgcgctcgggaggagca

SEQ ID NO: 72466 - DNA, 102 bp, Homo sapiens
  misc_feature 1..102: note = chr11:1825171-1825273
  misc_feature 1..102: note = hypo
  source 1..102: mol_type = genomic DNA
agtccttctgacccatgcccaccgtcatgccctggtgtctggggcaccccacgatggaggggaagacggcccagggggcatcgtcgtcggtgaagctggcct

SEQ ID NO: 72467 - DNA, 30 bp, Homo sapiens
  misc_feature 1..30: note = chr11:1826914-1826944
  misc_feature 1..30: note = hypo
  source 1..30: mol_type = genomic DNA
accagcgtagggaagcgtgatcaccacctt

SEQ ID NO: 72468 - DNA, 36 bp, Homo sapiens
  misc_feature 1..36: note = chr11:1829914-1829950
  misc_feature 1..36: note = hypo
  source 1..36: mol_type = genomic DNA
gtaaccaagaacatgtacagtcggtggtaggataga

SEQ ID NO: 72469 - DNA, 62 bp, Homo sapiens
  misc_feature 1..62: note = chr11:1847259-1847321
  misc_feature 1..62: note = hypo
  source 1..62: mol_type = genomic DNA
gcctgcacgcagtgacgcctacatgcagtgatgcctgtacgcagtgacgtctgcccacagtg

SEQ ID NO: 72470 - DNA, 47 bp, Homo sapiens
  misc_feature 1..47: note = chr11:18512392-18512439
  misc_feature 1..47: note = hypo
  source 1..47: mol_type = genomic DNA
ggagtattcatgcctcgttctgtgactgccttcgtgactacagccat

SEQ ID NO: 72471 - DNA, 57 bp, Homo sapiens; identical to SEQ ID NO: 42949
  misc_feature 1..57: note = chr11:1856532-1856589
  misc_feature 1..57: note = hypo
  source 1..57: mol_type = genomic DNA

SEQ ID NO: 72472 - DNA, 335 bp, Homo sapiens
  misc_feature 1..335: note = chr11:1857210-1857545
  misc_feature 1..335: note = hypo
  source 1..335: mol_type = genomic DNA
ggaggtgaagggccccgctgcgcaggaccagcggttctgcgagtttccggaaagggtgacgggggaagggcagaccccatgccctgggtggtggggagctgacagggcaggggcccttggctgagcccaccccgctggctcccagatcagggtgggcctgaggcaggcagccgacctgaggcctgggggcaccgtggacccctatgcccgggtcagcgtctccacccaggccggacacagacatgagacaaaagtgcaccgaggcacgctctgccccgtgtttgacgagacctgctgcttccacgtgagtcagggatggtcggctgggtgggcct

SEQ ID NO: 72473 - DNA, 60 bp, Homo sapiens
  misc_feature 1..60: note = chr11:1857873-1857933
  misc_feature 1..60: note = hypo
  source 1..60: mol_type = genomic DNA
tgccctatgggccatcggaaagacaggcctgatgggcagcattttcgggggtctgagccc

SEQ ID NO: 72474 - DNA, 63 bp, Homo sapiens
  misc_feature 1..63: note = chr11:1858589-1858652
  misc_feature 1..63: note = hypo
  source 1..63: mol_type = genomic DNA
gccagggaggtggaccgcatgctggccctgcagccccgccttcgcctgcgcctgcccttgccc

SEQ ID NO: 72475 - DNA, 30 bp, Homo sapiens
  misc_feature 1..30: note = chr11:1862756-1862786
  misc_feature 1..30: note = hypo
  source 1..30: mol_type = genomic DNA
gaagatgtttgagtccgagtcctaggccac

SEQ ID NO: 72476 - DNA, 30 bp, Homo sapiens; identical to SEQ ID NO: 42952
  misc_feature 1..30: note = chr11:1863098-1863128
  misc_feature 1..30: note = hypo
  source 1..30: mol_type = genomic DNA

SEQ ID NO: 72477 - DNA, 30 bp, Homo sapiens
  misc_feature 1..30: note = chr11:1864366-1864396
  misc_feature 1..30: note = hypo
  source 1..30: mol_type = genomic DNA
cgagacctggcctgtcggggggaagctgcc

SEQ ID NO: 72478 - DNA, 30 bp, Homo sapiens
  misc_feature 1..30: note = chr11:1864932-1864962
  misc_feature 1..30: note = hypo
  source 1..30: mol_type = genomic DNA
taagtgagaggcctgcggaaagcaaaccag

SEQ ID NO: 72479 - DNA, 43 bp, Homo sapiens; identical to SEQ ID NO: 43029
  misc_feature 1..43: note = chr11:18656839-18656882
  misc_feature 1..43: note = hypo
  source 1..43: mol_type = genomic DNA

SEQ ID NO: 72480 - DNA, 123 bp, Homo sapiens
  misc_feature 1..123: note = chr11:1867693-1867816
  misc_feature 1..123: note = hypo
  source 1..123: mol_type = genomic DNA
acatggagatgagagcgcctgcctcactggaccaccaggtaggcagggacccagctggcacctcctgcctccctaaactcctctcctatgtgccccccagagtcagcccgactctcccccagc

SEQ ID NO: 72481 - DNA, 271 bp, Homo sapiens
  misc_feature 1..271: note = chr11:1868053-1868324
  misc_feature 1..271: note = hypo
  source 1..271: mol_type = genomic DNA
catttgttcactgtccgtctcttcctctgggagggaaaatccacgaagtcagggacctggagttatttgcagctgtgtcagtgctgctggggcgaggcatacacctgtgacgggacctcaggacggggacacgggtctgcatgaggattgtctaacagtccctacaagacgctggggccaccatgtacactggagtcctctggcagccagtgttccccgttgtgcggggctggccgtgaccacgctggaaaccccccgatccccttgttgc

SEQ ID NO: 72482 - DNA, 81 bp, Homo sapiens
  misc_feature 1..81: note = chr11:1868863-1868944
  misc_feature 1..81: note = hypo
  source 1..81: mol_type = genomic DNA
ccccggtcactctgacgccgccaaatagtggagacaacaccaagctctaaagattttcaaagggagagagacaaaaaaaaa

SEQ ID NO: 72483 - DNA, 30 bp, Homo sapiens
  misc_feature 1..30: note = chr11:1869458-1869488
  misc_feature 1..30: note = hypo
  source 1..30: mol_type = genomic DNA
caaggccttttgtgccgaccgacgcccatc

SEQ ID NO: 72484 - DNA, 515 bp, Homo sapiens
  misc_feature 1..515: note = chr11:18742646-18743161
  misc_feature 1..515: note = hyper
  source 1..515: mol_type = genomic DNA
ttcagctgaagagcccggagcccctgaccctcacccctactctacggcgagtccctccggcacctcgccacccacaatggtcccgccctccatggctacgcccaccgtcttggtcccgcgttccttttggctcactcgccttgtggacacgccccttcgcttccattgcgtcccgccccgccacgttctggctctgcccctgctctgctctgccccgggggtactttgggtcctctgctcattccggcaatatcccggttcctgactcggcctctcttatcctgccgcgcctctcgggcaatgacagctgcttttcccactgcccggctctcgggccgccgttaaggctctcatcggtgagaagactggcggcccgccctgggggtccctgcctctggccttctcggtaactggacttgggcttggcccccgcaccttcagcacgtgttccttgttaatgctgtcgtagaatatcttggcggactccttgatggggatgccgctctccctcttcc

SEQ ID NO: 72485 - DNA, 103 bp, Homo sapiens
  misc_feature 1..103: note = chr11:18743474-18743577
  misc_feature 1..103: note = hyper
  source 1..103: mol_type = genomic DNA
gttgaggcttctccacgaactcagggacgctgtcgcccgcagggatgtttgagctccgggtcactaagctgaagaactccactatgctcgaggacttcctcct

SEQ ID NO: 72486 - DNA, 30 bp, Homo sapiens
  misc_feature 1..30: note = chr11:1878638-1878668
  misc_feature 1..30: note = hypo
  source 1..30: mol_type = genomic DNA
tcagttccctgagaacgtgccagagggatg

SEQ ID NO: 72487 - DNA, 986 bp, Homo sapiens
  misc_feature 1..986: note = chr11:18812557-18813543
  misc_feature 1..986: note = hyper
  source 1..986: mol_type = genomic DNA
gctgggggaggggagcgcgctaagcttgtattctaggggagggtgggacgcgggaggctaaagctaaagggtcggtggaggcgaagcaatgggaaggctgggagccgcgctttagaggccagaaggctagcggcgatttccaatctccctcaggggcttcaggctccggagaggcgatgcagcccagagccgcgcaccagcctccgccggccgcagaggctcagaccccaaaccactatcccgattcctccccggaaccgcgcacgggcttcgtggggagtggctgccgctccctcccggctaccaagcgacaagccccctcctctgcatgggggacccctcccccagcatgcgggcgcccagagccccacgggggcgtggcgggggcgggcgccggctcctcggccgggagggctggagaaggtgtcagttgcggggccgcccgaaggagggacccgcgccctccaccttccggctccgcacacaaaggcgcagacggaggcgccgcacttaccggccagagcgggctccgggcgccggcgagcaggcgggcaggctggcgggaggatgcgcgcgcgagtgtgcgtgtgtctgcgtgtgtccctgcttgtgtctgtgccagtgtgtatgcgacgggggccgcgccgagctctgtgcgtctgcgtgtgcgggggcgtccgtccttcggtgcctccgtccttcggtccgtccgcctggcgctccgtcccgcgctccgtgcgcgctccctcgcccgaccgcctcaccaaatgcgcttcagctgcagagtcgctggcgcagccgccgggtgggtttggcaccccccagccccggctccgccccgcccccgggcgggcttccgccgctcgccgggaattgcgcagggctggcggggcgggggaccgggagagcggcctgctcccggggcacgaagggggccggatcacagacccttaacccctgacctcatctcaggtgcctccctctcc

SEQ ID NO: 72488 - DNA, 442 bp, Homo sapiens; identical to SEQ ID NO: 33677
  misc_feature 1..442: note = chr11:18813609-18814051
  misc_feature 1..442: note = hyper
  source 1..442: mol_type = genomic DNA

SEQ ID NO: 72489 - DNA, 80 bp, Homo sapiens
  misc_feature 1..80: note = chr11:1884451-1884531
  misc_feature 1..80: note = hypo
  source 1..80: mol_type = genomic DNA
attcacccgcttgcccgtctgctcacagcctcacccttgcttccctcagtgttcccaaggtgctgcgcaaccccaactcc

SEQ ID NO: 72490 - DNA, 51 bp, Homo sapiens
  misc_feature 1..51: note = chr11:1889039-1889090
  misc_feature 1..51: note = hypo
  source 1..51: mol_type = genomic DNA
tcccccctgccccgtcgccccccacccctgccccagcgattctccttgtct

SEQ ID NO: 72491 - DNA, 30 bp, Homo sapiens
  misc_feature 1..30: note = chr11:1891550-1891580
  misc_feature 1..30: note = hypo
  source 1..30: mol_type = genomic DNA
ggtgcccgcagcacccggggacatacaccg

SEQ ID NO: 72492 - DNA, 214 bp, Homo sapiens
  misc_feature 1..214: note = chr11:18950386-18950600
  misc_feature 1..214: note = hypo
  source 1..214: mol_type = genomic DNA
gtgaatatcacaaaacgaacaccaacccctatcacttcaaggccacaaaagttaatgctcattattccgagtactccagtcttgtgattctatttaagatggatcttgccaccatgaccaaatacatggggtgacacaaggaataaaacacatgtatgaattattcaccattccccaaaaaactctatgcttttattaacggtgccactgtaaa

SEQ ID NO: 72493 - DNA, 152 bp, Homo sapiens
  misc_feature 1..152: note = chr11:1907948-1908100
  misc_feature 1..152: note = hypo
  source 1..152: mol_type = genomic DNA
tcctcctctgcagaccgctggccggacccccaagctagcccgccaggcctccatagagctgcccagcatggctgtggccagtaccaagagtcggtgggagacgggtgaggtacaggctcagtctgcggccaagactccgtcctgcaaggtaa

SEQ ID NO: 72494 - DNA, 22 bp, Homo sapiens
  misc_feature 1..22: note = chr11:19137286-19137308
  misc_feature 1..22: note = hypo
  source 1..22: mol_type = genomic DNA
ccacgcccggccagaaagctct

SEQ ID NO: 72495 - DNA, 632 bp, Homo sapiens
  misc_feature 1..632: note = chr11:19263417-19264049
  misc_feature 1..632: note = hyper
  source 1..632: mol_type = genomic DNA
gaataaaatttggcccgtccggggctcgcgggctgggccgcaggcgccctgcgattccccgcttggggctatctcacccctgcccagccccaggccggctcacctgccctcggactccagccggacctctcccccttgcacccctggcatgcatgattgtgctgcccaccgtctgccccgtgcctcgcagaaactggcgcgaggagggagaagcttggctactggtgcctaagctccgtgggctctgggccttggcccagcggtgagaactcaggtgtaggaggaagaggaggaaggcggaaaaccctccaaccctgtcctcgccgtctttcctcagggtctcccacccactcctccctttctcttccctgttgtctttccctctttttccggtctccgagcctcaggcagctttagcctggttccctgtagagccctagcagggtcggggagacacttcgatccttcgtcctcactttgcagaacgggacaccgaggcccggggcggcggcgctgcctcggctgcacctggatcatttgcgcccgcgttggctccctttgctctcctctgccttagacttttctgcggactggtgctgagtgttgcccaaccgcgccgagatctgggcgcc

SEQ ID NO: 72496 - DNA, 30 bp, Homo sapiens
  misc_feature 1..30: note = chr11:1934662-1934692
  misc_feature 1..30: note = hypo
  source 1..30: mol_type = genomic DNA
accgcgcccggcccccgctttctgatataa

SEQ ID NO: 72497 - DNA, 78 bp, Homo sapiens
  misc_feature 1..78: note = chr11:1935022-1935100
  misc_feature 1..78: note = hypo
  source 1..78: mol_type = genomic DNA
cgttccagtcctagacgcctcaccccgcgctctgcggtgagcacgagctgtgcactgggatcgcggactccttttccc

SEQ ID NO: 72498 - DNA, 483 bp, Homo sapiens
  misc_feature 1..483: note = chr11:19366652-19367135
  misc_feature 1..483: note = hyper
  source 1..483: mol_type = genomic DNA
ccggggtggcgaggccgccgattggcagcgaggcgccatgtgaactgcactggttggctggcgggagggaggaggaggcggtttcccgggtaacgggagggcaaggagcggctgcagcggcagcggccgcggctgagaagcgcgggccggagtgcagtgcgagaccggctggaggaggcggctccgcgaagccggtgtgggcgcaggtaggaaccccctatgctgcctcccccaggtcgggtctggctggactgcccggcggcgggaccggcctgggaaagtttgcggtgcaactgggtgggcaaggaggagaggacttggggatgctctgtgctgagctccggggtccagagcagggtggggactgccgttggggagagggccggcccctcattgagaggctcgggggccacacctctgctgcgggactctgaccgagggccagggcctctcaagccacccggccgcagcatagataccggg

SEQ ID NO: 72499 - DNA, 92 bp, Homo sapiens; identical to SEQ ID NO: 10731
  misc_feature 1..92: note = chr11:19367267-19367359
  misc_feature 1..92: note = hyper
  source 1..92: mol_type = genomic DNA

SEQ ID NO: 72500 - DNA, 127 bp, Homo sapiens
  misc_feature 1..127: note = chr11:19367810-19367937
  misc_feature 1..127: note = hyper
  source 1..127: mol_type = genomic DNA
ctgctgtgcttgtgtcggtctgtgcctctttgctgtgcctgtctgtccatacgtgtgtatgtgttggtgggggtggtgtaggtggatcggatccgagccaagccgggggcaactaggccaggcctgc

SEQ ID NO: 72501 - DNA, 39 bp, Homo sapiens; identical to SEQ ID NO: 10733
  misc_feature 1..39: note = chr11:19367938-19367977
  misc_feature 1..39: note = hyper
  source 1..39: mol_type = genomic DNA

SEQ ID NO: 72502 - DNA, 120 bp, Homo sapiens; identical to SEQ ID NO: 33684
  misc_feature 1..120: note = chr11:19368011-19368131
  misc_feature 1..120: note = hyper
  source 1..120: mol_type = genomic DNA

SEQ ID NO: 72503 - DNA, 88 bp, Homo sapiens
  misc_feature 1..88: note = chr11:1940385-1940473
  misc_feature 1..88: note = hypo
  source 1..88: mol_type = genomic DNA
tccatggggggtctccgaggcctcaggctgcttcctccccgggggagacagcgaagggcctggggcattgggccgggcggcgggaggg

SEQ ID NO: 72504 - DNA, 298 bp, Homo sapiens
  misc_feature 1..298: note = chr11:1945862-1946160
  misc_feature 1..298: note = hypo
  source 1..298: mol_type = genomic DNA
ggaagggtcttcgtgcgacatgtctctgaagacccctcagtgccagccttgtttccgggtgcactcagagccggggcttcccgcaggccctgtgggttctgtccccgttctcacttgtgtcacctgcagagcaggacttaacaagggcccccgtgcacaggcgcctccaggcatgggaataccaggcccccaggagggtgggaggggcctcagaacccctctcaggggccgggcccagcccagctgacagtgaccagctctgctggtgggagtccgtgctccccggggctggccagag

SEQ ID NO: 72505 - DNA, 34 bp, Homo sapiens
  misc_feature 1..34: note = chr11:1947562-1947596
  misc_feature 1..34: note = hypo
  source 1..34: mol_type = genomic DNA
gtcttgctcgctccccgcacgcaccccaccctcg

SEQ ID NO: 72506 - DNA, 39 bp, Homo sapiens
  misc_feature 1..39: note = chr11:1949943-1949982
  misc_feature 1..39: note = hypo
  source 1..39: mol_type = genomic DNA
gggctgcacccaccccggctgcaacgccctcttggtgga

SEQ ID NO: 72507 - DNA, 284 bp, Homo sapiens
  misc_feature 1..284: note = chr11:1950350-1950634
  misc_feature 1..284: note = hypo
  source 1..284: mol_type = genomic DNA
caccgcagaggaggacgcggaaggtaagggcccgtccctgccgccggaggtgcaggaccctggctctagccgacgcgagggaaagaggacaggctggggtctctcgctgccctgcctcctcctccctctgtcctctttctcttcccctggcacgggggcctcggagggccaggccttgctgctccgcacggtgccgctggggtcgagctgccagggcctcgcgggtgccaccgctccaagtttctgccacacagcggagggggagtaagcgggaccagccagca

SEQ ID NO: 72508 - DNA, 240 bp, Homo sapiens
  misc_feature 1..240: note = chr11:1955151-1955391
  misc_feature 1..240: note = hypo
  source 1..240: mol_type = genomic DNA
tggctgcaggagaagcgccgtgcagagagagcggagcagcagaggattcgtgcagagaaggagagggagcgccagaacagactggcggtgagggcaccatccgcactgctgcctcatcagagaatgagccccaggcccagagaaatgcagggggctgaggccttccttctcccggggttcccattgtcattggccaatgatcagaaccactggctaaggccccggcgccctgcagaaccc

SEQ ID NO: 72509 - DNA, 179 bp, Homo sapiens; identical to SEQ ID NO: 43031
  misc_feature 1..179: note = chr11:19567961-19568140
  misc_feature 1..179: note = hypo
  source 1..179: mol_type = genomic DNA

SEQ ID NO: 72510 - DNA, 1139 bp, Homo sapiens
  misc_feature 1..1139: note = chr11:1957221-1958360
  misc_feature 1..1139: note = hypo
  source 1..1139: mol_type = genomic DNA
gggctggccctgagacgggcttcacggcacaggacccaggtccttcccatgctgtgttcccagagctgaatcagggacccactggctttggatagatgcggccacagcgggcccccaggggctccagagcctggagggccatcaccaggccaagctagcccacagccgggcctcgatgccccagccgcccatccagccttgtaaccatcttggtctttctagatcatgaatgtccgggccagagtgcagatgctggccaagttgtaagtagccgggtccgccctgggccaggcccgtgggtgtgcgttgcacggtgaggtgaacctctcgcatggcaaaaacctggatcgctcaggatgctggcggcagggggcctggagccttcctcctgcccccgctctcccctcgtgcctgcagccgggggcttcccagtggccgctgccctgttggcaagcgaggaagggcccccaccttcccaggagctccgcctcaagccagcagcggccacagagtgcccctgggcacaggcacgagggcgggagcggctggcccaggagcagcagggccgttcggagctctgagctcagcggctgaagggagctggagctgagaaggaggggtccgcaggcctcacctgcaacccctccccagccccatccgtgctccgtaccccccgccccacatcctgccgcaggctgaaggtaagtggccagctacgggctgctgtgtgtggcagtccaggccagtacaggctggcgagagtaagtccaggcatgagcccaggggccacgggacggtgtccccctgcacaaggagccaggagacagtaagggagccgaggagccctcatgggggcccagcagccctgggtcgcgcagcccagcccaccctgcggtggagacaggccttcacccagtacacgcaggcctggccctcgggtcgtcgcagtgagtcactcatgttgttcacagatcaccacgctcaggagccgcattgaccaggcccagaagcagtgagtagccctgccgtcctcgctccgcactgggcacaggggcccttggggccagccgctgtagccagtccctaacaagggccggtggtggctggcctcggcagggcagtaacgagactaacccggc

SEQ ID NO: 72511 - DNA, 605 bp, Homo sapiens
  misc_feature 1..605: note = chr11:1958714-1959319
  misc_feature 1..605: note = hypo
  source 1..605: mol_type = genomic DNA
cctcatccataaaatcgtgtccctgggggctgtgggatcccttgacacagctactcgaccacctgcatggggctgcacccagggtgcccccggcgatgccacgctggggatcctgtcatggagcccagctgcacagccagtgccatttccccaaggatcgcagtgtttgggggctacttggagtttcgatgttttctgggattcttctccctcctcctgtcgccttggcttccctgcggcgcccagggcgggctcctccgtggtgcacgtgacctcacggcctccctgttgtgccgtcaggggtcattgcagacccctctgagggtgggcagtcggcgtggtgtgcatgtgcctgcgtgtgtgcatgtgtgcatgtgccgagagtgcccaggaacgtgtgtgagggcacggcctttgccagccaggtgtcctgctgagcagccgcgtctgaatggggccggcctcgcgggccgaagcactcctgtcctccacccgccttcacccctcacccgcacccagctcctcccggctcgtggccacatgaagacctcagacaaatggggcaggctcctgggcccctcagaggccaccgtctggaggggcat

SEQ ID NO: 72512 - DNA, 123 bp, Homo sapiens
  misc_feature 1..123: note = chr11:1959951-1960074
  misc_feature 1..123: note = hypo
  source 1..123: mol_type = genomic DNA
tctgcatgggggccccggaggacacgagaggaggcaggtaggggctagccaatggcacagcgtcctggtcatccgcggggccagctcaggagggcactggccagtacgcgcagggccagctca

SEQ ID NO: 72513 - DNA, 30 bp, Homo sapiens
  misc_feature 1..30: note = chr11:1963030-1963060
  misc_feature 1..30: note = hypo
  source 1..30: mol_type = genomic DNA
ggcatggcaagtgtgcggggtcagcacgtg

SEQ ID NO: 72514 - DNA, 93 bp, Homo sapiens
  misc_feature 1..93: note = chr11:19734973-19735066
  misc_feature 1..93: note = hyper
  source 1..93: mol_type = genomic DNA
gagaggtgtgagacccggcggcagcatccgtccaggtgggacccgctgagcgccgtggccagtcccccattcccatcccggcaccccaaaggc

SEQ ID NO: 72515 - DNA, 80 bp, Homo sapiens
  misc_feature 1..80: note = chr11:19735404-19735484
  misc_feature 1..80: note = hyper
  source 1..80: mol_type = genomic DNA
agatccccctgaaatcgcaggtgctgcaggggctgcaggagccagcgggggaggggctcccgctgcggaagagcggctcg

SEQ ID NO: 72516 - DNA, 51 bp, Homo sapiens
  misc_feature 1..51: note = chr11:19735709-19735760
  misc_feature 1..51: note = hyper
  source 1..51: mol_type = genomic DNA
gccttaagagctcttcgagacctgggatggcgggcacgtctgcagcatctt

SEQ ID NO: 72517 - DNA, 30 bp, Homo sapiens; identical to SEQ ID NO: 42838
  misc_feature 1..30: note = chr11:197439-197469
  misc_feature 1..30: note = hypo
  source 1..30: mol_type = genomic DNA

SEQ ID NO: 72518 - DNA, 105 bp, Homo sapiens
  misc_feature 1..105: note = chr11:1975964-1976069
  misc_feature 1..105: note = hypo
  source 1..105: mol_type = genomic DNA
aactccagaacaaaccgctgccgccagctgggccgagctccgtgctcggggctccggcctccaggtccaggcaggcggcagcccccagggcgccctgggattcct

SEQ ID NO: 72519 - DNA, 30 bp, Homo sapiens
  misc_feature 1..30: note = chr11:1977320-1977350
  misc_feature 1..30: note = hypo
  source 1..30: mol_type = genomic DNA
cattccaggcagggacgctgccccaggagg

SEQ ID NO: 72520 - DNA, 35 bp, Homo sapiens
  misc_feature 1..35: note = chr11:1980528-1980563
  misc_feature 1..35: note = hypo
  source 1..35: mol_type = genomic DNA
tctccaagagccctgcgtgccgcacccatggagct

SEQ ID NO: 72521 - DNA, 335 bp, Homo sapiens; identical to SEQ ID NO: 42963
  misc_feature 1..335: note = chr11:1981002-1981337
  misc_feature 1..335: note = hypo
  source 1..335: mol_type = genomic DNA

SEQ ID NO: 72522 - DNA, 30 bp, Homo sapiens
  misc_feature 1..30: note = chr11:1981581-1981611
  misc_feature 1..30: note = hypo
  source 1..30: mol_type = genomic DNA
ctgcagtgccctgtgcgtggtggccagggc

SEQ ID NO: 72523 - DNA, 30 bp, Homo sapiens
  misc_feature 1..30: note = chr11:1983138-1983168
  misc_feature 1..30: note = hypo
  source 1..30: mol_type = genomic DNA
ggccggctccacagacgtccctaccgtgga

SEQ ID NO: 72524 - DNA, 61 bp, Homo sapiens
  misc_feature 1..61: note = chr11:1983778-1983839
  misc_feature 1..61: note = hypo
  source 1..61: mol_type = genomic DNA
gactgctggggcccccgtgttccagcctctcctgcgcctccagatacggctgcttcctggg

SEQ ID NO: 72525 - DNA, 30 bp, Homo sapiens
  misc_feature 1..30: note = chr11:1984105-1984135
  misc_feature 1..30: note = hypo
  source 1..30: mol_type = genomic DNA
attggccctggcctccgtggacgctggggc

SEQ ID NO: 72526 - DNA, 76 bp, Homo sapiens
  misc_feature 1..76: note = chr11:1986000-1986076
  misc_feature 1..76: note = hypo
  source 1..76: mol_type = genomic DNA
agagagggggagggccgagcccggcctcgcaggtctcatttcccgtctgcgcgtgcgtgggcgcgagtgaggggtg

SEQ ID NO: 72527 - DNA, 30 bp, Homo sapiens
  misc_feature 1..30: note = chr11:1992236-1992266
  misc_feature 1..30: note = hypo
  source 1..30: mol_type = genomic DNA
gcctcctgagcatcccgatccgggccaagt

SEQ ID NO: 72528 - DNA, 35 bp, Homo sapiens
  misc_feature 1..35: note = chr11:1993637-1993672
  misc_feature 1..35: note = hypo
  source 1..35: mol_type = genomic DNA
ccccgcaccccacctcgtgccgggcaccgccatgt

SEQ ID NO: 72529 - DNA, 116 bp, Homo sapiens
  misc_feature 1..116: note = chr11:1996568-1996684
  misc_feature 1..116: note = hypo
  source 1..116: mol_type = genomic DNA
aaaggcccacattgccgggcacacaccagggtggccagggattggtcactgcctgaatgtccccggaccgatgcccgtgtgcccttgggcagccttcccctcggacaggctgtcca

SEQ ID NO: 72530 - DNA, 30 bp, Homo sapiens
  misc_feature 1..30: note = chr11:2000619-2000649
  misc_feature 1..30: note = hypo
  source 1..30: mol_type = genomic DNA
agcacccctccctcccggcaggccggtctg

SEQ ID NO: 72531 - DNA, 30 bp, Homo sapiens
  misc_feature 1..30: note = chr11:2011824-2011854
  misc_feature 1..30: note = hypo
  source 1..30: mol_type = genomic DNA
ctttgcctccagggccggccccactctgtt

SEQ ID NO: 72532 - DNA, 673 bp, Homo sapiens
  misc_feature 1..673: note = chr11:20153534-20154207
  misc_feature 1..673: note = hyper
  source 1..673: mol_type = genomic DNA
caatacccctccctccgacaaccagaaacaaatacccagcgcccagatccacaccagcagcaacccagagctccagtctgaggatgagactgttccagggccacagaaaagaggaaaacctcgggcagatggtgagggaagggaacctccgtgttcaggacacctccgcccatccacattcggcctggcaccgatcctgcggaatctctccccaacgcacggtttctacactggaacgattgaaactaagggggtgcgccaactcccccaccttcgcgggtcccctggcaggagacctggtccttgccttaccgcagtaggtgtggctgtgactgaagggagcggcatccctgagcacagtcggagacaaagggaggcgagggccaaccccagcccggaaactctgccctgtaactcggccaaaggagacgccgcattggagcggctgttccgcagcaccatgctgtagaaggtacgttcctctgatgccctgtgcgcaaacccctagccagccttcccacactgccaggataacccttttgaaacctcccctgtttgggacaggccgtgctcccaccttttattggagacgaggcgaacctgggcttagggcgccacctagagccaaaaaagaggaagcgacctggccgcgaagcttcgctaggcaaggatg

SEQ ID NO: 72533 - DNA, 250 bp, Homo sapiens
  misc_feature 1..250: note = chr11:20177593-20177843
  misc_feature 1..250: note = hyper
  source 1..250: mol_type = genomic DNA
tctctttggggctaccgcagggccggtggcgccctcaatgaggtgatggtttctaccgtcgggagaggcagcatctgggcacggggacaaagtgaatgcgcagactggaccccacctcttcgatttcaaagcacttaaaaatagtactctggcgtgcgagcggcttctaggacacggtgatttcctcctgttcctcgccctcctcttcctcctcggaatctgagaagtccgaaggtttcccgggactgct

SEQ ID NO: 72534 - DNA, 910 bp, Homo sapiens
  misc_feature 1..910: note = chr11:20178093-20179003
  misc_feature 1..910: note = hyper
  source 1..910: mol_type = genomic DNA
cgtcggttctggaaccagattttcacctggaatgtcccggccggcgagaagaagggagaagcagaggtcagatcaggggctccgggggacgcacgggggcggggagtggagtcgggtgcaggctctgtccttcgggctgtgtcctctccccacccccagaaatgagttccggtggattcccgcattgactccgcccccgcctcagctcgcggttccgtttgcctcatccgctgccaccctgccccgaagggcggggttgggggccggtgaggccgggagagaaggcggggagtcggggtggggagagaagagggctatcctgcggagcttcgagggtagtggcccgtgtactcactccctctctaggcctcggttttcccatctgtacagtgggacctaagccgtttccgaacccttgcaattgacgggtgcgccggggaggggtgaagggcgggggcggggggggtgctgtggaggaaatgcgctcacctgcgagtctttcaggcccagcttggccgccagcttcttgcggtcgggcttgctgatgtacttctgcttctggaacatcttctccagcgccttccgctgcacgtcggagaagactgctcgacgcagcatgccccgccgaggcttcccgcgcgcggccagcggccaggagaaggtcccggggatgggcaccacgctggaggaagctgcagggtggggggaggtggcgagtgagtgggcgtacgccccccagtcccaacacggctctccctggctttttgctctgatcccttcatctctttaaaacgctcctttttctccccctggagaataggccacgaacctacaaacctgcgagagtgaaaggcgctttccgcccaaacaactttccctttcaaccgtgcaaacccggattaggtaaaac

SEQ ID NO: 72535 - DNA, 30 bp, Homo sapiens
  misc_feature 1..30: note = chr11:20179512-20179542
  misc_feature 1..30: note = hyper
  source 1..30: mol_type = genomic DNA
actgaggacaagcagcgaaagccatatatt

SEQ ID NO: 72536 - DNA, 506 bp, Homo sapiens
  misc_feature 1..506: note = chr11:20180320-20180826
  misc_feature 1..506: note = hyper
  source 1..506: mol_type = genomic DNA
tggagggactagggccggtctgtgtgtggctgcccggaggagctgaccaattggtcatggtgctgaaacctttgtggggaatcgtggccaagtgcactgactctgtgggaaaacggcggcgtgaagggatgccaacagctcctcgccgggaagggaaccgcctcaaattgggaccatgacaattcctgctaatttgtagagcagggaattggtgcaaagtgtcaagcagtcactgcttgtgctcaatagggcatcaaattggcgcgacggattcatgaatgttatacgcctcgcaacctctgaaccagagcataaccccgaggggtggacggagaaatacggcttcggagcagggagcgatgggccggggctggggcgccgccctgcctcgcgcaaagaagggggacgagacctacctgggaaataagaagatctgatgaaaggctgaaaagacccttcgaagtagggaaaggcgaaggtcttgggagggacgctctggagcaagg

SEQ ID NO: 72537 - DNA, 459 bp, Homo sapiens; identical to SEQ ID NO: 33694
  misc_feature 1..459: note = chr11:20181185-20181644
  misc_feature 1..459: note = hyper
  source 1..459: mol_type = genomic DNA

SEQ ID NO: 72538 - DNA, 353 bp, Homo sapiens
  misc_feature 1..353: note = chr11:20181724-20182077
  misc_feature 1..353: note = hyper
  source 1..353: mol_type = genomic DNA
cggctgatgcggatcagatcctccaccaggaagctggagtggccggaaaatgccgactgcaaggactggggcagcgtcaaggtgggcgtgggccgcaggaggctagggtacccggcggggggcgcgaggaggccggggaacatcatggtaggcgcgggcgggcgaaataacccttctttcagtggccggagggtaaacgcctcgcttcccgcccctcccgcccccacagtgtcctctctcttgggcttagcaaacgtctccaagtaacaatcccacttgggcgtctgcgagtcctccgtggtcctctcgtcgaggtgatggttttatagtggcccgcccgctaaagcactttg

SEQ ID NO: 72539 - DNA, 280 bp, Homo sapiens
  misc_feature 1..280: note = chr11:20182831-20183111
  misc_feature 1..280: note = hyper
  source 1..280: mol_type = genomic DNA
ctgcaaggggctgtccgcacctcaccttgcgggaggagcggaggagagcggcgctgggctgccgagcggcaggattccgcttgcaaagagcttaggctgaccggaaactgcctcgggcaagggtatccaaaggctgtgagtgctatgctggccgttctccaaacacagggagctctcggcagtttaagttgaaactcacagccctgacattttaagccatagcagcgaaggtccagacgtcgtctggagagaaccctaccacttgcggggcccttaactt

SEQ ID NO: 72540 - DNA, 382 bp, Homo sapiens
  misc_feature 1..382: note = chr11:20183391-20183773
  misc_feature 1..382: note = hyper
  source 1..382: mol_type = genomic DNA
agaagtgtgcagccccgccaggccgccctgatcctattaaccatgaactaactgtcaccttcagctggttttcctttttgctttttaacacaaagctttctcaaaaatcttattaaccagctttatttctctcgatggttttgttcggggtgttttgtgttgatgatctccatgtcgctgctttaaccattcaataaaagtgcatctgcgatttatatcacattaaaccagaaacggagccggctaaaactctcccttgattcaaattaaaaagttatttagggcccagctccagaggcgaattaatgctagaagatgacgtaagtgcggagtttctgagcccaagaccgctcatgctcatgggcagcgggagaaaaccaat

SEQ ID NO: 72541 - DNA, 35 bp, Homo sapiens
  misc_feature 1..35: note = chr11:20184112-20184147
  misc_feature 1..35: note = hyper
  source 1..35: mol_type = genomic DNA
cagttcccagaaggacgcgccgggggcttcaggat

SEQ ID NO: 72542 - DNA, 987 bp, Homo sapiens; identical to SEQ ID NO: 33700
  misc_feature 1..987: note = chr11:20184500-20185487
  misc_feature 1..987: note = hyper
  source 1..987: mol_type = genomic DNA

SEQ ID NO: 72543 - DNA, 30 bp, Homo sapiens
  misc_feature 1..30: note = chr11:20185714-20185744
  misc_feature 1..30: note = hyper
  source 1..30: mol_type = genomic DNA
aatatagcttggcctcgctgaccgaaacaa

SEQ ID NO: 72544 - DNA, 379 bp, Homo sapiens
  misc_feature 1..379: note = chr11:20229217-20229596
  misc_feature 1..379: note = hyper
  source 1..379: mol_type = genomic DNA
gccttggcctcccaaagtgctaggattacaggcgtgagccccggggccctgccagaaaggaggctttttaccaacaaattttaaaaagaaacaacaaaccaaagaattttgccatggacagtggcaaagtatctgctgtgctgtttctgaccctccataaaaatcatgttcagaaatggtaaaaaggctaacgaagatcaaacaagaagagacagaatcacgggcgaagggggcgcattcagggttttctggacgtcaggaagggaccgcggtggggtgctttagaagtggccggagcccgcacctgcatgcagctcgcgcagaaagcgcctggacgctcccttaggaccgtttgcattctggccgctcgacaaaaaca

SEQ ID NO: 72545 - DNA, 120 bp, Homo sapiens
  misc_feature 1..120: note = chr11:20229900-20230020
  misc_feature 1..120: note = hyper
  source 1..120: mol_type = genomic DNA
agccaaagaccgaagcggcgccctgcaagttcttcccaagtcctcttgggaaaggcgagcctgagagggagaggcgcttttcaccaaaaggtgttttgcagagggcgggagggagctccc

SEQ ID NO: 72546 - DNA, 112 bp, Homo sapiens; identical to SEQ ID NO: 33702
  misc_feature 1..112: note = chr11:20230398-20230510
  misc_feature 1..112: note = hyper
  source 1..112: mol_type = genomic DNA

SEQ ID NO: 72547 - DNA, 205 bp, Homo sapiens
  misc_feature 1..205: note = chr11:2036933-2037138
  misc_feature 1..205: note = hypo
  source 1..205: mol_type = genomic DNA
cggagaggcctgagccgggagggcacacctgcctttctctcctgccactccgcaggagccacttctgcccatcccagaaccagccctcagggcaggcttggtgccaccgctgtgctgggtgtgcacgatgcccgtgggccgccggctcccctccgtgctaatgccaccctccaaagccatggcttcctctcgagccttgggtgtc

SEQ ID NO: 72548 - DNA, 81 bp, Homo sapiens
  misc_feature 1..81: note = chr11:20386484-20386565
  misc_feature 1..81: note = hypo
  source 1..81: mol_type = genomic DNA
cttgtgtctgtaaatcggatattcccttcactctaagttaaaggtttttttttttttttttctgagacggagtctcactct

SEQ ID NO: 72549 - DNA, 182 bp, Homo sapiens
  misc_feature 1..182: note = chr11:2040029-2040211
  misc_feature 1..182: note = hypo
  source 1..182: mol_type = genomic DNA
cctccagaggggccccgccacagtccatccccttcgcccaggtcccctcggatcagggcctgccagggtggtgtggcaaaggggcctgcatcgcgccaacctctcgcagctctccagcgggtgcagccaggctctggcccccacacgcttgggctttgctcccttcccgttttatgaggaat

SEQ ID NO: 72550 - DNA, 249 bp, Homo sapiens
  misc_feature 1..249: note = chr11:2042252-2042501
  misc_feature 1..249: note = hypo
  source 1..249: mol_type = genomic DNA
actctgcccgcagcccgtcttgctgcagttaccattggctcctgcgtctggggcacccacgtcacacccttcatctgctcagtcagcccgaggcagctcccagcctcaggaaagcccagaagcaattggaagagtctgggggtgggaggcgcgaggacatcggacagacctggcgcggccgggcggtgcaggcctgcttcagccttctttggcctgggcttgaaggcaggcctgcgcctgaggggtctg

SEQ ID NO: 72551 - DNA, 30 bp, Homo sapiens
  misc_feature 1..30: note = chr11:20486737-20486767
  misc_feature 1..30: note = hypo
  source 1..30: mol_type = genomic DNA
caatgtagccagaaacgttagattattaaa

SEQ ID NO: 72552 - DNA, 83 bp, Homo sapiens
  misc_feature 1..83: note = chr11:2048975-2049058
  misc_feature 1..83: note = hypo
  source 1..83: mol_type = genomic DNA
gactaggcaacatctcgccactgcccacgccagcaccaaggcctgtcctctccaggcggtgccctcgccggtcctgctggctc

SEQ ID NO: 72553 - DNA, 36 bp, Homo sapiens
  misc_feature 1..36: note = chr11:20595699-20595735
  misc_feature 1..36: note = hypo
  source 1..36: mol_type = genomic DNA
ccatagagacagcaccggggaaagtgagagtttcag

SEQ ID NO: 72554 - DNA, 211 bp, Homo sapiens
  misc_feature 1..211: note = chr11:20618182-20618393
  misc_feature 1..211: note = hyper
  source 1..211: mol_type = genomic DNA
ctggctaattcagaccgaatggctgcgcggtgatggatgcggatttacggcctccttggctgcggcgcgctgggcctgattatcactataaacaggcgtccgcggagggcgggggcggaggcccgcgtctagaggacgtgcggctggtcttcttcttcttcttcttctttttttttgtttttgttttttaatactgcggttccatcctctg

SEQ ID NO: 72555 - DNA, 503 bp, Homo sapiens; identical to SEQ ID NO: 953
  misc_feature 1..503: note = chr11:20618422-20618925
  misc_feature 1..503: note = hyper
  source 1..503: mol_type = genomic DNA

SEQ ID NO: 72556 - DNA, 755 bp, Homo sapiens; identical to SEQ ID NO: 33705
  misc_feature 1..755: note = chr11:20619219-20619974
  misc_feature 1..755: note = hyper
  source 1..755: mol_type = genomic DNA

SEQ ID NO: 72557 - DNA, 54 bp, Homo sapiens
  misc_feature 1..54: note = chr11:20620247-20620301
  misc_feature 1..54: note = hyper
  source 1..54: mol_type = genomic DNA
cattgctgggcatcccgatttggacggtctctaaggtcccgcgctgccaaatca

SEQ ID NO: 72558 - DNA, 260 bp, Homo sapiens
  misc_feature 1..260: note = chr11:20621539-20621799
  misc_feature 1..260: note = hyper
  source 1..260: mol_type = genomic DNA
aatgctggctgaagccgaggtacctagatttgtgcaaatcgaggagttctattctgcgtgtttgtgaaagggggttagacgagaggagtgcggtggaggcgaagataataggattattcttacagtgtaataataattattggtgctaatgtttaggaagccgtgaaagataacacgaggggagaaagtggatagaaaaaccaccgctggcagttcttttcatttgaaagtgaattgggaaaaagcgaataaaaattagt

SEQ ID NO: 72559 - DNA, 215 bp, Homo sapiens
  misc_feature 1..215: note = chr11:20622578-20622793
  misc_feature 1..215: note = hyper
  source 1..215: mol_type = genomic DNA
tctggacctgagttgcgaacgtctccatatctagatacaggtattttaaaagctgttgtgactttgttttgcacgaacttgacattgtgtttgcaggattgcagtgctcccaaggaaatgaataaactgccagccaacagcccggaggcggcggcggcgcagggccacccggatggcccatgcgctcccaggacgagcccggagcaggagcttcc

SEQ ID NO: 72560 - DNA, 370 bp, Homo sapiens
  misc_feature 1..370: note = chr11:20623258-20623628
  misc_feature 1..370: note = hyper
  source 1..370: mol_type = genomic DNA
cgcgagagaggccagccgggccgtggcgggtgcacgtatgctgatggggaaaccggttggcagtgccaggtgatggatgcgggaggcggctttggggcttcggaagctcgcactgcgctggggtcggcagttcagggcgcgagggctgcagtgaccctgccagaggggccacgacctgccccttcccagccttggcggtagcgggaatacaggtccagatccacgaaagagttgaggaagatagattccacccttttatgcagacagactccctctcctgccaatgactgtcttttcttttcaaaaataatttcttaattaaacaaaaagagggttaaaattcagaacaaagccacgtggtggtggctgg

SEQ ID NO: 72561 - DNA, 19 bp, Homo sapiens
  misc_feature 1..19: note = chr11:20672510-20672529
  misc_feature 1..19: note = hypo
  source 1..19: mol_type = genomic DNA
cagacgcctgttcttattg

SEQ ID NO: 72562 - DNA, 490 bp, Homo sapiens; identical to SEQ ID NO: 33710
  misc_feature 1..490: note = chr11:20690388-20690878
  misc_feature 1..490: note = hyper
  source 1..490: mol_type = genomic DNA

SEQ ID NO: 72563 - DNA, 104 bp, Homo sapiens; identical to SEQ ID NO: 33711
  misc_feature 1..104: note = chr11:20690982-20691086
  misc_feature 1..104: note = hyper
  source 1..104: mol_type = genomic DNA

SEQ ID NO: 72564 - DNA, 40 bp, Homo sapiens; identical to SEQ ID NO: 956
  misc_feature 1..40: note = chr11:20691121-20691161
  misc_feature 1..40: note = hyper
  source 1..40: mol_type = genomic DNA

SEQ ID NO: 72565 - DNA, 218 bp, Homo sapiens; identical to SEQ ID NO: 957
  misc_feature 1..218: note = chr11:20691162-20691380
  misc_feature 1..218: note = hyper
  source 1..218: mol_type = genomic DNA

SEQ ID NO: 72566 - DNA, 185 bp, Homo sapiens; identical to SEQ ID NO: 958
  misc_feature 1..185: note = chr11:20691431-20691616
  misc_feature 1..185: note = hyper
  source 1..185: mol_type = genomic DNA

SEQ ID NO: 72567 - DNA, 1210 bp, Homo sapiens
  misc_feature 1..1210: note = chr11:20691747-20692957
  misc_feature 1..1210: note = hyper
  source 1..1210: mol_type = genomic DNA
cgcagagggagcgcttccggctggcgggcgcggccggggcccgggagggcgcggtgcggcgagggcagagagctgcgggagaaccctgggatcccgcgatctcctcctgtgccttcctgactacccaggagaactccaggagtattctcctccgcctgtctttgctcccaagggctgggcgaacaattatctgagggaaatagagcagtggagacaatctggggaaattttctcaagctcaaaccagttttctcttgccataatcgcagggttccgtgtggggaggggggagcaaggatgacgcttgattgtctgaagtccccacttcgttctgcctccggagacgcagttgtgaggactctcagcgcatcttcttccttctgcttccaccggctcccttgcccaaaagtcccctggggttcggagactggcttgcagccgccttcttcaaagagctagtagtagatgcggggagactggggtgaggtgaggtggggtgagatgtaggaaattggcaaaaatagggcctgtcaactggggggagtgtcggaggtttgcaatcctacccagccatcctccgtacgcgctgcaccccagaatctgtgtggtcattccctttccctttattctcccccctttaccatccttatttccttctttagaggcgtggccttctctctaggccaaagagcaagttcatctggagagggctaagaaggggcgtctgcacttggttggctcaaaagttccctccgcttgcgcccaggcgcccctctttggcagttagcccgctggaagatctagcgtctaggagctttcagagggcccttcccacttccccaggactgagcaggcagcggctttcgtctggttaagaatgttgaatatggatttctcaagggacaaaagaaacctcccattccgttccttacctctatccgagcttcccaggctgcggagacgccaaggctcagtctagcttagaatagttgcttcttgagttcaggcccatccggatgggttagtcttttaaaaccaggacacgctgaaggagtgcgcgcaccccaggaagatcaggacaggcaagactagtgcagagcgtgggctactggctctgagcgcgagagtctggtgctcgtggacatcttacagaggaaccgcagacaggaagaagctaggtagggagggggcaacccgttagtgagttcac

SEQ ID NO: 72568 - DNA, 27 bp, Homo sapiens
  misc_feature 1..27: note = chr11:21017124-21017151
  misc_feature 1..27: note = hypo
  source 1..27: mol_type = genomic DNA
aaaaaaaatcagcgtctataaattgct

SEQ ID NO: 72569 - DNA, 55 bp, Homo sapiens
  misc_feature 1..55: note = chr11:2108054-2108109
  misc_feature 1..55: note = hypo
  source 1..55: mol_type = genomic DNA
cccaaagccagaccacggcaagcgctgggcgtgggggagtcggagctgcctgtgc

SEQ ID NO: 72570 - DNA, 30 bp, Homo sapiens
  misc_feature 1..30: note = chr11:2109282-2109312
  misc_feature 1..30: note = hypo
  source 1..30: mol_type = genomic DNA
ctaggggagggaatgcggagtcggtgttcg

SEQ ID NO: 72571 - DNA, 132 bp, Homo sapiens
  misc_feature 1..132: note = chr11:2109525-2109657
  misc_feature 1..132: note = hypo
  source 1..132: mol_type = genomic DNA
agtgatcaggttactcgatttggtgcagttagaaaagttcgtcactgtttaagcaaataggaaagccgtttatcctgcctagctgtgagaaaatcccctagcgtctttgaaactcttcgggagcgcccccct

SEQ ID NO: 72572 - DNA, 30 bp, Homo sapiens; identical to SEQ ID NO: 42969
  misc_feature 1..30: note = chr11:2110642-2110672
  misc_feature 1..30: note = hypo
  source 1..30: mol_type = genomic DNA

SEQ ID NO: 72573 - DNA, 132 bp, Homo sapiens
  misc_feature 1..132: note = chr11:2122361-2122493
  misc_feature 1..132: note = hypo
  source 1..132: mol_type = genomic DNA
tacagagccgagcagcgggagggaccaccctgccaggccaagggaggaagacccggggcctccagacacagtgtaccagaggagaacccttcccatccagcatggccaagcgggacccgtgtggcacttgaa

SEQ ID NO: 72574 - DNA, 153 bp, Homo sapiens
  misc_feature 1..153: note = chr11:2131777-2131930
  misc_feature 1..153: note = hypo
  source 1..153: mol_type = genomic DNA
tgggtaaacacacagcggtacctctatgccgaggaatgttattcggtgctaaaaagaagttagctgtgagccgcaagaagacatggaggagcaccaaatgcatgatactaagtgagagaagccactctgcaaaggctacgcccgtaggattcc

SEQ ID NO: 72575 - DNA, 61 bp, Homo sapiens
  misc_feature 1..61: note = chr11:2133266-2133327
  misc_feature 1..61: note = hypo
  source 1..61: mol_type = genomic DNA
aaacaaagcaagttccgtgagaagagtgagatgtctttgcactttgcgaatctctgtggct

SEQ ID NO: 72576 - DNA, 58 bp, Homo sapiens
  misc_feature 1..58: note = chr11:2150685-2150743
  misc_feature 1..58: note = hypo
  source 1..58: mol_type = genomic DNA
acgcaaggggctggtcggcaagtgcccccgggaacacccactccggcgaggcagaata

SEQ ID NO: 72577 - DNA, 170 bp, Homo sapiens
  misc_feature 1..170: note = chr11:2151064-2151234
  misc_feature 1..170: note = hypo
  source 1..170: mol_type = genomic DNA
aggccgagtccctgccgcagccctaggcgccgcggtggtggctgctatggcatcaccagacccgtgggctccggggcccaagcaacctggtcgatgggcagacctggcagctctcctgctctgtgggctcagacccgcctgacctccctactccccggcctcaccccacc

SEQ ID NO: 72578 - DNA, 322 bp, Homo sapiens
  misc_feature 1..322: note = chr11:2152269-2152591
  misc_feature 1..322: note = hypo
  source 1..322: mol_type = genomic DNA
gtaagtaaggtgtatcgggaatgggtggggtatggggagcatcgtggctcacgctgcgggggccgtggggacaggcgccaaggaggccagcctcacaagggcatctctgtcatggtggaaagatggaattaggcctgggacacaccccgcccaccctacgggtgtatcccaaatgccgccggccgcacactcaggccgcaccatctgagccccctcctctgagaggcagggcacagacagggccgaggggcagtggagatgggaacaggagcggggctcagaccatgaaaacattggagaatcttagcgggactttggcctg

SEQ ID NO: 72579 - DNA, 95 bp, Homo sapiens
  misc_feature 1..95: note = chr11:2156024-2156119
  misc_feature 1..95: note = hypo
  source 1..95: mol_type = genomic DNA
gaggaaaggctgaagcgtccttgaggtcagcaggtgggcaccccccacggcagccttggggcccaaggaggcgcatgcaccgctcacccctgcca

SEQ ID NO: 72580 - DNA, 82 bp, Homo sapiens
  misc_feature 1..82: note = chr11:2187516-2187598
  misc_feature 1..82: note = hyper
  source 1..82: mol_type = genomic DNA
ggtggcagcacaggccgtgggaggctccgctccagccccgccctatgccgcgcgaccctcggggcgccgagcctccttggcg

SEQ ID NO: 72581 - DNA, 572 bp, Homo sapiens
  misc_feature 1..572: note = chr11:2209843-2210415
  misc_feature 1..572: note = hypo
  source 1..572: mol_type = genomic DNA
aacaggagaaaatgccgcaaatcacacacctgatcggggagtagtacccggaacccacagagaacccctaaaacacaaccgccaaacaccagattcaaaagtgggcgaaggacgtagacgggcgcctctccagggaaggtgtatccaggacagcagccgcagggaaaggtgctcaatgccacgaatcattagggcaatgccaatcaaaatcacggcgcgacaggattccacacccgttagggtggccaccgtcaacaaacccaaacaatgcagaacacaaaatagcaagtgctcacgagaatgtggagaaatcagagcccctgcggtgggtcgtgccgcagggcagccgctgcggacagcaccctggcagctcccccgcgggttaaagaggcactacaggctgccgcaatcctgttcctacgtggatgcccagaagaaatgaaacctatgtccacccaggaacgtgtgtgtgactgctcacaacagtgttattcactattgctggaaagtggaaccaacccagtgtccgccggctaagagcaaaatgtggtccacgcatacaacggggcacg

SEQ ID NO: 72582 - DNA, 1061 bp, Homo sapiens
  misc_feature 1..1061: note = chr11:22214360-22215421
  misc_feature 1..1061: note = hyper
  source 1..1061: mol_type = genomic DNA
gccggccaacagggccggggggcggcgggtcccgaggagggacgggaggctgcatgtccggaggaggtgcgggaggcggcagagcagggacctggggacggcttgagcggagaggagggggccagcgtggagccagccgggccggggggcggggagatggcggtctccgagggtggggcgccggccggtcttgcggtctggaggcggggaaagaggcgtggaaacagggacgcagcgaaggggaaaggaaagctgccagagggcaggagtggaaaggatcctggcgagcaccgggaggagtggcggctgcgggatcagctgccgagcaggcacagggacaggtgcctggagaagtactgggagagcgcccaggagcgctaccggctgagggtggggaagcgcagggccaagcgcgcgaagcaggttgtgggggaccgggtcgagtggaagtacccgccggagaggaaggccggctggctgtggcgcccagagacggtggagtccgaggaggaggagaaggaggcctgcagaaggaagagcaggcccttagaagtccagcagcagcaactccggcggcccacagtcagattcagcacctgcctcagatctccacgtctgtctcagctgcccctctcctgctgcctctcaggcaccagtgccattaacgagctggcgaagatgggcgacccggatctcctggaagtgttggcggaggaaggtaggaccgcgccaagaggcgtcaagggagagccaggctggctgcctgcacccctccacccgcggcgcagaggccccgggggacgttggcggccctgcggcctgagtcctagggaggttcgctgcgtggcgtgctcagcgcgaaaccgggactgcggggcagagtcccccgcctggggtgagtggggttggtttcggcgccccacagatttctctgctgctcctgcgcgccagggacctgcgacctgtgacccctatggttccggaacaccctccttgctcccctgcaggcctgggaaccgccgagtaattcagggctgctaggctagcgctgcagtgcttgg

SEQ ID NO: 72583 - DNA, 139 bp, Homo sapiens
  misc_feature 1..139: note = chr11:2224689-2224828
  misc_feature 1..139: note = hypo
  source 1..139: mol_type = genomic DNA
tctgtcagctgcaggcgggtggcgggcggccgctctgataaggcctggtccctgcccctgtgcctctgtggggtgccggcacagcaagcctgggacctggccgccggcccctccgccaggtcaccgggaggcctggggg

SEQ ID NO: 72584 - DNA, 30 bp, Homo sapiens; identical to SEQ ID NO: 42976
  misc_feature 1..30: note = chr11:2226048-2226078
  misc_feature 1..30: note = hypo
  source 1..30: mol_type = genomic DNA

SEQ ID NO: 72585 - DNA, 246 bp, Homo sapiens
  misc_feature 1..246: note = chr11:22359172-22359418
  misc_feature 1..246: note = hyper
  source 1..246: mol_type = genomic DNA
ggtttccatagcatccgttcctgaagagcccccgtatggtccttggtcagggcgatccgcccagctcccctagaaagttggcaacctagctagccaaaagaagagtcccctattcctgaaacttactctgtccgtggtgctgaaacattgtaccgagacccgcccagacgggcgctgtcagccgctgaaaaaaaaaatcttccccgaggctgcccaaatcagaactgtgtatcttttatttactca

SEQ ID NO: 72586 - DNA, 15 bp, Homo sapiens
  misc_feature 1..15: note = chr11:22359485-22359500
  misc_feature 1..15: note = hyper
  source 1..15: mol_type = genomic DNA
cgtgatgggaggaga

SEQ ID NO: 72587 - DNA, 136 bp, Homo sapiens; identical to SEQ ID NO: 33720
  misc_feature 1..136: note = chr11:22359746-22359882
  misc_feature 1..136: note = hyper
  source 1..136: mol_type = genomic DNA

SEQ ID NO: 72588 - DNA, 92 bp, Homo sapiens
  misc_feature 1..92: note = chr11:22361451-22361543
  misc_feature 1..92: note = hyper
  source 1..92: mol_type = genomic DNA
atgaaaaaaaaaaaccgcattggctgaatttttttctcccagtaaaaataaattgcaatgttttctaacattgtgatcggactttaagaata

SEQ ID NO: 72589 - DNA, 30 bp, Homo sapiens
  misc_feature 1..30: note = chr11:22361815-22361845
  misc_feature 1..30: note = hyper
  source 1..30: mol_type = genomic DNA
tctttgtttaaatatcgaaagtatcaatcg

SEQ ID NO: 72590 - DNA, 708 bp, Homo sapiens
  misc_feature 1..708: note = chr11:22362501-22363209
  misc_feature 1..708: note = hyper
  source 1..708: mol_type = genomic DNA
gcggaataccagcatcgtcaacctggaaagcttcaacttgctagaaacggaaaaggcagcgcgggtgggaaaggctctctagttgggcccgcctgcagcggagcagctctctggtgctgtgttgcaggaggacaccgcggtagtcagggtaaagccctgctgggcgcgtgtaggagtgggaggcgcctactcaggtgcagaggaggcgctggtaacccctgccctcacaaaatgcagaccctgcagatcctgcaagaaagttaggcccaagcggcctgtgtatctcaatcagagcgcccaggggtggatcccgagatggggactcgctaccttaggcctaaaggtgttaaagttgaagagacgccgccgccgcggccaagggcacctgcagaatgtgagagagcctgggaggtcttgcagcttggtgtcaccccaccaccctaatccccgagggtggggggaggtcgacggccctcctcccaaccccgacgggtcctgaaaaatgggaatgggtcagcatcgggggtacctaagccgccaagtccttgactcgcccctgctctgccgcgcagggtgctggagaagaagcaagacaccggggagacaatcgagctgacggaggatgggaagcccctagaggtgcccgagaggaaggcgccgctgtgcgactgcacgtgcttcggcctgccccgccgctacattatcgcc

SEQ ID NO: 72591 - DNA, 815 bp, Homo sapiens
  misc_feature 1..815: note = chr11:22364799-22365614
  misc_feature 1..815: note = hyper
  source 1..815: mol_type = genomic DNA
aattcaactgggacccggaaaccgtggggatgatccacggttccttcttttggggctacatcatcactcagattccgggaggctacatcgcgtctcggctggcagccaacaggtaatgcgccaggcgggactggggctcggggcgtggtgtttgtttcctccgaaggggcagcagaagctggagcagagacaacagcccagaggggtttgaggactcccgggcgaagtcttctagtcccttgacacaccctctcagggctggagctgctggtgactccttcctgaattagtcgcctaaacgaatgtaggctctctgggaccagcgcacgcggcctccttccctctgctgtggctgaacttgcttttggcgaaataatcgacgtgctgtatggcctgacaggagctgagggcagaccgggagcaggcagagcagggacagtgcgcctgagtgcacaaaggggtgtagaacggcagatgctgcgctctctcctgcactccccgcaggctcccaggctccccgagggtctgacctcctggcaaggcgcctcgaagacctggccccgtcccccgcccagttggtgctctgggtatgaagtatttgtttctaggggggcaggcaccagcgatgcgatttcacctgttaatgagctgcgtaggggcgggcgttgggggagccctcagctgctttcagtggcctcctgccttgctgcggtgtccacaaccaaggtcctagcgccagttcccagaagcgccaccaacggcacctggagagacacccctaaagcataagacctaaggaccgatggggtggaggt

SEQ ID NO: 72592 - DNA, 482 bp, Homo sapiens
  misc_feature 1..482: note = chr11:22688123-22688605
  misc_feature 1..482: note = hyper
  source 1..482: mol_type = genomic DNA
tgtcaactgcatttgcgtccaccaaaaaaagtaagcattttacttccgctcggtctatgaggactgatgaaatgtaggaaatctgtttctggcagggagaaaaaatcgttttcccaaacagcactaaaaggagccatcagagaagtatgaagaggggtagtgcggctgtagctgctgccgctgccgccaggctggtggggtgcggggagcggctgctgcaggacctgtgcctggagggggccggccccgagaagctgcaggagcccagcccggagcccaagcgcctctgagagccgccagcagcccagctcgggacgcgggggtgagcacgactggctggcccagttctgcgccaacgccgccgcagcgtgcgcgcaccgcagccggggctcacgggagcccctgcctgtctactgcacccggggcggcgggggaggggagaggtcattaaaaaataacctcaggaacgaggcggggaagag

SEQ ID NO: 72593 - DNA, 517 bp, Homo sapiens
  misc_feature 1..517: note = chr11:2278322-2278839
  misc_feature 1..517: note = hypo
  source 1..517: mol_type = genomic DNA
aaaggtggtttcaggcgctcaggtgaagtggagcagaaacagaagttggaatccagccccagcgggcgggcggcagcagcagtgccggccctgcccagaacaggttcgacctgagccggcactgcccggctgccctggggctagggaggctgagacagagaagggaagccagagggtgggggtgggggcccggcactggcagagctgcctgccctcaacgaccgcccctgccggagacccccgccccacccgctgtggttctgctggcccaggtttcgctgggcccactcccagggtttggcatcactggagcccagggtcccccccgcaccctccccacagccttggccctgctgctgcctgcctcctccagggtaccccgaggcccacgtcaggagacccgcctcaggcagcagtggcccggtggctgcttctgcctagcccgcagcacgtgccaccctgggcgcactgccttcccgaaggctctcctccctccccggggcgctccctcccactc

SEQ ID NO: 72594 - DNA, 30 bp, Homo sapiens
  misc_feature 1..30: note = chr11:2287971-2288001
  misc_feature 1..30: note = hypo
  source 1..30: mol_type = genomic DNA
tcctttagaggcacacgtgaaacatgacgg

SEQ ID NO: 72595 - DNA, 96 bp, Homo sapiens
  misc_feature 1..96: note = chr11:2289204-2289300
  misc_feature 1..96: note = hypo
  source 1..96: mol_type = genomic DNA
agggcctccccagtgcgggcaaaacccaaagctagcgagagggcagcctccaggcacctctcactaactcctcccagaggccgttgaggtgggtct

SEQ ID NO: 72596 - DNA, 81 bp, Homo sapiens
  misc_feature 1..81: note = chr11:2290937-2291018
  misc_feature 1..81: note = hyper
  source 1..81: mol_type = genomic DNA
ctcctccctgcctcccggctgttacctcataggtcgagggcgctcagtagccccctaaccagctggagaagtcgagtagct

SEQ ID NO: 72597 - DNA, 422 bp, Homo sapiens
  misc_feature 1..422: note = chr11:2291072-2291494
  misc_feature 1..422: note = hyper
  source 1..422: mol_type = genomic DNA
cggaacgcggggagccgggctccgagctgcccccgcggcccggggacgaagaagcgcgggagggcgaggcggcgaccggggtggtccctggcggcccgcggggcgcagacggccgcacggcctgcggcctcagccctcccgccagcgcgttgcgcacggcgtcgtgctcggccagcaggcgctgcagcgcgcggatgtactccacggctgagcgcagcgtctccaccttgctcagcttcttgctggcgccgccgtgcggcacgtgctgccgcagcgcctggaagcccaagttcaccagcttcacgcggttgcgctcgcgctcattgcgccgcgctacggccgctgcgccgcctccggtctctgcggtggccggtcgccgccgccggctgcagcgcaacagttccggggacgcgggtctccgc

SEQ ID NO: 72598 - DNA, 125 bp, Homo sapiens
  misc_feature 1..125: note = chr11:2291800-2291925
  misc_feature 1..125: note = hyper
  source 1..125: mol_type = genomic DNA
ggactctcccaggtctccgcaggcgcggcgcaggcggctggtttttaaatgtatagataaccctcctccgcgccgccgccgtcgcctttctcacgccctccttccttcgcctcgccctcccgcca

SEQ ID NO: 72599 - DNA, 114 bp, Homo sapiens
  misc_feature 1..114: note = chr11:2291944-2292058
  misc_feature 1..114: note = hyper
  source 1..114: mol_type = genomic DNA
cgcgatcacattctgtaaggcccaaagcgtgcgcatgtccccctagcccatcccccggacgcagtccacagatccccagtgcgcccaactggcgaaatctgcgagttcccggtg

SEQ ID NO: 72600 - DNA, 255 bp, Homo sapiens; identical to SEQ ID NO: 10680
  misc_feature 1..255: note = chr11:2292105-2292360
  misc_feature 1..255: note = hyper
  source 1..255: mol_type = genomic DNA

SEQ ID NO: 72601 - DNA, 387 bp, Homo sapiens
  misc_feature 1..387: note = chr11:2292391-2292778
  misc_feature 1..387: note = hyper
  source 1..387: mol_type = genomic DNA
cgcccggccccattgaggaagcgcgtacgcgtggcgcgtggctcacggggagcatcgctaacaaagctgggttcctgctgggccccgccctgctcctcgcccccgcgactgggctgggcgcgctgtcccctagcgcagctatgtcccgagcgcgcccccacctgtgcgttaatctactgggaatgggggtggactgcgccttacctggggcggggtggggcttaaggagtggtcgagactgaggcggggtgggaggttcaggttcccggggcgccttccccaacccgccccgctttccccgtccctccacgcgcaccctgcctgtggtttccgtgcgcccccggcctgagggctctgggcggcaccttaacccggagggcctggagg

SEQ ID NO: 72602 - DNA, 94 bp, Homo sapiens
  misc_feature 1..94: note = chr11:232918-233012
  misc_feature 1..94: note = hypo
  source 1..94: mol_type = genomic DNA
ggagaaacaggcacccgagcctccgtgggagaaaaagaatgtgtgcgactcacagagggctcacctctctcaagcccatcgatgttctgcgtgt

SEQ ID NO: 72603 - DNA, 30 bp, Homo sapiens
  misc_feature 1..30: note = chr11:2329497-2329527
  misc_feature 1..30: note = hypo
  source 1..30: mol_type = genomic DNA
tcaggcagtggggagcgggactcagaccca

SEQ ID NO: 72604 - DNA, 30 bp, Homo sapiens
  misc_feature 1..30: note = chr11:2329892-2329922
  misc_feature 1..30: note = hypo
  source 1..30: mol_type = genomic DNA
ggccccccccagcagcgaccagccccccgc

SEQ ID NO: 72605 - DNA, 50 bp, Homo sapiens
  misc_feature 1..50: note = chr11:23326514-23326564
  misc_feature 1..50: note = hypo
  source 1..50: mol_type = genomic DNA
ttaactcttaccttgcggtgagctgcctgcatgtgcggtggcctgctggc

SEQ ID NO: 72606 - DNA, 137 bp, Homo sapiens
  misc_feature 1..137: note = chr11:2398257-2398394
  misc_feature 1..137: note = hyper
  source 1..137: mol_type = genomic DNA
atgcctgtcctcaggcgcggccctgctgccacccccttgggggctcggagcgcgacagcagcttggggacgcctcccgcgcccagcacggtgcacctgggccctgaggtcctggccgaaacgcgccaagttgggggt

SEQ ID NO: 72607 - DNA, 30 bp, Homo sapiens
  misc_feature 1..30: note = chr11:2425909-2425939
  misc_feature 1..30: note = hypo
  source 1..30: mol_type = genomic DNA
ggcacgttttctgcccggggagttgtgcct

SEQ ID NO: 72608 - DNA, 35 bp, Homo sapiens; identical to SEQ ID NO: 42979
  misc_feature 1..35: note = chr11:2428079-2428114
  misc_feature 1..35: note = hypo
  source 1..35: mol_type = genomic DNA

SEQ ID NO: 72609 - DNA, 192 bp, Homo sapiens
  misc_feature 1..192: note = chr11:2435222-2435414
  misc_feature 1..192: note = hypo
  source 1..192: mol_type = genomic DNA
aagctgggcccagctcgcccgcccaccccaccccctggcagctctcctcgaggacagctggcactcacctgaacgccgtcgtgggcaaagaaggccttggcgtcagcctcggtggccaggtgcaggcaggtggtcttgctccagcagcggttccggcgcaccagcagggcgaaggcgcgggcctcactgttg

SEQ ID NO: 72610 - DNA, 42 bp, Homo sapiens
  misc_feature 1..42: note = chr11:2435972-2436014
  misc_feature 1..42: note = hypo
  source 1..42: mol_type = genomic DNA
gcgcgtggctcgggccgcctcggcctccgtctccaggtgcga

SEQ ID NO: 72611 - DNA, 190 bp, Homo sapiens
  misc_feature 1..190: note = chr11:2436421-2436611
  misc_feature 1..190: note = hypo
  source 1..190: mol_type = genomic DNA
gtacgcgggagacctcgtgcagggagaaggccggtggccccgcgggtggctcccgggcctgctgggtgcccaggccggccagcgtcagccgggcctcctcctgcttccgctgcagcaggtcgaagagcaggctcttgcgtgacacggagcggtagagctcctgcagccgcccatacgtcaggaagtcggc

SEQ ID NO: 72612 - DNA, 291 bp, Homo sapiens
  misc_feature 1..291: note = chr11:2437920-2438211
  misc_feature 1..291: note = hypo
  source 1..291: mol_type = genomic DNA
acacccttcccagagcgtcccctcaaggtgtccccagcccctgcttagcagtgcctctccctgctggggctgtgtctgcctgccagcgtccagcccttcagcacgcgttcgtctccagcaaaaagcacatcaaatgctcatcaaaattttccatcagcgggtgaacagacgcatcaaccacggtctgtccacaggctggaacctgactccgccttacaaaaggaatgaagcatggaatggcatacgcttcaacacggaggaaccgtcaaaccctcccgctgcctgcaggga

SEQ ID NO: 72613 - DNA, 119 bp, Homo sapiens
  misc_feature 1..119: note = chr11:2439088-2439207
  misc_feature 1..119: note = hypo
  source 1..119: mol_type = genomic DNA
ccgcctcagccaggacgggggcagaggcaggccgtggtagacaccagcgtaggcacaggcagcgtccccaggtgagccttgcagcctgcatgcccaccgcccaccgggcccggcctggg

SEQ ID NO: 72614 - DNA, 45 bp, Homo sapiens
  misc_feature 1..45: note = chr11:24518383-24518428
  misc_feature 1..45: note = hyper
  source 1..45: mol_type = genomic DNA
catcctggggagcagcgggaataaatgatccgcccctggccagtg

SEQ ID NO: 72615 - skipped

SEQ ID NO: 72616 - DNA, 23 bp, Homo sapiens
  misc_feature 1..23: note = chr11:24518677-24518700
  misc_feature 1..23: note = hyper
  source 1..23: mol_type = genomic DNA
cggaagagcgctcatcactggct

SEQ ID NO: 72617 - DNA, 24 bp, Homo sapiens
  misc_feature 1..24: note = chr11:2465424-2465448
  misc_feature 1..24: note = hyper
  source 1..24: mol_type = genomic DNA
ggccctggtgggaagcgacccgag

SEQ ID NO: 72618 - DNA, 59 bp, Homo sapiens; identical to SEQ ID NO: 33594
  misc_feature 1..59: note = chr11:2465461-2465520
  misc_feature 1..59: note = hyper
  source 1..59: mol_type = genomic DNA

SEQ ID NO: 72619 - DNA, 390 bp, Homo sapiens
  misc_feature 1..390: note = chr11:2466441-2466831
  misc_feature 1..390: note = hyper
  source 1..390: mol_type = genomic DNA
ggagctggcggagggcggcccggcgggcggcgcgctctacgcgcccatcgcgcccggcgccccaggtcccgcgccccctgcgtccccggccgcgcccgccgcgcccccagttgcctccgaccttggcccgcggccgccggtgagcctagacccgcgcgtctccatctacagcacgcgccgcccggtgttggcgcgcacccacgtccagggccgcgtctacaacttcctcgagcgtcccaccggctggaaatgcttcgtttaccacttcgccgtgtgagtatcgccaccggcgacggccggcacgaaggtgcttcctgagagctggtgtgggggagctctgtcccagcgccacctgccccgtcggagctgcgaccccggagcagaggaggg

SEQ ID NO: 72620 - DNA, 140 bp, Homo sapiens
  misc_feature 1..140: note = chr11:2491342-2491482
  misc_feature 1..140: note = hypo
  source 1..140: mol_type = genomic DNA
accacgcccggctgattgttaaattttttgtagagctggggtctggctatgtcgctgacaatcaaaatgaggacttgaagcatactcctcaaatcatcgaggtttattgagccaacgtgagggcacgcccaggaaaaact

SEQ ID NO: 72621 - DNA, 24 bp, Homo sapiens
  misc_feature 1..24: note = chr11:24945189-24945213
  misc_feature 1..24: note = hypo
  source 1..24: mol_type = genomic DNA
ccaagatcgcgccactgcactcca

SEQ ID NO: 72622 - DNA, 161 bp, Homo sapiens
  misc_feature 1..161: note = chr11:2541198-2541359
  misc_feature 1..161: note = hypo
  source 1..161: mol_type = genomic DNA
gcacgggagtgatgccgccacccacccaggacgcgggagcccgcagaggctggaaggctgaaaagggccctgtcgcccccaccccccaggatgacgtatggcctgatgtggcattcctgcctcaggaccatggcaccaagtggtggcgctggggcccctgg

SEQ ID NO: 72623 - DNA, 202 bp, Homo sapiens
  misc_feature 1..202: note = chr11:2543263-2543465
  misc_feature 1..202: note = hypo
  source 1..202: mol_type = genomic DNA
gtgttcccgggcacccggggctgagatgttgaaatgatgtcggataattcaccgggtgccttcggggctggtactcgccgtcactgctcctgaggcctatttgctgtcaaggggaacaagtaggaggttgttttctggggtgcggtgggctccccgctcatgcagctccccgccccccgcatgaccacgccctcttgggagc

SEQ ID NO: 72624 - DNA, 30 bp, Homo sapiens
  misc_feature 1..30: note = chr11:2547325-2547355
  misc_feature 1..30: note = hypo
  source 1..30: mol_type = genomic DNA
ggccctgaggtgggccgggctgggcacagt

SEQ ID NO: 72625 - DNA, 79 bp, Homo sapiens
  misc_feature 1..79: note = chr11:2554518-2554597
  misc_feature 1..79: note = hyper
  source 1..79: mol_type = genomic DNA
ctgaaaaagccatttcgggaggaatctggtctcggctggggtccggccggcaccgtgaacaccacgtgaacaccacgtc

SEQ ID NO: 72626 - DNA, 145 bp, Homo sapiens
  misc_feature 1..145: note = chr11:2569001-2569146
  misc_feature 1..145: note = hypo
  source 1..145: mol_type = genomic DNA
atggaaggggaggggcggcagttctcagtggagcggccgggctgcgagtctctgtatggaggtgaaggtccagatgttggggtttcagggtcaagcattcctggcagagagcatggcacgtgccaagacccggatggggcgtgtg

SEQ ID NO: 72627 - DNA, 313 bp, Homo sapiens
  misc_feature 1..313: note = chr11:2596433-2596746
  misc_feature 1..313: note = hypo
  source 1..313: mol_type = genomic DNA
acctgtgcaaacatccgcccgctggccgggaacacggcccctttgtgcccggcttggcatcagtgccccggcccacaccgtcagctgcagcccgagcctcggccatcgcgcgccctggcctggccattgttcccgccaggccccgcgcccctggtcgccctgggccccccaccgcccagggctgtggggcaaacagctcccattcagctgccctgcagctgtctggggggagcggcccctgaggcctgagttatgggctgtgttcctggcatttctcggacaaacagaacttgagaaacgcaagaaggggcag

SEQ ID NO: 72628 - DNA, 32 bp, Homo sapiens
  misc_feature 1..32: note = chr11:2603413-2603445
  misc_feature 1..32: note = hypo
  source 1..32: mol_type = genomic DNA
gcagttctgggcagtcgcgtgagccgtgtgca

SEQ ID NO: 72629 - DNA, 36 bp, Homo sapiens
  misc_feature 1..36: note = chr11:2612777-2612813
  misc_feature 1..36: note = hypo
  source 1..36: mol_type = genomic DNA
taacgggcaggtgggcgtggccgggggctggggacc

SEQ ID NO: 72630 - DNA, 30 bp, Homo sapiens; identical to SEQ ID NO: 33725
  misc_feature 1..30: note = chr11:26353691-26353721
  misc_feature 1..30: note = hyper
  source 1..30: mol_type = genomic DNA

SEQ ID NO: 72631 - DNA, 30 bp, Homo sapiens
  misc_feature 1..30: note = chr11:26472646-26472676
  misc_feature 1..30: note = hypo
  source 1..30: mol_type = genomic DNA
aggagccaagatggccgaataggaaccact

SEQ ID NO: 72632 - DNA, 32 bp, Homo sapiens
  misc_feature 1..32: note = chr11:2745363-2745395
  misc_feature 1..32: note = hypo
  source 1..32: mol_type = genomic DNA
agatcgccagggggccgcgacaaggagaccag

SEQ ID NO: 72633 - DNA, 136 bp, Homo sapiens
  misc_feature 1..136: note = chr11:27495243-27495379
  misc_feature 1..136: note = hypo
  source 1..136: mol_type = genomic DNA
gcctaatagaccccacggaatcattacctgtaccaactacggctttaagggtacttcgtttcttgctctctgccatggcgttgagtcgttttactctataatggagacatttttaatgaatacattaaaacaagca

SEQ ID NO: 72634 - DNA, 75 bp, Homo sapiens
  misc_feature 1..75: note = chr11:27495679-27495754
  misc_feature 1..75: note = hypo
  source 1..75: mol_type = genomic DNA
aaaaaaaaaaaaaaaaaagcaggatttaaagataattatcatataaagttgactagccatcgtatgtaaataaaa

SEQ ID NO: 72635 - DNA, 276 bp, Homo sapiens
  misc_feature 1..276: note = chr11:2753764-2754040
  misc_feature 1..276: note = hypo
  source 1..276: mol_type = genomic DNA
ccgggcagtgaggagcgcaggcgaatgttacagcaggcgcgagcgaaggggcccgaggcaccggtgcttccgacggggcccgagggccgtctgacctttccggccacggggcagcagttgcgtgagcaggaacaatcgccccagtgtgcaaggcacaagcggccttttcttcctcaccgggccggcgcacacagctcccagcctggcttcccttgaacaaacatatttattgtggccgccaccgaggcctcgccttgcagccggagcctgggggcc

SEQ ID NO: 72636 - DNA, 39 bp, Homo sapiens
  misc_feature 1..39: note = chr11:2758828-2758867
  misc_feature 1..39: note = hypo
  source 1..39: mol_type = genomic DNA
gagtgaatttgactccgttcacggcgaagaagctttgtg

SEQ ID NO: 72637 - DNA, 30 bp, Homo sapiens; identical to SEQ ID NO: 42988
  misc_feature 1..30: note = chr11:2770653-2770683
  misc_feature 1..30: note = hypo
  source 1..30: mol_type = genomic DNA

SEQ ID NO: 72638 - DNA, 50 bp, Homo sapiens
  misc_feature 1..50: note = chr11:27720970-27721020
  misc_feature 1..50: note = hyper
  source 1..50: mol_type = genomic DNA
gtcaagaatcccccacgtacatcccaaccactccccgaaagtcaaaactc

SEQ ID NO: 72639 - DNA, 115 bp, Homo sapiens
  misc_feature 1..115: note = chr11:27722537-27722652
  misc_feature 1..115: note = hyper
  source 1..115: mol_type = genomic DNA
tacggagcttgcgaacgcgagcacacaatgaaatcgcacagagcatgggggctattggtttactctgctgccttaaacacgccggcttaaacagagttcgcgcactgacctctct

SEQ ID NO: 72640 - DNA, 220 bp, Homo sapiens
  misc_feature 1..220: note = chr11:27739988-27740208
  misc_feature 1..220: note = hyper
  source 1..220: mol_type = genomic DNA
gggaagggtgggtggcgatggtgatgcgggcgccttggagttcctttgcagcacgcttggaattgcatcagactgatcagaaatccccccgcccccaagctcagcccctcccgccacgctcccctgcccgcccctcccctcccctcccttcgcgtagatctgactgagaaaacgactggatctcggaacaatctgtgccccattcgctgcaggcttgctc

SEQ ID NO: 72641 - DNA, 30 bp, Homo sapiens
  misc_feature 1..30: note = chr11:27740463-27740493
  misc_feature 1..30: note = hyper
  source 1..30: mol_type = genomic DNA
gggaggagtccagaacgaccaaaccctggg

SEQ ID NO: 72642 - DNA, 88 bp, Homo sapiens
  misc_feature 1..88: note = chr11:27740898-27740986
  misc_feature 1..88: note = hyper
  source 1..88: mol_type = genomic DNA
tgtccagccgccgcacggagctaaaagtgttcttctccaccgcctccagccgcccaggccccctcgcccggcccgctctctggctctt

SEQ ID NO: 72643 - DNA, 30 bp, Homo sapiens
  misc_feature 1..30: note = chr11:27741900-27741930
  misc_feature 1..30: note = hyper
  source 1..30: mol_type = genomic DNA
cggcttacaccaccccggtggctagatcct

SEQ ID NO: 72644 - DNA, 30 bp, Homo sapiens
  misc_feature 1..30: note = chr11:27742185-27742215
  misc_feature 1..30: note = hyper
  source 1..30: mol_type = genomic DNA
actacctgggggtaccgccacctcggacaa

SEQ ID NO: 72645 - DNA, 125 bp, Homo sapiens
  misc_feature 1..125: note = chr11:27743048-27743173
  misc_feature 1..125: note = hyper
  source 1..125: mol_type = genomic DNA
atcatgtgagaagttcggctttgctcagtggatcgcccaccacttggtgtgacttatgaatctaataaccctttgcaatatccgcaagcttaaactctcaaccaccttggcgactacagaagaca

SEQ ID NO: 72646 - DNA, 1138 bp, Homo sapiens
  misc_feature 1..1138: note = chr11:27743419-27744557
  misc_feature 1..1138: note = hyper
  source 1..1138: mol_type = genomic DNA
actcagcctgcacaccgctcccttgcccactacgcaggtcacacctggggctccggcgaagctgaattcggctcgggagatttccctgtcgccaggtaagaaaaccttcgccttgtcaggctagggcgggaagaccgctggggaacttgttgcttatcagcgccggcagactaccgctttaataataataccagaaaagcgcagcagggagggggtggggggcggcaacggcgacgactaacctcgctgtttacgtgaccgactcactgtgactctctgggtaaaaaaaggaaacttcttagaaaagttcgtgcccctccccctcccccatcatgactaagggtctccagccgatgaggtcgtgagtgatgatcaaatggggactggggggaggggggcgagtaagtgacttgtccttgggaacatctgcatgcgtcgaagcgcgaaccagcccaacaactttcccttttcctcttaggtactgatgactaggcgagaggcaccaaggcgagccactagttgcccacaggaacctgtgtaagccgagctctcgagcggctgagttgaatgaagttatgactgcgtttgctctaatgggttatggcttcccaaatgtgagttaacagccccggtgcgcagctaggtcggaaggcgagccgcggagagcggagccgcgggccaaggcagggacgggaggggaggcggcaggttgggcgctccgctgctgctcggtgctgcttccccggagccgcttcctcatcctgcgggggctgccccgccgccggggtgccggggtgagcgcggcgggagccagggctggggtggcgaacctcggagggggctctcccaggaagccctgcggttagcgcccgcgcttccccaccagtggctgcgcaagctgggaagcgaagaggtcacgtgttggcggaaagtaacttggaggcgaaaggatgaactttgagaagaggaaaaaaagcacaatgaaacaaactacccccttggagtgtctaatagagggggaggcgggagggggggcggaggggcgccgctctccgcgggagatgtggggacgactccggaaatctcgggaaataggcaataactcgagctttggcaacgtcccccagcctagggaggc

SEQ ID NO: 72647 - DNA, 186 bp, Homo sapiens; identical to SEQ ID NO: 33732
  misc_feature 1..186: note = chr11:27744558-27744744
  misc_feature 1..186: note = hyper
  source 1..186: mol_type = genomic DNA

SEQ ID NO: 72648 - DNA, 114 bp, Homo sapiens
  misc_feature 1..114: note = chr11:279418-279532
  misc_feature 1..114: note = hyper
  source 1..114: mol_type = genomic DNA
tgcgcgacgtgggcccggacggacgcagcatcccgtgggggcggctggagcgcgcggacgccgtggacctcgcggagcagctggcccagttctacggcccggagcctgccctgg

SEQ ID NO: 72649 - DNA, 111 bp, Homo sapiens
  misc_feature 1..111: note = chr11:280108-280219
  misc_feature 1..111: note = hyper
  source 1..111: mol_type = genomic DNA
cgtgctgcagctgcacgctcgggtgaaggagaggaacgcccgctccgtgaagatcaccaagcgcttcaccaagctgctcatcgcgcccgagagcgccgccccggaggaggc

SEQ ID NO: 72650 - DNA, 35 bp, Homo sapiens
  misc_feature 1..35: note = chr11:2812777-2812812
  misc_feature 1..35: note = hyper
  source 1..35: mol_type = genomic DNA
gggaggggacctggccgtgccggctgggctgggaa

SEQ ID NO: 72651 - DNA, 199 bp, Homo sapiens
  misc_feature 1..199: note = chr11:2818195-2818394
  misc_feature 1..199: note = hypo
  source 1..199: mol_type = genomic DNA
caagggccagagaggcgaaattagatccgtggggagagattttacaacgtatgggctggtggcaagtggcggcaaaccgtccccacggggccacaacggggcattgttcacggcctcacctgggctgtctccagcaccccaggatttacgaggactcggcccagagcctcgatgccggccgctccgggcagacctgggg

SEQ ID NO: 72652 - DNA, 30 bp, Homo sapiens; identical to SEQ ID NO: 15520
  misc_feature 1..30: note = chr11:2829204-2829234
  misc_feature 1..30: note = hypo
  source 1..30: mol_type = genomic DNA

SEQ ID NO: 72653 - DNA, 50 bp, Homo sapiens
  misc_feature 1..50: note = chr11:2868750-2868800
  misc_feature 1..50: note = hypo
  source 1..50: mol_type = genomic DNA
tagggactcccagcacgcacgggatggactccaatcggcacacatgcaca

SEQ ID NO: 72654 - DNA, 430 bp, Homo sapiens
  misc_feature 1..430: note = chr11:2883606-2884036
  misc_feature 1..430: note = hyper
  source 1..430: mol_type = genomic DNA
cgacccccagaccttcggggtgcccagtccgagcctgggccgctaggggccgcgggcctggcgggcggggcgggggccggggtcgggggtccggcgagctttaatgcgcgcacaaagcctcatttgcaggtcaatgccgcggcacactcgcctctcccctcgcccggcgccctttgtccggccgcgcccgctcctcgcgccagatggccgcggaaatgctaatttcgggcgcccctgcccccccacccccgcgtttaattgcgcctttgcagatgggccgcgagtgtgcgcttcatgcagatgagcgcggcctcgccgccttcctcggacctccgggagccgcggccgggcgtgctggggccgagggcagggagggggccgctgtccctccactcgacgcgccgccgggcacgggcgggcacccagcggc

SEQ ID NO: 72655 - DNA, 47 bp, Homo sapiens
  misc_feature 1..47: note = chr11:2884253-2884300
  misc_feature 1..47: note = hyper
  source 1..47: mol_type = genomic DNA
tcagccctgggccggcggcacttggaggcggccgggcaagacggcag

SEQ ID NO: 72656 - DNA, 118 bp, Homo sapiens
  misc_feature 1..118: note = chr11:2905392-2905510
  misc_feature 1..118: note = hyper
  source 1..118: mol_type = genomic DNA
agggcggggccggcccggagacccgagagggggccgggagagggcgcggggcgcgggccggccggggtgggggcgccgtccccgcccgcgccgaggtccgcggcgggtcagctttgtt

SEQ ID NO: 72657 - DNA, 177 bp, Homo sapiens
  misc_feature 1..177: note = chr11:2905859-2906036
  misc_feature 1..177: note = hyper
  source 1..177: mol_type = genomic DNA
ggggccgggccgggccggggcggggccgtgcggggctcaccggagatcagaggcccggacagcttcttgatcgccgcgccgttggcgctggcggccgcggtgccggccgcgggacgtcccgaaatccccgagtgcagctggtcagcgagaggctcctggccgcgctgcccctggttc

SEQ ID NO: 72658 - DNA, 275 bp, Homo sapiens
  misc_feature 1..275: note = chr11:2906305-2906580
  misc_feature 1..275: note = hyper
  source 1..275: mol_type = genomic DNA
actaggcagctgctccggcgcctcctcgaggccgtcgagggactcagcggccggctcgaggggcgggctgacagccaccgcgaccgcgacgggccgcggcgccagcagcaggcggcagcgccccacctgcaccgtctcgcggtagaacgcgggcaccgagtcgctgtccacttcggtccactgcaggcgtccagggccccgcagcggcatgtcctgctggaagtcgtaatcccagcggttctggtcctcggcgttcagctcggccaggcgggcct

SEQ ID NO: 72659 - DNA, 190 bp, Homo sapiens
  misc_feature 1..190: note = chr11:2906781-2906971
  misc_feature 1..190: note = hyper
  source 1..190: mol_type = genomic DNA
gagaggaggagagggcggaggccgggcgcaagggagaccccgcgccgcccgactctgcgtgtgcgagggacgcggcggctacctggctgtccggtggtggactcttctgcgtcgggttcgcctgtctcgtccggacggcagccgcgccccctcgatgcctgctggctagctcgctcgctcaggcctggcc

SEQ ID NO: 72660 - DNA, 235 bp, Homo sapiens
  misc_feature 1..235: note = chr11:2932722-2932957
  misc_feature 1..235: note = hypo
  source 1..235: mol_type = genomic DNA
cagggtgaggaagggcgtgaggagggcacggggaggagcactgggccccagcaggtggctgagctgggcggctgccatcccagggtgctgcccacccccaggtactctgccggctcagggcccagccgcctgctgccgcctccttccctggccagccttcctcacctatgaaatgggccctcccctgcccttactcacccacaacgatgctgggagggtccgagctcgctcaggc

SEQ ID NO: 72661 - DNA, 135 bp, Homo sapiens
  misc_feature 1..135: note = chr11:2933495-2933630
  misc_feature 1..135: note = hypo
  source 1..135: mol_type = genomic DNA
cccacacctccccctcgggggctcaccgaaggcagtggggccaggtgccagccaggctccaaagcctggtgccccatggcaagggccagccccctggccctcttggtccagctgccccaacgcctgcagcctgtt

SEQ ID NO: 72662 - DNA, 30 bp, Homo sapiens
  misc_feature 1..30: note = chr11:2948107-2948137
  misc_feature 1..30: note = hypo
  source 1..30: mol_type = genomic DNA
ggccaggccatgtaccgttgccttcccagc

SEQ ID NO: 72663 - DNA, 460 bp, Homo sapiens
  misc_feature 1..460: note = chr11:2949947-2950407
  misc_feature 1..460: note = hyper
  source 1..460: mol_type = genomic DNA
cagcctgaggggccccgagaccctgacgcgagggggccagcgcgattgcggggcgccgggtcccccaaggaggtgcagcgcccccgccccgccgtctggggttgaagtggtttttcccaaaggccccggtcccggctgttagggcgcagggctcgccgggacgcgggcagtcactcaccgcggcgggctcatggcgtgcggggtttgggctgcggggatggcctggagggctccgagggctcggagggtgcggcggccgcggcagccacggcgtcctcggcgggtgcggcgggtgcggtgcgttcctggcggctgcgaaagtcctgcagggcgcggcggttctggaaatcgatgagcgccagcgcgatggccgcgttccagcagctctcgcccgcgcagcggaagtcgatctccttgtggtcggtggtgacgatggtgaagtacacgtacttgcccgtgc

SEQ ID NO: 72664 - DNA, 81 bp, Homo sapiens
  misc_feature 1..81: note = chr11:29581595-29581676
  misc_feature 1..81: note = hypo
  source 1..81: mol_type = genomic DNA
tgcttcctggtacaccggagcggtgattacctggagcagctctttcccctcaatgttgagaggcattttaagtttcatata

SEQ ID NO: 72665 - DNA, 39 bp, Homo sapiens
  misc_feature 1..39: note = chr11:299379-299418
  misc_feature 1..39: note = hypo
  source 1..39: mol_type = genomic DNA
caagtggtctcgaggcggggggtgcggggcccccagtgt

SEQ ID NO: 72666 - DNA, 138 bp, Homo sapiens
  misc_feature 1..138: note = chr11:30037614-30037752
  misc_feature 1..138: note = hyper
  source 1..138: mol_type = genomic DNA
aaatatacacttcaacgcacgccatttatgcagcccctatgtatgttgctcaaatgctcggaaaatgcacgcaaatccaaacgttggaagaggcagcaattcagacccgttcaccggctgttcccaaaagaagggaac

SEQ ID NO: 72667 - DNA, 112 bp, Homo sapiens
  misc_feature 1..112: note = chr11:30037883-30037995
  misc_feature 1..112: note = hyper
  source 1..112: mol_type = genomic DNA
cgcatccccgggtttgggaaaataacaactgttggccccccggagcgccgcgcagcatccgcacctcccttctcccacctcctggtttatttttaaccgccttccattcatg

SEQ ID NO: 72668 - DNA, 1239 bp, Homo sapiens
  misc_feature 1..1239: note = chr11:30038294-30039533
  misc_feature 1..1239: note = hyper
  source 1..1239: mol_type = genomic DNA
ttctgttgcctggcccgaggggtgcacagagtcctcgcggctggagcctgggggtgggggttggggctgccccagagaagaccccaagactcctggttcctctggagttcagcacaggagggattgcctgggaaaggaagtcaaggttcccccgaaaagaaacaaaatcctagacagcagcgatcacttgttaagcccgaattcctcctccaacatccatccctctctcgctctcgctggctgcgggagcagcacacgcctcccctggccgcgaacgcgctctgggcgggggcggggccagggccgaaccgagggtgtggcgttcgcgacggtcgccaggggcgcctcccggcgcggcggggcgggtgcagtcacgacgccgcgactccccgcaccccggctgggccccccgactcccaggatctgggatcgattccaggagtctttggctgtggtccccacaggcgaggagcaaatcctggagaagtgtccccgttggggccggaataggggtttcgacggcagcgcgggagtccccagagggcttgggagcggggagctccaatgggaggtgcagtcccgaaaatggggtcctctgggacatctcctctacctaacttgctttctctatatctcccctcgagccccgagccccgtcttcttttccccaccccatcccctcccaaagcgggtttgttgggttgggagccgggtgcatctccggcgaggccacgggcggggagccctcctgtgcctgccagagcgcccagatccctcagtctccgtctcctttgcacacaggagttgggaggcttcagcgccggggttgggcctcaggggcgcggaggagaccgactttcaacctgtattcaatcccgggcaggggaatgttacagaaattggaatcaggcccaggctaggggctgcgcacaggaggcagcagttctaggggaggagggttggagagatgagtaagttgcagggtgggccaggggctgagggctttggaaggcgggggaagagcccgcagccaacctgttgctgcaaaaacaaatacggctctggtatcgactccctgagggctctttggatccttcaggacagaaatcaagggatatcgcagcaaaaagcaagtttttttggttttctttctttctttcttttaattaaagcttgtgcgcacaagggagctaacaccaagaaaaaaaaaagtgggctgttcctcgaagtcagggtgtg

SEQ ID NO: 72669 - DNA, 152 bp, Homo sapiens
  misc_feature 1..152: note = chr11:30040150-30040302
  misc_feature 1..152: note = hyper
  source 1..152: mol_type = genomic DNA
gcgacggggtctccctagacacctctcccagctcgcccgatggaccaagcaggcagtggcagcgctatgccccggactgctggagcaaatccgaccttgggctggttggttggcgccaggactgtcactgtcgtcctcggggcggcagcttt

SEQ ID NO: 72670 - DNA, 40 bp, Homo sapiens
  misc_feature 1..40: note = chr11:30409640-30409680
  misc_feature 1..40: note = hypo
  source 1..40: mol_type = genomic DNA
gggaagggcctggtgcgggtgggggcggcctaataaagca

SEQ ID NO: 72671 - DNA, 44 bp, Homo sapiens
  misc_feature 1..44: note = chr11:30605841-30605885
  misc_feature 1..44: note = hyper
  source 1..44: mol_type = genomic DNA
ggtggtgggcagttgcgcgaggcggggtggggggtgctttatga

SEQ ID NO: 72672 - DNA, 81 bp, Homo sapiens
  misc_feature 1..81: note = chr11:30605945-30606026
  misc_feature 1..81: note = hyper
  source 1..81: mol_type = genomic DNA
tctaggctcacggctggctcttcccggctacaacttccccttccttcctgaaacaccagcgccttactcgctcagtccccc

SEQ ID NO: 72673 - DNA, 134 bp, Homo sapiens
  misc_feature 1..134: note = chr11:30606027-30606161
  misc_feature 1..134: note = hyper
  source 1..134: mol_type = genomic DNA
ttgccacctccgtcacctcctcggccgccgctcctgctggcactgctggcgctagcgctggcggccccgggctccgctggacgcctatcttttttctctccctcttccctagctctggattgattgatgaccac

SEQ ID NO: 72674 - DNA, 194 bp, Homo sapiens
  misc_feature 1..194: note = chr11:30606215-30606409
  misc_feature 1..194: note = hyper
  source 1..194: mol_type = genomic DNA
cgtccccgacctcagcctcccgggcgcgttggcatccccgaacccacagcgctgagcccgagcccggggccgccgcctcctccctgctctacgcctgggcgctgccaggttccttccctggaacggcggagaaaggaagggagggagccagcgagcgttggaagggggtgtggaggccacgggatctccccctc

SEQ ID NO: 72675 - DNA, 104 bp, Homo sapiens
  misc_feature 1..104: note = chr11:30606651-30606755
  misc_feature 1..104: note = hyper
  source 1..104: mol_type = genomic DNA
cttcacctcctaggccgcaaaaccccggaattcaaaggctttacaaagataaccttgttatacgtaaatagcaaagaaactcctgcctctgtagagaagaaatc

SEQ ID NO: 72676 - DNA, 967 bp, Homo sapiens
  misc_feature 1..967: note = chr11:30606795-30607762
  misc_feature 1..967: note = hyper
  source 1..967: mol_type = genomic DNA
cgcctagcctcgaccccagcttgggtcgccgggtcgctccgcaggctgcgagcgcggagacccaggcagcggcggagagtgaggttggggcgcggggacggggtgagaaagagccccgagcgagagcggcgcgcgcgggcggccccgggggcggccgcggggcgcagccggagcacaaagctgcgcggtgccttcccctcgtcactgcacctggcctcgggccgccgcgggagcccggggatcgggccaacacaatgcacccaggcctaggccggggcggctcgaacacatcaccccgggactttctagtaaacagctcgctgagccctcgtccccacccccatccccgccgcccggcttccccagcttctcgccgataccccctcctctcctcctaagaaatcctggcggaggagggagcgaagaggtggggacccccagaggtcgggggactgatggctggagggggtggagaagagaagaggcgcaggatggggagtcggagggaagacacctcctaaaaaagaatttgctttcgctcaggggttgaaaatcagccctccccgagcgccgaattgcccgggaggcgcccgctcgtgcggatgtcaggggcaccggggcagcccgggtccgcagcctccgagcccctcgcacgcgcctctgacaaggcacctctcacccgggctccgctttgtgtgtgcatttttttcccttcctctagtgctcggcaccgggctcccggccgcctcctccccctcccccgccctccgcctcccttcccggggcggattacctttcccgggctgcgctccggatcccggggatgccttcagcgcccggcgagcaggcgatccatagccgagcggcccgagccggctggaggagcgctgggggcgcgcgggggcggcgaggggcgcgagcgggccagaaccttcgaccccggaggtcccgccgcaggctggggctg

SEQ ID NO: 72677 - DNA, 121 bp, Homo sapiens
  misc_feature 1..121: note = chr11:30608098-30608219
  misc_feature 1..121: note = hyper
  source 1..121: mol_type = genomic DNA
gcctgctggtgctcccgggtcaagcaggcggcaggaagctgagctgcaagttcatcatcatgagtgcgatctgcgtaaaaaatgataggggaaggaaggcgggctacggtgccccaggaaa

SEQ ID NO: 72678 - DNA, 56 bp, Homo sapiens; identical to SEQ ID NO: 33569
  misc_feature 1..56: note = chr11:308110-308166
  misc_feature 1..56: note = hyper
  source 1..56: mol_type = genomic DNA

SEQ ID NO: 72679 - DNA, 36 bp, Homo sapiens
  misc_feature 1..36: note = chr11:308230-308266
  misc_feature 1..36: note = hyper
  source 1..36: mol_type = genomic DNA
cggccagcctcccaactacgagatgctcaaggagga

SEQ ID NO: 72680 - DNA, 36 bp, Homo sapiens
  misc_feature 1..36: note = chr11:308326-308362
  misc_feature 1..36: note = hyper
  source 1..36: mol_type = genomic DNA
ccacatccgcagcgagacctccgtgcctgaccatgt

SEQ ID NO: 72681 - DNA, 100 bp, Homo sapiens
  misc_feature 1..100: note = chr11:3102365-3102465
  misc_feature 1..100: note = hypo
  source 1..100: mol_type = genomic DNA
aggttccaaaatttccgttagacaggaggagtaacttccacgtataacatggtgactaccgttaacaacaatgtattgacagggcgtggtggctcacgcc

SEQ ID NO: 72682 - DNA, 32 bp, Homo sapiens
  misc_feature 1..32: note = chr11:3110963-3110995
  misc_feature 1..32: note = hypo
  source 1..32: mol_type = genomic DNA
gatgacaaccccagccgcggcctcctggcctc

SEQ ID NO: 72683 - DNA, 30 bp, Homo sapiens
  misc_feature 1..30: note = chr11:3114134-3114164
  misc_feature 1..30: note = hypo
  source 1..30: mol_type = genomic DNA
caggtggaacagctgcggcttccagggcat

SEQ ID NO: 72684 - DNA, 30 bp, Homo sapiens; identical to SEQ ID NO: 42992
  misc_feature 1..30: note = chr11:3150813-3150843
  misc_feature 1..30: note = hypo
  source 1..30: mol_type = genomic DNA

SEQ ID NO: 72685 - DNA, 177 bp, Homo sapiens
  misc_feature 1..177: note = chr11:31533680-31533857
  misc_feature 1..177: note = hypo
  source 1..177: mol_type = genomic DNA
atttgactcaagttgcgacaagcctaatatgactatattgtgacaaaaggtaatgataataggatgttatggtgttagaacggtaaaactatactgtaatattgtgattattgcctgaatatattatgtggttactgtgtaacaagtaaatattatagcttccgtgtagtacggtga

SEQ ID NO: 72686 - DNA, 402 bp, Homo sapiens
  misc_feature 1..402: note = chr11:3164552-3164954
  misc_feature 1..402: note = hypo
  source 1..402: mol_type = genomic DNA
gggctgcactgtgggcgaaaacgcacggacgcgacacacccaagagaaacaagcacacgcccccaggtggtccgcgcacgcacgctcccagcagcatggctcagggccatcagagagcggacacagccagacatccacatgggtgaacggataaacatggatcacatctgtgcaacggatggaagaacattcggccttcaggaggcaggaagcacggcactcacacatgcgacgacacggatgagccgcagagatgcaccaagtcaaagaagccagataccaaaggccacatcttgtccgcttccacgcccacgcagtgtccaggacgggcaggtctggacacggaacgcagactggtgcttgccagggcccggcccggttctgtcccggtttcctggggct

SEQ ID NO: 72687 - DNA, 99 bp, Homo sapiens
  misc_feature 1..99: note = chr11:3169788-3169887
  misc_feature 1..99: note = hypo
  source 1..99: mol_type = genomic DNA
aaccggcttccatgacggcagggcgggggcaccgtcctctgcacttttgtacatctttgacattttctatcatacgaagccaaacgggagaggacacag

SEQ ID NO: 72688 - DNA, 61 bp, Homo sapiens
  misc_feature 1..61: note = chr11:31818452-31818513
  misc_feature 1..61: note = hyper
  source 1..61: mol_type = genomic DNA
gacgcgctccgctcacgtgtgcgggcacaagcgtctgtgctaatttactgccccaagtttc

SEQ ID NO: 72689 - DNA, 26 bp, Homo sapiens
  misc_feature 1..26: note = chr11:31818570-31818596
  misc_feature 1..26: note = hyper
  source 1..26: mol_type = genomic DNA
cgctttattttcgggtttggtgaaga

SEQ ID NO: 72690 - DNA, 1059 bp, Homo sapiens
  misc_feature 1..1059: note = chr11:31819302-31820361
  misc_feature 1..1059: note = hyper
  source 1..1059: mol_type = genomic DNA
ctagaagttggatctcgactcccccacccccacgataaacctaagtggtggacaattaagatatcttcttcaaaaggcgccccctcggagccgcgcaaagcaggggccttcagtgggtgccgttcaccttccagcctaatccgtgagaaagcgagtgaaagcgcctcccattatcccagccccaggaccatctgacgatgggaataggatttgtttcctggaaggaggtgagagagagagagagagagagagacagagagagagttgctgggaaataaaatcattccttagtttcttagtgtcttaatcagtgaggcggaaaacaagcaagaaaagatagcaacccggttgcggcaccttttcagctctggagcgcggatcaaaacattgtagcatctgttgaaagagaggctgactaaatcctatagagggcttgggtattatggggggtgggggtggggtgaggggaggagataagaaaaagtgtctccgtgatccctaaaaccaccaaatcgccggagaattggggctggatagagttgtctcttgttgttgtcagcccacgtcgtcgcgattttattcaccgccgcatggcgttgatcagatggaaaccatatttgtctccctctgagacctaacccccgccttatgcttttggagtatggactctttaaaacccaagaaaggcttcctgggctgggaaagggggctagggagggagggggaccctcttagcaccaaaaagtctgaggattccccgggaacgtgaagcgaagctcaccaccggtgcccgctacccccacgccggcaactctgtgcttcgtttggcccacgtgtcctccccacgcaactaggggcgacggtcctgtgcctgaggtgacaatcaccccccaaaaacctcacttgcgggtgggggggtggtgattgccagttgacccagaattttctagcaactaggcgcgttaaagtgaaaagcccctggactagctccacctccggccccaaccatcacaggcggaccctagctgatttgactctcacttcccgccctcagactgc

SEQ ID NO: 72691 - DNA, 928 bp, Homo sapiens; identical to SEQ ID NO: 33746
  misc_feature 1..928: note = chr11:31820460-31821388
  misc_feature 1..928: note = hyper
  source 1..928: mol_type = genomic DNA

SEQ ID NO: 72692 - DNA, 389 bp, Homo sapiens; identical to SEQ ID NO: 33747
  misc_feature 1..389: note = chr11:31821389-31821778
  misc_feature 1..389: note = hyper
  source 1..389: mol_type = genomic DNA

SEQ ID NO: 72693 - DNA, 706 bp, Homo sapiens
  misc_feature 1..706: note = chr11:31822002-31822708
  misc_feature 1..706: note = hyper
  source 1..706: mol_type = genomic DNA
cagccaccttcataccgctcctgacatacacaaccctcacattcccaggccaacaaaatggttcaacaaacaccacctacatacaatgtggtcgatgtgtcccaggccttcaaatgcagtctcacccatgacattccccaagcatggaagccctgagaggaaatggttgggagagtaggggacaggcaaagggatgcacatatggagagctgcgtggatggctgcttgggttttaccttgcgtaggttgccctggcaccgaagtccccggataccaaccagggcgggtgccccagcttccggtctgcccgttcaacatccttagtttatcatacatgccgtctgcgcccatctgttgcttttcgctagccaggttgcgaagaactctgtttattgatgacacctgcaaatcaaaccaaaatcaaaccaaatggtagtgtctcctgaagacacagtcacccatctcagctcacccacaaccttaaaaagcaactctcaacccgttaaaaagctcccagccaccccgggacagtgggtggatttgcagatacaccgtggaaaaaatgatagctatcactttgggcatggaaatttagttggatagagaattgggcggagggggtccttcaccattgcttggtgtctctggtgacctaactcacacggttgctttgctttgttaaaagactgcccgaaaataaaaacta

SEQ ID NO: 72694 - DNA, 87 bp, Homo sapiens
  misc_feature 1..87: note = chr11:31823165-31823252
  misc_feature 1..87: note = hyper
  source 1..87: mol_type = genomic DNA
ccaagcaaagatggacgggcactcccgcttatactgggctattttgcttacaacttctggagtcgctactctcggtttactaccacc

SEQ ID NO: 72695 - DNA, 810 bp, Homo sapiens; identical to SEQ ID NO: 33751
  misc_feature 1..810: note = chr11:31824154-31824964
  misc_feature 1..810: note = hyper
  source 1..810: mol_type = genomic DNA

SEQ ID NO: 72696 - DNA, 29 bp, Homo sapiens
  misc_feature 1..29: note = chr11:31826042-31826071
  misc_feature 1..29: note = hyper
  source 1..29: mol_type = genomic DNA
acaggcgtttgggggatctgggctccggc

SEQ ID NO: 72697 - DNA, 198 bp, Homo sapiens; identical to SEQ ID NO: 964
  misc_feature 1..198: note = chr11:31826106-31826304
  misc_feature 1..198: note = hyper
  source 1..198: mol_type = genomic DNA

SEQ ID NO: 72698 - DNA, 325 bp, Homo sapiens; identical to SEQ ID NO: 965
  misc_feature 1..325: note = chr11:31826408-31826733
  misc_feature 1..325: note = hyper
  source 1..325: mol_type = genomic DNA

SEQ ID NO: 72699 - DNA, 407 bp, Homo sapiens; identical to SEQ ID NO: 33755
  misc_feature 1..407: note = chr11:31827113-31827520
  misc_feature 1..407: note = hyper
  source 1..407: mol_type = genomic DNA

SEQ ID NO: 72700 - DNA, 457 bp, Homo sapiens; identical to SEQ ID NO: 967
  misc_feature 1..457: note = chr11:31827597-31828054
  misc_feature 1..457: note = hyper
  source 1..457: mol_type = genomic DNA

SEQ ID NO: 72701 - DNA, 480 bp, Homo sapiens
  misc_feature 1..480: note = chr11:31829116-31829596
  misc_feature 1..480: note = hyper
  source 1..480: mol_type = genomic DNA
taacttctcttttggcgtttagatcttcacccctttaactgtactgtgacacaccctgtctacctcgcctcactgctttaaaaagtacgaacaggagggggtgagcgtggtcgacaaagccgacagacggcaaacaatggcttctattctccagctttcctcgaacccaaggagcaaaaccgagtctccctaaccagcaacacagcttccaaccaaatgtaccaacaacccaccaactcacaaagggaacagagggacgcttctagcttcataagccctgacccagtgcaggggtccccgaggctgctcccgtacgaacacctccctacctttcccaaaggaaaaaaaaaaaaagtcttttgggtgagtggagaaaatagaaaagtaatttcttgttgtaaatatctggaggtaattgtgttactggtgtgagttgttaggggctgtaaaaagatacaacggcaccgtggggagctcaat

SEQ ID NO: 72702 - DNA, 99 bp, Homo sapiens
  misc_feature 1..99: note = chr11:31830319-31830418
  misc_feature 1..99: note = hyper
  source 1..99: mol_type = genomic DNA
aattacttaagtaaacgtgaacactaagtgcagaagcaacccgggaagtggggcacatcgacacccggaagcagtcctgtgcaccggagaggtcagacc

SEQ ID NO: 72703 - DNA, 660 bp, Homo sapiens
  misc_feature 1..660: note = chr11:31831479-31832139
  misc_feature 1..660: note = hyper
  source 1..660: mol_type = genomic DNA
aagagccccagcctccgcaaggcaagggagatgagagtcgggggaagcctggggagcagagagttttcaagttccgagctcagcgctccagtggagttgggggcaagagcccgggggctgggtggaagctgacagtcctcccgctcggctctgagctccctcggagcgcgcgttccaccgccttggcctggtggcttccttcccggctcgcgctagctcgctcttccctctacctccagcgtgcggctgccttgccgactgactccactcgggctggtggcgggcgcggtgcccccctcggcgctcgagtgccggctgactcttctgcgccggagcccagtgcggcacaaagcccgagggccggcgggcgggcggagacgcggcgagcaggttccctcggcgctccctcggcgagtcctcggagcgcccgctctctgcgcgttcgctgggcctcgggctggacaaagcagccggcagcggttgctctctgcggccgttccagggccttgggcaccacagagcctcttcgtcttttcccgcgggtcgggagcattgggcgacgctggggctaggagccgcggctgctgtcgcgcctggagtctcccttcttcccgcgagctcagcccgcgctggcgctggcgctggcgctggggctgagct

SEQ ID NO: 72704 - DNA, 566 bp, Homo sapiens
  misc_feature 1..566: note = chr11:31832589-31833155
  misc_feature 1..566: note = hyper
  source 1..566: mol_type = genomic DNA
aaaatgggctgtcagcggctggagagtgagagataaagagtgtgggtgagggaagtggctgcagccagcacacctatgctgattggtgatggctcaagtgtgttaatgtgtgtgtgccggcgcccggcctcgcctccaccgctcctcactggcccattagcgaagcctgacctctgtcatcatcctccagcaaaacacttcctcctgcgcctgaaccagagcgggaaatgaggccgagccacggttcccttttcaaacccactaatcactccgcaacatgcaaatgcaccgctcgctctcacacaaaatattgctttatgcaaagcagcgccggggcctcgcgccagccgattggatgctccctctccccgcctggtgcaattggtccgtttgtttgaatatgaatacacttgttttcggctccgccggtgggtcccggctcctctccccggcgcagggcccccgagcccgggctctggcgctcgcctgcatctccccgctccgcgcacgccgagattcggcgcggcccgccctgctgccgcgaacttgagcggtcaagtgaaggt

SEQ ID NO: 72705 - DNA, 248 bp, Homo sapiens
  misc_feature 1..248: note = chr11:31833517-31833765
  misc_feature 1..248: note = hyper
  source 1..248: mol_type = genomic DNA
ccaaatcctccaccccgctctccccgccctttcttctctcctttctcctttcggaagccgcggtgcgcagcggagcagaggcacagctctggctggagaggcccgagtaaacacgccacttactttgtgtacagagggttcttgtgaaaagccctgaagagtcctcaccaaacactcaccaacttctcccacgtgccatttgttgactaagtgcggctgcttttcgcagcgcccgagaggaggggaag

SEQ ID NO: 72706 - DNA, 156 bp, Homo sapiens
  misc_feature 1..156: note = chr11:31834086-31834242
  misc_feature 1..156: note = hyper
  source 1..156: mol_type = genomic DNA
ccatttgttgaatgccgcacgattaggacacacctcagtacactccaaaggcgcccctcggagcctgcagttaaggtgacaggagagcgagcggctgcctggtcctgcgctgtcccgagctctctcggcggcttcgggccacggagccgggaagga

SEQ ID NO: 72707 - DNA, 375 bp, Homo sapiens
  misc_feature 1..375: note = chr11:31834473-31834848
  misc_feature 1..375: note = hyper
  source 1..375: mol_type = genomic DNA
caagccgccctgggccgccgggccacatgtgggcctcaccctctcgttcctgcctgggacccagcagccctgcgaccaaggagcccgggcagggctcccgggaagcaaaggcctccccggccctagccagaggtggggtcgcataaccctctcccctccccgggctggggagggctgccggctctaacccttccccgggagctcgcagcgccgggaggaaacctgggtcagaggtgaaggaggtggcgccgggtgtccaggtccgcggcctcctgggcgaggtttcatttcgcaggagcgcgactttcggaggatgccggcaagtggggccgcggccctgagtcccagaccagcgaaagtcggctttctctttct

SEQ ID NO: 72708 - DNA, 1337 bp, Homo sapiens
  misc_feature 1..1337: note = chr11:31835180-31836517
  misc_feature 1..1337: note = hyper
  source 1..1337: mol_type = genomic DNA
agtgaatgccactgacgtcattgggtggggaagggggctccgggaaagactcctggaaactcctccgcacaaacaaaaaacaaaaaggacttggctgcttcccatgtgtcaatatttggggaggggagttcaaccccagaatgaggccgagttttcaaagtttaaggagagaggggtgagagtgagatttcctcgttctctctggactggtctcaaggaaggtgggggtgctgttctacctcgtggggagcctcactccctctgccaagtaccggctctgggggcgaagcggcctaggggtgtgggggccgagactgaggtgcgggcgcggttgccagaggtgtgtacaaaaccgagacaactcgcaggtcgccattttaattgcggctaccaacacgcccgaggcccacttgctgccctccaagacgcgggggggcggcggggattgcgctttaggttctgtctcctttccccgcctccccacaggcccctgttcccccctaccctccgccccctgtggccagagggaggacctctcaggccggcgggtgcgttcccgcgggggccgccggggtcgtcccacccggtagcggggctgtctgcgtggagggagtcccgctgggggaccgtggctcgccagagcctgcccagagcttctagccagtattgatgcgtcaacatgaggtgaggcaagcatctcacccgcaccgatccctggcattcccctgtgcccaccccatcaggccttcggggaggcaaagaagtgcccacttctggggggaagtgcctccagctcccagcttcagaaccaagagcctcccatccggagttctgacagttctgacacctccaaactctctctttccccggtcaagcagaggcgcagcgccggcgcgctggaaagggtgaagactggcattttttggagaaggaaagtcttggcagacacctgcgtcactttgtagtgccccaaacgtctctctttttgcagaccctgggaaggtgggatcccttgtccgcggagctggcaaacgggtccagtgagccctaaaggcaaaggctcccatcccggccgcccagtccctggtgcctcccccacttccaggcctttgtccctctcctttctccagcaacctgccggttcccgctaacccggcagcctcgccgagcccagagcctagaaaagccaagaagatcccagagccgccccgtggcaccttcaggctgtggccactgctcggcttggggggaagccgcggtgccctcgcccttcctcgcctcctgccaaatggccagtgctaggggctccctgggttcagtcctcagtcctcttccgt

SEQ ID NO: 72709 - DNA, 30 bp, Homo sapiens; identical to SEQ ID NO: 33767
  misc_feature 1..30: note = chr11:31836824-31836854
  misc_feature 1..30: note = hyper
  source 1..30: mol_type = genomic DNA

SEQ ID NO: 72710 - DNA, 159 bp, Homo sapiens; identical to SEQ ID NO: 969
  misc_feature 1..159: note = chr11:31837354-31837513
  misc_feature 1..159: note = hyper
  source 1..159: mol_type = genomic DNA

SEQ ID NO: 72711 - DNA, 2405 bp, Homo sapiens
  misc_feature 1..2405: note = chr11:31837541-31839946
  misc_feature 1..2405: note = hyper
  source 1..2405: mol_type = genomic DNA
cgagaggaaagggaatgaaaaatgaagcaacaaatgacaccacccaggctggcagccctcgttcccggccagaccccgctcctcaggcccggctctggcgccgggtggcgtccagcccctgcacgcgcggcgcggcccgcgggaaagtttgtgcagcgagagtgactgtccttccgcctcgcgcgcgctgcccccttctgccccggaggggcgttgggttcccttcggttttcctttccaattctaaaataaataaataaactccgggccctggggaaatctgaatagtaattccagtcatccaaattctatgagagggtctgaggaaaaaaagacaagcctatcacgggcgccctccgatcacgaagggcacgggcatgagaaggcgacagaggaggtcctcggctcgccctgggcgcggagcgaggactctggtcagaggtaattatgtcaccgcgttttctcgccgtgacagccgaataaacacgatctccaataaacatctctaatgagggaggaggcccgaggatggctgggtttgatttatgactggaggagaaggtccacttcccactgcgaagcaggcgacctgctcgccgcccagctccagggagaggaacccgcggaggagaggatcccggcccaggtaaggcgtgcggccggactgccactgcgctcgtcccccgtttccaggtgaggtgagcagggggcgccaccgctcggagtcgggcggaggtcccaacacctgtcacaggtgactgagctccgaaggtgctcccagaagacctagaaagggggcgcaggagcgcgagtgggagtgggggttgggggctagccggggcctggcccagaggccgccccaaactcccgggcggggttcttgggtgccccgcctaagccggcctgggcgtctccagctgcttttagggccgggctcccaggactttcgcccggctgaaccacaagttagtctaagtttgggtcgtcccttccctgactcactaaggggacacttccgggccccggctctggccctccaagggccgcagggtggtgggcgcttctctttcccgggcttggcggcccggctcccatggcgcccgcgcgcttcccgccgaggcagccagcgcagcgcccgcagtaaccggagcccgcgttctagctcagtgagaatcgctaattattaggtcttccgaagtgaagctcaaatcacacgctgggagctttacgcgctgcccagctctgtcggccgcattctttcgtactccgcgtctttctgagaaacgaaccccatctctagactttgttgcggtccagccatctgcactttgcaaccgcgggaaacttctgctgcacctcgcccgacccgcggcagggtgtctttaagcgctccaggcgcgggtacggactttcccaagcgtggatgtcgtgaactgcgatgcagaggaggtctggatgcaaagtgcgtccccacctcctgcatttttcgcggtcgcgagtggctttagcagacagcagcagcagactcccgccccctactcccagctcagggccggactggaagtccactcttaggagtggaacattttgctacttttgcagaagagcacactcggcaaagacaagtccctcctccaccccccttcctatccctccctcagtaactcgcttccatctttgtatgcctccttttaaaagcaaaaatcaagccccggggccacttggggcgggctttgatttggggacagcagtcgctggcagcggagaggccccgcgggccccgagccgggccggggccggagcccgggcggttacctgggagcggagggcggggaggcaggtgagcctggcagcgccggttcccacacttctcaccgccgctcggcaggggaagtggcagatctgacagccgcgttctacgcgaggacctgccccagagtttaaatgtcaatgataagaaaagagggtgctcaggcaggcgctaactttccttaatatccacgccagcgccgtcctcattggctgcccggcccgcgtgacgtcatggcggctagagttgggcacagctctgcgccgactagttttccggccgggcgggagcctgcttctccccacccagggtccggccggctccaacccctgctttggccttccttggcccggcctgtgactgctctagcccggcccggtccagcctgggccgccgtcctgtatggcgtagagtcgatccccaggaaactagtcttgccgagtgcgctcctccgcaccttcgggcactagggccccaagatctctgcccttaggctggccagctacctctctgggtaatcaccctgtcccctcctccgatccccaagggagtcccttcatcggagagacccgaaggccgcgccgggatggagagg

SEQ ID NO: 72712 - DNA, 132 bp, Homo sapiens; identical to SEQ ID NO: 3732
  misc_feature 1..132: note = chr11:31840041-31840173
  misc_feature 1..132: note = hyper
  source 1..132: mol_type = genomic DNA

SEQ ID NO: 72713 - DNA, 102 bp, Homo sapiens
  misc_feature 1..102: note = chr11:31840878-31840980
  misc_feature 1..102: note = hyper
  source 1..102: mol_type = genomic DNA
gacttgattttttgtcttgctcagcccgtcgaggactggagggcagagtaggggtgggagtgggggtaggggtagaggtgggggtggcggtgaaggtgggga

SEQ ID NO: 72714 - DNA, 315 bp, Homo sapiens; identical to SEQ ID NO: 971
  misc_feature 1..315: note = chr11:31841774-31842089
  misc_feature 1..315: note = hyper
  source 1..315: mol_type = genomic DNA

SEQ ID NO: 72715 - DNA, 102 bp, Homo sapiens; identical to SEQ ID NO: 33773
  misc_feature 1..102: note = chr11:31842174-31842276
  misc_feature 1..102: note = hyper
  source 1..102: mol_type = genomic DNA

SEQ ID NO: 72716 - DNA, 62 bp, Homo sapiens
  misc_feature 1..62: note = chr11:31843422-31843484
  misc_feature 1..62: note = hyper
  source 1..62: mol_type = genomic DNA
tgacaaggccggcttcgatctacaattgtatttgaatgggcaatgagcggaaagatctctca

SEQ ID NO: 72717 - DNA, 280 bp, Homo sapiens
  misc_feature 1..280: note = chr11:31845075-31845355
  misc_feature 1..280: note = hyper
  source 1..280: mol_type = genomic DNA
aaaggaaagtttgggcgggaagcgagcgtccccgggtctgaggctgctgggtggaaagctggcctaggagggcgagtagggagcaaaatagggcctggtccttgcggggccggggagctagaggccgcaggaagctgggagggccctttccaggcaggcagggcagcctcctggcgcggcccaaggcgcgaggcagccgctggctagggaggtccagtctcctgcaggccagggagggcttcctctgggtgcagccgtctccctccgctcctcagcttgg

SEQ ID NO: 72718 - DNA, 30 bp, Homo sapiens
  misc_feature 1..30: note = chr11:31845607-31845637
  misc_feature 1..30: note = hyper
  source 1..30: mol_type = genomic DNA
ggaattagttggaagcgggcgcattcccca

SEQ ID NO: 72719 - DNA, 58 bp, Homo sapiens; identical to SEQ ID NO: 33775
  misc_feature 1..58: note = chr11:31845842-31845900
  misc_feature 1..58: note = hyper
  source 1..58: mol_type = genomic DNA

SEQ ID NO: 72720 - DNA, 1140 bp, Homo sapiens; identical to SEQ ID NO: 33776
  misc_feature 1..1140: note = chr11:31846162-31847302
  misc_feature 1..1140: note = hyper
  source 1..1140: mol_type = genomic DNA

SEQ ID NO: 72721 - DNA, 343 bp, Homo sapiens; identical to SEQ ID NO: 33777
  misc_feature 1..343: note = chr11:31847370-31847713
  misc_feature 1..343: note = hyper
  source 1..343: mol_type = genomic DNA

SEQ ID NO: 72722 - DNA, 104 bp, Homo sapiens; identical to SEQ ID NO: 3735
  misc_feature 1..104: note = chr11:31847769-31847873
  misc_feature 1..104: note = hyper
  source 1..104: mol_type = genomic DNA

SEQ ID NO: 72723 - DNA, 76 bp, Homo sapiens; identical to SEQ ID NO: 3736
  misc_feature 1..76: note = chr11:31847895-31847971
  misc_feature 1..76: note = hyper
  source 1..76: mol_type = genomic DNA

SEQ ID NO: 72724 - DNA, 285 bp, Homo sapiens
  misc_feature 1..285: note = chr11:31848318-31848603
  misc_feature 1..285: note = hyper
  source 1..285: mol_type = genomic DNA
cttgatggcataactcgaaccggagaagcgaggggagcctgagtgactggggcgcacatgacccccctcctggggcctttgggctcaacccttacttttaacttgttctaacaggaataatggagtagtactactaatgcatggtcagaaggggcttttctgtctagaacgcaggcggcgggagttgcaccgccacagcccgggagaccaaagagtctccactccccgctcccggcgcctcctcgccgaccggagccccgagcccagtgagcccagccggtccca

SEQ ID NO: 72725 - DNA, 353 bp, Homo sapiens; identical to SEQ ID NO: 3738
  misc_feature 1..353: note = chr11:31848722-31849075
  misc_feature 1..353: note = hyper
  source 1..353: mol_type = genomic DNA

SEQ ID NO: 72726 - DNA, 30 bp, Homo sapiens
  misc_feature 1..30: note = chr11:31849540-31849570
  misc_feature 1..30: note = hyper
  source 1..30: mol_type = genomic DNA
tgccctagtgattgtcgaattttaaggact

SEQ ID NO: 72727 - DNA, 83 bp, Homo sapiens
  misc_feature 1..83: note = chr11:3186228-3186311
  misc_feature 1..83: note = hyper
  source 1..83: mol_type = genomic DNA
tccccagctccccagcgcgcgaccggccccgcggcgtggttccccgcactggctactgccagggtccgcggggctgcggcgcg

SEQ ID NO: 72728 - DNA, 170 bp, Homo sapiens
  misc_feature 1..170: note = chr11:3186601-3186771
  misc_feature 1..170: note = hyper
  source 1..170: mol_type = genomic DNA
ggcgggaggaggaggcgcggcggccgcaaaacccgggccgaatcgccgcgcggagcgggcgcccaggggctgccccccaccggctgccgcttctcctcatcccccaaccccccgcgcgcgctccggggctcacacccacccgggcggccagaggtcgggacactccgctg

SEQ ID NO: 72729 - DNA, 48 bp, Homo sapiens; identical to SEQ ID NO: 42995
  misc_feature 1..48: note = chr11:3187905-3187953
  misc_feature 1..48: note = hypo
  source 1..48: mol_type = genomic DNA

SEQ ID NO: 72730 - DNA, 127 bp, Homo sapiens
  misc_feature 1..127: note = chr11:32009000-32009127
  misc_feature 1..127: note = hyper
  source 1..127: mol_type = genomic DNA
cgacgccatctgctctgcgaagcagaaacggcggcagctgcgcgcccagtccctccgcccgcgccccgcgcgccgagtccggatccgccgcccggcggcaccgcggacagcgccagccccggggtgg

SEQ ID NO: 72731 - skipped

SEQ ID NO: 72732 - DNA, 100 bp, Homo sapiens
  misc_feature 1..100: note = chr11:3209774-3209874
  misc_feature 1..100: note = hypo
  source 1..100: mol_type = genomic DNA
acagagcgagactccatctcaaaaaaaaaaaaatctctcacaaaagctcataacagagtgacagtatgaatgcgtgggtgggggccggcagggtgctggc

SEQ ID NO: 72733 - DNA, 67 bp, Homo sapiens
  misc_feature 1..67: note = chr11:3224699-3224766
  misc_feature 1..67: note = hyper
  source 1..67: mol_type = genomic DNA
gctctgctgcctgtccgggtgccggaggcacgaccgctcccctccaggccgacgggctgctccagac

SEQ ID NO: 72734 - DNA, 23 bp, Homo sapiens
  misc_feature 1..23: note = chr11:32269881-32269904
  misc_feature 1..23: note = hypo
  source 1..23: mol_type = genomic DNA
actgcacccggcccacatctaca

SEQ ID NO: 72735 - DNA, 23 bp, Homo sapiens
  misc_feature 1..23: note = chr11:32281902-32281925
  misc_feature 1..23: note = hypo
  source 1..23: mol_type = genomic DNA
accgcgcccggccagtgctgcat

SEQ ID NO: 72736 - DNA, 68 bp, Homo sapiens
  misc_feature 1..68: note = chr11:32354892-32354960
  misc_feature 1..68: note = hyper
  source 1..68: mol_type = genomic DNA
caggtgcacggaaggcggcccattctggacagaaaagctttcgtttgacccaaagctcccccttccgg

SEQ ID NO: 72737 - DNA, 339 bp, Homo sapiens
  misc_feature 1..339: note = chr11:32354999-32355338
  misc_feature 1..339: note = hyper
  source 1..339: mol_type = genomic DNA
cgagcaggcggcttctcctgaccggggagacgcgggaggtttgcaaacagaccttggcctgggctgcgcagggacaaagtgttcaagggcagcaggggaggctgagggagtacacggctgggaacaagggacactgccgcccccagccacgcaggagcggtgtctgcaccactgaaagtcccccggggcccacagctctatccaggcggaagggaagcagccaggccgccgcggatctgaacttgaatcccgggtggaccggacgccccggccggcgctcctgacgcgcggaggagctggcgagaacctgcagatctcagggctcgcccgcggtccggc

SEQ ID NO: 72738 - DNA, 447 bp, Homo sapiens
  misc_feature 1..447: note = chr11:32448447-32448894
  misc_feature 1..447: note = hyper
  source 1..447: mol_type = genomic DNA
ggacagtcccccaggcgcggccactcccccacccaatctcccagggcaggcgcttttccttccttcatgacctcactacctccttcccttgacgtcagccccgggtccccgcgcggaggggagggaggatggggatgggtttgggggcagccggtgtcaggatccccgagcaccagggaggagggggctatgaggtcatgcgcgcccaatcccgggccgcacaggcctcgcgctgctgctccccggcccccgccccaacttccagccccgtgcgggctggtgtgcgccgcagttactaggcaaccctatcgcagacgcgggcggccggccaagttcacccaaagttgaagaaaaaatttgggggagagaaggtggagcgagaggcgagaagaggaagcacggagcggggaaaagcttggaagggaatgaagctggccttgggcctcc

SEQ ID NO: 72739 - DNA, 131 bp, Homo sapiens
  misc_feature 1..131: note = chr11:32449434-32449565
  misc_feature 1..131: note = hyper
  source 1..131: mol_type = genomic DNA
gtccgccggctcatgcgtcccctccggggtcccaaggacccagacgcagagcccagcgccttcctacctgctgtagggcgtcctcagcagcaaagcctggctgccggtgcagctgtcggtgggggtgtggc

SEQ ID NO: 72740 - DNA, 1170 bp, Homo sapiens
  misc_feature 1..1170: note = chr11:32455276-32456446
  misc_feature 1..1170: note = hyper
  source 1..1170: mol_type = genomic DNA
gtgggcgggcatcggcgcgggatgagaaaccaacctgatacttatcgtgtgccgagttccctccttgtatcctgactaagcacagcgaataaccctgtccttgttctaaccccaggtcttgaagaaatactgtcccagctgagccccgcgtttacaagatgaagaggcgccccagatgcgctgaaagaaaggccaaagctcgtgcctccttccactgcctgcggtagaacctggtcccgcatagcttggactcggataagtcaagttctcttccatccccagaacctgcgtggccgccgcctgagcgaagcccagtgaagatccacttctgtattaccatacgcgggagctatccacggacacgacgctgttccagaaagccatttagttactggaggtgcatgtgctcattctagttctctacgatacttaatgtgcacctaagtgtgtgccaacaccgtattataagggctggaggtgctcctggacattttagcgctgcggaggcagcacagcacaggcgctcacccccgcgctggtcccactccgaatccagagtccagacgtctgaaaagcgctacgcttggtgacaatttggcgtttccttaattaacaaaactctccccaaggcagagccagacactgcgccggtctcctggttccactcccgtggggactagcagtcccggaatctctcggactctaaggggccccagacgccctcccggctcttgcgaacagtcaggctcctagctctgcctggctttggaggatgtcgggggccagtgcctgcgtgcactcccactctccggcctcctccccagccgccgcttccgctatcctcacggcccttgggaagcagctgggtaagagctgcggtcaaaaggggtaggagaggggggtgtcctagagcggagagtccctggcgccactgccccgcgcgtagggggcgctccccggcctacttaccctgattgcgaatagcgggctggctctcgaggcagctgggcaggtagggcgcgttaggaaacatcctggcctggccggatgacgcctggctgggcggaggaggaccgaagggcccgtagcgacaggctccggctgtgccagtgaactggccggaaaagtggacagtgaaggcgctcaggcactgctcctcgtgcggctccg

SEQ ID NO: 72741 - DNA, 154 bp, Homo sapiens; identical to SEQ ID NO: 3740
  misc_feature 1..154: note = chr11:32456758-32456912
  misc_feature 1..154: note = hyper
  source 1..154: mol_type = genomic DNA

SEQ ID NO: 72742 - DNA, 286 bp, Homo sapiens; identical to SEQ ID NO: 33789
  misc_feature 1..286: note = chr11:32456913-32457199
  misc_feature 1..286: note = hyper
  source 1..286: mol_type = genomic DNA

SEQ ID NO: 72743 - DNA, 1564 bp, Homo sapiens
  misc_feature 1..1564: note = chr11:32457219-32458783
  misc_feature 1..1564: note = hyper
  source 1..1564: mol_type = genomic DNA
cgccctcgcagctggggtgagggcgggtccgagggagcgtccctctcggagacaccctcctcttcaacccaacacgcgctctcagctggccggtgtggcacaaccctccccccacctccccttcttggccttcgccagtgtgggagcctcgtctcactggagagtccgttcaggtaagcagtgagtccgggcagggtcgaatgcggtgggagtagagatggggttgttaatctaaaagagtggtttggagggaggggcaggtaggctccaagagggcgggaacttcaggaaagcgcagaaagaactcagtcaagcttcaaagaagcgtatacccttgctttgcacccttgagtctggctcttgcttctagaactgtcgggtaggggagtggccatgatcttggggtcactggggaaagaggtggccctttgtgggttccagaggtcgggactgaaagcgaacgtccctcagttgggtggccgggagttgcaccagttataagccgggcgtatttcgatcggctagtagttgtttacttggtgaggtttgcgccaggcggaaggcggttgccgcctacctaaaattggagtcagcagcacttagtttccctttccagtgaggaatatctaattcttctacggttaagccgggaaaacagcggctagtttaggagggaagaaaacccttgggcaaacgcccaaagcctgcgtatattccggccggagcatcctggcgcccagtttggggaggaggggtgaaggggagggtttggatacgaagcccggcagggagcgggtaactcctggagccactccgccgagcactgcctgtggccctggtcgaggataccattctggttgctcagtgattgaccaggaggcggaagccagttaaggggaccaaggagtggagtagggagaacctccatcggcccacgggcgcgagttagtgttcgaatctttgggagctcgaagagcttcgctaaatctgactcccttcgtctagtctctgtttggcagcccccgcgccccagagcaggtgtttggggcgggtagggggtgttttggtttggtttttggatcttctaaaggagtcagtatctattgggaaacaacccctaggcaaggagaagaaccgggggccggagcggagcgtgtttcagaggtgcgtataaaatcccaggggcgccaggaggcagcagcgacggcgcagcgtgggacggccaggcgcgacgggagggaagcaaccggttgcagtccggcctcctgtacctggctggcccgggctggggctgcaagctttccagccaaacttatgtgaagcaaagtagttgcagtttgacaaagaatggcgtttcaataaatgacatagtaattttttacgctttggtttttagcttgcattgcataaacgttgtcgccattaaattctggctgcggacccgaagtgtgtgcgggcccaggacttactcgaagggcgcacttcttgggaatgcgcatcccgtaggcgcaggagaccctgagggtaaagatgcggcacttgagccctccgcttgcctcccagg

SEQ ID NO: 72744 - DNA, 44 bp, Homo sapiens
  misc_feature 1..44: note = chr11:32459407-32459451
  misc_feature 1..44: note = hyper
  source 1..44: mol_type = genomic DNA
ggaggggaagagcaccggtgcgaaccccggggtgccccctcgcc

SEQ ID NO: 72745 - DNA, 299 bp, Homo sapiens
  misc_feature 1..299: note = chr11:32459576-32459875
  misc_feature 1..299: note = hyper
  source 1..299: mol_type = genomic DNA
cgaccccaacggatccacatgcccggaagcccaggcgacactaagccagcgctggggaactgacgtactcctgcagtcgcagggcgctccatgcctctctgtcctcttctttgttgtgggtaacgttctctgcgggagacctgaggttttccaagggggacatgccagctacactggccttggcgccctgagctaagcaccaggactcacagcctagcacgaaggcaggtagcaccttcacccgccgcggacgataggcgctctcctgtacctcctttagctcgcgaggcccgcccttc

SEQ ID NO: 72746 - DNA, 30 bp, Homo sapiens; identical to SEQ ID NO: 33793
  misc_feature 1..30: note = chr11:32460192-32460222
  misc_feature 1..30: note = hyper
  source 1..30: mol_type = genomic DNA

SEQ ID NO: 72747 - DNA, 47 bp, Homo sapiens; identical to SEQ ID NO: 33794
  misc_feature 1..47: note = chr11:32460468-32460515
  misc_feature 1..47: note = hyper
  source 1..47: mol_type = genomic DNA

SEQ ID NO: 72748 - DNA, 164 bp, Homo sapiens
  misc_feature 1..164: note = chr11:32460744-32460908
  misc_feature 1..164: note = hyper
  source 1..164: mol_type = genomic DNA
gacagccacactgcgcgcggggcccgcaggccgtaataaagagtggctcgacctcgctgctgcctgtcgcgggagaggaacaagctttcgactagcgcctctccccggggcccgcgccccgagccccacgcgcaagacagcccaacagctgttcctcccctccc

SEQ ID NO: 72749 - DNA, 32 bp, Homo sapiens
  misc_feature 1..32: note = chr11:32461289-32461321
  misc_feature 1..32: note = hyper
  source 1..32: mol_type = genomic DNA
tcagtgaaaggattccgcggcactgcctctat

SEQ ID NO: 72750 - DNA, 265 bp, Homo sapiens
  misc_feature 1..265: note = chr11:3249604-3249869
  misc_feature 1..265: note = hypo
  source 1..265: mol_type = genomic DNA
caggtggtcaggtggcgtgggcggcggcacgagtaccaggctgggaagagggcggccaggcactgctccacgctgacggccgccaggagactcaggcccacgatgtagcagaagaagcgcagcgttgccaggctggtctgcacgaagcccgggaagtccagccggccttgcagcaagtcggggacgatggccaccatgtggcagccaaggaagatgagatccgcgcaggccacgtccaggaggtagatggcgaaggggtttctgt

SEQ ID NO: 72751 - DNA, 153 bp, Homo sapiens
  misc_feature 1..153: note = chr11:3251585-3251738
  misc_feature 1..153: note = hypo
  source 1..153: mol_type = genomic DNA
catagctggtcttagcggcttcttcccacctcaaggttgtgctcagaacccctgctgtctccctccagtgataggagcacccgagaccatgcagggggacgctgcggtgctgggatgctggggagaggtggcccggggcggggctatcgctga

SEQ ID NO: 72752 - DNA, 82 bp, Homo sapiens
  misc_feature 1..82: note = chr11:3254436-3254518
  misc_feature 1..82: note = hypo
  source 1..82: mol_type = genomic DNA
gtctgatgaatgtgtcgcgctggtgtctgacgtccatgcggggctggtatctgacaggcagcagtgccgcttgctgagttgt

SEQ ID NO: 72753 - DNA, 22 bp, Homo sapiens
  misc_feature 1..22: note = chr11:32604850-32604872
  misc_feature 1..22: note = hypo
  source 1..22: mol_type = genomic DNA
tccactgcgcccagccaaagct

SEQ ID NO: 72754 - DNA, 195 bp, Homo sapiens
  misc_feature 1..195: note = chr11:327113-327308
  misc_feature 1..195: note = hyper
  source 1..195: mol_type = genomic DNA
tgcctcagtgccccacggacagggggtgcgatctgagcagaatgaggtgacgtcactgggtcagcggctcctgtggcatctggccaaggacaatgtgctgagaagtttcccctgaaaaaatcagaaacaaaactcacctcaggagaggcccctgcaccctccaagaggaagtgggagtcacgtgaggctcgtctt

SEQ ID NO: 72755 - DNA, 210 bp, Homo sapiens; identical to SEQ ID NO: 43034
  misc_feature 1..210: note = chr11:32728943-32729153
  misc_feature 1..210: note = hypo
  source 1..210: mol_type = genomic DNA

SEQ ID NO: 72756 - DNA, 30 bp, Homo sapiens
  misc_feature 1..30: note = chr11:3277135-3277165
  misc_feature 1..30: note = hypo
  source 1..30: mol_type = genomic DNA
ctgcttcttcagggccgtgaggccatgctg

SEQ ID NO: 72757 - DNA, 17 bp, Homo sapiens
  misc_feature 1..17: note = chr11:32859995-32860012
  misc_feature 1..17: note = hypo
  source 1..17: mol_type = genomic DNA
tccggaaaaaaaaaaaa

SEQ ID NO: 72758 - DNA, 37 bp, Homo sapiens; identical to SEQ ID NO: 43036
  misc_feature 1..37: note = chr11:32935022-32935059
  misc_feature 1..37: note = hypo
  source 1..37: mol_type = genomic DNA

SEQ ID NO: 72759 - DNA, 173 bp, Homo sapiens; identical to SEQ ID NO: 33796
  misc_feature 1..173: note = chr11:33037467-33037640
  misc_feature 1..173: note = hyper
  source 1..173: mol_type = genomic DNA

SEQ ID NO: 72760 - DNA, 104 bp, Homo sapiens; identical to SEQ ID NO: 43037
  misc_feature 1..104: note = chr11:33181185-33181289
  misc_feature 1..104: note = hypo
  source 1..104: mol_type = genomic DNA

SEQ ID NO: 72761 - DNA, 18 bp, Homo sapiens
  misc_feature 1..18: note = chr11:33184321-33184339
  misc_feature 1..18: note = hypo
  source 1..18: mol_type = genomic DNA
ctccgtctcaaaaaaaat

SEQ ID NO: 72762 - DNA, 137 bp, Homo sapiens
  misc_feature 1..137: note = chr11:33202679-33202816
  misc_feature 1..137: note = hypo
  source 1..137: mol_type = genomic DNA
gaggtctctgcccaacgctgagtcgcaactgccacattcaggacacatgtctccaacacttacataaaggacttttaggctgggcgcagtggctcacacctgtaattagccgggtgtggtggtgggcgcctgtagtc

SEQ ID NO: 72763 - DNA, 15 bp, Homo sapiens
  misc_feature 1..15: note = chr11:33262877-33262892
  misc_feature 1..15: note = hypo
  source 1..15: mol_type = genomic DNA
cgcaaagaaattaat

SEQ ID NO: 72764 - DNA, 224 bp, Homo sapiens; identical to SEQ ID NO: 43040
  misc_feature 1..224: note = chr11:33269863-33270087
  misc_feature 1..224: note = hypo
  source 1..224: mol_type = genomic DNA

SEQ ID NO: 72765 - DNA, 23 bp, Homo sapiens
  misc_feature 1..23: note = chr11:33277687-33277710
  misc_feature 1..23: note = hypo
  source 1..23: mol_type = genomic DNA
agccaccgcgcccggcctccttt

SEQ ID NO: 72766 - DNA, 107 bp, Homo sapiens
  misc_feature 1..107: note = chr11:33397535-33397642
  misc_feature 1..107: note = hyper
  source 1..107: mol_type = genomic DNA
gagcccggccgggcgcgcgggagcggggagcgcgcggtggctccgcgcggggctgcgcgcgcgcgccggcctcgcctcctcgcctcctcgcccgttccggaggctac

SEQ ID NO: 72767 - DNA, 16 bp, Homo sapiens
  misc_feature 1..16: note = chr11:33430482-33430498
  misc_feature 1..16: note = hypo
  source 1..16: mol_type = genomic DNA
gcgactccatctcaaa

SEQ ID NO: 72768 - DNA, 18 bp, Homo sapiens
  misc_feature 1..18: note = chr11:33655887-33655905
  misc_feature 1..18: note = hypo
  source 1..18: mol_type = genomic DNA
ctgcgcttactgctctga

SEQ ID NO: 72769 - DNA, 36 bp, Homo sapiens
  misc_feature 1..36: note = chr11:33721908-33721944
  misc_feature 1..36: note = hyper
  source 1..36: mol_type = genomic DNA
gcaggggaccaggggcgaggcaaccacctcaggccc

SEQ ID NO: 72770 - DNA, 46 bp, Homo sapiens
  misc_feature 1..46: note = chr11:33721966-33722012
  misc_feature 1..46: note = hyper
  source 1..46: mol_type = genomic DNA
cgcagaggctcgtaggggatggaggccaggccggagggccagggcg

SEQ ID NO: 72771 - DNA, 198 bp, Homo sapiens
  misc_feature 1..198: note = chr11:33801487-33801685
  misc_feature 1..198: note = hypo
  source 1..198: mol_type = genomic DNA
tggggctgtgttcctcggtggagacagctcctgtcagcgccctctttcctacctccagctcactcagctctgatgatactgttccctccctccagctgctagaactgtgcctcttgctttttcagggttggtaacggcttccctcccccaccccattactaatccctgggcacctcactgtcccgcattggttccctt

SEQ ID NO: 72772 - DNA, 44 bp, Homo sapiens
  misc_feature 1..44: note = chr11:33850913-33850957
  misc_feature 1..44: note = hyper
  source 1..44: mol_type = genomic DNA
ccccacacctggacccgcggacacctgggcggaaccccaagccg

SEQ ID NO: 72773 - DNA, 25 bp, Homo sapiens
  misc_feature 1..25: note = chr11:33858438-33858463
  misc_feature 1..25: note = hypo
  source 1..25: mol_type = genomic DNA
aaaccgaccacgccccttattattc

SEQ ID NO: 72774 - DNA, 39 bp, Homo sapiens
  misc_feature 1..39: note = chr11:33874033-33874072
  misc_feature 1..39: note = hypo
  source 1..39: mol_type = genomic DNA
ctcaagctcttcttgcgaggaacgcgtgggtgaacaagt

SEQ ID NO: 72775 - DNA, 180 bp, Homo sapiens
  misc_feature 1..180: note = chr11:33874405-33874585
  misc_feature 1..180: note = hypo
  source 1..180: mol_type = genomic DNA
tgtatttattgatggagatggctctcagtggagaggggagctggagaggggacgggacaagcagataatcttccctgagatctggcgttctccagccggctcttctctgaagttaatctctcctctgaagtccagctctccctctgaagtcaagtcgcctctctccagtcaagctgcttc

SEQ ID NO: 72776 - DNA, 186 bp, Homo sapiens
  misc_feature 1..186: note = chr11:33880881-33881067
  misc_feature 1..186: note = hypo
  source 1..186: mol_type = genomic DNA
agatgcccggggactcgggcctatatcatcccattgatcttagtccactcgtagatgtcctgttcgcacactatgtcagagttgatgaggaggtatctgtcacctacacagaaatgcttctgacaggcggcgcatttgaaacattccaggtgatacactttgtctttcacccgcattgtcatctca

SEQ ID NO: 72777 - DNA, 452 bp, Homo sapiens
  misc_feature 1..452: note = chr11:33890181-33890633
  misc_feature 1..452: note = hyper
  source 1..452: mol_type = genomic DNA
ctctgctaaaaactacgagactctactccccagaataattcacctatacacaaaatggtgcattaactttcgaggttcacatgtccccatcggtggaccccgaggaggggtacacctactcagatttactccggatttcgctgctctagaaatccctggaggcccagagccagctccgaggtggacggtcggacccctcacccgcccgttatccgcaaggctggcagcggctccacctgcggaccgggaaggcggccgttggggaccccggaggccgccacttggaatgttcccctttccaagaccaaatggacaaagagaaaggaccgagaaggagagggaagaagggagcagagtcaagcccagaacgctctccggactgcacctgcgcgcctccaggctctcctcgtgcctgctcccgtgcaaactttctggcccgtggtggctttggg

SEQ ID NO: 72778 - DNA, 168 bp, Homo sapiens
  misc_feature 1..168: note = chr11:33891959-33892127
  misc_feature 1..168: note = hyper
  source 1..168: mol_type = genomic DNA
tgcactgggatgccccggacagcgcggctctgcgggctgcgggctacgggctgcgggccccaggctgcgggctccgggctgcgggctccgggctgcggccgcgctctgcagaggcgatggtggtgcgccagccgggactgcacgggctggggacgcctagagcagagc

SEQ ID NO: 72779 - DNA, 48 bp, Homo sapiens
  misc_feature 1..48: note = chr11:33928255-33928303
  misc_feature 1..48: note = hypo
  source 1..48: mol_type = genomic DNA
cagaccgtggagctccgggtcaccagcctgaaccgcttaatgcacatc

SEQ ID NO: 72780 - DNA, 31 bp, Homo sapiens
  misc_feature 1..31: note = chr11:33951209-33951240
  misc_feature 1..31: note = hypo
  source 1..31: mol_type = genomic DNA
gaaaactcatgaggccgggcacggtggctca

SEQ ID NO: 72781 - DNA, 52 bp, Homo sapiens
  misc_feature 1..52: note = chr11:33976639-33976691
  misc_feature 1..52: note = hypo
  source 1..52: mol_type = genomic DNA
aggattgtggtgccacgtgggagcacaggctcagtgccgacagatctttctg

SEQ ID NO: 72782 - DNA, 30 bp, Homo sapiens; identical to SEQ ID NO: 42997
  misc_feature 1..30: note = chr11:3398724-3398754
  misc_feature 1..30: note = hypo
  source 1..30: mol_type = genomic DNA

SEQ ID NO: 72783 - DNA, 35 bp, Homo sapiens
  misc_feature 1..35: note = chr11:33993944-33993979
  misc_feature 1..35: note = hypo
  source 1..35: mol_type = genomic DNA
ttttaagttttctgccgtaaacatacagcacgtgt

SEQ ID NO: 72784 - DNA, 30 bp, Homo sapiens
  misc_feature 1..30: note = chr11:3429178-3429208
  misc_feature 1..30: note = hypo
  source 1..30: mol_type = genomic DNA
tggagccgggtgggccgggctgcagtttag

SEQ ID NO: 72785 - DNA, 45 bp, Homo sapiens
  misc_feature 1..45: note = chr11:34378277-34378322
  misc_feature 1..45: note = hyper
  source 1..45: mol_type = genomic DNA
catagggctgcaagacgccccagagctcggcgtcgttgttgatga

SEQ ID NO: 72786 - DNA, 30 bp, Homo sapiens
  misc_feature 1..30: note = chr11:3446939-3446969
  misc_feature 1..30: note = hypo
  source 1..30: mol_type = genomic DNA
atacttaaaaccaaacgtaaaattccaggt

SEQ ID NO: 72787 - DNA, 46 bp, Homo sapiens
  misc_feature 1..46: note = chr11:34517683-34517729
  misc_feature 1..46: note = hypo
  source 1..46: mol_type = genomic DNA
ggggcctcaaggattcggagaaacgcccaggcggggagtcggcccc

SEQ ID NO: 72788 - DNA, 35 bp, Homo sapiens
  misc_feature 1..35: note = chr11:34534277-34534312
  misc_feature 1..35: note = hypo
  source 1..35: mol_type = genomic DNA
ccaaactgaaaactccggcccgagaataccttaga

SEQ ID NO: 72789 - DNA, 204 bp, Homo sapiens
  misc_feature 1..204: note = chr11:34535044-34535248
  misc_feature 1..204: note = hypo
  source 1..204: mol_type = genomic DNA
ctctctgaggcaagccgtcacatccgtgtcaaacagctcccggaggccctgggactgcacccagcgcaggtgccggccctggagctggagatggacgagcagacccaggccccaggccgagcctctgagccctgacaccccttacgattcatccaaaaaagcaaagaaaaggcgcttacgtgagggcagcggtggctaggtcca

SEQ ID NO: 72790 - DNA, 30 bp, Homo sapiens; identical to SEQ ID NO: 43050
  misc_feature 1..30: note = chr11:34536053-34536083
  misc_feature 1..30: note = hypo
  source 1..30: mol_type = genomic DNA

SEQ ID NO: 72791 - DNA, 26 bp, Homo sapiens
  misc_feature 1..26: note = chr11:34577250-34577276
  misc_feature 1..26: note = hypo
  source 1..26: mol_type = genomic DNA
aactcaaatctgaagcgtcctggctg

SEQ ID NO: 72792 - DNA, 163 bp, Homo sapiens
  misc_feature 1..163: note = chr11:34847311-34847474
  misc_feature 1..163: note = hypo
  source 1..163: mol_type = genomic DNA
ctggcagcaactggtcgtacctgttttagagtcagtacattgtgtttgctggagagatgaaggagagcagcacacagcaccatctcatcatcgcaaatgccatttcaggttaatgattaccacgtacagtattactgtagtcaaaatgcgcacaccaagggcc

SEQ ID NO: 72793 - DNA, 28 bp, Homo sapiens
  misc_feature 1..28: note = chr11:34920681-34920709
  misc_feature 1..28: note = hypo
  source 1..28: mol_type = genomic DNA
ctgggattacaggcgtgagccactgagc

SEQ ID NO: 72794 - DNA, 166 bp, Homo sapiens; identical to SEQ ID NO: 43052
  misc_feature 1..166: note = chr11:35134173-35134339
  misc_feature 1..166: note = hypo
  source 1..166: mol_type = genomic DNA

SEQ ID NO: 72795 - DNA, 399 bp, Homo sapiens
  misc_feature 1..399: note = chr11:35440486-35440885
  misc_feature 1..399: note = hyper
  source 1..399: mol_type = genomic DNA
atcccctcacccttccgtagatgccatggtctggggaacgccccctcctcttcagcactatccggcagctgtgggcgagggagaaagcggacgccggggtgagcgcgaagtgcggccgggagcggtatttaagaggagcctctgcccgcccttccacccgcctccggggtaagccctttagcgcctcaacgggcgcaggaggctcctgcgggcgctaatccgcgtcccggctctccacggcgcgcgacccgcgctcccctccgcccgcggggatggcgcttggcggggagctccgggggctccgagggtggcttccccgagagagcgatgcgcccagggctgcaggagggcgcacgccggcgatgcgcccctgcagccgctgccacctgtgctttgctg

SEQ ID NO: 72796 - DNA, 822 bp, Homo sapiens
  misc_feature 1..822: note = chr11:35440936-35441758
  misc_feature 1..822: note = hyper
  source 1..822: mol_type = genomic DNA
cggtgagcgtgcgtgcgcgtgtgcgggtgtgtgcgcgcctggggaggcggtggaggccgctgcgctctggctcggcgccggccagggagggattgcaaggtttagccccgccggagctggggatttgcaggcgatccctctctattttcgtcgagagctgacatcacccgcgccgccgcctcgggcaactcctttaaccgccgccccccgcccccatctccagtcgcggtccctcctctgccatccctccccccagcctctcgccataaattagccaaataagaaaagaggccccgccgctcgtccgggaaggcttgggcagccggtggcaggagcccaggatctaaggagtagctattgtttcccctgaagcccgcgtggccccaggtcaccccgtgcggggtgaagcgcaggcgaccgcgcggagacccgggatgcccctccgtctccgcctccctggagcagcccctggcgctccctcctcactccccggagcacccgcttcagctcacactcacccccaaactcacaggcaggcacacccaccccatcctcccacgtctgggggtcccaggtccagcggagtcgagcggctgaaacacgcgggtggtgcagcctaaacgcggcccagctgcgctccctcccccgccgaagctcgaataaatctctggccttcaattattcagcgagattaatattaatgcagctccctgggggcggcgggcggggtgcaggggaggccgggattttttttttttttttttaggccgagagaggtcggcctcgtgggtgccggctgagaaggcgcggagagttggccga

SEQ ID NO: 72797 - DNA, 30 bp, Homo sapiens
  misc_feature 1..30: note = chr11:35547097-35547127
  misc_feature 1..30: note = hyper
  source 1..30: mol_type = genomic DNA
agtgagccccaactgcgtccagcaacccag

SEQ ID NO: 72798 - DNA, 240 bp, Homo sapiens
  misc_feature 1..240: note = chr11:35547335-35547575
  misc_feature 1..240: note = hyper
  source 1..240: mol_type = genomic DNA
ctgccttaacccttgcggggccccgggaggtgtggccacgcctggagacccgcggacggcggctgcaaaggaagctgcgggggagggaggccagcctgggtacaggtggggtcccagtgttgggtgctgggaggaggggccataggaccctgggcgggagcagaggtacccagggctgcggggcgctcaggtgaggccgggagatcttcctacgggaggctgagacgggagctggctttg

SEQ ID NO: 72799 - DNA, 89 bp, Homo sapiens
  misc_feature 1..89: note = chr11:35639567-35639656
  misc_feature 1..89: note = hyper
  source 1..89: mol_type = genomic DNA
ctgatcctagcctggcggagctcggaaagaggtggaaatctgtctgaagtttgcaggagacccgcgctgcctaggcaaagggacccggc

SEQ ID NO: 72800 - DNA, 149 bp, Homo sapiens
  misc_feature 1..149: note = chr11:35639657-35639806
  misc_feature 1..149: note = hyper
  source 1..149: mol_type = genomic DNA
accaagacacccccgcgagggcccagggcgcgtccctcccgccaggccccagactccggctctgcgccaccccctcctacgccccggcgcgggcgcagccagtccggcttcctccaggcccccaagtcccggaccgagtgtggggccgc

SEQ ID NO: 72801 - DNA, 1118 bp, Homo sapiens
  misc_feature 1..1118: note = chr11:35640499-35641617
  misc_feature 1..1118: note = hyper
  source 1..1118: mol_type = genomic DNA
tcagccaggcagccccggccggaggagagcgccgcggtgcacgggggcgtcttctggagccgcggcctggaggagcaggtgcccccgggcttttcggaggcccaggcggcggcgtggctggaggcggctcgcggcgcccggatggtggccctggagcgcgggggttgcgggcgcagctccaaccgactggcccgttttgccgacggcacccgcgcctgcgtgcgctacggcatcaacccggagcagattcagggcgaggccctgtcttactatctggcgcgcctgctgggcctccagcgccacgtgccgccgctggcactggctcgggtggaggctcggggcgcgcagtgggcgcaggtgcaggaggagctgcgcgctgcgcactggaccgagggcagcgtggtgagcctgacacgctggctgcccaacctcacggacgtggtggtgcccgcgccctggcgctcggaggacggccgtctgcgccccctccgggatgccgggggtgagctggccaacctcagccaggcggagctggtggacctagtacaatggaccgacttaatccttttcgactacctgacggccaacttcgaccggctcgtaagcaacctcttcagcctgcagtgggacccgcgcgtcatgcagcgtgccaccagcaacctgcaccgcggtccgggcggggcgctggtctttctggacaatgaggcgggcttggtgcacggctaccgggtagcaggcatgtgggacaagtataacgagccgctgttgcagtcagtgtgcgtgttccgcgagcggaccgcgcggcgcgtcctggagctgcaccgcggacaggacgccgcggcccggctgctgcgcctctaccggcgccacgagcctcgcttccccgagctggccgcccttgcagacccccacgctcagctgctacagcgccgcctcgacttcctcgccaagcacattttgcactgtaaggccaagtacggccgccggtctgggacttagtgtcaccgggaggaaaagagagagatctggggctggggtatggatgatggggggaagggcggtcgcctctgccactgtcagggaccagccggccaacgcccacccgcaaaggtgtctaa

SEQ ID NO: 72802 - DNA, 290 bp, Homo sapiens; identical to SEQ ID NO: 43053
  misc_feature 1..290: note = chr11:35684922-35685212
  misc_feature 1..290: note = hypo
  source 1..290: mol_type = genomic DNA

SEQ ID NO: 72803 - DNA, 30 bp, Homo sapiens
  misc_feature 1..30: note = chr11:3638442-3638472
  misc_feature 1..30: note = hypo
  source 1..30: mol_type = genomic DNA
ttgcccggccccacccggtctcctgtgcct

SEQ ID NO: 72804 - DNA, 420 bp, Homo sapiens
  misc_feature 1..420: note = chr11:36398057-36398477
  misc_feature 1..420: note = hyper
  source 1..420: mol_type = genomic DNA
gggaggagggagggacggagggagggagagctgggcagagcgcgacggggagaaccatccaggtcgctcatttctctccggtgagaaaacttcctcgggaagaccggaaactttttcctaggcgcgcggagtctggggcggaggcgagcggcgggtgtgcgcgactcggggtgattcacgccggggaccccaaggaggtgagtggtgggtggggggcgtctctgggaggggccggagtcataggctcagcaaccgcgcaggattgagcgaaaattaccgcgcgctaatctgacggggcgcggcgtggcgggggtaggagctagggaaaagtgtcacgtttgggggggcaaccaggtgggaactcctgcatggttaaggatcctccgatcggacgctgcaggcaggcgtaggggatcttac

SEQ ID NO: 72805 - DNA, 787 bp, Homo sapiens
  misc_feature 1..787: note = chr11:36398700-36399487
  misc_feature 1..787: note = hyper
  source 1..787: mol_type = genomic DNA
gcagcagccttttcccggcggtccccctttttctggagggaggcgtgggagagaagggcagggcagggagccactttgtcccgtgcgctgctgcacgcgcgcgctctgcggactagggtgggccagggcccagccagtggggatcccgccgggacgggctgtgagcaagccctgggacggcccggctgcggaccccgcgctgggagtccgcagtatcccccttccgttttatttctcccgcctgccttcctttcggcgaggctttcctctgcgcgcttactgtgcgcgcatgccgggctcgctgcacgcagggggcgctctaggggccccgcccgggcagctgggaccctgcctgcccaaccctccggcccattttccttgaggccgccgcccggggtgggaccaggctgtgtgcttgctaactgtgcttcaggaatccgctctgggatgccttcctgtctggcaaaaggggttacccccagttctacccagtccctgtcctcggtcacatgctgccgccgcctcttcccccgcggtgccgggagcccgcgttttgtttgtcagcagttaggcggtgagtatttatagacgccacggcagtcctgcggtgcgcaaggtttcaattactgcgatgcgccccacaagacgaaaggttcacgcgctgcgtctgagctgcacgtctgccccggagacccgcgtggaaaaagctctgggctggaatctccgggcttccctgcttgggcagaattctggacctgttgcccagacgacacgtgcacattcagat

SEQ ID NO: 72806 - DNA, 110 bp, Homo sapiens
  misc_feature 1..110: note = chr11:3663415-3663525
  misc_feature 1..110: note = hyper
  source 1..110: mol_type = genomic DNA
tgcggaagccgccagcgggagggagcgccgagggctctggcgggcgctgcgctgtccccggaggagtccggagtccggctgaaagcaaaggttctcgaggctaactgtag

SEQ ID NO: 72807 - DNA, 98 bp, Homo sapiens; identical to SEQ ID NO: 43054
  misc_feature 1..98: note = chr11:36687119-36687217
  misc_feature 1..98: note = hypo
  source 1..98: mol_type = genomic DNA

SEQ ID NO: 72808 - DNA, 22 bp, Homo sapiens
  misc_feature 1..22: note = chr11:36935607-36935629
  misc_feature 1..22: note = hypo
  source 1..22: mol_type = genomic DNA
ataaaggaaggtggccgggtgt

SEQ ID NO: 72809 - DNA, 858 bp, Homo sapiens
  misc_feature 1..858: note = chr11:369415-370273
  misc_feature 1..858: note = hyper
  source 1..858: mol_type = genomic DNA
ccccgcacccctccccgcgcgccgccattggctccccgcggcctggctcggtccgattggttccgcgcgcgcggccggggcccgatccgcggtggcagccgtggatgctgttcggtcccgccgccgccccaggagcgcggagccgggagcggccgggcggggggcaccgcgaggagccgcccccgccgcccaccccgggcccgcggccgagggcggcctgggggggtcgcggccgcacccggtggccgcgcacggcggacaaaggaccatgcggggccgcgggcgctgagcgcggcggggcgggccggggatgcggcgcggggcgggcgggggccgggggctgcagcggcgccgctgagcgcggcctggggcgggcgcggcggccgcgatgccgcggctcccggtgaagaagatccgtaagcagatgaagctgctgctgctgctgctgctgctgagctgcgccgcgtggctcacctacgtgcacctgggcctggtgcgccagggacgcgcgctgcgccagcgcctgggctacgggcgaggtacggcgcggggggcgcggggggcgcggggggcgggggcggcgcggggggcgcggggggcgcgggcggcgcggggggcgcgggcggcgcgggcggcgggggccccggggcgcgggccgggcctcccaccgcacagaggtctcggctgggcccgaccctcccggagaccccgcccgctgttctccgctctgcgatttggggggagggggcgcggttcggctcggcccggacgctcgatgacgtcggcagtgacgcgcgcgaccctcccagagagggtccctgactctgggatctggcttggatccggtagtgaggggct

SEQ ID NO: 72810 - DNA, 93 bp, Homo sapiens; identical to SEQ ID NO: 42998
  misc_feature 1..93: note = chr11:3697398-3697491
  misc_feature 1..93: note = hypo
  source 1..93: mol_type = genomic DNA

SEQ ID NO: 72811 - DNA, 30 bp, Homo sapiens; identical to SEQ ID NO: 42999
  misc_feature 1..30: note = chr11:3766731-3766761
  misc_feature 1..30: note = hypo
  source 1..30: mol_type = genomic DNA

SEQ ID NO: 72812 - DNA, 159 bp, Homo sapiens; identical to SEQ ID NO: 43000
  misc_feature 1..159: note = chr11:3828803-3828962
  misc_feature 1..159: note = hypo
  source 1..159: mol_type = genomic DNA

SEQ ID NO: 72813 - DNA, 33 bp, Homo sapiens
  misc_feature 1..33: note = chr11:38503116-38503149
  misc_feature 1..33: note = hypo
  source 1..33: mol_type = genomic DNA
gctggacgtcaagagggacgcaccaacaggcac

SEQ ID NO: 72814 - DNA, 30 bp, Homo sapiens
  misc_feature 1..30: note = chr11:392634-392664
  misc_feature 1..30: note = hypo
  source 1..30: mol_type = genomic DNA
cctggacacctcggccgtcagcagtggcct

SEQ ID NO: 72815 - DNA, 356 bp, Homo sapiens
  misc_feature 1..356: note = chr11:394701-395057
  misc_feature 1..356: note = hypo
  source 1..356: mol_type = genomic DNA
tccaagcagggaccccggggtcctccaaagactgagcctggccaggccccacctgtgcctggagtcctggagccatccctgtgggggatgacagggaaggttggcacatggcaggcgggccaggccactcggtcggcaaacccggaacacgcacgcgcctggccccggtagcacagactcacatagggtctcagggacacccagacacccacgctcctcccatacctcacgggaatgagcagaacgggaaagcggggagaggtgtgggggtgctggaagtcctggaggaaagccaggcctgtctggaccaggggctccctgaggaattagaggggagggcccggctggagtgacct

SEQ ID NO: 72816 - DNA, 43 bp, Homo sapiens
  misc_feature 1..43: note = chr11:39673547-39673590
  misc_feature 1..43: note = hypo
  source 1..43: mol_type = genomic DNA
cacagagacaggctccgtgcagtgcttgcggctggaccaggcg

SEQ ID NO: 72817 - DNA, 30 bp, Homo sapiens
  misc_feature 1..30: note = chr11:39808437-39808467
  misc_feature 1..30: note = hypo
  source 1..30: mol_type = genomic DNA
catagtggtggctcccgggggtaggttcca

SEQ ID NO: 72818 - DNA, 231 bp, Homo sapiens
  misc_feature 1..231: note = chr11:40314692-40314923
  misc_feature 1..231: note = hyper
  source 1..231: mol_type = genomic DNA
tctccttccctccaccgcctctgcaatttcataatctcacgttaaatggagtgcggggggcgggggcgggggcgggggcggaggtagtggaggaaaatttcaaggctccgtcagctgtcaagaagaaacccattcctccccccgctactttttttttttctttttaaggctcggggtgcctttccttcctctgtccccgcccccacccccagcacccggtccagatcctcc

SEQ ID NO: 72819 - skipped

SEQ ID NO: 72820 - DNA, 143 bp, Homo sapiens
  misc_feature 1..143: note = chr11:40315465-40315608
  misc_feature 1..143: note = hyper
  source 1..143: mol_type = genomic DNA
cggtttgaactctcttcctccccctccctctgctctctcccctctttttctcccaaataaatgctctcccagcaccggcggcagctcttgccagcccaggctttctctcgaccaatgccacgtcctgacgcttagggtcctag

SEQ ID NO: 72821 - DNA, 448 bp, Homo sapiens
  misc_feature 1..448: note = chr11:406722-407170
  misc_feature 1..448: note = hyper
  source 1..448: mol_type = genomic DNA
ggcccattcacaaagcgtggtgccgcagagctccccacggaggggtcccagcctggagcccgggcaccgcccatctctaacccgccgctagccccggaccctcccgcgcctgctccgcaccacggagccgggcctccagagcagcaaggtcaccaggtggcggtgctggcgcagcaggcggagcgccgggtgcgcggggtcgcgcctctggccctcgaaggtgatgaagatgggtctgcgggtgagctccagcagccggcacaggccctccctgcggggcgggaccgtcaggggggtgggtgctacgctggggcccacccaaccccgcgcgggacccaccggaagctgtggctgcaccaggcccggctcaggaaggcgtccgaaagcaccacgatgaggcgtcggcagcggctcaggttcaccaagaggtcggcggagggctctgcgg

SEQ ID NO: 72822 - DNA, 142 bp, Homo sapiens
  misc_feature 1..142: note = chr11:407389-407531
  misc_feature 1..142: note = hyper
  source 1..142: mol_type = genomic DNA
cgggtgggcggggcacggggtggggcccgggataccagcgcgcggcaggaggtcgcggtcgtccaggaagagcttgtagccccgacgccgctccagctgcggctttaggatgaagttcacgaacttgcggtcctcggggcag

SEQ ID NO: 72823 - DNA, 32 bp, Homo sapiens
  misc_feature 1..32: note = chr11:416565-416597
  misc_feature 1..32: note = hyper
  source 1..32: mol_type = genomic DNA
cgtcctcggtccgcggccgcccctgcccggtg

SEQ ID NO: 72824 - DNA, 37 bp, Homo sapiens
  misc_feature 1..37: note = chr11:41989424-41989461
  misc_feature 1..37: note = hypo
  source 1..37: mol_type = genomic DNA
aatccttaatttggccgggcgctgtggctcacgcctg

SEQ ID NO: 72825 - DNA, 120 bp, Homo sapiens
  misc_feature 1..120: note = chr11:42366142-42366262
  misc_feature 1..120: note = hypo
  source 1..120: mol_type = genomic DNA
tgcccgggctggtggaactggccggccgctccgagtgctgggcttgccgagcccttgcccgcccggaacacagaactcatgctggcctgtgagcaccaagagcagccctggttcctgctg

SEQ ID NO: 72826 - DNA, 293 bp, Homo sapiens
  misc_feature 1..293: note = chr11:429466-429759
  misc_feature 1..293: note = hypo
  source 1..293: mol_type = genomic DNA
cacacacctcagacacggcaggcatatgtgggccgtgcagggcatcgggcgccaacagcccctgctcgggtcggcctcagctgcgctgccagctccacctcacctgttcctcgtcccacacgtacaggtcccagtgcaggaccacgcgggcgcgctgccgcttccagatctccaggaacaccgtggctgcggcgggggcaaggaggggcatcactgcactacgccaggtggacctcggagcttgggctggcacttcccctggccccgcagaggcgtcccgcagcaactcaccc

SEQ ID NO: 72827 - DNA, 44 bp, Homo sapiens
  misc_feature 1..44: note = chr11:4298908-4298952
  misc_feature 1..44: note = hypo
  source 1..44: mol_type = genomic DNA
atttacccaatatttggtaaatcagtgagcgacagcaaacagag

SEQ ID NO: 72828 - DNA, 18 bp, Homo sapiens
  misc_feature 1..18: note = chr11:43402096-43402114
  misc_feature 1..18: note = hypo
  source 1..18: mol_type = genomic DNA
gcccggccaaaagctggc

SEQ ID NO: 72829 - DNA, 126 bp, Homo sapiens
  misc_feature 1..126: note = chr11:43543226-43543352
  misc_feature 1..126: note = hypo
  source 1..126: mol_type = genomic DNA
ggggcctcaagaccacgcggaacccctgggtgggtccccagctcgcttcagaggctcagagcagggtcagggacctggctccccggggccggagctgcctctaccccctggcgttacagactgcag

SEQ ID NO: 72830 - DNA, 46 bp, Homo sapiens
  misc_feature 1..46: note = chr11:43544024-43544070
  misc_feature 1..46: note = hypo
  source 1..46: mol_type = genomic DNA
gccttgggagtggtccgcatccgtgggtagacgctgtgggtctcat

SEQ ID NO: 72831 - DNA, 133 bp, Homo sapiens
  misc_feature 1..133: note = chr11:43568942-43569075
  misc_feature 1..133: note = hyper
  source 1..133: mol_type = genomic DNA
gcacagcgactgggccgggagcgacctggctctcggaagccgggcagggtgggggagggggcaggtaagtgggttgcctggcaacccggcagacccgcgggtggacaagctcaaggggcagccaggtgccacc

SEQ ID NO: 72832 - DNA, 187 bp, Homo sapiens; identical to SEQ ID NO: 33813
  misc_feature 1..187: note = chr11:43569128-43569315
  misc_feature 1..187: note = hyper
  source 1..187: mol_type = genomic DNA

SEQ ID NO: 72833 - DNA, 51 bp, Homo sapiens
  misc_feature 1..51: note = chr11:43569569-43569620
  misc_feature 1..51: note = hyper
  source 1..51: mol_type = genomic DNA
cggggagggagcgggcggggcggggccgcgctgctacgtaagcagccgcga

SEQ ID NO: 72834 - DNA, 107 bp, Homo sapiens; identical to SEQ ID NO: 33815
  misc_feature 1..107: note = chr11:43596489-43596596
  misc_feature 1..107: note = hyper
  source 1..107: mol_type = genomic DNA

SEQ ID NO: 72835 - DNA, 462 bp, Homo sapiens
  misc_feature 1..462: note = chr11:43596850-43597312
  misc_feature 1..462: note = hyper
  source 1..462: mol_type = genomic DNA
gcaggagggagagagcgggagccttagaatctgttatttgcgtcactcgaggagccggggctatctgcccgacaaacacacagaattaatccgagttacagccatagctgtctatgctacagtgaccagatgagaaagggcggggaaaggacgcgcgcgggagcgtgtgcacggccgagtttgcattgggcgtcttgggagagtttggggagggggctgtcctgctgggcacgcccctcggggccccgcttgcccggtgcagactaggctgcagcctgctctgcagctgcccagcccaagcctggggtggcgcccgcctcggccgcctcgcctgctcagtggctgcgtggaacacaaagcgctgtctccgagcagaagcgtcttctcagctgaaccagacccaccaaagaggagaatctgcacgtgacgtcagtagctgatgactgacgcaggctggcaaag

SEQ ID NO: 72836 - DNA, 66 bp, Homo sapiens
  misc_feature 1..66: note = chr11:43598418-43598484
  misc_feature 1..66: note = hyper
  source 1..66: mol_type = genomic DNA
gctgcaactctctctcgcgttatgggtcggcgctgttgagctcggttttctcgatggccccctccc

SEQ ID NO: 72837 - DNA, 30 bp, Homo sapiens; identical to SEQ ID NO: 10840
  misc_feature 1..30: note = chr11:43599075-43599105
  misc_feature 1..30: note = hyper
  source 1..30: mol_type = genomic DNA

SEQ ID NO: 72838 - DNA, 199 bp, Homo sapiens
  misc_feature 1..199: note = chr11:43600016-43600215
  misc_feature 1..199: note = hyper
  source 1..199: mol_type = genomic DNA
aacaagggcttttaccgatgtgcagaataacacaaataacgctgcaacccacactttgtcttgacaattcagttcaaaccaaagctgctcacagcctctcggcccaccccgcggcctcctcgtcattcactgggacctactggttccctttcccaagcctcgcccctctcagccctgcaagttgcgtggttgtgtttac

SEQ ID NO: 72839 - DNA, 1105 bp, Homo sapiens
  misc_feature 1..1105: note = chr11:43600492-43601597
  misc_feature 1..1105: note = hyper
  source 1..1105: mol_type = genomic DNA
cacggattcccaagtcgtgactgcaaaaagtgagtaatgcgcgctggctgcgtcatggctctagtcacagttcattccgaactgagaaggaatcgtgacttcgcctggagacgtcccctacatgggagatggggggcgggggggcaccaaatcagtggggacgggggtgggggggaagacctatccaatgaaaaccgctgccaggggggcatttgaactccgtcgcttgctgtctcgctgtcccctctctgccccgcgcacctcgctccccctcccggccggcgctcgcagtggcgcgcctgctcgctctcccgctaagcgacgagtcttcaacaagttggaggaaggcaggaacgcaggggttaagctcggaaagccgcaattaccaagatcgtgaccctcccacacagtacagtaacttatatacttacctggaagaacccgctttgccgccgggcaaacacccgtggggggcggggaggggccggagggagcgggccggcaggagaggggctgcttccagctggctgcagtgcggacgggaccggcgcgctcccgtggcccccagaccgaggtaaggagcagggagtcggcgcccgggtcggctggtggtcggtcggctcactggtagtcggtcggctcacgggtagtctgagcagaacttttttttcccagttgccccgcgccgcggcggcggcgggcgcagaccgcggagcccctctggcgcggcgggcgcgcagacgctcggagggtgtgtgcttgcgtctgtcagtcccggagccgaggggatgccgtgggagggtgagtgggtcgcggagctgcaggagggtgatggatgggcgaagggggtgggtcgacagggacttgaagacagtgcctccaccgtcgagagacgttttctccgggcgtgctgggcgagggtgggagtgtgtgtgcgcgcgcgcgcgcccgcccgcacgtcgattccagggtgccaaagaacaaatatggcaactttccccccaagttcttgcaatgtttgcagtaacccatcctgggtgaggtttcccccactgggggactatactgctagggagggagatagtcaggacgtcccttagcccac

SEQ ID NO: 72840 - DNA, 30 bp, Homo sapiens
  misc_feature 1..30: note = chr11:43602138-43602168
  misc_feature 1..30: note = hyper
  source 1..30: mol_type = genomic DNA
atctttgtcatttttcgtctggatcttctg

SEQ ID NO: 72841 - DNA, 454 bp, Homo sapiens; identical to SEQ ID NO: 973
  misc_feature 1..454: note = chr11:43602393-43602847
  misc_feature 1..454: note = hyper
  source 1..454: mol_type = genomic DNA

SEQ ID NO: 72842 - DNA, 189 bp, Homo sapiens; identical to SEQ ID NO: 974
  misc_feature 1..189: note = chr11:43602848-43603037
  misc_feature 1..189: note = hyper
  source 1..189: mol_type = genomic DNA

SEQ ID NO: 72843 - DNA, 1070 bp, Homo sapiens
  misc_feature 1..1070: note = chr11:43603076-43604146
  misc_feature 1..1070: note = hyper
  source 1..1070: mol_type = genomic DNA
cgcaccttcccgaagctgctccatccgagccttacccggccctttccccgttttccacggaagattcggccctttcccccgtcctttccgcggtgcccgaggctttggtcacctgtcttccctccgagcgagtcccccgcccccaactttttaacagactttgtatcacagggggaactggagcaggtggggtgtgtgtgttttcggagaagtgagaagaagctaaaatgcaataaaagtttacagaagttgtgtcttccccccaacccccgcccacaccacgaataaccccattcactcaatgcaaagaaaaggatctgagcttaaggccaagtcagaacctggaatatgaatcagtttaggacattttgtggtcatttttgaccgtaatgatccgattctgcaatatgggggtggggaagcccttgagggaggggctggaggcccttagtatcttatgtcctggtgcgggggacccggaggtgaggcgagccgcggtgaattgggtagatccgaaaaagagggaaaacacccaggcaccgcccgatccccggagtctcttcctcccgcgcctgcttccaacctaatttggggcgttttgcagcctcgggtctcccacatctcctctttttcaaaactaagtagcacggaagggggtaaaacaggcgagaactggggaagcccccgcagagaaggagctttggagagatgcggttgtgcccgactcagacgcttagcaggaacagaagcagcagcagcagcagcagccccatcccggcctctccaggcgccggtcctggggaggggggcaaagctgcaggagaggggagagtctgtgagtccccctcctccccctccactcattgcagtcctgaccacttcggtcacaagtggcacaaatcaggccttcaccacgctccccgcgcccttcgcctgctaggaacactgctagacgcccttgcccttagggactgggccagaaggacacacatacacacatgagtgcccacagggacagaaatgggtagaagatgggtctagagacaccggagttcaagacccgagggctg

SEQ ID NO: 72844 - DNA, 127 bp, Homo sapiens
  misc_feature 1..127: note = chr11:43604737-43604864
  misc_feature 1..127: note = hyper
  source 1..127: mol_type = genomic DNA
aagaggttgagccaccgcagcgcaggcggctcagggttattgcgaccctagccccctcacttctccctccgaggctaagtgtgggactagggctccagggcccaaggagcaacggccgaacccggcg

SEQ ID NO: 72845 - DNA, 30 bp, Homo sapiens
  misc_feature 1..30: note = chr11:4361455-4361485
  misc_feature 1..30: note = hypo
  source 1..30: mol_type = genomic DNA
cgctctgttttctgtcgctcactgatttac

SEQ ID NO: 72846 - DNA, 16 bp, Homo sapiens
  misc_feature 1..16: note = chr11:43694378-43694394
  misc_feature 1..16: note = hypo
  source 1..16: mol_type = genomic DNA
ccgcaccctggccaat

SEQ ID NO: 72847 - DNA, 30 bp, Homo sapiens
  misc_feature 1..30: note = chr11:43701969-43701999
  misc_feature 1..30: note = hyper
  source 1..30: mol_type = genomic DNA
atcccatttcctcttcgaacctgagctcaa

SEQ ID NO: 72848 - DNA, 93 bp, Homo sapiens
  misc_feature 1..93: note = chr11:43963470-43963563
  misc_feature 1..93: note = hyper
  source 1..93: mol_type = genomic DNA
atgaatgggggtgcccgagggacttgggtgggggagtgaggagacaaacataaagaagacatctagggaagggaagaaccggaatggaataat

SEQ ID NO: 72849 - DNA, 392 bp, Homo sapiens
  misc_feature 1..392: note = chr11:43963623-43964015
  misc_feature 1..392: note = hyper
  source 1..392: mol_type = genomic DNA
gtgcgcgcgcgcgcctgcggaggggggtggcaaggatccagaaggggagcccaccccttcttccgagctcagctctggggagccgggcgctcaggctcgccaggctgcaaagagagctgagagctgcctcgcgccccgcgcagaaccggcggtggaataaccagcgcctcaagtgtgtgcatctgggaccagggggcgggggagggggacctgcggccccgcggccaacccggttggtgcagacttggggatcccagaagggacagtgcccgcccagtcgcggcgattgagggtccctgtccgggcgcagctcgggccagccgcgtgctccggggccgcggcttctcccggaacccccgcgggcggggcctgccttccggagccggttggcg

SEQ ID NO: 72850 - DNA, 1054 bp, Homo sapiens
  misc_feature 1..1054: note = chr11:43964245-43965299
  misc_feature 1..1054: note = hyper
  source 1..1054: mol_type = genomic DNA
ccccgtgccccccgacgggtccgcccgcccgcccgccctcccgaggagcgccggcccgggcccgcgagggccgccgccaccccgcagcagatttggatcccccgcccggcgagcccccggctgctgcctcccggggggccccggcgcagcggccgccctcggagagccccggcgccccgccgcccggccccgcagacgccggaggcgccatggccgccaagcccggcgagctgatgggcatctgctccagttaccaggcggtgatgccgcacttcgtgtgcctggccgacgagttcccgcagcccgtgcggcccgccaagctgcccaagggccggggccggctgcggcggccgcgccagtctcgcttcaagacgcagccggtgaccttcgacgagatccaggaggtggaggaggagggggtgtcccccatggaggaggagaaggccaagaagtcgttcctgcagagcctggagtgcctgcgccgcagcacgcagagcctgtcgctgcagcgggagcagctcagcagctgcaaactgaggaacagcctggactccagcgactccgactcggccctgtaaggggcgccgcccgcgggggggacgcgcgcgtccgcggtccgcgcggggaccggcgtgtgaaccccgagagtgcccgcgccctgctcccgggggacccgcaaggacccgggaccgccgctcctcgcgcgctcggactcccgccccgctgcgaaccggtcggtgcgcccctcgccgcgctcgccctggcccgggagcgccgggagcggggccgctttcctcgtccttgtaaatgtttattttttaactcttcccagtgcgaactctgctgtgagtgtgtgcggggaggcgcgcccgcgctgagtcggcggcgggtagccactccatgcccttgtccgatggtttgcaactccgattttgcacaccgctccaccgtgccccccagcgcacacccattcacactcacgccaacactctcgctgaacacttttataattgttaggcgtggccgttgggactttgggcgcagcgcggctgct

SEQ ID NO: 72851 - DNA, 557 bp, Homo sapiens
  misc_feature 1..557: note = chr11:43965504-43966061
  misc_feature 1..557: note = hyper
  source 1..557: mol_type = genomic DNA
gtggcagggggatgtcggaccagggagccgggagtggagctacctccacaagcttcggtcaccggaacgaggttgcgccaccggtgcgcgggtcggttgcctgcctccccaagtggatccacccccggtccagtgtgctcctgcgtccctggtctattccccatcgccggcatccgggctgaagtgaagccgcaggaggggcggaggcagagctgacgatggagagctctctcctccgtacagttcacttcccagagctggggtcagggtcctcgccccgcacccgccacagaagacgcatctccctctgcgctgattcctggcggcgggtggggagatgtcggagccagcaatgcgagatgtttgggcgttgggacccgagagtgggctggaggccagcctgggttggtcgagagtgtgggtgcgcgctcgctgtcgcgggcaggtgactccctgaccgcagttgacccagcgcagtgcctggcgctcctgcgctgcggggaaaaccgcggccgctatgtctccagccgttctctgcgctccgcagggttcctcca

SEQ ID NO: 72852 - DNA, 30 bp, Homo sapiens
  misc_feature 1..30: note = chr11:4399994-4400024
  misc_feature 1..30: note = hypo
  source 1..30: mol_type = genomic DNA
gtgtttctggtaaagcggctgcctttctgc

SEQ ID NO: 72853 - DNA, 33 bp, Homo sapiens; identical to SEQ ID NO: 33832
  misc_feature 1..33: note = chr11:44324942-44324975
  misc_feature 1..33: note = hyper
  source 1..33: mol_type = genomic DNA

SEQ ID NO: 72854 - DNA, 82 bp, Homo sapiens
  misc_feature 1..82: note = chr11:44325688-44325770
  misc_feature 1..82: note = hyper
  source 1..82: mol_type = genomic DNA
gtatcatcacatagccgggtcctcgcagtgttggtttcccaatccgatgactgtcacctcggtgaggacctgtgctgatggc

SEQ ID NO: 72855 - DNA, 464 bp, Homo sapiens
  misc_feature 1..464: note = chr11:44325886-44326350
  misc_feature 1..464: note = hyper
  source 1..464: mol_type = genomic DNA
cggcttcctgaacaggggtttggggggctaaggacgctgaggctccgggggcaggaagttctctctggttaagcgttctctcttctctccggcatacactcccctacccacccacctcgcctaccctcggggcgagaggctcaccaaggcagggcgcgccccccccatgaatcatcccaaggcctctgagccgcgggggctccgggcaactatccccctcctctcctggcctcaggcaccccagtccaggggtctgcagagaagcccgaagcccggacaaacgcgccggacgtcaacaacctctcatccctggcagcagcaaaggccaatatatttccatttcttatttcagtttgccaccaaaacaaagctgcgcgcggctgagggcaggaaggcgctgagaccgagaagaagggacgtcccggagaaagtgcgcccagctgatcttagaaaccagagtcctc

SEQ ID NO: 72856 - skipped

SEQ ID NO: 72857 - DNA, 132 bp, Homo sapiens
  misc_feature 1..132: note = chr11:44330477-44330609
  misc_feature 1..132: note = hyper
  source 1..132: mol_type = genomic DNA
cagggtcccaggactcgggtcttgccagaccacagtgtcccctgggaccctagggtctctggctccgcactgtgttgcgccagtgcgcctggatttcccgtgagctttcggccaaccacgctccgggcttcc

SEQ ID NO: 72858 - DNA, 81 bp, Homo sapiens; identical to SEQ ID NO: 976
  misc_feature 1..81: note = chr11:44330877-44330958
  misc_feature 1..81: note = hyper
  source 1..81: mol_type = genomic DNA

SEQ ID NO: 72859 - DNA, 481 bp, Homo sapiens; identical to SEQ ID NO: 977
  misc_feature 1..481: note = chr11:44330959-44331440
  misc_feature 1..481: note = hyper
  source 1..481: mol_type = genomic DNA

SEQ ID NO: 72860 - DNA, 425 bp, Homo sapiens
  misc_feature 1..425: note = chr11:44331482-44331907
  misc_feature 1..425: note = hyper
  source 1..425: mol_type = genomic DNA
cgaacttgtcgcctccgggaaatgccctaaaaggcgacgagccctcccgactctgcgacaccgggctgtagtaggcgtccatggcagcggccggcgactcgcagtaagagacgcaagtctcagcattcatgcctggcttgcgcaggcggcgggcggggacgcgagcgagggcgcgaggacgccaccgcgcgccttggctgggagtttggggaggcgaggaggctgtggctgtgcactccttgcccggcctgctcgctctccctcctcccctccacgccggcctctctctctctccccctcttctttctctgtctctctcctctctctccctcctctctctctcttcccctccctcccccccccttcctctctctctccctctctctctttcctccctccccacagctagccgagggaaagaacgg

SEQ ID NO: 72861 - DNA, 814 bp, Homo sapiens
  misc_feature 1..814: note = chr11:44332324-44333138
  misc_feature 1..814: note = hyper
  source 1..814: mol_type = genomic DNA
gggaccacgggcctgcggatgcaagcgagtcctacggactcctgcgcgcgagctcgcgggcgccgctgcgggccttcccgctggcaccttttcctaggtttccaaccttcctccccattcccgttcctacgggagattaacacacacacaagccttcgtcgtccagtgcatggtcacttgcacgtcttgttaactatttccctctgctgtaagggcgctgggctgggatgtagcggaatctgtgctccctcaagccctggagaagccctgggctgggcccggcttcagaagctttagagcgctgccctctgcgctcccgtctagaggccgcaccgttcacgccccacgtctgcgcccaggcgaggggatttcctgccaggcgaagtacagagagcggactctggagaccccctgaccttgcccgatagtcgcgctgtcacctgttcactccttggggtcaggggtcggggagaggggtgagaccgtctcttccctttctggcctcactgcccccgactgtaaaacgaactgcttggttttgataggttgtggtttcaccaccactgcgagcctcaaggcccctggcaccgccacagcaagggaaaaaactttgcgcgtgcagcccctcgatttcgcttcatgacaaccgtgctagagattggcgcccccaattttctgatgagctaacggaggctcagagaggggcggccacctggtccaggtcacacagctgggaaatagccgtcgcgccctggaacctctgctcaggctagtccctccaccgacctggaaggccgtgcggacagcgtagatg

SEQ ID NO: 72862 - DNA, 86 bp, Homo sapiens
  misc_feature 1..86: note = chr11:44333542-44333628
  misc_feature 1..86: note = hyper
  source 1..86: mol_type = genomic DNA
accaagccaggagcgcgcaggctccagccgccccccactccatgcccaatgggaaccgcgcctcactggcccgcagacctaagcca

SEQ ID NO: 72863 - DNA, 136 bp, Homo sapiens; identical to SEQ ID NO: 10858
  misc_feature 1..136: note = chr11:44337726-44337862
  misc_feature 1..136: note = hyper
  source 1..136: mol_type = genomic DNA

SEQ ID NO: 72864 - DNA, 176 bp, Homo sapiens; identical to SEQ ID NO: 10859
  misc_feature 1..176: note = chr11:44337882-44338058
  misc_feature 1..176: note = hyper
  source 1..176: mol_type = genomic DNA

SEQ ID NO: 72865 - DNA, 466 bp, Homo sapiens
  misc_feature 1..466: note = chr11:44338086-44338552
  misc_feature 1..466: note = hyper
  source 1..466: mol_type = genomic DNA
cgctgggacttgcaccccgagtttaggggcttagccatttccggaactcgggctagtggactctggggaatcaggcgctgggagaggccttcgcagctgcgtctctcctgcccagcatattgtgttgaatgaggcaagggagtgagggggtcgtaaaggaaacccgcactcaggggcacaccttcatttatctgggaacagcgcggatcccagaggtgcgggataaaccaggcgttccagctgctcacacgctgtttggtaccccgcgtctatgaagcacaaagcaggagcggattggaggttttacaaactgaccaaccccgccgcccgcgcccgctggagggagacgcacacctttgccctgcatattcgcttccaggctctgcatctctgctcttggggagccggccacccgcttttccgcgcgggggctggggttctcgcctgaaggcgaagtccgcgtgcg

SEQ ID NO: 72866 - DNA, 30 bp, Homo sapiens
  misc_feature 1..30: note = chr11:44340703-44340733
  misc_feature 1..30: note = hyper
  source 1..30: mol_type = genomic DNA
ccagcccagggcggccggctcccaggcctg

SEQ ID NO: 72867 - DNA, 243 bp, Homo sapiens
  misc_feature 1..243: note = chr11:44341082-44341325
  misc_feature 1..243: note = hyper
  source 1..243: mol_type = genomic DNA
gctactcattagctgcgtccagcctgtgcaactcccccgatccggccggtagtatctgaggactccagtggccagacctcgaccctctctcccacccctcctgaggtccttccttccccaggacccatgggcgcacagctggcctctccatactccccctacccgcccagagcaggcccagagcgcgcaactgcgggcgaactgacacctctcctggcgtcgacccctcggtccagaactgag

SEQ ID NO: 72868 - DNA, 68 bp, Homo sapiens; identical to SEQ ID NO: 3751
  misc_feature 1..68: note = chr11:44341966-44342034
  misc_feature 1..68: note = hyper
  source 1..68: mol_type = genomic DNA

SEQ ID NO: 72869 - DNA, 30 bp, Homo sapiens
  misc_feature 1..30: note = chr11:44525426-44525456
  misc_feature 1..30: note = hypo
  source 1..30: mol_type = genomic DNA
aacctgagggtctggcggctgagaacagcc

SEQ ID NO: 72870 - DNA, 362 bp, Homo sapiens
  misc_feature 1..362: note = chr11:445925-446287
  misc_feature 1..362: note = hypo
  source 1..362: mol_type = genomic DNA
cacttcagaagaccccgtccaccagaccgcctccccctgaggcccaacatgcagcagaggcagctcctccgtccctgcagcctccttttaactgtgggatatggcagccacccgtggagcggtccgggtgacaaagccagcgagagctagggagcgcccaggtgaaatcccacaggcaggtgtgagcaccaattgtcattacctttgccctgggcccctcagagacctgtcctccccccccgcccccaacagcctcctgggcgcggccacagacacagacacagtgtctggacgagcagactcgtccaggcactgctcagaggcagcccctctgggtcagctggagtcggtgcctctgagaa

SEQ ID NO: 72871 - DNA, 66 bp, Homo sapiens
  misc_feature 1..66: note = chr11:44609349-44609415
  misc_feature 1..66: note = hypo
  source 1..66: mol_type = genomic DNA
ccccaacctgccctgcgggcaaggacagaagaggcctgagaaccgtctcttcggactcaggggcag

SEQ ID NO: 72872 - DNA, 42 bp, Homo sapiens
  misc_feature 1..42: note = chr11:44620240-44620282
  misc_feature 1..42: note = hypo
  source 1..42: mol_type = genomic DNA
ctgaggcaggtgcctcgtgccttgggccggtcctggctctgg

SEQ ID NO: 72873 - DNA, 30 bp, Homo sapiens
  misc_feature 1..30: note = chr11:44621968-44621998
  misc_feature 1..30: note = hypo
  source 1..30: mol_type = genomic DNA
ttttctcttcttccccgaacaaagctgctg

SEQ ID NO: 72874 - DNA, 229 bp, Homo sapiens
  misc_feature 1..229: note = chr11:44748190-44748419
  misc_feature 1..229: note = hyper
  source 1..229: mol_type = genomic DNA
ccctctccccactcccgcaacgatcttccgaattcagacgcagagagggcccgcgagcagagcgggaggtggtcggaggcggaggaaggggagatgggcagagggtgggcccagggacccccagacaaggcctggacgcggggttggaggaggaggcggaggctggcgggaggcgaggggcagcccgcagaggagacgcgcttctcggcagcaacggcgtctggagccg

SEQ ID NO: 72875 - DNA, 196 bp, Homo sapiens
  misc_feature 1..196: note = chr11:44748675-44748871
  misc_feature 1..196: note = hyper
  source 1..196: mol_type = genomic DNA
gagcgagcgccgccgcctcgcgctgcgggtccccggacgcgccgccaccgccgggaaggcagccggcgccgggcaagttgcgagcgcgcccctccgaccaggaaagtttccccccggccgccggcgggatttggcgcggggtccggcagccgccgctggaaggtatggggctccgcacctccgtgccctccgcacg

SEQ ID NO: 72876 - DNA, 34 bp, Homo sapiens
  misc_feature 1..34: note = chr11:44749184-44749218
  misc_feature 1..34: note = hyper
  source 1..34: mol_type = genomic DNA
tttcggccagggctgcgcccggaaaggggctgct

SEQ ID NO: 72877 - DNA, 120 bp, Homo sapiens
  misc_feature 1..120: note = chr11:447598-447718
  misc_feature 1..120: note = hypo
  source 1..120: mol_type = genomic DNA
ggcttgagccaccgcgcccggccttctctgccacagtttttttgtctctaagcgacagtcaaaaatagaacctaagggggtgtgttaagatcacaatagttggcccggcgcggtggctca

SEQ ID NO: 72878 - DNA, 51 bp, Homo sapiens
  misc_feature 1..51: note = chr11:44919182-44919233
  misc_feature 1..51: note = hypo
  source 1..51: mol_type = genomic DNA
gcaggacagttgccccgagtgtgtgtatctggagggcgggttttcataaac

SEQ ID NO: 72879 - DNA, 281 bp, Homo sapiens
  misc_feature 1..281: note = chr11:44922693-44922974
  misc_feature 1..281: note = hypo
  source 1..281: mol_type = genomic DNA
tctgaaactggaacccgggcctccatattcttcaccggcccccaggctcacatcatctattttcctacctgactcacctttgaggttgtgggaggctcttcccaggagacatgtctcctttgattgcatttgtctgggagcccagcactccgcaagcccgggccatgagatgtaatctgcaatgaatgtggtacacaataaatacaggtagtccgtttatgagctgccatatttattacaccccttaattgctaaagagccagagccggctgaagctggat

SEQ ID NO: 72880 - DNA, 30 bp, Homo sapiens
  misc_feature 1..30: note = chr11:44925810-44925840
  misc_feature 1..30: note = hypo
  source 1..30: mol_type = genomic DNA
gatgctgagtggccccgcctgtgcctcccc

SEQ ID NO: 72881 - DNA, 142 bp, Homo sapiens
  misc_feature 1..142: note = chr11:44929860-44930002
  misc_feature 1..142: note = hypo
  source 1..142: mol_type = genomic DNA
ggcctcttgggcctccggtcctcccaccacacaaagggatttcaaatactttacagcccgcaaatcccatggtgccaaactttggttcttcccacaacagatctgcttctaatacttatctgtgcccaagaaaaatggaata

SEQ ID NO: 72882 - DNA, 33 bp, Homo sapiens
  misc_feature 1..33: note = chr11:44931098-44931131
  misc_feature 1..33: note = hypo
  source 1..33: mol_type = genomic DNA
ggactcactggctctcgccgcaggtgaattcct

SEQ ID NO: 72883 - DNA, 41 bp, Homo sapiens
  misc_feature 1..41: note = chr11:449336-449377
  misc_feature 1..41: note = hypo
  source 1..41: mol_type = genomic DNA
ggatgacaggcgtgcgccgccgcgcccggcctgcctagcat

SEQ ID NO: 72884 - DNA, 132 bp, Homo sapiens
  misc_feature 1..132: note = chr11:44941372-44941504
  misc_feature 1..132: note = hypo
  source 1..132: mol_type = genomic DNA
ttgctgcggggtcaacgggcctgaagactttaagtttgcatctgtgtttcgactcctgaccctggatagtgaagaggtgccggaggcctgctgccggagggaaccccaaagtcgggacggggtcctgctgag

SEQ ID NO: 72885 - DNA, 85 bp, Homo sapiens
  misc_feature 1..85: note = chr11:449589-449674
  misc_feature 1..85: note = hypo
  source 1..85: mol_type = genomic DNA
gtcaactaaaatcagcgtgtccgcaccattttcgcccgcccaatttcacgcgatcctgcgaaagaatgacccagaccggtccggg

SEQ ID NO: 72886 - DNA, 32 bp, Homo sapiens
  misc_feature 1..32: note = chr11:45167668-45167700
  misc_feature 1..32: note = hyper
  source 1..32: mol_type = genomic DNA
ctcaccctcagccttcgcgggacgcctgcgtc

SEQ ID NO: 72887 - DNA, 23 bp, Homo sapiens
  misc_feature 1..23: note = chr11:45195161-45195184
  misc_feature 1..23: note = hypo
  source 1..23: mol_type = genomic DNA
aaacaccgcgtcaaaaaaaaaaa

SEQ ID NO: 72888 - DNA, 37 bp, Homo sapiens
  misc_feature 1..37: note = chr11:45307820-45307857
  misc_feature 1..37: note = hyper
  source 1..37: mol_type = genomic DNA
cctccaggcagctcccgggatccgggcgagccagcag

SEQ ID NO: 72889 - DNA, 16 bp, Homo sapiens
  misc_feature 1..16: note = chr11:45337961-45337977
  misc_feature 1..16: note = hypo
  source 1..16: mol_type = genomic DNA
gcgcccagtctaaaaa

SEQ ID NO: 72890 - DNA, 56 bp, Homo sapiens
  misc_feature 1..56: note = chr11:45376235-45376291
  misc_feature 1..56: note = hypo
  source 1..56: mol_type = genomic DNA
ccataggcagaacagcggcatgggctgttcaactgtgtatacgttatttattgatt

SEQ ID NO: 72891 - DNA, 220 bp, Homo sapiens; identical to SEQ ID NO: 33848
  misc_feature 1..220: note = chr11:45376858-45377078
  misc_feature 1..220: note = hyper
  source 1..220: mol_type = genomic DNA

SEQ ID NO: 72892 - DNA, 75 bp, Homo sapiens; identical to SEQ ID NO: 33849
  misc_feature 1..75: note = chr11:45377121-45377196
  misc_feature 1..75: note = hyper
  source 1..75: mol_type = genomic DNA

SEQ ID NO: 72893 - DNA, 65 bp, Homo sapiens
  misc_feature 1..65: note = chr11:45553228-45553293
  misc_feature 1..65: note = hypo
  source 1..65: mol_type = genomic DNA
gaggtgatgcaggaacgccattaccccgttgcccatctggctcctccagacgcagtggtcctcca

SEQ ID NO: 72894 - DNA, 187 bp, Homo sapiens; identical to SEQ ID NO: 33850
  misc_feature 1..187: note = chr11:45686237-45686424
  misc_feature 1..187: note = hyper
  source 1..187: mol_type = genomic DNA

SEQ ID NO: 72895 - DNA, 596 bp, Homo sapiens
  misc_feature 1..596: note = chr11:45686449-45687045
  misc_feature 1..596: note = hyper
  source 1..596: mol_type = genomic DNA
cgcctcgggggccaccgcgcgtctcaagtttgctgccctcctcgaatgggggcagggagggctgaggtgatcgcggcgctcaccggccaccagccccggcagccccttcctgcgcccaacacgccgccgttcctcgccgccgccacccctccgctcaccgccggtagctgctgtccccgagcggaggggcgtctcccaccgcgcccgcgcccctcccggctgctgcggcggagtgtccgctcccgcccgccccggagcccgcggggcccggccaatacctggtcggggacgcgccgggagcagctgcagcgcccagcgccggctccatcctcgggtctggagtcagggtcgccggggacccgcgggtggcggcggcggcagcagccgcggcggcatcctccgcctcccgcgccctcctcctcggcctccctcctccctcctcttcctccgactccgcgcgcgcctcacgggcccctcttcatggcccgggggcgcgagcccggggcggctcgagcagctgagtgcgttctctccggccggacgcgggacccggggccggggctcagggacccgagagatgccgggacaggggccgg

SEQ ID NO: 72896 - DNA, 30 bp, Homo sapiens
  misc_feature 1..30: note = chr11:45825671-45825701
  misc_feature 1..30: note = hyper
  source 1..30: mol_type = genomic DNA
gatacagccaagtcccgggacgtgccagct

SEQ ID NO: 72897 - DNA, 30 bp, Homo sapiens
  misc_feature 1..30: note = chr11:45902551-45902581
  misc_feature 1..30: note = hypo
  source 1..30: mol_type = genomic DNA
cgggcagagatagagcgagcatgtgtgtgt

SEQ ID NO: 72898 - DNA, 63 bp, Homo sapiens
  misc_feature 1..63: note = chr11:45921994-45922057
  misc_feature 1..63: note = hyper
  source 1..63: mol_type = genomic DNA
cggtctcaggtgaggcgccaacgtggggggcggcgccctgggccgccgcggagatgtgagggg

SEQ ID NO: 72899 - DNA, 23 bp, Homo sapiens
  misc_feature 1..23: note = chr11:46038808-46038831
  misc_feature 1..23: note = hypo
  source 1..23: mol_type = genomic DNA
accacgcccggcctacatctatt

SEQ ID NO: 72900 - DNA, 30 bp, Homo sapiens
  misc_feature 1..30: note = chr11:46141017-46141047
  misc_feature 1..30: note = hyper
  source 1..30: mol_type = genomic DNA
atttcaacatatgaccggaatatgatgaca

SEQ ID NO: 72901 - DNA, 169 bp, Homo sapiens
  misc_feature 1..169: note = chr11:46259315-46259484
  misc_feature 1..169: note = hyper
  source 1..169: mol_type = genomic DNA
ataatcgggtcaacacgcggcgagtggcggtgcgcgcggggccaaccgcgtggagctgtcgggagggcgataggatgggcgcgcccgggctgcaggcggggagccggaggtgggaggtgcctcttgagagtggctctccaccgctgacagcaaacgagctggtccggac

SEQ ID NO: 72902 - DNA, 33 bp, Homo sapiens; identical to SEQ ID NO: 43057
  misc_feature 1..33: note = chr11:46298483-46298516
  misc_feature 1..33: note = hypo
  source 1..33: mol_type = genomic DNA

SEQ ID NO: 72903 - DNA, 109 bp, Homo sapiens
  misc_feature 1..109: note = chr11:46299747-46299856
  misc_feature 1..109: note = hyper
  source 1..109: mol_type = genomic DNA
acttcctcaacaatgcggtaagatgaagggtctccgttcccgttccacccctcggcacccgtcctcgcggcgcgcctgggcccctagaaggacccgactacacatcact

SEQ ID NO: 72904 - DNA, 15 bp, Homo sapiens
  misc_feature 1..15: note = chr11:46316818-46316833
  misc_feature 1..15: note = hyper
  source 1..15: mol_type = genomic DNA
gtaccattactgccc

SEQ ID NO: 72905 - DNA, 461 bp, Homo sapiens; identical to SEQ ID NO: 980
  misc_feature 1..461: note = chr11:46316895-46317356
  misc_feature 1..461: note = hyper
  source 1..461: mol_type = genomic DNA

SEQ ID NO: 72906 - DNA, 321 bp, Homo sapiens
  misc_feature 1..321: note = chr11:46317407-46317728
  misc_feature 1..321: note = hyper
  source 1..321: mol_type = genomic DNA
cgcaggtctgcaagcaggagagctcgggaacctctcctccaagggagggaagccggcgccggctgcgcgtgacagccgagaaggagcttatattggcacgactataggaaaaagtctttaacgaggagggaaacaaatcataatatgtccttctccggcttcccacccccgttgcctggaaaggcacccctgtaggacgctcaccccctgcagaaccctgtcgccctcagagcgttgacacatggctcccctgaagttcgtgaactcctggccgccgaccccttgctcttgctccccaatttccatcggacaatctaaacc

SEQ ID NO: 72907 - DNA, 33 bp, Homo sapiens
  misc_feature 1..33: note = chr11:46332619-46332652
  misc_feature 1..33: note = hypo
  source 1..33: mol_type = genomic DNA
ccatggcagtgacagcgacggctcccagagtcc

SEQ ID NO: 72908 - DNA, 222 bp, Homo sapiens
  misc_feature 1..222: note = chr11:46354344-46354566
  misc_feature 1..222: note = hyper
  source 1..222: mol_type = genomic DNA
gccctgagctaggttcgtgcccgtggtgggctgggccgggctcgctcccttcgtgccctgagcgggcgggctgggcggagcggcgccctcccctccggaccccaccggctggagagtgtctctaaggtgacactcgggtgcgcggcagcagcggcggttgcaggagctcgctctccgcccgggctccggctccgctccagccgtccggggggcgccgcggcg

SEQ ID NO: 72909 - DNA, 332 bp, Homo sapiens
  misc_feature 1..332: note = chr11:46354603-46354935
  misc_feature 1..332: note = hyper
  source 1..332: mol_type = genomic DNA
cgcccccccggagcgcaggaggaccccggcccgcctctcccaggcgcagcgcccagcatctcgctgctcctgtcgtctaagcgtcggcgtcgctagggacctgcggaacccggcgctcccctccctccccgcctcgcgtccccggcccgggcggactggagactcgaacttgagcgggtgcccgaaaggccgcaggagccgcgggcggaaggcggccgcacgatggccgaggggcagggcggcggagggcagcgctgggactgggctggcggcggccgggcagccgaggaggaggtggtgcggcggcgatgccggcgcggggaggaggccca

SEQ ID NO: 72910 - DNA, 123 bp, Homo sapiens
  misc_feature 1..123: note = chr11:46403934-46404057
  misc_feature 1..123: note = hyper
  source 1..123: mol_type = genomic DNA
ccgcgagggcacctgcggggcccagacccagcgcatccggtgcagggtgccctgcaactggaagaaggagtttggaggtgaggcggggcgcagtcagagggcaggagacggggggcacagcct

SEQ ID NO: 72911 - DNA, 209 bp, Homo sapiens
  misc_feature 1..209: note = chr11:46405726-46405935
  misc_feature 1..209: note = hypo
  source 1..209: mol_type = genomic DNA
cagatgcgagggctgcgtgcctacctcactgcccacctccccccttcccactgtcatggaaacccgagtgagccaccaggttgacccctttcctcttgcctgtgtgacccaggcctccaccctgcagaagccagggggtgagaggtttgaagagggcagatgggaatgccatccaccacagcctcaccctgactcgatgtgtgacctgg

SEQ ID NO: 72912 - DNA, 103 bp, Homo sapiens
  misc_feature 1..103: note = chr11:46413862-46413965
  misc_feature 1..103: note = hyper
  source 1..103: mol_type = genomic DNA
ccgctgcgtgccggccgggccgcccgcgaggaggggcgccgtcggggcctggggaagcgcaggagcgggtggactggagaggttcggccggggagagaagagc

SEQ ID NO: 72913 - DNA, 221 bp, Homo sapiens
  misc_feature 1..221: note = chr11:46414479-46414700
  misc_feature 1..221: note = hyper
  source 1..221: mol_type = genomic DNA
ctcaagaccctcccccgagggccggaggtggtgagggcgattgcgggggcggcggtggaggagaggcaggagcctcttggcagagaatgggagggaactcgagtagaagccagcgctgcggggctcttggtgtggggttctccgcgcggaacccggaagtggagttcgggtccccagagctcgcgagcgcgacggctggggttggtcggaattgggaactt

SEQ ID NO: 72914 - DNA, 22 bp, Homo sapiens
  misc_feature 1..22: note = chr11:46614016-46614038
  misc_feature 1..22: note = hypo
  source 1..22: mol_type = genomic DNA
tacaacaaaactgggcgggcgc

SEQ ID NO: 72915 - DNA, 30 bp, Homo sapiens; identical to SEQ ID NO: 43060
  misc_feature 1..30: note = chr11:46774904-46774934
  misc_feature 1..30: note = hypo
  source 1..30: mol_type = genomic DNA

SEQ ID NO: 72916 - DNA, 19 bp, Homo sapiens
  misc_feature 1..19: note = chr11:46777041-46777060
  misc_feature 1..19: note = hypo
  source 1..19: mol_type = genomic DNA
ccaccgcacctggccccat

SEQ ID NO: 72917 - DNA, 85 bp, Homo sapiens
  misc_feature 1..85: note = chr11:46872609-46872694
  misc_feature 1..85: note = hypo
  source 1..85: mol_type = genomic DNA
ggttgccaacaaccccgcccccaccccctgcggttgtgcacccggttgatcaaagattggtcttaagaccacatgagtaaacaag

SEQ ID NO: 72918 - DNA, 53 bp, Homo sapiens
  misc_feature 1..53: note = chr11:46916169-46916222
  misc_feature 1..53: note = hypo
  source 1..53: mol_type = genomic DNA
cctccacgttgctgccgttgaggttggcacggaggatccggtccagggtgaca

SEQ ID NO: 72919 - DNA, 16 bp, Homo sapiens
  misc_feature 1..16: note = chr11:46920026-46920042
  misc_feature 1..16: note = hypo
  source 1..16: mol_type = genomic DNA
gcgcccagccggtagt

SEQ ID NO: 72920 - DNA, 635 bp, Homo sapiens; identical to SEQ ID NO: 33862
  misc_feature 1..635: note = chr11:46938439-46939074
  misc_feature 1..635: note = hyper
  source 1..635: mol_type = genomic DNA

SEQ ID NO: 72921 - DNA, 102 bp, Homo sapiens
  misc_feature 1..102: note = chr11:46939396-46939498
  misc_feature 1..102: note = hyper
  source 1..102: mol_type = genomic DNA
agtaccagattctaccggggcctctctccgcaacccgcccgagcccccagccccaggaaggagggctatttacaatttatgggtttagcgaccctcctcacc

SEQ ID NO: 72922 - DNA, 37 bp, Homo sapiens
  misc_feature 1..37: note = chr11:46939526-46939563
  misc_feature 1..37: note = hyper
  source 1..37: mol_type = genomic DNA
cgcaccaaggacacagagcccccgacctaacctgaaa

SEQ ID NO: 72923 - DNA, 83 bp, Homo sapiens
  misc_feature 1..83: note = chr11:46957761-46957844
  misc_feature 1..83: note = hypo
  source 1..83: mol_type = genomic DNA
tgagtgagaattgagaagaaatggcaattagttcagaggacttaatgagtaccttttgtgtgtccagccgtcataggcagaaa

SEQ ID NO: 72924 - DNA, 41 bp, Homo sapiens
  misc_feature 1..41: note = chr11:46959060-46959101
  misc_feature 1..41: note = hypo
  source 1..41: mol_type = genomic DNA
aaaaaggcacacacacgcatagatatgtacacacacacaca

SEQ ID NO: 72925 - DNA, 105 bp, Homo sapiens
  misc_feature 1..105: note = chr11:47178630-47178735
  misc_feature 1..105: note = hypo
  source 1..105: mol_type = genomic DNA
acacagtgattgtgccgacgtcgtccagtgggcagcaccgccaacgacctgccttgggcggggccggcacgctggagggcgtggaggcgtcgctgttctaccagt

SEQ ID NO: 72926 - DNA, 699 bp, Homo sapiens
  misc_feature 1..699: note = chr11:47208581-47209280
  misc_feature 1..699: note = hyper
  source 1..699: mol_type = genomic DNA
ggcctaagctcctcccgctccgagttcttatttccagattttgtaccacgattcattcttacccttcgcccctccaccccctttatcagtctggtacatttttccatatcgccacgatgccaccccacgctaaataaatcccttctccctcctctctccctacttccctctccccgctttcccccgggggtgagattttgcagagcggctccgtctgttatttatatccactggagcggtccaagaatgttccgaagctgacctaatcgccacctgctcggcctctccgcccctcccactctctcctgggcccggtgacccagcggcggtgccctgagccttgaagaccagggggagcgcggaccaacggggtcgaacgcccgggcgcagaaggtcccggacgcagaaggtcccgggcgcgcagaatcgcagcgggtcggagagccccggcgctctcagaggagtgcgcccccagggacgcggctctgagccctgggaagctgaggcgcctggctgcgccctctgaagctcgtacttttcctcccaccctcagctccctgaagagtgtgagtgcgtgcgcgcggagttttaaacggcagctttaaaaatagcaaaattatgttgtttctaaatccaggaggaatcactgacgcgttctttacgcagatgaatccgctcacaaaacgggaaagggacctg

SEQ ID NO: 72927 - DNA, 144 bp, Homo sapiens
  misc_feature 1..144: note = chr11:47215919-47216063
  misc_feature 1..144: note = hypo
  source 1..144: mol_type = genomic DNA
tgccattgtgtactccgggtttcagctctgttggccgggaggctcctgctccagaagcctaccctggtgcacttgggcacccattgtgtgaccaacaccaggctgggtgctcagtccttaattcgaagaaagcaggccaggtgc

SEQ ID NO: 72928 - DNA, 266 bp, Homo sapiens; identical to SEQ ID NO: 43063
  misc_feature 1..266: note = chr11:47358971-47359237
  misc_feature 1..266: note = hypo
  source 1..266: mol_type = genomic DNA

SEQ ID NO: 72929 - DNA, 141 bp, Homo sapiens
  misc_feature 1..141: note = chr11:47367760-47367901
  misc_feature 1..141: note = hypo
  source 1..141: mol_type = genomic DNA
tgctcttcttctcatcgcgcctcatgcccttgagcctctttagcatgccgcgcaggtcagtgacgccgtactggaaggcgatgcgctcgtactcagatgggggtgcctgccgtaggatctcccacacgtcctcctctgctg

SEQ ID NO: 72930 - DNA, 30 bp, Homo sapiens
  misc_feature 1..30: note = chr11:47463077-47463107
  misc_feature 1..30: note = hypo
  source 1..30: mol_type = genomic DNA
agtggctgaaagagccggctaacctactgg

SEQ ID NO: 72931 - DNA, 198 bp, Homo sapiens
  misc_feature 1..198: note = chr11:47599117-47599315
  misc_feature 1..198: note = hypo
  source 1..198: mol_type = genomic DNA
cccacttgcactgtgcgggccaaaaaccgagagcattcctcaaagagagatgtcagctgatacatgtctgacacctcataaatttcctgcaactcctcagctcgaagtttcacagtcccatggtagatataatcaaccaggagctggaaaacagactcgctgacatcctgcagcacaatcacccggttgtgggcctcc

SEQ ID NO: 72932 - DNA, 213 bp, Homo sapiens
  misc_feature 1..213: note = chr11:47615713-47615926
  misc_feature 1..213: note = hyper
  source 1..213: mol_type = genomic DNA
cggtcgagtcgggttcggtctgagcccgcgatctggctccgggctgcgggctgcgggctgcaggctgcaggctgcgggtgccgggctgcgcgctgaccgcccgcgctgcggcaggggcggcgggggctccggctgcttttcccggctctgaggcggcagcggacagggtgctggggccaggggccgggcgtggggaggcgtgagggaaaggga

SEQ ID NO: 72933 - DNA, 21 bp, Homo sapiens
  misc_feature 1..21: note = chr11:4785810-4785831
  misc_feature 1..21: note = hypo
  source 1..21: mol_type = genomic DNA
gaatactgggcagggcgcagt

SEQ ID NO: 72934 - DNA, 23 bp, Homo sapiens
  misc_feature 1..23: note = chr11:47873752-47873775
  misc_feature 1..23: note = hypo
  source 1..23: mol_type = genomic DNA
agtcaccgcgcctggccacactt

SEQ ID NO: 72935 - DNA, 30 bp, Homo sapiens
  misc_feature 1..30: note = chr11:4792115-4792145
  misc_feature 1..30: note = hypo
  source 1..30: mol_type = genomic DNA
catgagcagctgtgtcgaattgcttgcgct

SEQ ID NO: 72936 - DNA, 82 bp, Homo sapiens
  misc_feature 1..82: note = chr11:486013-486095
  misc_feature 1..82: note = hypo
  source 1..82: mol_type = genomic DNA
cgtgctcaccgtgtgcgcaggcgagtgtaaacagtgcacgggcgtgtgtgttcaccgtgtgcgcaggcgagtgtaaacacag

SEQ ID NO: 72937 - DNA, 245 bp, Homo sapiens; identical to SEQ ID NO: 42846
  misc_feature 1..245: note = chr11:487303-487548
  misc_feature 1..245: note = hypo
  source 1..245: mol_type = genomic DNA

SEQ ID NO: 72938 - DNA, 30 bp, Homo sapiens
  misc_feature 1..30: note = chr11:487827-487857
  misc_feature 1..30: note = hypo
  source 1..30: mol_type = genomic DNA
tttggtgtcaggccccgggcacggggatgc

SEQ ID NO: 72939 - DNA, 35 bp, Homo sapiens; identical to SEQ ID NO: 43066
  misc_feature 1..35: note = chr11:49212608-49212643
  misc_feature 1..35: note = hypo
  source 1..35: mol_type = genomic DNA

SEQ ID NO: 72940 - DNA, 109 bp, Homo sapiens
  misc_feature 1..109: note = chr11:49229761-49229870
  misc_feature 1..109: note = hyper
  source 1..109: mol_type = genomic DNA
actcggcagctgacccgcgagtcccagcaccgcggcaccacggggaagactccgaggtttgctccgcgaggcgcccccctaccgaagaggaagccgaggagaaagaagc

SEQ ID NO: 72941 - DNA, 54 bp, Homo sapiens; identical to SEQ ID NO: 42847
  misc_feature 1..54: note = chr11:493145-493199
  misc_feature 1..54: note = hypo
  source 1..54: mol_type = genomic DNA

SEQ ID NO: 72942 - DNA, 30 bp, Homo sapiens
  misc_feature 1..30: note = chr11:49837177-49837207
  misc_feature 1..30: note = hypo
  source 1..30: mol_type = genomic DNA
agtggatgccattaccgcaaatagtgcaga

SEQ ID NO: 72943 - DNA, 30 bp, Homo sapiens; identical to SEQ ID NO: 43067
  misc_feature 1..30: note = chr11:50205839-50205869
  misc_feature 1..30: note = hypo
  source 1..30: mol_type = genomic DNA

SEQ ID NO: 72944 - DNA, 45 bp, Homo sapiens
  misc_feature 1..45: note = chr11:50206566-50206611
  misc_feature 1..45: note = hypo
  source 1..45: mol_type = genomic DNA
tcaccaggtccttcacggtgtccaagtaatcgtcccactcgggcg

SEQ ID NO: 72945 - DNA, 163 bp, Homo sapiens
  misc_feature 1..163: note = chr11:50256715-50256878
  misc_feature 1..163: note = hypo
  source 1..163: mol_type = genomic DNA
gtaacctcaacctcccgtgcttgatcgcttatataatctctgctcactgtaatctcaacctcccgggctggattccatatatataaatacatacatatatttgtttgtttagacgttatctcagtctgtccaacaggctggagtgcagtggcgcgatctcggc

SEQ ID NO: 72946 - DNA, 157 bp, Homo sapiens
  misc_feature 1..157: note = chr11:507665-507822
  misc_feature 1..157: note = hyper
  source 1..157: mol_type = genomic DNA
gggacaggagggacccgggagaaacccccctggggcggctccgcatgtcggggtcgcgactctaggcgaccttggtagaggggctcgtttgcgccgagctcgcgacccccgagggagccacggccccgtgaaccacgctgcccgtcctggccactgg

SEQ ID NO: 72947 - DNA, 26 bp, Homo sapiens
  misc_feature 1..26: note = chr11:5169023-5169049
  misc_feature 1..26: note = hypo
  source 1..26: mol_type = genomic DNA
tttttttttttttttcggagacagag

SEQ ID NO: 72948 - DNA, 39 bp, Homo sapiens
  misc_feature 1..39: note = chr11:518894-518933
  misc_feature 1..39: note = hyper
  source 1..39: mol_type = genomic DNA
accggggcgggggggcgtgtctcccggtcacgtgacctg

SEQ ID NO: 72949 - DNA, 159 bp, Homo sapiens; identical to SEQ ID NO: 15524
  misc_feature 1..159: note = chr11:5192016-5192175
  misc_feature 1..159: note = hypo
  source 1..159: mol_type = genomic DNA

SEQ ID NO: 72950 - DNA, 41 bp, Homo sapiens
  misc_feature 1..41: note = chr11:5192457-5192498
  misc_feature 1..41: note = hypo
  source 1..41: mol_type = genomic DNA
ttctgcctccagtcccgggatgccaacgagagtgaatgttg

SEQ ID NO: 72951 - DNA, 44 bp, Homo sapiens
  misc_feature 1..44: note = chr11:520975-521019
  misc_feature 1..44: note = hypo
  source 1..44: mol_type = genomic DNA
ccgctgcctgaacaccggcatttactcaccgatgctctcgtctt

SEQ ID NO: 72952 - DNA, 30 bp, Homo sapiens
  misc_feature 1..30: note = chr11:528361-528391
  misc_feature 1..30: note = hypo
  source 1..30: mol_type = genomic DNA
cttcctccaccccctcggcagcccagcagg

SEQ ID NO: 72953 - DNA, 136 bp, Homo sapiens
  misc_feature 1..136: note = chr11:5330681-5330817
  misc_feature 1..136: note = hypo
  source 1..136: mol_type = genomic DNA
catacagaaaacttgcgcctacacctatttttttaagcattccatagattggatctcatttctctccacatttttatgtcttcccaatataaaactttactcaggccgggcgcggtggctcacgcctgtaatccca

SEQ ID NO: 72954 - skipped

SEQ ID NO: 72955 - DNA, 148 bp, Homo sapiens
  misc_feature 1..148: note = chr11:537026-537174
  misc_feature 1..148: note = hyper
  source 1..148: mol_type = genomic DNA
cggtgtgtgtttcctggtcctcgggggcgcttcccccggtgcttccttttgccgtcggcctcacttccaaccgaaggtcaggacggcaggcctcggccccaggggcgacccttccacctgggaaaggtgggcgcgagcctccagcaga

SEQ ID NO: 72956 - DNA, 95 bp, Homo sapiens
  misc_feature 1..95: note = chr11:5394464-5394559
  misc_feature 1..95: note = hypo
  source 1..95: mol_type = genomic DNA
gcttgatatcagtctcggcaattttttagatattgtcttgatttgaagaaaattttcactggaagtctatattgatcgattttttctttcacaaa

SEQ ID NO: 72957 - DNA, 30 bp, Homo sapiens
  misc_feature 1..30: note = chr11:5411435-5411465
  misc_feature 1..30: note = hypo
  source 1..30: mol_type = genomic DNA
ctgtccctggtgcaccgttttgggaagcat

SEQ ID NO: 72958 - DNA, 30 bp, Homo sapiens
  misc_feature 1..30: note = chr11:548977-549007
  misc_feature 1..30: note = hypo
  source 1..30: mol_type = genomic DNA
ccagccaattcagagcggagtggaaaagcc

SEQ ID NO: 72959 - DNA, 21 bp, Homo sapiens
  misc_feature 1..21: note = chr11:55684103-55684124
  misc_feature 1..21: note = hypo
  source 1..21: mol_type = genomic DNA
ttatttaaaagaaaacgtggc

SEQ ID NO: 72960 - DNA, 37 bp, Homo sapiens
  misc_feature 1..37: note = chr11:55743007-55743044
  misc_feature 1..37: note = hypo
  source 1..37: mol_type = genomic DNA
tacaggcgtgagccaccgcgcccggcccaggattgtc

SEQ ID NO: 72961 - DNA, 16 bp, Homo sapiens
  misc_feature 1..16: note = chr11:5580873-5580889
  misc_feature 1..16: note = hypo
  source 1..16: mol_type = genomic DNA
ccgtctcaaaaaaaaa

SEQ ID NO: 72962 - DNA, 160 bp, Homo sapiens
  misc_feature 1..160: note = chr11:55918225-55918385
  misc_feature 1..160: note = hypo
  source 1..160: mol_type = genomic DNA
aaaaaaacaaaacaaacaagaaaaaacaggtagcaatataccagtaataagtcctctatcgtccacaatttctttaattttacatgaattaaactcagtaattataattaaaaagtacggatagtagaatgaatgtaaacaacaacgatgtgatccagct

SEQ ID NO: 72963 - DNA, 30 bp, Homo sapiens
  misc_feature 1..30: note = chr11:55919964-55919994
  misc_feature 1..30: note = hypo
  source 1..30: mol_type = genomic DNA
attttcgcttattcccgccatttattcctg

SEQ ID NO: 72964 - DNA, 27 bp, Homo sapiens
  misc_feature 1..27: note = chr11:5609308-5609335
  misc_feature 1..27: note = hypo
  source 1..27: mol_type = genomic DNA
catgagcctccgcgactgacctaaaat

SEQ ID NO: 72965 - DNA, 638 bp, Homo sapiens
  misc_feature 1..638: note = chr11:562246-562884
  misc_feature 1..638: note = hypo
  source 1..638: mol_type = genomic DNA
acagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggtgagcccggggacctgatcccctgtcactcccccacccctgatatgggcagatacggggatcacagggtcccactcgggaggcaggtgagcccggggacctgatccc

SEQ ID NO: 72966 - DNA, 30 bp, Homo sapiens
  misc_feature 1..30: note = chr11:5624731-5624761
  misc_feature 1..30: note = hypo
  source 1..30: mol_type = genomic DNA
cagccagggaacctgcggcctaatcggcat

SEQ ID NO: 72967 - DNA, 30 bp, Homo sapiens
  misc_feature 1..30: note = chr11:567232-567262
  misc_feature 1..30: note = hypo
  source 1..30: mol_type = genomic DNA
cgctgggaccctcctcgcccagagttccta

SEQ ID NO: 72968 - DNA, 32 bp, Homo sapiens
  misc_feature 1..32: note = chr11:57056902-57056934
  misc_feature 1..32: note = hyper
  source 1..32: mol_type = genomic DNA
gagggcaaaggctcccgcggggagcagccagc

SEQ ID NO: 72969 - DNA, 137 bp, Homo sapiens
  misc_feature 1..137: note = chr11:57071533-57071670
  misc_feature 1..137: note = hypo
  source 1..137: mol_type = genomic DNA
ccacatctacaggcacggcacagagccacacctgacacaaacacacgcatccccgcatccccacacccccaccccacacacacacactcatactacgcacagaggtgtgggaaagcctggcacggcagtgcctggaa

SEQ ID NO: 72970 - DNA, 230 bp, Homo sapiens
  misc_feature 1..230: note = chr11:57117349-57117579
  misc_feature 1..230: note = hyper
  source 1..230: mol_type = genomic DNA
attttgccaaactggcgcgcacggtgaggacctagccattcttccgcgaccccaaactccccaccttcagccctttcccagatttcagggccctttggccggcactggccaggagccgccgcgagacagcgccacctggtggaagcatcccaggccgccactggctttgtgcctgaatcctttctgctttccccgcgcagagcgatcttgccccccgcctccgccgagtc

SEQ ID NO: 72971 - DNA, 40 bp, Homo sapiens
  misc_feature 1..40: note = chr11:57150498-57150538
  misc_feature 1..40: note = hypo
  source 1..40: mol_type = genomic DNA
gcagattggtaggaccgggcacggtggctcatgcctgtaa

SEQ ID NO: 72972 - DNA, 30 bp, Homo sapiens
  misc_feature 1..30: note = chr11:57168307-57168337
  misc_feature 1..30: note = hypo
  source 1..30: mol_type = genomic DNA
gccgagcacttttcacgtagagccttactt

SEQ ID NO: 72973 - DNA, 30 bp, Homo sapiens
  misc_feature 1..30: note = chr11:57168787-57168817
  misc_feature 1..30: note = hypo
  source 1..30: mol_type = genomic DNA
gtgaagtgtggtgcacgctctgaagggcac

SEQ ID NO: 72974 - DNA, 30 bp, Homo sapiens; identical to SEQ ID NO: 42849
  misc_feature 1..30: note = chr11:571791-571821
  misc_feature 1..30: note = hypo
  source 1..30: mol_type = genomic DNA

SEQ ID NO: 72975 - DNA, 614 bp, Homo sapiens
  misc_feature 1..614: note = chr11:57194178-57194792
  misc_feature 1..614: note = hyper
  source 1..614: mol_type = genomic DNA
gaagacacaaactcccgctgccaagttggtgttatcttcagtttactgacaatgaaacaaaagctcccatggatttcaggaacttgcccaaggtcacagggctagtttagtcacgacgcaggccattctactgccagaaatacccccaactcccatgaccctcgcctaggactcgcaaacctggtccccgccgcccttcctcgcatcaacttctaccaggaaagcctccgggggccgctccccgccagcctccgcaccccgctccagcctgcggcctgccctccccgcagaggagcccgaggggccaggccgcgctcggcgccccatggcgcccgaaaggggacccttcgccctacccgcctgctccgcgccggggctctccgcgccctttccgcacgggccaggttcgcattcgcgcctctcgcagcccctcccagtcccctgctcgcctccgccccctcctgcccgcccggaaggggctggggcagacctcccactctccatcacttccttcttcttttcccttgctcacagcctcccgcgccctttttacctctccctcttgaaacttctccctctagaaccccctagaaccccagcggtgtctttccctc

SEQ ID NO: 72976 - skipped

SEQ ID NO: 72977 - DNA, 21 bp, Homo sapiens
  misc_feature 1..21: note = chr11:57227249-57227270
  misc_feature 1..21: note = hyper
  source 1..21: mol_type = genomic DNA
cgcacccgcttgtaaatgcac

SEQ ID NO: 72978 - DNA, 207 bp, Homo sapiens
  misc_feature 1..207: note = chr11:57235251-57235458
  misc_feature 1..207: note = hypo
  source 1..207: mol_type = genomic DNA
cagaacaacctcatccgcacgctgcggccaggcacctttgggtccaacctgctcaccctgtggctcttctccaacaacctctccaccatctacccgggcactttccgccacttgcaagccctggaggagctggacctcggtgacaaccggcacctgcgctcgctggagcccgacaccttccagggcctggagcggctgcagtcgctg

SEQ ID NO: 72979 - DNA, 69 bp, Homo sapiens
  misc_feature 1..69: note = chr11:57243666-57243735
  misc_feature 1..69: note = hyper
  source 1..69: mol_type = genomic DNA
ccacctcttcctccacgggaaccgcctgcggctgctcacagagcacgtgtttcgcggcctgggcagcct

SEQ ID NO: 72980 - DNA, 32 bp, Homo sapiens
  misc_feature 1..32: note = chr11:57281984-57282016
  misc_feature 1..32: note = hyper
  source 1..32: mol_type = genomic DNA
ccatgtccggactctcgcgccaggaaagaccc

SEQ ID NO: 72981 - DNA, 30 bp, Homo sapiens
  misc_feature 1..30: note = chr11:57308593-57308623
  misc_feature 1..30: note = hypo
  source 1..30: mol_type = genomic DNA
aaatagtgagggcatcgaattcaggaaccc

SEQ ID NO: 72982 - DNA, 163 bp, Homo sapiens
  misc_feature 1..163: note = chr11:57311354-57311517
  misc_feature 1..163: note = hypo
  source 1..163: mol_type = genomic DNA
agactgtgtagcttccggacagaccagtccttcagccaggtaatgtcaaactctggggctccagctccaattccccctacctcctgcttccctcagcgtccaccatcaactcagtctgggttcccccagcacctgatttcaagatattcgaggattcctggca

SEQ ID NO: 72983 - DNA, 33 bp, Homo sapiens
  misc_feature 1..33: note = chr11:57373422-57373455
  misc_feature 1..33: note = hypo
  source 1..33: mol_type = genomic DNA
tgctcatggaaagaacgacgtgttcaggactca

SEQ ID NO: 72984 - DNA, 30 bp, Homo sapiens
  misc_feature 1..30: note = chr11:57405988-57406018
  misc_feature 1..30: note = hyper
  source 1..30: mol_type = genomic DNA
gatccaagcccggcccgggagaggggctgg

SEQ ID NO: 72985 - DNA, 30 bp, Homo sapiens
  misc_feature 1..30: note = chr11:57417507-57417537
  misc_feature 1..30: note = hyper
  source 1..30: mol_type = genomic DNA
gtaggcatcaagggacggggctagaggagt

SEQ ID NO: 72986 - DNA, 30 bp, Homo sapiens
  misc_feature 1..30: note = chr11:57421913-57421943
  misc_feature 1..30: note = hypo
  source 1..30: mol_type = genomic DNA
aagaacatatgatgacggtattgtttggag

SEQ ID NO: 72987 - DNA, 25 bp, Homo sapiens
  misc_feature 1..25: note = chr11:57423912-57423937
  misc_feature 1..25: note = hypo
  source 1..25: mol_type = genomic DNA
ttattataaccggactcagaaactc

SEQ ID NO: 72988 - DNA, 20 bp, Homo sapiens
  misc_feature 1..20: note = chr11:57437214-57437234
  misc_feature 1..20: note = hypo
  source 1..20: mol_type = genomic DNA
gcccccgtgcccagctggca

SEQ ID NO: 72989 - DNA, 37 bp, Homo sapiens
  misc_feature 1..37: note = chr11:57501031-57501068
  misc_feature 1..37: note = hypo
  source 1..37: mol_type = genomic DNA
agtgaggaatttacagatgaaacgatatagctggaat

SEQ ID NO: 72990 - DNA, 91 bp, Homo sapiens
  misc_feature 1..91: note = chr11:57548730-57548821
  misc_feature 1..91: note = hypo
  source 1..91: mol_type = genomic DNA
ggaatgtgagctcaaacagttgggtgacccctagtaaactctaaggttaagcttttccatgaatattttttttttccgagtctagggtatg

SEQ ID NO: 72991 - DNA, 18 bp, Homo sapiens
  misc_feature 1..18: note = chr11:57551113-57551131
  misc_feature 1..18: note = hypo
  source 1..18: mol_type = genomic DNA
gagcgagactccatctca

SEQ ID NO: 72992 - DNA, 19 bp, Homo sapiens
  misc_feature 1..19: note = chr11:5784549-5784568
  misc_feature 1..19: note = hypo
  source 1..19: mol_type = genomic DNA
aatttatttttgagacgga

SEQ ID NO: 72993 - DNA, 30 bp, Homo sapiens
  misc_feature 1..30: note = chr11:57994277-57994307
  misc_feature 1..30: note = hypo
  source 1..30: mol_type = genomic DNA
aggcgcgagccactgcgccccaccaggtta

SEQ ID NO: 72994 - DNA, 148 bp, Homo sapiens
  misc_feature 1..148: note = chr11:58275194-58275342
  misc_feature 1..148: note = hypo
  source 1..148: mol_type = genomic DNA
aagaggcctacataccgctgcatggcgatcataggccatggaggccaggaggtagcactcaacagtggcaaaccccacaaagaagaagaactgagctgcacatccatcgtaggagatggccttgtcccctgaccgcaatgcagccacc

SEQ ID NO: 72995 - DNA, 141 bp, Homo sapiens
  misc_feature 1..141: note = chr11:58406402-58406543
  misc_feature 1..141: note = hypo
  source 1..141: mol_type = genomic DNA
tggttgctgagggtccgcacatgctgcgagaagcagggctgaatatcaggggtttctgggaccttcagagagtagatgctgtggtggacctgcactctggctgtgacctacaacctgatggaaccccgggttgtacgcctt

SEQ ID NO: 72996 - DNA, 229 bp, Homo sapiens
  misc_feature 1..229: note = chr11:58668329-58668558
  misc_feature 1..229: note = hyper
  source 1..229: mol_type = genomic DNA
cattaagggaatcttcgagtccaagaacggaagctaccattggccttaatcttcacctcccgcttttcttccctgcttcttttctcctccctattccagtaggttagttctctggcgccatcagctggcagcacgcgggaatataccaaacgcggaaacgcgccttcgcctgccctgagtaactgcaaatccagggctgagtgaggtatttaagcgcttggcttgtgta

SEQ ID NO: 72997 - DNA, 481 bp, Homo sapiens
  misc_feature 1..481: note = chr11:58672686-58673167
  misc_feature 1..481: note = hyper
  source 1..481: mol_type = genomic DNA
ggcattgtctgtgttcgccagcccctccacgaagttggatcatttgcggagcaggccaagtccctctagacctcacgcagacgcgggtgcagcctgctctgcgacttgcagtcagctggaagctgggcctctgcatcatcagggtggagctctctctgctgctgccgctggatcccgcctggatgcacgtcccgccaccgccgccgacccatcagcggcagaagggcagcaatggccacacaccgaagcaccttggcgggctattccccttgcagctctcctcagcgcgctgctcccactcgcaatcaaaaggcggaaaaagcgcgaaaccgccaggcatctcccatacccacccggctgccgcgcaacccctccttggcttccactgggagacaggggacgccgatgagcaggaagaagcagggcagtgactgcttagtttatcctggtacgcgggaactggctgtggaccgagtggttc

SEQ ID NO: 72998 - DNA, 121 bp, Homo sapiens
  misc_feature 1..121: note = chr11:58673168-58673289
  misc_feature 1..121: note = hyper
  source 1..121: mol_type = genomic DNA
ggggaggggatcgctgggaccgggatgggtcatctggacaaatagggagggtgggcgggtgggcgcgcagtcccctcggcctggccgtctgacccgcccgcgagcgcgtgcgcccaggcgt

SEQ ID NO: 72999 - DNA, 16 bp, Homo sapiens
  misc_feature 1..16: note = chr11:58821650-58821666
  misc_feature 1..16: note = hypo
  source 1..16: mol_type = genomic DNA
gcgtggcctcctattc

SEQ ID NO: 73000 - DNA, 152 bp, Homo sapiens
  misc_feature 1..152: note = chr11:58835165-58835317
  misc_feature 1..152: note = hypo
  source 1..152: mol_type = genomic DNA
aggagacgcgtttgccgactttatctctgtatcgcttaggaggagttatttaattcactttagactttgttaagttaaatattaatgttaaaatgcccagggctattttgttcaagacagttgccactaatcacgtgatttttttttttttt

SEQ ID NO: 73001 - DNA, 30 bp, Homo sapiens
  misc_feature 1..30: note = chr11:58953988-58954018
  misc_feature 1..30: note = hypo
  source 1..30: mol_type = genomic DNA
ccagaaagagctgggcgaggagaatcggcc

SEQ ID NO: 73002 - DNA, 179 bp, Homo sapiens
  misc_feature 1..179: note = chr11:59245284-59245463
  misc_feature 1..179: note = hypo
  source 1..179: mol_type = genomic DNA
agcccctgcactatgcgactatcatgagtagagaccattgcattgggctcacagtggctgcctggttggggggctttgtccactccatcgtgcagatttccctgttgctcccactccctttctgcggacccaatgttcttgacactttctactgtgatgtccaccgggtcctcaaactg

SEQ ID NO: 73003 - DNA, 30 bp, Homo sapiens; identical to SEQ ID NO: 15547
  misc_feature 1..30: note = chr11:59312651-59312681
  misc_feature 1..30: note = hypo
  source 1..30: mol_type = genomic DNA

SEQ ID NO: 73004 - DNA, 53 bp, Homo sapiens; identical to SEQ ID NO: 33871
  misc_feature 1..53: note = chr11:59318986-59319039
  misc_feature 1..53: note = hyper
  source 1..53: mol_type = genomic DNA

SEQ ID NO: 73005 - DNA, 30 bp, Homo sapiens
  misc_feature 1..30: note = chr11:59323446-59323476
  misc_feature 1..30: note = hyper
  source 1..30: mol_type = genomic DNA
gtacttgcttagttccgagagtgcggtttg

SEQ ID NO: 73006 - DNA, 28 bp, Homo sapiens
  misc_feature 1..28: note = chr11:59323871-59323899
  misc_feature 1..28: note = hyper
  source 1..28: mol_type = genomic DNA
gatagactaagcaaacgcttttcttcag

SEQ ID NO: 73007 - DNA, 28 bp, Homo sapiens
  misc_feature 1..28: note = chr11:59323959-59323987
  misc_feature 1..28: note = hyper
  source 1..28: mol_type = genomic DNA
gtccctgttcgggcggatgctgttttag

SEQ ID NO: 73008 - DNA, 19 bp, Homo sapiens
  misc_feature 1..19: note = chr11:59328895-59328914
  misc_feature 1..19: note = hypo
  source 1..19: mol_type = genomic DNA
accttaaaggctgggcgcg

SEQ ID NO: 73009 - DNA, 138 bp, Homo sapiens; identical to SEQ ID NO: 43081
  misc_feature 1..138: note = chr11:59329214-59329352
  misc_feature 1..138: note = hypo
  source 1..138: mol_type = genomic DNA

SEQ ID NO: 73010 - DNA, 330 bp, Homo sapiens
  misc_feature 1..330: note = chr11:59333343-59333673
  misc_feature 1..330: note = hyper
  source 1..330: mol_type = genomic DNA
ccttgttacggtttaaaaagctggacaaagcccgtgcgccgaacgctttcgaggacttctttggccaagagggggcccgggctgtcaccattcccggcaagcccgcgaccaagcaggcagcggaggcggcgcaggccgagagctcccgcccctctgacagtgagagaagggtcgcagcgcccacggctgcctagaacccgaaagaagaggagcggggtgcggggacacagggttgctcaagaaagtgagctatgcgcagtgctccggaagagcttgtctcaaaccaggtcccaagtgagggcagaggcgtaacttcgtactgggcagttt

SEQ ID NO: 73011 - DNA, 196 bp, Homo sapiens
  misc_feature 1..196: note = chr11:5949707-5949903
  misc_feature 1..196: note = hypo
  source 1..196: mol_type = genomic DNA
cccgccatttattcccgccatctcggcagccacctcggataccctgactcagcatttccgggtccacctttcttgttcccgccgcctcagtgaacacgcatgcccactaaagcacatcactaaggcacatcactcatctatataagcgcgctgcacctttggcacagcgcgacttccctgaccctccccctgcaga

SEQ ID NO: 73012 - DNA, 15 bp, Homo sapiens
  misc_feature 1..15: note = chr11:5949963-5949978
  misc_feature 1..15: note = hypo
  source 1..15: mol_type = genomic DNA
cggccttattgatcc

SEQ ID NO: 73013 - DNA, 30 bp, Homo sapiens
  misc_feature 1..30: note = chr11:5951371-5951401
  misc_feature 1..30: note = hypo
  source 1..30: mol_type = genomic DNA
ggcggttccatccaccgatccagagtggga

SEQ ID NO: 73014 - DNA, 30 bp, Homo sapiens
  misc_feature 1..30: note = chr11:59521144-59521174
  misc_feature 1..30: note = hypo
  source 1..30: mol_type = genomic DNA
tctattttcttgaagcgcggggaactacgt

SEQ ID NO: 73015 - DNA, 34 bp, Homo sapiens
  misc_feature 1..34: note = chr11:5957970-5958004
  misc_feature 1..34: note = hypo
  source 1..34: mol_type = genomic DNA
cctcctcaatccagtcggccgagaaggcttgcca

SEQ ID NO: 73016 - DNA, 61 bp, Homo sapiens
  misc_feature 1..61: note = chr11:59609779-59609840
  misc_feature 1..61: note = hypo
  source 1..61: mol_type = genomic DNA
tcccatccacaggcacgttcacatccttagctcctcctccatgggacgctctcctttgtca

SEQ ID NO: 73017 - DNA, 188 bp, Homo sapiens
  misc_feature 1..188: note = chr11:59807943-59808131
  misc_feature 1..188: note = hypo
  source 1..188: mol_type = genomic DNA
agtcttgatgctcctcgctgtcttgatttggaccggtgctgagaacctccatggtaaataacaagttttagagaatgcttcctcgaaggagttaatcataatgatcgctttccatgcaggtgttttactccctgaagaaatctgatcttattctaactggctagaagaagaagcgctttcaggccaag

SEQ ID NO: 73018 - DNA, 120 bp, Homo sapiens
  misc_feature 1..120: note = chr11:59841387-59841507
  misc_feature 1..120: note = hypo
  source 1..120: mol_type = genomic DNA
ggagaccgtggaaagagagggagagagagaccgtggggagcggcagcgggagcaggagcgggagagggagagggagagggcagcactatgagttttaagaagcaattgaaaatgtatgca

SEQ ID NO: 73019 - DNA, 30 bp, Homo sapiens; identical to SEQ ID NO: 43085
  misc_feature 1..30: note = chr11:60282848-60282878
  misc_feature 1..30: note = hypo
  source 1..30: mol_type = genomic DNA

SEQ ID NO: 73020 - DNA, 23 bp, Homo sapiens
  misc_feature 1..23: note = chr11:60409067-60409090
  misc_feature 1..23: note = hypo
  source 1..23: mol_type = genomic DNA
ttatatactttcccccgttctat

SEQ ID NO: 73021 - DNA, 213 bp, Homo sapiens
  misc_feature 1..213: note = chr11:60524504-60524717
  misc_feature 1..213: note = hypo
  source 1..213: mol_type = genomic DNA
aaactcatcaattttcggggaatcccggtaagggacagtcctgactcccgtcaggaggatgggacccacgcgtaaaatatcaggggttggattatcatgggtcaagaaatgaccaaagaacagaaagtgttttttaaaaacagtgcgacagctacttaaggctaaccagtgcactgcagagcctggagctctacacaacgctatgatcttaat

SEQ ID NO: 73022 - DNA, 26 bp, Homo sapiens
  misc_feature 1..26: note = chr11:60535370-60535396
  misc_feature 1..26: note = hypo
  source 1..26: mol_type = genomic DNA
aaaggacgggaaaggcggggcacggt

SEQ ID NO: 73023 - DNA, 30 bp, Homo sapiens
  misc_feature 1..30: note = chr11:605782-605812
  misc_feature 1..30: note = hypo
  source 1..30: mol_type = genomic DNA
gttctagggtggggccgtgatagcctggct

SEQ ID NO: 73024 - DNA, 67 bp, Homo sapiens
  misc_feature 1..67: note = chr11:60640875-60640942
  misc_feature 1..67: note = hypo
  source 1..67: mol_type = genomic DNA
ggatgactatcccatcgtgaggctgctccgagaaccagtccatgtggaggtccggcttctgcagagg

SEQ ID NO: 73025 - DNA, 226 bp, Homo sapiens
  misc_feature 1..226: note = chr11:60718628-60718854
  misc_feature 1..226: note = hyper
  source 1..226: mol_type = genomic DNA
ccgcagaaggagctgcggccgtcggggaaggcggtggcgggcagcaggcccgaggcggccaggtagagcagcaggctgagcgcgaccgcgcggtagcggcccaggtacacgtcggccagccagccgcccacgggcgccagcaggtaggaggcgcccaggaataccagcgcggcgcgcgtcgcctgctcgccggtccagttgaagttggtgctgttgaggtacagca

SEQ ID NO: 73026 - DNA, 261 bp, Homo sapiens
  misc_feature 1..261: note = chr11:60718976-60719237
  misc_feature 1..261: note = hyper
  source 1..261: mol_type = genomic DNA
cgctccccgggcacgcggggctgctcccgggcgcgcggcgcgggcatcctggctccgggctgggccccccgcggctcttctctcctctcctctccccgcctcagagccctgcactcctgcccccgggcctcggccctctcccccacccaactggctggccctcctttctcaccgctttggcccacccttccctcctgtcccctctccctttcttgccctacccttcctgtccctccgctcactacccggactctaccacct

SEQ ID NO: 73027 - DNA, 30 bp, Homo sapiens
  misc_feature 1..30: note = chr11:607280-607310
  misc_feature 1..30: note = hypo
  source 1..30: mol_type = genomic DNA
ggggcggttcaggctcggaacttgtcaaat

SEQ ID NO: 73028 - DNA, 30 bp, Homo sapiens; identical to SEQ ID NO: 43087
  misc_feature 1..30: note = chr11:60892552-60892582
  misc_feature 1..30: note = hypo
  source 1..30: mol_type = genomic DNA

SEQ ID NO: 73029 - DNA, 170 bp, Homo sapiens
  misc_feature 1..170: note = chr11:60897862-60898032
  misc_feature 1..170: note = hypo
  source 1..170: mol_type = genomic DNA
catttggtaaagaaccggcagcgctgacctagcgtcacgcggatggcacataggccggggaggggcaggcaccagaaggtcaaggtccctccttggccccagcagccccgggcccaccagatgctgcgtcctcaggtagtggacatttcaaggcacgtacaacttcctaa

SEQ ID NO: 73030 - DNA, 86 bp, Homo sapiens
  misc_feature 1..86: note = chr11:60927434-60927520
  misc_feature 1..86: note = hypo
  source 1..86: mol_type = genomic DNA
agccaggttatctaacatctccgcaactcacttcatctgtaaaacgggatcatcacctatttggacatgttcgcaaaattcggtat

SEQ ID NO: 73031 - DNA, 171 bp, Homo sapiens; identical to SEQ ID NO: 5117
  misc_feature 1..171: note = chr11:60941596-60941767
  misc_feature 1..171: note = hypo
  source 1..171: mol_type = genomic DNA

SEQ ID NO: 73032 - DNA, 30 bp, Homo sapiens
  misc_feature 1..30: note = chr11:61014723-61014753
  misc_feature 1..30: note = hypo
  source 1..30: mol_type = genomic DNA
gaaatggccagttctcggatgattaatttc

SEQ ID NO: 73033 - DNA, 41 bp, Homo sapiens
  misc_feature 1..41: note = chr11:61027383-61027424
  misc_feature 1..41: note = hypo
  source 1..41: mol_type = genomic DNA
atgctccttgacttacgatggggtcacgtcccaataaacct

SEQ ID NO: 73034 - DNA, 39 bp, Homo sapiens
  misc_feature 1..39: note = chr11:61036508-61036547
  misc_feature 1..39: note = hypo
  source 1..39: mol_type = genomic DNA
tcaccaagaccccaccggtgacaccggcccctgcctccc

SEQ ID NO: 73035 - DNA, 377 bp, Homo sapiens
  misc_feature 1..377: note = chr11:61038898-61039275
  misc_feature 1..377: note = hypo
  source 1..377: mol_type = genomic DNA
gagccaccgcacctggccaacaatacacacttcttaaggccaactgccaagcaccatcgtcctcacacatctactgagagcaggataaactcggtccaaccctttttgtgaaagtggaacttgacagcaccggagggagactgcggccagcctgaggccagcctctggaggggccaggacgcttgtctcctctgggtgaggcggggcagccaggtaaagcagctgaaggcgagcaggttgtcattcacctggcagatgcataactcacaggggtcaccaggcgaccagatctgtccaatcggaaactcaaccccgttgtcgtcaagagagcagcctggatgaggacaatggcagagaaaagacggcacaagacctag

SEQ ID NO: 73036 - DNA, 30 bp, Homo sapiens
  misc_feature 1..30: note = chr11:61041904-61041934
  misc_feature 1..30: note = hypo
  source 1..30: mol_type = genomic DNA
taaagtgttgtgcctcgctcccctctccat

SEQ ID NO: 73037 - DNA, 158 bp, Homo sapiens
  misc_feature 1..158: note = chr11:61049497-61049655
  misc_feature 1..158: note = hypo
  source 1..158: mol_type = genomic DNA
ggtccatgcctgccccgaggtgcgggatgtgactcagacagctgggagcggggctgaaatctagtgcttgtcttgttaataggttcacacatcgagcaggtatttaatgcgagtatcagagactcagccccagcactatgcagcggtaattaattgct

SEQ ID NO: 73038 - DNA, 175 bp, Homo sapiens
  misc_feature 1..175: note = chr11:61058212-61058387
  misc_feature 1..175: note = hypo
  source 1..175: mol_type = genomic DNA
aggagatataattcccgctgtccccctccccctcccccaccactcccaggcgtctcacctgtacacctgatgccaacagctgtctccgtcatcgagaagcccacggggcacactcgggccacctcctgacagcctccatggttgcaggtaaggtcacagccgtactccccacatg

SEQ ID NO: 73039 - DNA, 124 bp, Homo sapiens
  misc_feature 1..124: note = chr11:61058771-61058895
  misc_feature 1..124: note = hypo
  source 1..124: mol_type = genomic DNA
agcagacattgggagcgatgcagatgccactcccacagccgaaggagcagagggctgagaggagaagtgcaggtgagacacgaggaactggggcctcccgtctgcccctcggaccagggactga

SEQ ID NO: 73040 - DNA, 336 bp, Homo sapiens
  misc_feature 1..336: note = chr11:61062688-61063024
  misc_feature 1..336: note = hyper
  source 1..336: mol_type = genomic DNA
aggggacgcggcggacgattgtggggagggtctctggcacctcgaagcgaaacacacaaaggcaacgccgcccgcctgctgatgcctctccgagaggcgcggagcccggggcgggggcaaagatcagggacccctgggggcggggtttcgccctcggcccacaccccctgccccggtttgggagtcggcttcctgcgaagcgctgactgaaggcgtcagaccgaggccccgggaggaaacagacttcgggaacaaggctagcaccagaggctgcgcgccccgggcatggcccctgtcggtgggacccgagacgccttgttgtgacgaggtgggaac

SEQ ID NO: 73041 - DNA, 97 bp, Homo sapiens; identical to SEQ ID NO: 10877
  misc_feature 1..97: note = chr11:61063061-61063158
  misc_feature 1..97: note = hyper
  source 1..97: mol_type = genomic DNA

SEQ ID NO: 73042 - DNA, 30 bp, Homo sapiens
  misc_feature 1..30: note = chr11:61112512-61112542
  misc_feature 1..30: note = hypo
  source 1..30: mol_type = genomic DNA
tcaagtggagggcttcggggcaggcctcac

SEQ ID NO: 73043 - DNA, 18 bp, Homo sapiens
  misc_feature 1..18: note = chr11:61198502-61198520
  misc_feature 1..18: note = hypo
  source 1..18: mol_type = genomic DNA
tttttttttttgagacgg

SEQ ID NO: 73044 - DNA, 40 bp, Homo sapiens
  misc_feature 1..40: note = chr11:61276061-61276101
  misc_feature 1..40: note = hyper
  source 1..40: mol_type = genomic DNA
tgggcaggtagggggcgggctccggcgctgggaccccact

SEQ ID NO: 73045 - DNA, 88 bp, Homo sapiens
  misc_feature 1..88: note = chr11:61276416-61276504
  misc_feature 1..88: note = hyper
  source 1..88: mol_type = genomic DNA
cggggcgatgcctggcggtggcagtggcggcggccccggccggggcccgtgaccatgggcatcgccgagtccacgccggatgagctgc

SEQ ID NO: 73046 - DNA, 585 bp, Homo sapiens; identical to SEQ ID NO: 33878
  misc_feature 1..585: note = chr11:61276535-61277120
  misc_feature 1..585: note = hyper
  source 1..585: mol_type = genomic DNA

SEQ ID NO: 73047 - DNA, 15 bp, Homo sapiens
  misc_feature 1..15: note = chr11:61277327-61277342
  misc_feature 1..15: note = hyper
  source 1..15: mol_type = genomic DNA
cgctccaggactggg

SEQ ID NO: 73048 - DNA, 30 bp, Homo sapiens
  misc_feature 1..30: note = chr11:61305680-61305710
  misc_feature 1..30: note = hypo
  source 1..30: mol_type = genomic DNA
aaagtcatcctgttccgaaagccctaagac

SEQ ID NO: 73049 - DNA, 518 bp, Homo sapiens
  misc_feature 1..518: note = chr11:61334835-61335353
  misc_feature 1..518: note = hyper
  source 1..518: mol_type = genomic DNA
tgctgaaacagctgtcggccacgcggctccttgtccttggtgctgaaacagaactcagtcctggggctgcgccctcttccaggtcgccctttgcgcagctcccagcgagcaggatccgagagactgtgcatagtgattccgccttcctctgccaatgcctccctgatcaaccctcagctgaagctatggcagcacccagtgacctcaagagccccctttcctcgagttaggtcctcggatgctgaagaccccagtcctgactcaggacaaaaagggccgccccgcgaacgtggtaaataccacgccccattccctcccgggggcccgccgcactgcctcctggtggctggcgcgggcactgcaccccggcgggcgcacagacggtccccagcggcggcctgggccagcggcgaagcagcggcagacggttctccggcccccgccgccccctcaccgctcccggggcaatctggcgctcagagcttgcggcgttgcccgacacccgcacactccagcct

SEQ ID NO: 73050 - DNA, 95 bp, Homo sapiens
  misc_feature 1..95: note = chr11:61347879-61347974
  misc_feature 1..95: note = hyper
  source 1..95: mol_type = genomic DNA
cagcgctggcacccccggggcaccggtgctggggagcctcgggtgcctctgagggcactgcccggctcccacaggggcagcggctcctcgctccg

SEQ ID NO: 73051 - DNA, 38 bp, Homo sapiens
  misc_feature 1..38: note = chr11:61355533-61355571
  misc_feature 1..38: note = hyper
  source 1..38: mol_type = genomic DNA
gagctgtgactgtcccggttccgcgatccctggctctg

SEQ ID NO: 73052 - DNA, 43 bp, Homo sapiens
  misc_feature 1..43: note = chr11:61356081-61356124
  misc_feature 1..43: note = hyper
  source 1..43: mol_type = genomic DNA
tgggaggtgagggggcgcagaggccgggcgccctggaaaggag

SEQ ID NO: 73053 - DNA, 93 bp, Homo sapiens
  misc_feature 1..93: note = chr11:61447983-61448076
  misc_feature 1..93: note = hyper
  source 1..93: mol_type = genomic DNA
gggcctccggcgcggcgggccggtcctgggcgcgggcgcggtgcgagcggcgcggcgggctgggcagtgtccagggcgcgcggtggccggccc

SEQ ID NO: 73054 - DNA, 51 bp, Homo sapiens
  misc_feature 1..51: note = chr11:61526128-61526179
  misc_feature 1..51: note = hypo
  source 1..51: mol_type = genomic DNA
atgcacaggcatgctcgtacctcagggcttttgcaccggctgtccccgcca

SEQ ID NO: 73055 - DNA, 192 bp, Homo sapiens
  misc_feature 1..192: note = chr11:615793-615985
  misc_feature 1..192: note = hyper
  source 1..192: mol_type = genomic DNA
cgcccgaccctcatctctcaggctcccccagctcttggctctacccctccggggtcacggagcccccacggaggctctcgctcccggcctgcaccgcgtgggtctggggtccccagtacctgggtgccagagccgccgggacgggaagtttcgtctcgcggggaagcggagggccggcgcttttatggtggc

SEQ ID NO: 73056 - DNA, 30 bp, Homo sapiens
  misc_feature 1..30: note = chr11:61581920-61581950
  misc_feature 1..30: note = hypo
  source 1..30: mol_type = genomic DNA
tggggctgtgtcgggcgttggttccttccg

SEQ ID NO: 73057 - DNA, 129 bp, Homo sapiens
  misc_feature 1..129: note = chr11:61582570-61582699
  misc_feature 1..129: note = hyper
  source 1..129: mol_type = genomic DNA
tggcgataagattcacgttggcaggtccggcagccccgggccctgtaagtgatgcggcgtgtggggcgggggccggggcggagccggcggccggtggcaccacacatacggaccaatcgccgtccccgc

SEQ ID NO: 73058 - DNA, 53 bp, Homo sapiens
  misc_feature 1..53: note = chr11:61582756-61582809
  misc_feature 1..53: note = hyper
  source 1..53: mol_type = genomic DNA
cgtctgcgcatgcgccgggacacgcctgcgcccttggccgcagtcagggctcc

SEQ ID NO: 73059 - DNA, 448 bp, Homo sapiens
  misc_feature 1..448: note = chr11:61583181-61583629
  misc_feature 1..448: note = hyper
  source 1..448: mol_type = genomic DNA
ggcctggggctggggcgcgcgccgaccccgcagtgagaccaagggaagaagggacaggaccccgcgaagggcctaccgccccagagcgtaaacagcggtccgctccgcggaatagctgaagacctcgctggcctgcggctcagtggcctccccggcgattcgagaacagctctgggggtcctcgctaagtgtatgccattcccaatcccttatgtacgccagcggccgcttgccctccccggccagcgctgtcccttccgcgtcctccagtcttcacacgacgcaggggtccccaaggcagcggtctccccaagcttcccgtttcagccccatcctcgagaatgggctcctttcctgctccctctccgctcctgctggcgagtggagaccggcacctaggtccagacgcggctgcgctgcctctcctagccatcgagacaggatgtga

SEQ ID NO: 73060 - DNA, 232 bp, Homo sapiens
  misc_feature 1..232: note = chr11:61583894-61584126
  misc_feature 1..232: note = hyper
  source 1..232: mol_type = genomic DNA
acaggtatgatcaggcgcctccgggctttcctccgaattagtcggtgtttggctcggagtgcgtaactctgtctcccctgcactcagcctccggtcccgccctctcctgtgcccccgcctggctgcgctcaccgtggcatcctgcccggcgtagtggctgatgacccgggagccccctggatgccggcgggtgaactcgctgatgttgtacaccttacggtcgatcactagc

SEQ ID NO: 73061 - DNA, 46 bp, Homo sapiens
  misc_feature 1..46: note = chr11:61584805-61584851
  misc_feature 1..46: note = hyper
  source 1..46: mol_type = genomic DNA
cttgccacgtcgtgccgccaattgtgctgcccgaagtagcagcctg

SEQ ID NO: 73062 - DNA, 511 bp, Homo sapiens
  misc_feature 1..511: note = chr11:61594981-61595492
  misc_feature 1..511: note = hyper
  source 1..511: mol_type = genomic DNA
gaggttgcagaaaggcgccagaatgtggatggcgcggacaatgtgggatactggagtctcgactgccgcgcgccaaggaagggcgtcacctagccaagccggccctggagttgagtgccccgcagcccgccggtccacccgcccggccgcttgctggcaccctggtggccgcgccggctttgtgtcggcatcaggtgcaaacccccagagcgccgggcgtgcgcgcacgcgccccggagcgcgcggagcccattcgttgcccccaccgggatctcctctaggatctcctccggcgcccggggccggagagtgggggagggaggaggtcggacacgtagcctgcctcgcagcagggctcgactccacgcgggagggcgggggagccggggacccgccgctccagcccgctggccttcgaaagatcctcctgggccaatggcaggcggggcgacgcgaccggattggtgcaggcgctctgctgatcgctgtggaaactcgggcggcggggaac

SEQ ID NO: 73063 - DNA, 944 bp, Homo sapiens
  misc_feature 1..944: note = chr11:61595751-61596695
  misc_feature 1..944: note = hyper
  source 1..944: mol_type = genomic DNA
aaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggtaagggtctgggggcgccccagccacccttctctgctgcaggcggagtcaggatccctggctccccgtgggccaaacagacctccggcgctgaatggagcttgggacgtcctgtagggaaggaaagtgcatctattgcactcgtaccccctccccaatcctcctcctcctctgggccgactggggtggagaccggatctgggacccggggaggcggcgctgcggtgaaagtcccagcggtggagaacagggcaagcatctaccgcgcgcgccgggacccacgcgtcctccccttcctcggggtttgtctggaggcagggactccccaagaggggcgctcgggccagacggctttggcgcccccagcggggaagatggccgcccctgcgcgccgctgaaaggagcgggagcgcaggcagccaggtgtgggactccgcgcttgtcccgcactctccatccagactgggtggcgagaaggaaagctcgtccccggccggagatcgctcctgctgggactcttgtctaagaagttcctcaatggccacctgggaaaaaccgcccagcagctcgggttcccacgctccagggattatctagactcaccccaagctcgagccggccttctt

SEQ ID NO: 73064 - DNA, 30 bp, Homo sapiens
  misc_feature 1..30: note = chr11:61625542-61625572
  misc_feature 1..30: note = hypo
  source 1..30: mol_type = genomic DNA
ttctgggcctctcatcggctggttgatggc

SEQ ID NO: 73065 - DNA, 82 bp, Homo sapiens
  misc_feature 1..82: note = chr11:61633635-61633717
  misc_feature 1..82: note = hypo
  source 1..82: mol_type = genomic DNA
cttcactctccctgacggctgccattggtccaccctttcatagagaggcctgctttgttacaaagctcgggtctccctcctg

SEQ ID NO: 73066 - DNA, 81 bp, Homo sapiens; identical to SEQ ID NO: 43095
  misc_feature 1..81: note = chr11:61641410-61641491
  misc_feature 1..81: note = hypo
  source 1..81: mol_type = genomic DNA

SEQ ID NO: 73067 - DNA, 105 bp, Homo sapiens
  misc_feature 1..105: note = chr11:616542-616647
  misc_feature 1..105: note = hypo
  source 1..105: mol_type = genomic DNA
tgttcagtcaagaatatcagatactctcacaattaaaacatttggaaaggaattaatggtgtatttccattagggaaagtgctgacaagccgcaagggatccctt

SEQ ID NO: 73068 - DNA, 488 bp, Homo sapiens
  misc_feature 1..488: note = chr11:61664512-61665000
  misc_feature 1..488: note = hypo
  source 1..488: mol_type = genomic DNA
gcaggccaccagccacggggagagggaggcctggctcatcccccagtaacccacagccctctgaatactaagggaggactcaaatagtcctccccacagcaagtaagtggtgatggcggaggtggggtggcttcaggatttgggtttaatcccaagcacgagggcgggcagggaaaggatttggtttcattccttcagatgcccaagccttggccagagccccagggtgcaggagtgagggcgcgtggccacccagcctgtaccaacaaagcctgcctttattaaatagagatcgcgttacattccatccaaagaaggaaatccggacgtggtgagggatgcgtccaggtgggagctccgaacgctggtcctgagtgggctctgatgggtgggagggcccaggtcctgcctgcccacccaggccccacatgccagggcgcgtgtctgcatggccacccacagctgaaaacaggcgtgggtgatctgaa

SEQ ID NO: 73069 - DNA, 59 bp, Homo sapiens; identical to SEQ ID NO: 43097
  misc_feature 1..59: note = chr11:61665728-61665787
  misc_feature 1..59: note = hypo
  source 1..59: mol_type = genomic DNA

SEQ ID NO: 73070 - DNA, 140 bp, Homo sapiens
  misc_feature 1..140: note = chr11:61666088-61666228
  misc_feature 1..140: note = hypo
  source 1..140: mol_type = genomic DNA
agacaagcaggtacacgctgtcacatgccacagcggtggtccagacctgggaactacattagacaaggcacagatgcctccctggggtctcacaaggaccctgcgcagtgaggcggggaccacagcggccatccagggac

SEQ ID NO: 73071 - DNA, 174 bp, Homo sapiens
  misc_feature 1..174: note = chr11:61669877-61670051
  misc_feature 1..174: note = hypo
  source 1..174: mol_type = genomic DNA
aaaggagtcaagtaacgcttgcaaaggctgactcaccctggcccgggaagatggcgagatgtagtaatggcttttggagtccccgagccggattcggtggcggcaggtgcgggtcagcccgctcagggcacatgtgctaggggaaagcaaaatgggtcacgggggctggctggg

SEQ ID NO: 73072 - DNA, 244 bp, Homo sapiens
  misc_feature 1..244: note = chr11:61674856-61675100
  misc_feature 1..244: note = hypo
  source 1..244: mol_type = genomic DNA
ggcctcaccttgccccgagcctccttcagctgcttttctgatgccgcctgcttcatgttggcttctcgaaccatcttgtgagcttcctaggaagaaggcagtccctgcgtgagtggtgaggagccaacggacgcccagatgacccattccccaagttgttcccgcgcccagccggtgtacctcaaacaggctggccgtcagctcttccagctcctgttctagctgctcccgcaccttggacagc

SEQ ID NO: 73073 - DNA, 245 bp, Homo sapiens
  misc_feature 1..245: note = chr11:61684587-61684832
  misc_feature 1..245: note = hyper
  source 1..245: mol_type = genomic DNA
ttgacgctgtcaccccgggacggtcggctgcccacccttcgcaccctgcaccccgagagacacccccgacccctcccccggagtctcctggctgcaagtcggctcgcctgcaggcagggcgggggcgcacagcacctccgggtggcggcgcagacccggcggggacccccgaaatcctcccgtcccgggaggcgaccgcggcccagacccagcgcgggaccgcgagcgcgcgcggacctacccgc

SEQ ID NO: 73074 - DNA, 305 bp, Homo sapiens
  misc_feature 1..305: note = chr11:61722682-61722987
  misc_feature 1..305: note = hyper
  source 1..305: mol_type = genomic DNA
cccttctggctgttccgggtccctgtggccgcccaggctccagacaggccaggggaggatcacgaggagctgcggcaaggggctggggagggggcgggggaacgccagcggcaggtcggcgcctctctgtagggaaaggtgcggactgcagccagtgaaactgaagttagacgttaggtaagacgtcctgccgttagcaatgaaaaccccattttctgagggaagcgctgacatcatggtccctggagcccctgcgcgggaggggagggggtctggcggatttctgggaccagcagggggacccc

SEQ ID NO: 73075 - DNA, 32 bp, Homo sapiens
  misc_feature 1..32: note = chr11:61736195-61736227
  misc_feature 1..32: note = hypo
  source 1..32: mol_type = genomic DNA
ggtccactgttctgtcgcgtcttttgacgcat

SEQ ID NO: 73076 - DNA, 23 bp, Homo sapiens
  misc_feature 1..23: note = chr11:61736670-61736693
  misc_feature 1..23: note = hypo
  source 1..23: mol_type = genomic DNA
ttgcctggggctgggcgcggtgg

SEQ ID NO: 73077 - DNA, 82 bp, Homo sapiens; identical to SEQ ID NO: 43102
  misc_feature 1..82: note = chr11:61736993-61737075
  misc_feature 1..82: note = hypo
  source 1..82: mol_type = genomic DNA

SEQ ID NO: 73078 - DNA, 42 bp, Homo sapiens
  misc_feature 1..42: note = chr11:61753272-61753314
  misc_feature 1..42: note = hypo
  source 1..42: mol_type = genomic DNA
atcttttcatacgcttgaaaaaaaagacggtgagcatctttt

SEQ ID NO: 73079 - DNA, 30 bp, Homo sapiens; identical to SEQ ID NO: 43103
  misc_feature 1..30: note = chr11:61784772-61784802
  misc_feature 1..30: note = hypo
  source 1..30: mol_type = genomic DNA

SEQ ID NO: 73080 - DNA, 137 bp, Homo sapiens
  misc_feature 1..137: note = chr11:61793162-61793299
  misc_feature 1..137: note = hyper
  source 1..137: mol_type = genomic DNA
tgcagtcagcagacacgtacgggatgtgggaggtttgttttgaccacacccctgtcaatagttacaagataagccaaagcaagaagcacagacaccatgcctggcagaaaagcggccgtttgcggaactattttatg

SEQ ID NO: 73081 - DNA, 30 bp, Homo sapiens
  misc_feature 1..30: note = chr11:61899800-61899830
  misc_feature 1..30: note = hypo
  source 1..30: mol_type = genomic DNA
ggctttgtgcaaggccgcagggcagggcct

SEQ ID NO: 73082 - DNA, 256 bp, Homo sapiens
  misc_feature 1..256: note = chr11:62105312-62105568
  misc_feature 1..256: note = hyper
  source 1..256: mol_type = genomic DNA
agctgcgaacccagccgttcagaacagagactgggcattgtccccacagggtctcccgaggaccttgtacccgcgcggcttccttgggctggctttggacgacgctttcgccttcctgctgcctaggatccgccgacatgaatcccatcgtagtggtccacggcggcggagccggtcccatctccaaggatcggaaggagcgagtgcaccagggcatggtcagagccgccaccgtgggctacggcatcctccggga

SEQ ID NO: 73083 - DNA, 35 bp, Homo sapiens
  misc_feature 1..35: note = chr11:62184274-62184309
  misc_feature 1..35: note = hypo
  source 1..35: mol_type = genomic DNA
ttcctgtttagcaagcgttgcgtaccttggcttac

SEQ ID NO: 73084 - DNA, 203 bp, Homo sapiens
  misc_feature 1..203: note = chr11:62191247-62191450
  misc_feature 1..203: note = hypo
  source 1..203: mol_type = genomic DNA
aatcctaaatcctgacgatagatagtggcccctcaccagtctttcctgtgctcctccttcccacggctccttcattctgctcagtccccacacacacccccaccttccctgccctcagtttttaaaaagagccaagcccctttcaaccttaagacctttgtaccagccacacagccctggctgctcaaaaagtgtggctgatg

SEQ ID NO: 73085 - DNA, 228 bp, Homo sapiens; identical to SEQ ID NO: 43104
  misc_feature 1..228: note = chr11:62370522-62370750
  misc_feature 1..228: note = hypo
  source 1..228: mol_type = genomic DNA

SEQ ID NO: 73086 - DNA, 95 bp, Homo sapiens; identical to SEQ ID NO: 43105
  misc_feature 1..95: note = chr11:62421710-62421805
  misc_feature 1..95: note = hypo
  source 1..95: mol_type = genomic DNA

SEQ ID NO: 73087 - DNA, 30 bp, Homo sapiens; identical to SEQ ID NO: 43106
  misc_feature 1..30: note = chr11:62440622-62440652
  misc_feature 1..30: note = hypo
  source 1..30: mol_type = genomic DNA

SEQ ID NO: 73088 - DNA, 117 bp, Homo sapiens
  misc_feature 1..117: note = chr11:62445413-62445530
  misc_feature 1..117: note = hypo
  source 1..117: mol_type = genomic DNA
tcggccttttccctccgcctctcctcagcagcccggcgcatctcatcttcctgtagccgctgtcgtgctgctgacaactcttgcccttgtctcctgcgctgccgttcccgttccaat

SEQ ID NO: 73089 - DNA, 78 bp, Homo sapiens
  misc_feature 1..78: note = chr11:62450128-62450206
  misc_feature 1..78: note = hypo
  source 1..78: mol_type = genomic DNA
attacaggcgtgagccaccatgcccagtgctggaattacaggcgtgagtgctgtaattacaggcgtgagtgctggaat

SEQ ID NO: 73090 - DNA, 27 bp, Homo sapiens
  misc_feature 1..27: note = chr11:62497829-62497856
  misc_feature 1..27: note = hypo
  source 1..27: mol_type = genomic DNA
agccactgcacccggcccagtaatttt

SEQ ID NO: 73091 - DNA, 104 bp, Homo sapiens; identical to SEQ ID NO: 43007
  misc_feature 1..104: note = chr11:6257172-6257276
  misc_feature 1..104: note = hypo
  source 1..104: mol_type = genomic DNA

SEQ ID NO: 73092 - DNA, 40 bp, Homo sapiens
  misc_feature 1..40: note = chr11:62609977-62610017
  misc_feature 1..40: note = hyper
  source 1..40: mol_type = genomic DNA
cctgatcctcaaacccgggatcccgcggtgggagaaaggt

SEQ ID NO: 73093 - DNA, 43 bp, Homo sapiens
  misc_feature 1..43: note = chr11:62661211-62661254
  misc_feature 1..43: note = hypo
  source 1..43: mol_type = genomic DNA
aaaagccttctcctgcgcaatggcttgggcctgtaatcccagc

SEQ ID NO: 73094 - DNA, 209 bp, Homo sapiens
  misc_feature 1..209: note = chr11:62666677-62666886
  misc_feature 1..209: note = hypo
  source 1..209: mol_type = genomic DNA
acttgctttgtcctgcgaaagtaacctttaacttttaaaaagcttgtgattctgattgcttgtcttccttaatagtgtgttgccctggcaataatatttaaattcacatctgtgttttctagaaggtataaatacctgtgagttttctttgttaagccagagggggagcattgacacattcctcttctcccacgcgcatgaagtagaat

SEQ ID NO: 73095 - DNA, 15 bp, Homo sapiens
  misc_feature 1..15: note = chr11:626863-626878
  misc_feature 1..15: note = hyper
  source 1..15: mol_type = genomic DNA
accccccaccccacc

SEQ ID NO: 73096 - DNA, 307 bp, Homo sapiens
  misc_feature 1..307: note = chr11:6280415-6280722
  misc_feature 1..307: note = hyper
  source 1..307: mol_type = genomic DNA
aggagatggagggtgcggagacagatgcaggagctaccccaggcccgcagcgaggagctgcagggaactacggtagcaatagtgtcacggtcactgcggccactgcaacacagtacggtaaatgcggctctaggctcagactaaagcatccgcgcctcagcaggtgacgcacgcagacctggtctccaacgccacctccacgttccctgatacaccagagaaagatgctggatccgtggcagccgtctctacccaacccctcctaccctcccttccccgaaacctccccctacgctgccaatactct

SEQ ID NO: 73097 - DNA, 156 bp, Homo sapiens
  misc_feature 1..156: note = chr11:6281164-6281320
  misc_feature 1..156: note = hyper
  source 1..156: mol_type = genomic DNA
ctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgaggtgggtgcctc

SEQ ID NO: 73098 - DNA, 102 bp, Homo sapiens
  misc_feature 1..102: note = chr11:63258610-63258712
  misc_feature 1..102: note = hyper
  source 1..102: mol_type = genomic DNA
gcactgggggcggctcggggaggaaccgcggaggggaaagcgccgcgggctgcaaacggcagaggcgcgcggggtggcgacagtggcgcgggcgcagtgagc

SEQ ID NO: 73099 - DNA, 57 bp, Homo sapiens
  misc_feature 1..57: note = chr11:63258713-63258770
  misc_feature 1..57: note = hyper
  source 1..57: mol_type = genomic DNA
cgtccgagaacagaatgggacgaaacggggcgcttagaggcccgggaatctgtgggt

SEQ ID NO: 73100 - DNA, 101 bp, Homo sapiens
  misc_feature 1..101: note = chr11:63374106-63374207
  misc_feature 1..101: note = hypo
  source 1..101: mol_type = genomic DNA
gcctcgcctggaggccggagatgagccttgcagatggctaacacctccggcagggggagcagccgagcaaaggccccagcggggcgcgtgtctgagcaaca

SEQ ID NO: 73101 - DNA, 90 bp, Homo sapiens
  misc_feature 1..90: note = chr11:6341394-6341484
  misc_feature 1..90: note = hyper
  source 1..90: mol_type = genomic DNA
ggctgcgcggcgcaccgcgcgctcttgggcggcgttggcgtgcgagctcacgcgctccgccttggccagcagctgcgccaaggtgttgct

SEQ ID NO: 73102 - DNA, 101 bp, Homo sapiens
  misc_feature 1..101: note = chr11:63537119-63537220
  misc_feature 1..101: note = hyper
  source 1..101: mol_type = genomic DNA
cgcgttaccacggctcggaagcgctgggcggaccctggctgcgggtcccggggcgcccccggtcccccagctccggagaagcggagcgcagggacccggag

SEQ ID NO: 73103 - DNA, 154 bp, Homo sapiens
  misc_feature 1..154: note = chr11:63572071-63572225
  misc_feature 1..154: note = hypo
  source 1..154: mol_type = genomic DNA
tgggggtgaaaagaacgtcctggtagcatttatgtcctgggtccggttattcctaaagtcggcctgtatccctgcccttcccacaattgggcattcagcccttccttcagttccatgagccaataaatcccccattttgttcaagctagtatat

SEQ ID NO: 73104 - DNA, 96 bp, Homo sapiens
  misc_feature 1..96: note = chr11:63609980-63610076
  misc_feature 1..96: note = hypo
  source 1..96: mol_type = genomic DNA
ttcctgtattctttaaaacgggaaaaaagacaagcagcagctcctcaggtcacaaggccaggtatatcaaacactggcctccgagaatagatcatg

SEQ ID NO: 73105 - DNA, 18 bp, Homo sapiens
  misc_feature 1..18: note = chr11:63641124-63641142
  misc_feature 1..18: note = hypo
  source 1..18: mol_type = genomic DNA
tatttttttctgagacgg

SEQ ID NO: 73106 - DNA, 56 bp, Homo sapiens
  misc_feature 1..56: note = chr11:63652242-63652298
  misc_feature 1..56: note = hypo
  source 1..56: mol_type = genomic DNA
cttggcagttgatagcgatagttgctcatggcagttgatagcgatagttgctcaga

SEQ ID NO: 73107 - DNA, 12 bp, Homo sapiens
  misc_feature 1..12: note = chr11:636895-636907
  misc_feature 1..12: note = hyper
  source 1..12: mol_type = genomic DNA
actagggtgagc

SEQ ID NO: 73108 - DNA, 88 bp, Homo sapiens
  misc_feature 1..88: note = chr11:637176-637264
  misc_feature 1..88: note = hyper
  source 1..88: mol_type = genomic DNA
ggggcccccctgagccggggcgggtcgggggcgggaccagggtccggccggggcgtgcccgaggggagggactccccggcttgcgacc

SEQ ID NO: 73109 - DNA, 152 bp, Homo sapiens
  misc_feature 1..152: note = chr11:637349-637501
  misc_feature 1..152: note = hyper
  source 1..152: mol_type = genomic DNA
cgcgggccggccgcgggggcatctgcgggggcatctgcggggctggctgggcagggcgcggcggcgctggtggggggcgtgctgctcatcggcgcggtgctcgcggggaactcgctcgtgtgcgtgagcgtggccaccgagcgcgccctgca

SEQ ID NO: 73110 - DNA, 30 bp, Homo sapiens
  misc_feature 1..30: note = chr11:63735580-63735610
  misc_feature 1..30: note = hypo
  source 1..30: mol_type = genomic DNA
actcctggtttcaagcgatcctcctggctc

SEQ ID NO: 73111 - DNA, 30 bp, Homo sapiens
  misc_feature 1..30: note = chr11:63743650-63743680
  misc_feature 1..30: note = hypo
  source 1..30: mol_type = genomic DNA
ggggaatactgactccgaggtgccttcttt

SEQ ID NO: 73112 - DNA, 18 bp, Homo sapiens
  misc_feature 1..18: note = chr11:63767704-63767722
  misc_feature 1..18: note = hyper
  source 1..18: mol_type = genomic DNA
ccgggagccgatagccgc

SEQ ID NO: 73113 - DNA, 182 bp, Homo sapiens
  misc_feature 1..182: note = chr11:63768254-63768436
  misc_feature 1..182: note = hyper
  source 1..182: mol_type = genomic DNA
gggcctcagcgtcggtgcgatcccaaggcccacctccccaggcggcgccccatcacggggcggcggcaaaccctaggacccattttgcggatgaggaaaccgaggccaccttgttacagggtgatcagatctgtagctggagtctgggtcttccagccgcgcggggaggtgagcccgacgcc

SEQ ID NO: 73114 - DNA, 145 bp, Homo sapiens
  misc_feature 1..145: note = chr11:63779111-63779256
  misc_feature 1..145: note = hypo
  source 1..145: mol_type = genomic DNA
agggaatcagggctgcgggacgaagacatggagcagggcagtgcatcagggttctgggcagagtggccagggcaggcaggatggcccttgtgcgtgttcgaacaatgggtggctggtcatgggaggggcgcgggtagaggcctga

SEQ ID NO: 73115 - DNA, 30 bp, Homo sapiens; identical to SEQ ID NO: 43111
  misc_feature 1..30: note = chr11:63780950-63780980
  misc_feature 1..30: note = hypo
  source 1..30: mol_type = genomic DNA

SEQ ID NO: 73116 - DNA, 32 bp, Homo sapiens
  misc_feature 1..32: note = chr11:63783251-63783283
  misc_feature 1..32: note = hypo
  source 1..32: mol_type = genomic DNA
ctggaggactgagaacgcggagcagtgctgag

SEQ ID NO: 73117 - DNA, 82 bp, Homo sapiens; identical to SEQ ID NO: 43112
  misc_feature 1..82: note = chr11:63783734-63783816
  misc_feature 1..82: note = hypo
  source 1..82: mol_type = genomic DNA

SEQ ID NO: 73118 - DNA, 30 bp, Homo sapiens
  misc_feature 1..30: note = chr11:63785738-63785768
  misc_feature 1..30: note = hypo
  source 1..30: mol_type = genomic DNA
gtgcctgacgtcccacgggtgggggggctc

SEQ ID NO: 73119 - DNA, 295 bp, Homo sapiens
  misc_feature 1..295: note = chr11:63803412-63803707
  misc_feature 1..295: note = hyper
  source 1..295: mol_type = genomic DNA
cgcggctccgccgggcgcccgagccgggcagatgcgccgccgcgcgccccccgctccgggcccgccaccgtgctctgccgcgcgccgggggctcctctcccgggcccccctgggcgccctccggctctggttcccgcccgctccttggaataacccctgaggctccagccgtcaccgcaaagtttcccgaggagacccgcctccccggccgctgcgcaggtagggctggctgcaccgggcgggggtcggggtccgcgcgtctgggacagggcgccagagccgacggggcgggggc

SEQ ID NO: 73120 - DNA, 30 bp, Homo sapiens
  misc_feature 1..30: note = chr11:63804018-63804048
  misc_feature 1..30: note = hyper
  source 1..30: mol_type = genomic DNA
cccgcactcgggaaccggaggagggcgcgc

SEQ ID NO: 73121 - DNA, 94 bp, Homo sapiens
  misc_feature 1..94: note = chr11:63804348-63804442
  misc_feature 1..94: note = hyper
  source 1..94: mol_type = genomic DNA
gggcactggagaccccggggaggaaggctggggagtgttgtcgcccagctgcagggaaccgtggttgatcagagctccccgaggaggagaaagt

SEQ ID NO: 73122 - DNA, 254 bp, Homo sapiens
  misc_feature 1..254: note = chr11:63849380-63849634
  misc_feature 1..254: note = hypo
  source 1..254: mol_type = genomic DNA
agccctctggactcccggctctcgagtgccgcgttctacctgctgtgttctaaatggacatgccatccccacagctgtgtcaataaagcagccatttacagagcgggcgccggatcccgtgacaggttgaaaagtgtgtgagctgcagcgtcctgggctggggcagaggggccgtggcgagaacagatggggctgtgcccatctccccaggccctcctgtggctgcgcctggagcctcccgggagggaggccag

SEQ ID NO: 73123 - DNA, 30 bp, Homo sapiens
  misc_feature 1..30: note = chr11:63906088-63906118
  misc_feature 1..30: note = hypo
  source 1..30: mol_type = genomic DNA
ctctctccccaactgcgatgccgctcggct

SEQ ID NO: 73124 - DNA, 59 bp, Homo sapiens
  misc_feature 1..59: note = chr11:63916700-63916759
  misc_feature 1..59: note = hypo
  source 1..59: mol_type = genomic DNA
caggtgctgagtgaccgtcatttgcacgtcacgtgcatcagctccgagtgcccccagta

SEQ ID NO: 73125 - DNA, 30 bp, Homo sapiens
  misc_feature 1..30: note = chr11:63920212-63920242
  misc_feature 1..30: note = hypo
  source 1..30: mol_type = genomic DNA
cctgcagaacagctccgagcttcctcccac

SEQ ID NO: 73126 - DNA, 20 bp, Homo sapiens
  misc_feature 1..20: note = chr11:63934599-63934619
  misc_feature 1..20: note = hypo
  source 1..20: mol_type = genomic DNA
aaacacgaggatggattttt

SEQ ID NO: 73127 - DNA, 30 bp, Homo sapiens
  misc_feature 1..30: note = chr11:63938071-63938101
  misc_feature 1..30: note = hypo
  source 1..30: mol_type = genomic DNA
cctcctgggctcaatcgatcctccagcctc

SEQ ID NO: 73128 - DNA, 37 bp, Homo sapiens
  misc_feature 1..37: note = chr11:63955145-63955182
  misc_feature 1..37: note = hypo
  source 1..37: mol_type = genomic DNA
atttctggaataagacgttgctcttttacctttaaga

SEQ ID NO: 73129 - DNA, 129 bp, Homo sapiens
  misc_feature 1..129: note = chr11:63978732-63978861
  misc_feature 1..129: note = hypo
  source 1..129: mol_type = genomic DNA
aacctgcactccaggcgtggcacctgcactgttccgggggatgccagctcacttctcggacagcgcccagactgaggcctgctaccacatgctgagccggccccagccgccacccgaccccctcctgct

SEQ ID NO: 73130 - DNA, 40 bp, Homo sapiens
  misc_feature 1..40: note = chr11:64010257-64010297
  misc_feature 1..40: note = hypo
  source 1..40: mol_type = genomic DNA
ctatgaccagctgggcgcagtggctcacccctgtaatccc

SEQ ID NO: 73131 - DNA, 80 bp, Homo sapiens
  misc_feature 1..80: note = chr11:64039207-64039287
  misc_feature 1..80: note = hyper
  source 1..80: mol_type = genomic DNA
cccttcgtcgtcctccgtccccgcggggtaggagctgtggcgactccggatctccacagccccagcgcctgcagagggtc

SEQ ID NO: 73132 - DNA, 67 bp, Homo sapiens
  misc_feature 1..67: note = chr11:64042943-64043010
  misc_feature 1..67: note = hypo
  source 1..67: mol_type = genomic DNA
cccatctgccaggatcgccatgacaacaaatgagagcaggaaagccccctaccggcccctcatagcc

SEQ ID NO: 73133 - DNA, 99 bp, Homo sapiens
  misc_feature 1..99: note = chr11:64054286-64054385
  misc_feature 1..99: note = hypo
  source 1..99: mol_type = genomic DNA
tctctactgctgccccgtctgcctgcagttcttcaccttgacgcttatgaacctctactttgcccaggtaaccaactgtggtcccgggtggggggcggg

SEQ ID NO: 73134 - DNA, 1297 bp, Homo sapiens
  misc_feature 1..1297: note = chr11:64058814-64060111
  misc_feature 1..1297: note = hyper
  source 1..1297: mol_type = genomic DNA
gttgcggacccttcccgatccggtaatgggcctgggagatgccagattagcgtggtgcctgtccggagagacgggccagctgatgcccaggtcggggccctgccgctggccacactgggctccggtccaaggctagaaggctggcccctgctgcaacccctctccggctcctctgccacccacctcccggggctggccggctgtggggagccaggcggccgcaggtaaacggcttggggcggcgccggcggcgagggcgctgcacggagggaagcgcggcgccggaggggttaaccgcgggaggaggggggcttctgccggcgggaggggggtcccagccccggcggccgcccgctccgcccctgccgcctccgcggcccagtcggcaccggcgaggccgtgctggaacccgggcctcagccgcagccgcagcggggccgacagtaagtgcggtgcgggctccggtgcgcgggcaggactcaggggcagggacgccccaggggcgactggccgggcggggtgcccacctctcgcgcgtgggcgcctccgggagtggtgtggccgccggtcccgccgcccgccacgctccgaggcgtcgctgtgcggacgcgggggaggcggtgggagcgagctgcgggcgctgcgcggtggccctgctgtctggcgtgtgcacgctagtgtccacacacgtgtgcgtgggctctgggtgccctggcgcggccggcacgcccatgggggccggggatgccggggcgtctgcggagagtgcaggtggggtgcgtgcgtgcagcggggcggcgcggcgctgcagcctcgggatggagcgtgggcgcgcgggtctttgtgcccgcgcttggcggcgcgtgccggggcgtgtgtgcgcgtgggcgccgccgcccgctgtctcggactgacagctgtctcgggggctgtcgccccggtgtggcctttgcggacccccgccccgctttttccgggaactgggcgtccccagcacccctcctcgcctgggtgcggcggccgggacccgcccctgggttcctcgaaagcccggcggggcgcgggggcaccctggagggccagccaggaagcagggcgaggcgagaggggacggagaagccgcggagatgctgtcacagccgcagcgggcgagcagggacccaccattcccctgtccccgccttgcgctgtccggcctctcctccgggtttcccttcggacgcctccgagccccctcagcctcctcctcgagggccagctccccgcacccccaccaagctccacacatttcctcgct

SEQ ID NO: 73135 - DNA, 33 bp, Homo sapiens; identical to SEQ ID NO: 33894
  misc_feature 1..33: note = chr11:64060160-64060193
  misc_feature 1..33: note = hyper
  source 1..33: mol_type = genomic DNA

SEQ ID NO: 73136 - DNA, 420 bp, Homo sapiens
  misc_feature 1..420: note = chr11:64066842-64067262
  misc_feature 1..420: note = hyper
  source 1..420: mol_type = genomic DNA
ccagctggactggcacggtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggctt

SEQ ID NO: 73137 - DNA, 215 bp, Homo sapiens
  misc_feature 1..215: note = chr11:64105859-64106074
  misc_feature 1..215: note = hypo
  source 1..215: mol_type = genomic DNA
ttttggtctgagagtcgtgatgtctgtgtctgcctgccacctccttctctgagtccttgagagttctacggagagcagtactgctccaaacattccataaaacagccaggcgctcttaagccagctttacaattgtgcagatgaagtggagccgagttttcactctgctctaggagtgtcactgacaggccgggcgtggtggctcacacctgtaa

SEQ ID NO: 73138 - DNA, 85 bp, Homo sapiens
  misc_feature 1..85: note = chr11:64108286-64108371
  misc_feature 1..85: note = hyper
  source 1..85: mol_type = genomic DNA
cggagcctgatgctcagtgggcggggcctgagggacggtgggcgaggcctgttgacgggaggcgggtcctcgagcccacctccgg

SEQ ID NO: 73139 - DNA, 95 bp, Homo sapiens
  misc_feature 1..95: note = chr11:64117072-64117167
  misc_feature 1..95: note = hypo
  source 1..95: mol_type = genomic DNA
ccagcaaggaggaggcgctgatggagctcaagaccagggccctgcagctggaagaggagctgttccaggtgatgcctgcccgcctgggagctggg

SEQ ID NO: 73140 - DNA, 105 bp, Homo sapiens
  misc_feature 1..105: note = chr11:64120222-64120327
  misc_feature 1..105: note = hypo
  source 1..105: mol_type = genomic DNA
cagctgcaggcccagcgggccagcgtggaggcacaggaggtggccctgctggcagagcgtgaacgcctgatgcaagatgggcatcggcagcggggcctggaggag

SEQ ID NO: 73141 - DNA, 126 bp, Homo sapiens
  misc_feature 1..126: note = chr11:64120822-64120948
  misc_feature 1..126: note = hypo
  source 1..126: mol_type = genomic DNA
ctattgacacagctgcgaagtgcccaggaagaggagaaccggcagctgctggctgaagttcaggccctgagccgggagaacagggagctcctggagcgcagcctggagagtcgggaccacctgcac

SEQ ID NO: 73142 - DNA, 30 bp, Homo sapiens
  misc_feature 1..30: note = chr11:64124074-64124104
  misc_feature 1..30: note = hypo
  source 1..30: mol_type = genomic DNA
taggtctttgaagcacgtcacaggccaacc

SEQ ID NO: 73143 - DNA, 88 bp, Homo sapiens
  misc_feature 1..88: note = chr11:64124704-64124792
  misc_feature 1..88: note = hypo
  source 1..88: mol_type = genomic DNA
ctccacggtcagcgccggggcccggagatggagctgggacgagtgtgtggacaggggggatggctggcccccacgagcagctccaggc

SEQ ID NO: 73144 - DNA, 66 bp, Homo sapiens
  misc_feature 1..66: note = chr11:64129402-64129468
  misc_feature 1..66: note = hypo
  source 1..66: mol_type = genomic DNA
aaggatcctaagaagcgattgggcgcggggccccagggggcacaagaagtccggaaccatcccttc

SEQ ID NO: 73145 - DNA, 41 bp, Homo sapiens
  misc_feature 1..41: note = chr11:64140397-64140438
  misc_feature 1..41: note = hypo
  source 1..41: mol_type = genomic DNA
cttatggacccaagacgggtgccaggcgctccagggactcc

SEQ ID NO: 73146 - DNA, 30 bp, Homo sapiens
  misc_feature 1..30: note = chr11:64147610-64147640
  misc_feature 1..30: note = hypo
  source 1..30: mol_type = genomic DNA
gtgtgagcgtgtggacgtgtgtgggtgtga

SEQ ID NO: 73147 - DNA, 104 bp, Homo sapiens
  misc_feature 1..104: note = chr11:64168551-64168655
  misc_feature 1..104: note = hypo
  source 1..104: mol_type = genomic DNA
tgtgggtaggaaatacgtggagcgctgagaatgggcacagaatgcaaagatgtttgtttccaatgcggatgccccgcagagggcacccccggcagaggagctct

SEQ ID NO: 73148 - DNA, 21 bp, Homo sapiens
  misc_feature 1..21: note = chr11:64184141-64184162
  misc_feature 1..21: note = hypo
  source 1..21: mol_type = genomic DNA
aagaatgaggctgggcgcggt

SEQ ID NO: 73149 - DNA, 76 bp, Homo sapiens
  misc_feature 1..76: note = chr11:64187500-64187576
  misc_feature 1..76: note = hypo
  source 1..76: mol_type = genomic DNA
ggttgtgagatgggtcgtgcctgacaccatttggcgctcagccaactcttgtttgtttcgtcgattctgctgggtt

SEQ ID NO: 73150 - DNA, 209 bp, Homo sapiens
  misc_feature 1..209: note = chr11:64292291-64292500
  misc_feature 1..209: note = hypo
  source 1..209: mol_type = genomic DNA
gtgtcccgagaatggcgcccagggagggtgtggaatctccgcggcccccctcacagccctgccccatgtgccccctccatctcgcagttcatctgtgtcctttctaatcttcacaataaactataactgtaagtaagtgtctccccgaattctgtgagcagtcctagccaatgaattgaacccgaggaagaggtcgtggggacctctta

SEQ ID NO: 73151 - DNA, 44 bp, Homo sapiens
  misc_feature 1..44: note = chr11:64313087-64313131
  misc_feature 1..44: note = hypo
  source 1..44: mol_type = genomic DNA
ctgaagtctacctgccgccagggcaagggcgcatatgtcaggaa

SEQ ID NO: 73152 - DNA, 62 bp, Homo sapiens
  misc_feature 1..62: note = chr11:64323679-64323741
  misc_feature 1..62: note = hypo
  source 1..62: mol_type = genomic DNA
tgaccatctccatcccgccaggccccaaccaggggccccaccagtgccgccgcttccgccag

SEQ ID NO: 73153 - DNA, 126 bp, Homo sapiens
  misc_feature 1..126: note = chr11:64361015-64361141
  misc_feature 1..126: note = hypo
  source 1..126: mol_type = genomic DNA
aacacgggcactctccgtaggtctctgacctggcgccatgcaggggggctccatgcaggctccagggctgaaccactcggtctccttgcagtgatggagtggacggcggcacgggcccgacccttg

SEQ ID NO: 73154 - DNA, 271 bp, Homo sapiens
  misc_feature 1..271: note = chr11:64409914-64410185
  misc_feature 1..271: note = hyper
  source 1..271: mol_type = genomic DNA
agctggggtggggcccgcgggggcccagctgcgcacacgggaagcgccccccgcccccgggccaaccgggtggccggcatctacagtgccacttaccgtggccgccgcgggtgaggaagggcatgcggttgatggcgatgggcacggtgccgtgcttgctgtggaagtggtggacgtggtgggtggtgctgaggctggaggagacccgggccccctcggccgcccccagcagcaacagcagcaacagcggcaacagcggcagcagaggtgg

SEQ ID NO: 73155 - DNA, 233 bp, Homo sapiens; identical to SEQ ID NO: 33897
  misc_feature 1..233: note = chr11:64410203-64410436
  misc_feature 1..233: note = hyper
  source 1..233: mol_type = genomic DNA

SEQ ID NO: 73156 - DNA, 359 bp, Homo sapiens
  misc_feature 1..359: note = chr11:64410638-64410997
  misc_feature 1..359: note = hyper
  source 1..359: mol_type = genomic DNA
gcagggaggggagagcgagggaaatcctgcggaaaaaccgagctggggagcggggcggtgcgggctggaggagagaagagggacggagacctggttcccccgaaggcgggagaccgacggcgactggggccggccgcgccgctgctgccgctgccgcccgacggaggccgggggaaaggagggagcggccgggggaggggggggcgggagaagggggaagggaagcaaatccgggtgaggggggaatgaagggataggagaggaggggataggagaggaggggagcggggctgagccgaggaaaggcgcgagcctgcgagattccggcggagagatggaggcagcgaagtgttgctgca

SEQ ID NO: 73157 - DNA, 30 bp, Homo sapiens
  misc_feature 1..30: note = chr11:64411442-64411472
  misc_feature 1..30: note = hyper
  source 1..30: mol_type = genomic DNA
cactgagatgtgtatcggcttgggtatgga

SEQ ID NO: 73158 - DNA, 257 bp, Homo sapiens
  misc_feature 1..257: note = chr11:64478747-64479004
  misc_feature 1..257: note = hyper
  source 1..257: mol_type = genomic DNA
acacacacacacaaccgctgagtggcccacagcttctagagggaccaggggagagaacgtcaggcctgaggcacacacgagctggaagaacagggacgaggggcggggagagacgcgcatgcgccgcccccagaccgatgggggagcccctccccacgcccagccagaccctaatggaagaggctcctcccagtgcttcctctcctcagcgccccctgccccccgacaccacagccccgccccgggccgctcagccc

SEQ ID NO: 73159 - DNA, 78 bp, Homo sapiens; identical to SEQ ID NO: 33900
  misc_feature 1..78: note = chr11:64480253-64480331
  misc_feature 1..78: note = hyper
  source 1..78: mol_type = genomic DNA

SEQ ID NO: 73160 - DNA, 877 bp, Homo sapiens
  misc_feature 1..877: note = chr11:64480379-64481256
  misc_feature 1..877: note = hyper
  source 1..877: mol_type = genomic DNA
cgaagcgccccaggccctcacccccgcgcccaggcaccgggcggccgctccccggggctcaccttcgctgcagaacttgccgccgaagcccgtgtggctgcagtcgcagcccacctcgccgggggccagcacggtgcagaggccgccgttggcgcaggggttgcgcgcgggcgcgcacagcgggtcggcggtggcgccgcgcaggccctggctgcccagcagcgcggggggccgctcgcccagcttcaggttggccaagaggccgcggaagggcggctcgtacttgacggtgctcagcgtaagcgccgagaggcgcacgtcgggcgggatgccgcccacgaacaggtcgctggccacctgcatctcgcgccgcttggagcgcacctcggcggcgcgggcctcgccgtccaccgccagcgccgtgcggcgcgcgtcgcgggtcagcagcaccatgtgccagcggtcgtcggccaccggcgtgtccagctgcagcgtggccggctcggcgcacgaaagcgtgaagcgcagccgcaggcggccgtccaccagcagcagctccaggaagtcgcagtcgccgccgtcgtccaggtagagcagcagcgcgcgcgtggcgttggtgcgcaggctgaagctgagctcgccgctgctcgccgcgcccgcccagcgcgcgtagcgagcccactgcccggggccgccgccgaactccaggccgtccgcgcgcgccgccagcgccagcagcagcagcaacagcagcggcggcggtgtcggccgccaccggctcccggacgccatgcctacggcggccccggccccgcccggcccccggcccccgctcaggcttcagagccgcgggcgcatggggcgggagggggccggg

SEQ ID NO: 73161 - DNA, 214 bp, Homo sapiens
  misc_feature 1..214: note = chr11:64488458-64488672
  misc_feature 1..214: note = hypo
  source 1..214: mol_type = genomic DNA
ggggctctgggggcacgtagtggccgtgtgtgtgttgtgtacatggcagcaaggcacctgggggaggtctcaaggaggcaggcatgaggtggcagcctctctgggtggggagtgtgggctgtatgctgccaggaggtgtattgtgtacgcaggtgtgtgtgcctgtgtaggtgtgtgtctgggtgggtgccaccgagcgcgtgtatcattgtca

SEQ ID NO: 73162 - DNA, 33 bp, Homo sapiens
  misc_feature 1..33: note = chr11:64496441-64496474
  misc_feature 1..33: note = hypo
  source 1..33: mol_type = genomic DNA
acactctgggccctgcgccgacactcaactgac

SEQ ID NO: 73163 - DNA, 30 bp, Homo sapiens; identical to SEQ ID NO: 43124
  misc_feature 1..30: note = chr11:64507459-64507489
  misc_feature 1..30: note = hypo
  source 1..30: mol_type = genomic DNA

SEQ ID NO: 73164 - DNA, 30 bp, Homo sapiens
  misc_feature 1..30: note = chr11:64508029-64508059
  misc_feature 1..30: note = hypo
  source 1..30: mol_type = genomic DNA
cgacaaattctaccccggaagagccccgaa

SEQ ID NO: 73165 - DNA, 202 bp, Homo sapiens
  misc_feature 1..202: note = chr11:64511882-64512084
  misc_feature 1..202: note = hyper
  source 1..202: mol_type = genomic DNA
cccgcctggctctaccgcttcctcgtgtgaccttgagaatcacttggcctctgggagcctcaattttctcatctgccaaatgggggtacgcgggggagggccccgctggaaggtggctgggaaaagctgggtgcaccgtggaggtcctccgccctccggggatccagcgcgccttagctctcgtggccgctgccccctctcc

SEQ ID NO: 73166 - DNA, 850 bp, Homo sapiens
  misc_feature 1..850: note = chr11:64512898-64513748
  misc_feature 1..850: note = hyper
  source 1..850: mol_type = genomic DNA
gggacctgtggggagcgaggaatgaaatcgtggctatctggagacgcggccttgatgtctgggaatgggggcggggggcccagttcacacaggaggaacggggccccggaagcctggctccccacagggtcgaatggaaaggggcagccgcatgtggcggtgggttctccgcagctcggagactggagacctggatgcctggccaacagggaggaacttgggaggggcagccgcaggcggttggggtccccactagccgggcctaggagagcgggtaacggtttccgaccatttggcttcagacacactcactgtgaaaccaccgaccccaaacctcccttccgaggcgtgcccctcccagccttggggcgggggatccaggaccgcccccgcacctcagtcttggtaatgtaagacttagaaacaggacctttctgttcctcagtttccccataatgagggcctagactaggcggtctgcgagtgttccctgccgtaacactcccccgactttggatccagtgtagccacctgctaagagacccttaaacgccgcagtagggcggggctaagggcggagccaagaaggcgccgagcatcctctgcttcctccccctcctgggtcctgccctcgacagcgcggatcctccgtggtccgggaagcctcagcccaagtcccggctcccagccccggtgggccccacccaggcagacgccccgcccccggccagcgaggctggccgctgacctagtatggacacggcactgggaagagaggcgtggagggtgacgccaggaaaggggctggagaggcctaggccccgcccccacgggtcgccccctccacctc

SEQ ID NO: 73167 - DNA, 43 bp, Homo sapiens
  misc_feature 1..43: note = chr11:64572043-64572086
  misc_feature 1..43: note = hypo
  source 1..43: mol_type = genomic DNA
ccaccttcagggcctcgggctgtgccagcgacagtcccaggag

SEQ ID NO: 73168 - DNA, 80 bp, Homo sapiens
  misc_feature 1..80: note = chr11:64578524-64578604
  misc_feature 1..80: note = hypo
  source 1..80: mol_type = genomic DNA
tcccacttccgcccgcgagatactctaacacgtgctaagagtagcttttgtttgtttgttttgagacacggtctttctct

SEQ ID NO: 73169 - DNA, 58 bp, Homo sapiens
  misc_feature 1..58: note = chr11:64609349-64609407
  misc_feature 1..58: note = hypo
  source 1..58: mol_type = genomic DNA
ctttcacctttgatacgaaggggctggctgaggggacacagggcgggactcagagtgc

SEQ ID NO: 73170 - DNA, 53 bp, Homo sapiens
  misc_feature 1..53: note = chr11:64610107-64610160
  misc_feature 1..53: note = hypo
  source 1..53: mol_type = genomic DNA
gcctccctgtctggacgaagcttttgtctggtcaagaacgtcctctttcctca

SEQ ID NO: 73171 - DNA, 87 bp, Homo sapiens; identical to SEQ ID NO: 43128
  misc_feature 1..87: note = chr11:64667987-64668074
  misc_feature 1..87: note = hypo
  source 1..87: mol_type = genomic DNA

SEQ ID NO: 73172 - DNA, 96 bp, Homo sapiens; identical to SEQ ID NO: 43129
  misc_feature 1..96: note = chr11:64669480-64669576
  misc_feature 1..96: note = hypo
  source 1..96: mol_type = genomic DNA

SEQ ID NO: 73173 - DNA, 30 bp, Homo sapiens
  misc_feature 1..30: note = chr11:64733479-64733509
  misc_feature 1..30: note = hypo
  source 1..30: mol_type = genomic DNA
aaatatcctaccaaccgcaggaacccaaaa

SEQ ID NO: 73174 - DNA, 602 bp, Homo sapiens
  misc_feature 1..602: note = chr11:64739234-64739836
  misc_feature 1..602: note = hyper
  source 1..602: mol_type = genomic DNA
ggggggactgcacttcggcggcggagggtggagcccggcccggaaacttccctcagaaataaacagaaacgcaaagacaacttcccgagggcccgggccgtcgtgtgccgttacctcagccccaggtggttcccaggctcggccaggctatgtctcacacactgactaggggtccttcggcctcagaaaagtggccccggacggaatacccactaagaagtgctctctgaaaaaggcgggcgccaacctcgaacgaagtcgttttgagggactggctcgccagctcctaagcaacttcggggctcgtgccgcgcacccaccaggccttctgcgcacgcgcaagtgcgcttcccaccgccccttcgggcgcagctccaaggcctggccgcggtctgcgcgtgcgcatttcattgtcgacaccgagaggacgccttggcgccttcaggtccctcctggatttaccagcccattgtttatttcgcgcctgctttagcgtggtgtcgtcgggaactagcgactgcagagtccttactgtgtgctaggcgttatgcagggtaccttcctttattcctcggcgatatgctctgcggcaggcattaatg

SEQ ID NO: 73175 - DNA, 30 bp, Homo sapiens
  misc_feature 1..30: note = chr11:64766930-64766960
  misc_feature 1..30: note = hypo
  source 1..30: mol_type = genomic DNA
tgccgtattctcacacggtctctctgcctt

SEQ ID NO: 73176 - DNA, 19 bp, Homo sapiens
  misc_feature 1..19: note = chr11:64774608-64774627
  misc_feature 1..19: note = hypo
  source 1..19: mol_type = genomic DNA
gagcacagcagctcacgcc

SEQ ID NO: 73177 - DNA, 30 bp, Homo sapiens
  misc_feature 1..30: note = chr11:64794372-64794402
  misc_feature 1..30: note = hypo
  source 1..30: mol_type = genomic DNA
tggcagcaaacccatcgcaaaaaagctcca

SEQ ID NO: 73178 - DNA, 152 bp, Homo sapiens
  misc_feature 1..152: note = chr11:64809453-64809605
  misc_feature 1..152: note = hypo
  source 1..152: mol_type = genomic DNA
cagcacaagatccaccgagccccgacgtgggacctcgggcccatctctgggtcttagttgtctcaggaataaaagtggagggggcaagggtggaaagggagaattggtctaaatagtgattttcaaacttttttttttttgagtctcgctct

SEQ ID NO: 73179 - DNA, 31 bp, Homo sapiens
  misc_feature 1..31: note = chr11:64809845-64809876
  misc_feature 1..31: note = hypo
  source 1..31: mol_type = genomic DNA
cgtgagccaccgcgcccggctgattttcaaa

SEQ ID NO: 73180 - DNA, 30 bp, Homo sapiens
  misc_feature 1..30: note = chr11:64825805-64825835
  misc_feature 1..30: note = hypo
  source 1..30: mol_type = genomic DNA
cacctgaggttctcccggatcctgtgggca

SEQ ID NO: 73181 - DNA, 337 bp, Homo sapiens
  misc_feature 1..337: note = chr11:64875821-64876158
  misc_feature 1..337: note = hypo
  source 1..337: mol_type = genomic DNA
ctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgag

SEQ ID NO: 73182 - DNA, 96 bp, Homo sapiens
  misc_feature 1..96: note = chr11:64878797-64878893
  misc_feature 1..96: note = hypo
  source 1..96: mol_type = genomic DNA
ggtgtcggtgctgaccggcatcatcaagatcagcctgaagacgctgctggagtgtgtgcggctgcgcacctttgggcgcttcgggctgcagcaggt

SEQ ID NO: 73183 - DNA, 30 bp, Homo sapiens
  misc_feature 1..30: note = chr11:64879104-64879134
  misc_feature 1..30: note = hyper
  source 1..30: mol_type = genomic DNA
cccaggatctggtctcggtggtccttcccc

SEQ ID NO: 73184 - DNA, 200 bp, Homo sapiens
  misc_feature 1..200: note = chr11:64883895-64884095
  misc_feature 1..200: note = hypo
  source 1..200: mol_type = genomic DNA
atgaccagggtaacccgttcagctagggagctcctcaatgagagttcttggggcaggtggcacggggcctccccaaagccgctccagctccccagtgagggcggccacctcctcggctaccacagcatgggcttggtgagccctggcgcagtctagggccaggggtgtgagggccgcctcattttcgttggtccaggcca

SEQ ID NO: 73185 - DNA, 79 bp, Homo sapiens
  misc_feature 1..79: note = chr11:64903249-64903328
  misc_feature 1..79: note = hypo
  source 1..79: mol_type = genomic DNA
cagagttggcttccccgtaaggccacgtataactttttttcccccttttctttttatttatttatttattaatttttgc

SEQ ID NO: 73186 - DNA, 19 bp, Homo sapiens
  misc_feature 1..19: note = chr11:64903448-64903467
  misc_feature 1..19: note = hypo
  source 1..19: mol_type = genomic DNA
caggcgtgagccacaacac

SEQ ID NO: 73187 - DNA, 30 bp, Homo sapiens
  misc_feature 1..30: note = chr11:64937648-64937678
  misc_feature 1..30: note = hypo
  source 1..30: mol_type = genomic DNA
tgctttgggcagggccgccctcaggctata

SEQ ID NO: 73188 - DNA, 135 bp, Homo sapiens
  misc_feature 1..135: note = chr11:64950220-64950355
  misc_feature 1..135: note = hypo
  source 1..135: mol_type = genomic DNA
caagtgcagaagcagcgggccagggagctgggcctgggccgccatgagaatgccatcaagtacctgggccaggattatgagcagctgcgggtgcgatgcctgcagagtgggaccctcttccgtgatgaggccttc

SEQ ID NO: 73189 - DNA, 159 bp, Homo sapiens
  misc_feature 1..159: note = chr11:64951735-64951894
  misc_feature 1..159: note = hypo
  source 1..159: mol_type = genomic DNA
ggtggaggtggccctcggaacccagggtgcggaacccacagtgcggatccactttggcccagcgccacacccacctgctccagtctgcaggggcgcagtctcgcccccttccctcgctcctccaatccgctcctccctggcctccgattggccagttca

SEQ ID NO: 73190 - DNA, 96 bp, Homo sapiens
  misc_feature 1..96: note = chr11:6497213-6497309
  misc_feature 1..96: note = hypo
  source 1..96: mol_type = genomic DNA
tggccaggtctcagctttcaaactgacatccccatttccaccccagtccatgccagatgcccctcctttgtgctcccacagcgccctctgtacttc

SEQ ID NO: 73191 - DNA, 72 bp, Homo sapiens
  misc_feature 1..72: note = chr11:64975460-64975532
  misc_feature 1..72: note = hypo
  source 1..72: mol_type = genomic DNA
ccagctgcctccacacgggcagggccggggcctctcttacctgctttctccccttctcggtccagcaagtgc

SEQ ID NO: 73192 - DNA, 72 bp, Homo sapiens
  misc_feature 1..72: note = chr11:64977462-64977534
  misc_feature 1..72: note = hypo
  source 1..72: mol_type = genomic DNA
gccctcaccctctgccgccacctcagtccatcttccggaagtttgacctggacaagtcgggcagcatgagtg

SEQ ID NO: 73193 - DNA, 144 bp, Homo sapiens
  misc_feature 1..144: note = chr11:65028520-65028664
  misc_feature 1..144: note = hypo
  source 1..144: mol_type = genomic DNA
atgctgggattacaggcgtgagtgaccgcacctggcctgggatggacattttaaaggttcctgatacatattgctaaattgttttctcgaaacgctctataccatcccaccagcattgtatgacgcctacggttgagatttttg

SEQ ID NO: 73194 - DNA, 151 bp, Homo sapiens
  misc_feature 1..151: note = chr11:65091310-65091461
  misc_feature 1..151: note = hypo
  source 1..151: mol_type = genomic DNA
ggttgcagtgtgtgatgaaggaaagaactggggctcgggaagggcgggactgtgaagctggaacacaggctggcggcagcagggaagagtttcgctggccaggctgacgctgaggcgatggggtgctgctgaaggacgtgaaagcagaaga

SEQ ID NO: 73195 - DNA, 205 bp, Homo sapiens
  misc_feature 1..205: note = chr11:65127486-65127691
  misc_feature 1..205: note = hypo
  source 1..205: mol_type = genomic DNA
tctgaaactccttgacgatgagactgttcctgtctgacccttgtcccgtgctgctctgtaaaatggaacgctggggagctggggcctgtttttgccccttgcttgtaggttttagtgaatgaaaagaagcttttgtgttactttcagcttgcttcgttgtcctaattgaccaactccacacctggcagctcgaactaacaactcc

SEQ ID NO: 73196 - DNA, 30 bp, Homo sapiens
  misc_feature 1..30: note = chr11:65168665-65168695
  misc_feature 1..30: note = hypo
  source 1..30: mol_type = genomic DNA
attcacagtcacctgcggtgggcgtggaaa

SEQ ID NO: 73197 - DNA, 30 bp, Homo sapiens
  misc_feature 1..30: note = chr11:65182751-65182781
  misc_feature 1..30: note = hypo
  source 1..30: mol_type = genomic DNA
cctgccagcctggcacgcacagcctggctc

SEQ ID NO: 73198 - DNA, 585 bp, Homo sapiens
  misc_feature 1..585: note = chr11:65185143-65185728
  misc_feature 1..585: note = hyper
  source 1..585: mol_type = genomic DNA
taggaaagctgggctcgcttatttggccaaggagggtggggagggttggaggaggtctaggggccgctggaggtgcagggcagcccggggaggcagggctatggggcccagccacgcattccacaggccttctctctgcgggaacaggagtgaggacacaggcgctcagcgtggcagggtgggaacaggaaggtctcgtgagctctgtgacaggatggggctacaggagacagaggtagcagtgagctggtgaagaggcaggaggaggcaaggaggacagggtgttctagggtgccagctcaggcaaggctccaaggagtgggtgagtgctcaggaggacgggggaccaaggcctggggtaaggggcaggtgcccaggcactctagcatggcacggaacaggggacagtcccaggacatccggatgcagggggctgacaccgcaaagttctttcctgtaaagcacagcccgaggcctggggcttggccctgggcagaggaagccccccttagatctgccttggcagtagtgaggaaagggcgtgcacagaccccacgcagcccgaggtgacgggtcaaatgcaag

SEQ ID NO: 73199 - DNA, 30 bp, Homo sapiens
  misc_feature 1..30: note = chr11:65192943-65192973
  misc_feature 1..30: note = hyper
  source 1..30: mol_type = genomic DNA
cagatcagcatccttcgctgccccttagca

SEQ ID NO: 73200 - DNA, 209 bp, Homo sapiens
  misc_feature 1..209: note = chr11:65197681-65197890
  misc_feature 1..209: note = hyper
  source 1..209: mol_type = genomic DNA
tctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaa

SEQ ID NO: 73201 - DNA, 30 bp, Homo sapiens
  misc_feature 1..30: note = chr11:65259108-65259138
  misc_feature 1..30: note = hypo
  source 1..30: mol_type = genomic DNA
ggccctgtcattctgcgggcttctgtttta

SEQ ID NO: 73202 - DNA, 28 bp, Homo sapiens
  misc_feature 1..28: note = chr11:65276916-65276944
  misc_feature 1..28: note = hypo
  source 1..28: mol_type = genomic DNA
gagccaccgatcccggcccacagttttg

SEQ ID NO: 73203 - DNA, 44 bp, Homo sapiens
  misc_feature 1..44: note = chr11:65306381-65306425
  misc_feature 1..44: note = hypo
  source 1..44: mol_type = genomic DNA
accggggaggggggccggtaggggcgcctcgggtctcaaggcgc

SEQ ID NO: 73204 - DNA, 30 bp, Homo sapiens
  misc_feature 1..30: note = chr11:65306775-65306805
  misc_feature 1..30: note = hypo
  source 1..30: mol_type = genomic DNA
cccacccccgaagcccggctcacccacgca

SEQ ID NO: 73205 - DNA, 203 bp, Homo sapiens
  misc_feature 1..203: note = chr11:65309028-65309231
  misc_feature 1..203: note = hypo
  source 1..203: mol_type = genomic DNA
gggagttgtccagtccgagggaggagctgggaggacactcaccctcacaaccgtgctggtcctgggtgggagtgaagccctcatcgcagacacacacataggagccctgaaggttcttgcaggccccatggggaaggcacaggctcgggtcctggctgcactcatctatgtctgcggggcaagagtagcgcagctggaaaccc

SEQ ID NO: 73206 - DNA, 30 bp, Homo sapiens
  misc_feature 1..30: note = chr11:65360776-65360806
  misc_feature 1..30: note = hypo
  source 1..30: mol_type = genomic DNA
tcacccccttctcaacgctgccaccagagc

SEQ ID NO: 73207 - DNA, 79 bp, Homo sapiens
  misc_feature 1..79: note = chr11:65405437-65405516
  misc_feature 1..79: note = hyper
  source 1..79: mol_type = genomic DNA
agaatgagcactgctcggtgctgacctccgccaggcctggaatccccgctgctgcgcttcccgccgcagacagctcccg

SEQ ID NO: 73208 - DNA, 251 bp, Homo sapiens
  misc_feature 1..251: note = chr11:65413862-65414113
  misc_feature 1..251: note = hypo
  source 1..251: mol_type = genomic DNA
tggtcccaggtctcccgtgggcatggagtcctgccgcccctcactaacgcctccctccccgcagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctg

SEQ ID NO: 73209 - DNA, 30 bp, Homo sapiens; identical to SEQ ID NO: 43146
  misc_feature 1..30: note = chr11:65463016-65463046
  misc_feature 1..30: note = hypo
  source 1..30: mol_type = genomic DNA

SEQ ID NO: 73210 - DNA, 83 bp, Homo sapiens; identical to SEQ ID NO: 43147
  misc_feature 1..83: note = chr11:65478528-65478611
  misc_feature 1..83: note = hypo
  source 1..83: mol_type = genomic DNA

SEQ ID NO: 73211 - DNA, 104 bp, Homo sapiens
  misc_feature 1..104: note = chr11:65511076-65511180
  misc_feature 1..104: note = hypo
  source 1..104: mol_type = genomic DNA
aataagggcactgatctcattcatgacagttccaccctcatgactaatcatctcaccccaagccctatctcctagttccatcgcctttacggttgggatttcaa

SEQ ID NO: 73212 - DNA, 66 bp, Homo sapiens
  misc_feature 1..66: note = chr11:65511418-65511484
  misc_feature 1..66: note = hypo
  source 1..66: mol_type = genomic DNA
ggcccaaggggccagcgggagctgggaacaggtgaaagcctcaccccctgccgagttggcagggca

SEQ ID NO: 73213 - DNA, 154 bp, Homo sapiens; identical to SEQ ID NO: 43150
  misc_feature 1..154: note = chr11:65551581-65551735
  misc_feature 1..154: note = hypo
  source 1..154: mol_type = genomic DNA

SEQ ID NO: 73214 - DNA, 75 bp, Homo sapiens
  misc_feature 1..75: note = chr11:65554042-65554117
  misc_feature 1..75: note = hyper
  source 1..75: mol_type = genomic DNA
ggcggcttcgcgcctccccaggagcctcgggcgcgccgggttgggccggccccagtggggcgagtttcgtgtcat

SEQ ID NO: 73215 - DNA, 86 bp, Homo sapiens
  misc_feature 1..86: note = chr11:65554637-65554723
  misc_feature 1..86: note = hyper
  source 1..86: mol_type = genomic DNA
cgttctcagggaagacggcgacattccgcggaggtggaaccgccgcgcgccgtccgggctcggaccttccccggaacgtgggggcg

SEQ ID NO: 73216 - DNA, 170 bp, Homo sapiens
  misc_feature 1..170: note = chr11:65577359-65577529
  misc_feature 1..170: note = hypo
  source 1..170: mol_type = genomic DNA
gtcctactgtggcctcggggtctggtcattctccgaatggggctgaaggacagcaatagggccagaacggcaatctgggtctgtgcatcatgttctagccaacaaaacatcccaccttggattttattttttaaatctattcaaagcttcggttccgcatccaattccca

SEQ ID NO: 73217 - DNA, 97 bp, Homo sapiens; identical to SEQ ID NO: 33909
  misc_feature 1..97: note = chr11:65600749-65600846
  misc_feature 1..97: note = hyper
  source 1..97: mol_type = genomic DNA

SEQ ID NO: 73218 - DNA, 810 bp, Homo sapiens; identical to SEQ ID NO: 33910
  misc_feature 1..810: note = chr11:65600847-65601657
  misc_feature 1..810: note = hyper
  source 1..810: mol_type = genomic DNA

SEQ ID NO: 73219 - DNA, 137 bp, Homo sapiens
  misc_feature 1..137: note = chr11:65629450-65629587
  misc_feature 1..137: note = hypo
  source 1..137: mol_type = genomic DNA
agctactggccagctcggcactcaggagcccgagtgatactgctggtgctctaccgggagcacctggtgagcactgggctacaccgggaggcggaaccatggcagtggggtgggaggttccccgaggggcctggccc

SEQ ID NO: 73220 - DNA, 99 bp, Homo sapiens
  misc_feature 1..99: note = chr11:65640238-65640337
  misc_feature 1..99: note = hyper
  source 1..99: mol_type = genomic DNA
gcacagctccctggacgcgcggccccaggaagcgccccccgcccgcccgcctgccgcggcgcggcccaccccggcgcctccgcccgcccttcggcggat

SEQ ID NO: 73221 - DNA, 21 bp, Homo sapiens
  misc_feature 1..21: note = chr11:65665095-65665116
  misc_feature 1..21: note = hypo
  source 1..21: mol_type = genomic DNA
ccacagcgcccagcctagtat

SEQ ID NO: 73222 - DNA, 68 bp, Homo sapiens
  misc_feature 1..68: note = chr11:65666703-65666771
  misc_feature 1..68: note = hyper
  source 1..68: mol_type = genomic DNA
agcccaggcaagtcccgacagcggtagcccgagcccaagcgctgcgggcccggcgtcccagtgacccc

SEQ ID NO: 73223 - DNA, 243 bp, Homo sapiens
  misc_feature 1..243: note = chr11:65667149-65667392
  misc_feature 1..243: note = hyper
  source 1..243: mol_type = genomic DNA
ctggactccccaggccgagaaacgatagggacttggcgacggaggggcgaaggacagacagacggacggacacgcggagggtcgcagaccgggccgggactcccaccctggcccagctgctctcccgacggatcccgcctccctcccgtgtggggaccctcaccccagcccagactccagatcccaggaattcagcccgaagcggagagaccctcctagccttcgaggcgaccaccctaggcg

SEQ ID NO: 73224 - DNA, 30 bp, Homo sapiens
  misc_feature 1..30: note = chr11:65677170-65677200
  misc_feature 1..30: note = hypo
  source 1..30: mol_type = genomic DNA
ccaggcgcgtggtggcgggtgcctgtagtt

SEQ ID NO: 73225 - DNA, 212 bp, Homo sapiens
  misc_feature 1..212: note = chr11:65684960-65685172
  misc_feature 1..212: note = hypo
  source 1..212: mol_type = genomic DNA
agcactcgggagccacgggcactacccccaagctggaaacggctctcatagagagtggggcagaggtgccagcgattggcccggtagatgcccaggtaggtgtagacatcaggcttgtaggtgagcaggcacttaatgcccgctgcacggatggctgaatccgcctccagtacacccaagcggtccgtgaagtcgtccgtgtaaacacagat

SEQ ID NO: 73226 - DNA, 30 bp, Homo sapiens
  misc_feature 1..30: note = chr11:65721988-65722018
  misc_feature 1..30: note = hypo
  source 1..30: mol_type = genomic DNA
gactcctaacaggtccgtgaagcagggagt

SEQ ID NO: 73227 - DNA, 36 bp, Homo sapiens
  misc_feature 1..36: note = chr11:65722778-65722814
  misc_feature 1..36: note = hypo
  source 1..36: mol_type = genomic DNA
aaagagttaggtactcggctgtacgccgtggctcac

SEQ ID NO: 73228 - DNA, 30 bp, Homo sapiens; identical to SEQ ID NO: 43154
  misc_feature 1..30: note = chr11:65741409-65741439
  misc_feature 1..30: note = hypo
  source 1..30: mol_type = genomic DNA

SEQ ID NO: 73229 - DNA, 398 bp, Homo sapiens
  misc_feature 1..398: note = chr11:65779206-65779604
  misc_feature 1..398: note = hyper
  source 1..398: mol_type = genomic DNA
tctggacagccctcccgtgaaccgtccctgtactggcacttgttgctggggactgtcgctgtcctctccctccccgggccaggtgtgtcctggagggcagggaagcgtcttggcacgcgggtgcgcgccgccccctcggcctcctgggctccctgaacctcgcaggaccccggcaacttcgagccccgccccagctccaggccgcgggggcgcatcgcgggcgtcgggcggggcggcccagcgggtaaaagctgcgcggccgcaagctcggcactcacggctctgagggctccgacggcactgacggccatggcgcgttcgaacctcccgctggcgctgggcctggccctggtcgcattctgcctcctggcgctgccacgcgacgcccgggcccggcc

SEQ ID NO: 73230 - DNA, 73 bp, Homo sapiens; identical to SEQ ID NO: 985
  misc_feature 1..73: note = chr11:65816447-65816520
  misc_feature 1..73: note = hyper
  source 1..73: mol_type = genomic DNA

SEQ ID NO: 73231 - DNA, 159 bp, Homo sapiens
  misc_feature 1..159: note = chr11:65816560-65816719
  misc_feature 1..159: note = hyper
  source 1..159: mol_type = genomic DNA
cggggtccgagggtgcccggggccctgcgcgccgagtgccggtggcttgcctctcagcgcctggatgggatcaggtggcagcgtccgctaggctcgctcctcccggctctgcccgccccccgccccccgccccccatcgcacaccggaggaaggcgagg

SEQ ID NO: 73232 - DNA, 30 bp, Homo sapiens
  misc_feature 1..30: note = chr11:65901677-65901707
  misc_feature 1..30: note = hypo
  source 1..30: mol_type = genomic DNA
tcagtaacagggactcggtgattaaatttc

SEQ ID NO: 73233 - DNA, 166 bp, Homo sapiens
  misc_feature 1..166: note = chr11:66048056-66048222
  misc_feature 1..166: note = hypo
  source 1..166: mol_type = genomic DNA
ggggattgtttgttccggggggctgagtcagcgccaggcagcctggggggtgggaggggtgacgcccgccgcctgctggtggtgccagctctggggtacagacggcacccttctgctccctgtggaccctgttgctgtgcgtgccaagtggcgctgcccagagtca

SEQ ID NO: 73234 - DNA, 217 bp, Homo sapiens
  misc_feature 1..217: note = chr11:66059146-66059363
  misc_feature 1..217: note = hyper
  source 1..217: mol_type = genomic DNA
gctcaaggtcgcgagcgcgagcgcggccggaggagaacccaggggtccagccgcccagcgggggcttctcggggacgggcggagcgcccgcggtgccaggcgctgccggcggcgccgccggtgccgcgggggcggggtcagcggagggcggggcgcctggcacccgggccgccaacgccgccgccgccgctgccgccgcgctcgggctcgagctccg

SEQ ID NO: 73235 - DNA, 33 bp, Homo sapiens
  misc_feature 1..33: note = chr11:66059580-66059613
  misc_feature 1..33: note = hyper
  source 1..33: mol_type = genomic DNA
gagccgggcctggggcggcgtgagagggaccag

SEQ ID NO: 73236 - DNA, 60 bp, Homo sapiens
  misc_feature 1..60: note = chr11:66101601-66101661
  misc_feature 1..60: note = hypo
  source 1..60: mol_type = genomic DNA
ccgtctgcggcaagccggcgccgcaggcgggctgccaggatgggccggagaggcttgagc

SEQ ID NO: 73237 - DNA, 30 bp, Homo sapiens
  misc_feature 1..30: note = chr11:66114013-66114043
  misc_feature 1..30: note = hypo
  source 1..30: mol_type = genomic DNA
ccttgcctcctgccacgtagaatggctccc

SEQ ID NO: 73238 - DNA, 86 bp, Homo sapiens
  misc_feature 1..86: note = chr11:66147017-66147103
  misc_feature 1..86: note = hypo
  source 1..86: mol_type = genomic DNA
agtacattcttaatgcggtaaaaaaattataatgtgctttaaattttgctcattcattgctatatataagaatatggggcggggcg

SEQ ID NO: 73239 - DNA, 68 bp, Homo sapiens
  misc_feature 1..68: note = chr11:66186333-66186401
  misc_feature 1..68: note = hyper
  source 1..68: mol_type = genomic DNA
actctttcagcaccacggacagcggtcggcgcagtattccttcactgcagattcgctcagattgctgg

SEQ ID NO: 73240 - DNA, 107 bp, Homo sapiens
  misc_feature 1..107: note = chr11:66187360-66187467
  misc_feature 1..107: note = hyper
  source 1..107: mol_type = genomic DNA
gggtcatggagggtccggcgctgccccttcgcttctcagctgctcccccatcttgcccgcctaggcagggcggggagccctccggagcggtgcggaggcagccaggc

SEQ ID NO: 73241 - DNA, 30 bp, Homo sapiens
  misc_feature 1..30: note = chr11:66187796-66187826
  misc_feature 1..30: note = hyper
  source 1..30: mol_type = genomic DNA
tggtccctttcccaccggactccctttcca

SEQ ID NO: 73242 - DNA, 390 bp, Homo sapiens; identical to SEQ ID NO: 33916
  misc_feature 1..390: note = chr11:66188095-66188485
  misc_feature 1..390: note = hyper
  source 1..390: mol_type = genomic DNA

SEQ ID NO: 73243 - DNA, 214 bp, Homo sapiens; identical to SEQ ID NO: 33917
  misc_feature 1..214: note = chr11:66188570-66188784
  misc_feature 1..214: note = hyper
  source 1..214: mol_type = genomic DNA

SEQ ID NO: 73244 - DNA, 297 bp, Homo sapiens
  misc_feature 1..297: note = chr11:66188852-66189149
  misc_feature 1..297: note = hyper
  source 1..297: mol_type = genomic DNA
cgagctgccaggcgccggagaccctggagctgagggaacccgctggggctgtcgcatgtctagggcagcgtgctggcgagctggggagattcgggactcgggagattcgggactttctacttttcctcctgagctccctccagacctcaccttagttctgaatgagagttagagagcctggacggtgtccctaacaccagattatgagaggataagagccaggacagagcggcctcggtgcccgccagtgcagaagcgctccgggagccggggagggaagcccgggaagttgcaggg

SEQ ID NO: 73245 - DNA, 33 bp, Homo sapiens; identical to SEQ ID NO: 43156
  misc_feature 1..33: note = chr11:66324511-66324544
  misc_feature 1..33: note = hypo
  source 1..33: mol_type = genomic DNA

SEQ ID NO: 73246 - DNA, 167 bp, Homo sapiens
  misc_feature 1..167: note = chr11:66325229-66325396
  misc_feature 1..167: note = hypo
  source 1..167: mol_type = genomic DNA
atgagtgccatgcagcgcaaactagaggactttcgggactaccggcgtctgcacaagccgccccgcattcaggaaaagtgccagctggagatcaacttcaacacactgcagaccaagttgcggctcagccaccggcctgccttcatgccctccgagggcaagctggt

SEQ ID NO: 73247 - DNA, 39 bp, Homo sapiens
  misc_feature 1..39: note = chr11:66327260-66327299
  misc_feature 1..39: note = hypo
  source 1..39: mol_type = genomic DNA
ctgcccagagggatgcgctggtaccgcccctcttggaaa

SEQ ID NO: 73248 - DNA, 35 bp, Homo sapiens
  misc_feature 1..35: note = chr11:66332091-66332126
  misc_feature 1..35: note = hypo
  source 1..35: mol_type = genomic DNA
gagggcgggagatcccgtggcggtaaaactggagg

SEQ ID NO: 73249 - DNA, 30 bp, Homo sapiens
  misc_feature 1..30: note = chr11:66346865-66346895
  misc_feature 1..30: note = hyper
  source 1..30: mol_type = genomic DNA
cagatctgggtcctgcgcttcacaccacct

SEQ ID NO: 73250 - DNA, 33 bp, Homo sapiens
  misc_feature 1..33: note = chr11:66347133-66347166
  misc_feature 1..33: note = hypo
  source 1..33: mol_type = genomic DNA
ccccattcccgtagccgccgcttatgaccaagc

SEQ ID NO: 73251 - DNA, 30 bp, Homo sapiens
  misc_feature 1..30: note = chr11:66410982-66411012
  misc_feature 1..30: note = hypo
  source 1..30: mol_type = genomic DNA
cagagcggctgctatcggtgcgggaaagag

SEQ ID NO: 73252 - DNA, 189 bp, Homo sapiens; identical to SEQ ID NO: 43158
  misc_feature 1..189: note = chr11:66411368-66411557
  misc_feature 1..189: note = hypo
  source 1..189: mol_type = genomic DNA

SEQ ID NO: 73253 - DNA, 30 bp, Homo sapiens
  misc_feature 1..30: note = chr11:66454424-66454454
  misc_feature 1..30: note = hypo
  source 1..30: mol_type = genomic DNA
actctcctcccatcccgagagcactgttcc

SEQ ID NO: 73254 - DNA, 51 bp, Homo sapiens
  misc_feature 1..51: note = chr11:66494819-66494870
  misc_feature 1..51: note = hyper
  source 1..51: mol_type = genomic DNA
gagggggagggcagacgacatgtagcaggttaagaccggggcaaacctgca

SEQ ID NO: 73255 - DNA, 156 bp, Homo sapiens; identical to SEQ ID NO: 43159
  misc_feature 1..156: note = chr11:66511194-66511350
  misc_feature 1..156: note = hypo
  source 1..156: mol_type = genomic DNA

SEQ ID NO: 73256 - DNA, 94 bp, Homo sapiens; identical to SEQ ID NO: 43160
  misc_feature 1..94: note = chr11:66513159-66513253
  misc_feature 1..94: note = hypo
  source 1..94: mol_type = genomic DNA

SEQ ID NO: 73257 - DNA, 93 bp, Homo sapiens; identical to SEQ ID NO: 43161
  misc_feature 1..93: note = chr11:66513553-66513646
  misc_feature 1..93: note = hypo
  source 1..93: mol_type = genomic DNA

SEQ ID NO: 73258 - DNA, 16 bp, Homo sapiens
  misc_feature 1..16: note = chr11:66515380-66515396
  misc_feature 1..16: note = hypo
  source 1..16: mol_type = genomic DNA
gcgcagggcagcatta

SEQ ID NO: 73259 - DNA, 82 bp, Homo sapiens; identical to SEQ ID NO: 43163
  misc_feature 1..82: note = chr11:66557367-66557449
  misc_feature 1..82: note = hypo
  source 1..82: mol_type = genomic DNA

SEQ ID NO: 73260 - DNA, 1097 bp, Homo sapiens
  misc_feature 1..1097: note = chr11:66625090-66626187
  misc_feature 1..1097: note = hypo
  source 1..1097: mol_type = genomic DNA
gacccagcccctccccgggccaggctcacagaagctggcttctgggactgtcctgggcccaagtgggcacctgcgccagccccacctgtgcctgggctgtggccccttcctacagggcgctcaccatggccccgccgctcctgctgctgctgctggccagtggagcggccgcctgcccgctgccctgcgtctgccagaacctgtccgagtcgctcagcaccctctgtgcccaccgaggcctgctgtttgtgccgcccaacgtggaccggcgcacagtggagctgcggctggctgacaacttcatccaggccctggggccccctgacttccgcaacatgacgggactggtggacctgacactgtctcgcaatgccatcacccgcattggggcccgcgcctttggggacctcgagagcctgcgttccctccaccttgacggcaacaggctggtggagctgggcaccgggagcctccggggccccgtcaatctgcagcacctcatcctcagcggcaaccagctgggccgcatcgcgccgggagccttcgacgacttcctagagagcctggaggacctggacctgtcctacaacaacctccggcaggtgccctgggccggcatcggcgccatgcctgccctgcacaccctcaacctggaccataaccttattgacgcactgcccccaggcgccttcgcccagctcggtcagctctcccgcctggacctcacctccaaccgcctggccacgctggctccggacccgcttttctctcgtgggcgtgatgcagaggcctctcccgcccccctggtgctgagctttagcgggaaccccctgcactgcaactgtgagctgctgtggctgcggcggctggcgcggccggacgacctggaaacgtgcgcctccccgcccggcctggccggccgctacttctgggcagtgcccgagggcgagttctcctgtgagccgcccctcattgcccgccacacgcagcgcctctgggtgctggaaggccagcgggccacgctgcggtgccgggccctgggtgaccccgcgcctaccatgcactgggtcggtcctgacgaccggttggttggcaac

SEQ ID NO: 73261 - DNA, 410 bp, Homo sapiens
  misc_feature 1..410: note = chr11:66626525-66626935
  misc_feature 1..410: note = hypo
  source 1..410: mol_type = genomic DNA
ccagtacaacagcagcgaagatgagaccctcatctaccggtgaggatgcgtgccccacacccggctgcactcccggcgcccttcctccgccctctgctccccacaaggctttgcttccacccctcctctctctggggctgacaccccctccccgaccatggctgctggactcttggaggagcagtggcctggcctggcctggctgcctgagggggctggagctcaaggggcggcagaaggaccccaccccgagatgtcccaggtgtcactgagctgtgcaggcctccccggcagcaggtggcggttgggtctgtctgaagcacatggcccgcgcccgcgtgttatttctgcctctgctggtgccatccccccaccccattcccctcgcttgcctgcgtcctgtgccagtg

SEQ ID NO: 73262 - DNA, 79 bp, Homo sapiens
  misc_feature 1..79: note = chr11:66627238-66627317
  misc_feature 1..79: note = hypo
  source 1..79: mol_type = genomic DNA
gtgcccatttctccacgctgccggcctcgcccctgtgccacgccctgcaggcccacgtgctgggcgggaccctgaccgt

SEQ ID NO: 73263 - DNA, 573 bp, Homo sapiens
  misc_feature 1..573: note = chr11:66631279-66631852
  misc_feature 1..573: note = hypo
  source 1..573: mol_type = genomic DNA
tgctcatcttggtggcggccgtggggtggtctttgccgtgggcaatgactttgaccagcagggagtcgtagtggggcgagatgacggctccttggaaggcggaagcattatccaggcggatgcccatgccctctccgctccggaacacctgtgggaagggtgaggcgtgaggacctgcgccagaaactgcggtcaaaagtgccccacccaccccgaggctggccaggtgtgcacccagcagctgctgagagcagagcgtggggtgtctgcaggtgaatcccagctctggctggtcaggttttgctgtttctgccaccaaacccaggagtgcgtcccttctctacgtgccacgcagtcactgctactggctccctgtgaggagctgggagggggcagaggaggaagggaatgcctgccgcagagcgggagaggggcccgggcaggcaggggccagccctgcctctattcccacggacctgctgcacctgcctgagcaaccctctagcctttcagactcatccacgttcgttccacagcacggattgaggtctgctgacccggccgctaaagggc

SEQ ID NO: 73264 - DNA, 94 bp, Homo sapiens
  misc_feature 1..94: note = chr11:66633739-66633833
  misc_feature 1..94: note = hypo
  source 1..94: mol_type = genomic DNA
cggatgttctcctgccgcaggcccaggtcgggtaggctcctgccctcagccacgtggatctgagcatggaccaggtctacgctgtagggcattg

SEQ ID NO: 73265 - DNA, 143 bp, Homo sapiens
  misc_feature 1..143: note = chr11:66637063-66637206
  misc_feature 1..143: note = hypo
  source 1..143: mol_type = genomic DNA
ccctggtcgatgcctcgcattagctgtggctgaggccttgctgcagagtgcacaccccggccttcggcatggggaggtgacgcatcctctgctgcctataggccagggaagaagagggggcaggaccccgctgcacacctggc

SEQ ID NO: 73266 - DNA, 144 bp, Homo sapiens
  misc_feature 1..144: note = chr11:66648961-66649105
  misc_feature 1..144: note = hypo
  source 1..144: mol_type = genomic DNA
tcaggaaggcacctacgacgacctgcaggctgaggcagggcgagggcctggccgtcacctgccccgctcctgacagagctgccgcttccatagcacacaacacatactcactgagctccacctggtgcccggccagtgccagtg

SEQ ID NO: 73267 - DNA, 30 bp, Homo sapiens
  misc_feature 1..30: note = chr11:66658260-66658290
  misc_feature 1..30: note = hypo
  source 1..30: mol_type = genomic DNA
ccacctcccccgccgcggttgtttccaatt

SEQ ID NO: 73268 - DNA, 78 bp, Homo sapiens
  misc_feature 1..78: note = chr11:66683635-66683713
  misc_feature 1..78: note = hypo
  source 1..78: mol_type = genomic DNA
tggtctttcccttagcgtaggtcaggccaggcccacagctgtagacagcaagcctgtcctgctcgttgccaagcagtt

SEQ ID NO: 73269 - DNA, 17 bp, Homo sapiens
  misc_feature 1..17: note = chr11:66683833-66683850
  misc_feature 1..17: note = hypo
  source 1..17: mol_type = genomic DNA
ggcgtgagccactgtga

SEQ ID NO: 73270 - DNA, 408 bp, Homo sapiens
  misc_feature 1..408: note = chr11:66725945-66726353
  misc_feature 1..408: note = hyper
  source 1..408: mol_type = genomic DNA
ttgggcagtgttctccgtcactcctcgcccctaggctctggactcctccctgtgcccgcctgtccgtcacgtttaagccttggcgccccacgtcagccccgcccctcccgtccccggcgagcgcctggataagtggcgaggctgggagagcccgcccctggcgcaccaccgcctactcccttgtctccggagcctcacgtgggccgccggaccctagccgacgcccgcaataggcggaagtggccgggctgtggctcgcagttattggctgtcggcgggggtggggacgttcgattcattcacccgagtagcacgtgtctcccgaagctgcaagcacaacagttcgcactggggctcaggcatcccggctagacgcagatacgcgctggctagcggagaagaggtcgc

SEQ ID NO: 73271 - DNA, 102 bp, Homo sapiens
  misc_feature 1..102: note = chr11:6676451-6676553
  misc_feature 1..102: note = hyper
  source 1..102: mol_type = genomic DNA
acacagccagagagacgcccagggacacacaacctcccagtgacacgcactgacacactccgacgatgcactggaacacaacgctgtcgcaccccacacccc

SEQ ID NO: 73272 - DNA, 341 bp, Homo sapiens
  misc_feature 1..341: note = chr11:6676627-6676968
  misc_feature 1..341: note = hyper
  source 1..341: mol_type = genomic DNA
cgctcacgttcacgcccgcccgggtcccgcaggcccaggccccccctcccccattgtctccggctcagaacaaagcccccggctccgccgccgctgccgcagcccaggggaggccggcgggcagggcgggcgcggccagacgggccgggcgggcgcgggcactgacctccgcgcgacgcgggctccctcgcccggtgctggggcgccgtccggccgcggtcagccccccgggcagcgcccgctcgcgcggggcctgaggccgcgcatcgtccgcagtcgctgtctccgaggcccgcgatcccctccgggcagccgccgtcggtccgcgcgcccttggccgt

SEQ ID NO: 73273 - DNA, 133 bp, Homo sapiens
  misc_feature 1..133: note = chr11:6677213-6677346
  misc_feature 1..133: note = hyper
  source 1..133: mol_type = genomic DNA
cccaggccccggctccggatccggccccagcgccgcgccgcgcccccgtcccggttcccttcccttctccccgtcacttctcccgtcctctcctcccattcggttctctacgccctctcgtctcttccccttc

SEQ ID NO: 73274 - DNA, 590 bp, Homo sapiens
  misc_feature 1..590: note = chr11:66790528-66791118
  misc_feature 1..590: note = hyper
  source 1..590: mol_type = genomic DNA
acccctgtccccaggcgtgggagcgaggggttgggcttggcctcagggcgtccctggatcccggacgcgcttggggatctccggctcggaccccaggagcagagacagcgctcgagcttgtcactttaaattcaagagggagcgggcgggcaagcgggcgagcgcgagggagcgcgcggcgggctcctgggagcgtgcccggactgcggcgcagctccggtccgccgccccggcccggccgagcccccggcccgcgccgcgctcctcggaggcgggagcccggcgacactgcaggggtggcgttgccgccggcggccgggctaggcgcaggtgcgtgcgcgctgcgggaggcgggccggcagctggagcccagccggagcggcggcccctccgcggagcccgggtgagtacgcaccccgccgacccccgtgcgcggccgggatcgcaccctgatcgcggacgcacgcagccccctcctcgggccctgggcccgggaccccagagccccgcgcactccgcgctcctgcacctccgcgccgcgcttgcacacgaacgaatgccgggcaccgcgcacgctgggcgcccttacc

SEQ ID NO: 73275 - DNA, 260 bp, Homo sapiens
  misc_feature 1..260: note = chr11:66791246-66791506
  misc_feature 1..260: note = hyper
  source 1..260: mol_type = genomic DNA
cgccctgactgtcctcactgtccctgctctggcttcgcaccccctcccgacactccggtccccatacaccctggaggttcccgaggcaggagcgctgggtctgcaggaaccgtcccaatctggaggggaacgttgcaccccagcccgaggaggccctggccgtgtgaagagccagatatgaccctcagccgccggtggcaccagcctgagtggggggctttccagagcttaggagaggggtatggcggggcaggggagga

SEQ ID NO: 73276 - DNA, 241 bp, Homo sapiens
  misc_feature 1..241: note = chr11:66824362-66824603
  misc_feature 1..241: note = hyper
  source 1..241: mol_type = genomic DNA
ccggccccgggatgacggcggcccaggccgcgggtgaggaggcgccaccaggcgtgcggtccgtcaaggtggtcctggtgggcgacggcggctgcgggaagacgtcgctgctgatggtcttcgccgatggggccttccccgaggtgagtgccccgcgcctccgcctcgcccggttccgctcgcgcgcccgggtgtacaggtccgtgccggagcggcccaggctgtgcgcctaacccggcct

SEQ ID NO: 73277 - DNA, 180 bp, Homo sapiens
  misc_feature 1..180: note = chr11:66897583-66897763
  misc_feature 1..180: note = hypo
  source 1..180: mol_type = genomic DNA
ccaccccacctggctaatttttttttttttcttgcaccaaagctttctaaagttagtgatttatttctgacaagtttgcaaaacccaagagagagcagttttctgggttgaactcatacttcgtgtttactcgagtctgagtcacggcacctgacttcctcacaggtgcacctgactgct

SEQ ID NO: 73278 - DNA, 42 bp, Homo sapiens
  misc_feature 1..42: note = chr11:66897883-66897925
  misc_feature 1..42: note = hypo
  source 1..42: mol_type = genomic DNA
gggattacaggcgtgagccaccatgcccggccttaagctctc

SEQ ID NO: 73279 - DNA, 295 bp, Homo sapiens; identical to SEQ ID NO: 43169
  misc_feature 1..295: note = chr11:67072101-67072396
  misc_feature 1..295: note = hypo
  source 1..295: mol_type = genomic DNA

SEQ ID NO: 73280 - DNA, 183 bp, Homo sapiens
  misc_feature 1..183: note = chr11:67179695-67179878
  misc_feature 1..183: note = hypo
  source 1..183: mol_type = genomic DNA
gtgcctgccatggatcggcggggaggacccacggtctccatcttgccctgccacccacttgaggttccctgaattcccacactgttccaggctcccagaggggtcagacttggactcacctgcatgggaaaggccctttcttctcctctgagcctcagtattctcctgcggataatgggatta

SEQ ID NO: 73281 - DNA, 264 bp, Homo sapiens
  misc_feature 1..264: note = chr11:67209957-67210221
  misc_feature 1..264: note = hypo
  source 1..264: mol_type = genomic DNA
ggaacttggggttgacggcgcagaaggtgctgtcccaggtaacacgggacacgcgaatgtcctcatagcactggtcgttcttgaccggctgcccgaacacatgccggaatttgctctgccggaccactttgcggaaggacatgtctgcgggacagagaggcctgggtcagtccggcccatcccaacaactccagccctccccaggctgctgaaggtgagccgggaggatgcaaccgggggccaggccaccgtaaccctcctggg

SEQ ID NO: 73282 - DNA, 217 bp, Homo sapiens
  misc_feature 1..217: note = chr11:67230800-67231017
  misc_feature 1..217: note = hypo
  source 1..217: mol_type = genomic DNA
agcctcttggttggccggtaggggagaccagctcagtgccggtttccttctccctccccgacagtgtcatgggaagagccctgggctacgttcctaattctacctaccacctgctggctgtccttgggtgagtcagtccttatctgtaaaatgggacggaggtagtgaagattacaagatataacccgtgttcagtgcttagcgcagggcctagtat

SEQ ID NO: 73283 - DNA, 206 bp, Homo sapiens
  misc_feature 1..206: note = chr11:67232077-67232283
  misc_feature 1..206: note = hyper
  source 1..206: mol_type = genomic DNA
gccgcgatcacttctcgaagtagggcaggtagaagaactggaagccccggtggcccttgaccgcgcagtagatgaagatcacgtgatagactgcggggcggggcctgtcagcgcagaagccccgcccctccccgcaacaccgcccccagtgccgccccacagcccccgccccttccgccccggtgcccgctcgcacctccaggcac

SEQ ID NO: 73284 - DNA, 36 bp, Homo sapiens
  misc_feature 1..36: note = chr11:67258422-67258458
  misc_feature 1..36: note = hypo
  source 1..36: mol_type = genomic DNA
gaagaggacaaagcccggttccgggggatcttctcc

SEQ ID NO: 73285 - DNA, 30 bp, Homo sapiens
  misc_feature 1..30: note = chr11:67291596-67291626
  misc_feature 1..30: note = hypo
  source 1..30: mol_type = genomic DNA
cctgggtctgtcctccggggcccccagttg

SEQ ID NO: 73286 - DNA, 199 bp, Homo sapiens
  misc_feature 1..199: note = chr11:6731043-6731242
  misc_feature 1..199: note = hypo
  source 1..199: mol_type = genomic DNA
actcctgaggtctctcgccccagtgccacccaacccactgacactaatcctctccaatcctaaccccaccttgatggcagcgctactctctccacttctatcacagaaatccccatctctacacaggcatctttgctttatcccaatttacctttttcccatcttttgtgtgatttcttgagaacggcctctgaatctc

SEQ ID NO: 73287 - DNA, 30 bp, Homo sapiens
  misc_feature 1..30: note = chr11:67378945-67378975
  misc_feature 1..30: note = hypo
  source 1..30: mol_type = genomic DNA
agtctgtgtgtgagacggtgctgatggact

SEQ ID NO: 73288 - DNA, 155 bp, Homo sapiens
  misc_feature 1..155: note = chr11:67402314-67402469
  misc_feature 1..155: note = hypo
  source 1..155: mol_type = genomic DNA
agtccatgagcagggcgtagtcggccagggagtccatgcccaggatcttcacctggaagggggggaacatcctcctgcgggagggaggtgctcagcagccggatgcggctccaaccctggcccctgcctcaccccgcccccgctgctcacacctg

SEQ ID NO: 73289 - DNA, 32 bp, Homo sapiens
  misc_feature 1..32: note = chr11:67408869-67408901
  misc_feature 1..32: note = hypo
  source 1..32: mol_type = genomic DNA
acttaccacacagcacgcgcacagacacaggc

SEQ ID NO: 73290 - DNA, 128 bp, Homo sapiens
  misc_feature 1..128: note = chr11:67442012-67442140
  misc_feature 1..128: note = hypo
  source 1..128: mol_type = genomic DNA
ctgctctgctgactgcgatcctcccaggagactggcagctcccaaaccaactcccgtgcccacgcctggcaatggggtaatcaatggggtgatgctcagtgttacccaacaggcgtggggcagggctg

SEQ ID NO: 73291 - DNA, 215 bp, Homo sapiens
  misc_feature 1..215: note = chr11:67462618-67462833
  misc_feature 1..215: note = hypo
  source 1..215: mol_type = genomic DNA
ccccaaggcaagatccgccttaagccgtatgaggtagccacggaaccgcaggcaagactcactcgctcggtccagcagtaggacttatcatgatttacacaagcaacaccagctgcagtgaggcttgtgactattcacacacacttttaacctccagaatatcccgaccaccaagcaagtactttgtcgcacccttgcgacgtttctttactttg

SEQ ID NO: 73292 - DNA, 491 bp, Homo sapiens
  misc_feature 1..491: note = chr11:67478792-67479283
  misc_feature 1..491: note = hyper
  source 1..491: mol_type = genomic DNA
ataggaggtgcaaagcgcggtcacacgcggcccgggtccgcggccgacagctgggaggatctggagcggggccgggtcgcaagaagaccctgaccctgctcccgcgctggggcgcgtgctaagggcccgcagggtttcagctgtattttcgaacccctgtgcttggccgaggggttcccaaggctccactccgccttggagggggctgcggaagcccggaggtgacccgggctctgggaggggcgtccccaatgtgggggaggggagacaggggcctttgaatacagcgcgggactcagagggggtccccccgacctaagacgtggtaaactgaggccggcgaggagggaggctgagtccggggaccaggcggcccctcactgctcctccggtccgtctcccctctgcgcctgttcgtacgggcagggccggcggccgagtccagcgggctcggggccaggcctgggccccgcgggcggcgcctcctcctc

SEQ ID NO: 73293 - DNA, 24 bp, Homo sapiens
  misc_feature 1..24: note = chr11:67479341-67479365
  misc_feature 1..24: note = hyper
  source 1..24: mol_type = genomic DNA
cggtaaccgcgcaccttgtgctgg

SEQ ID NO: 73294 - DNA, 232 bp, Homo sapiens
  misc_feature 1..232: note = chr11:67764062-67764294
  misc_feature 1..232: note = hypo
  source 1..232: mol_type = genomic DNA
ctgtacttaccaaggcgataccagtgcaggcaaagagcacctcgaagccgctgtagataaagaaaggcacgaggtggcgcaggcggtagtcacgcacgtgcttgaagggcagctggaagatgttgccccagcccacgctgcgcagatcgatctcctccgtgggccggtaagcggctccgcacaaacccagcacctgcgaacccattacttgaaggggcggccagccaggccc

SEQ ID NO: 73295 - DNA, 147 bp, Homo sapiens; identical to SEQ ID NO: 15585
  misc_feature 1..147: note = chr11:67781462-67781609
  misc_feature 1..147: note = hypo
  source 1..147: mol_type = genomic DNA

SEQ ID NO: 73296 - DNA, 146 bp, Homo sapiens
  misc_feature 1..146: note = chr11:67797137-67797283
  misc_feature 1..146: note = hypo
  source 1..146: mol_type = genomic DNA
tgtcctccctctgcacgggcatgggacatgccctctgcctccttcctgtcctggcctgcccaactcctacctaccctcagcgcagatcctcccaacacacacatgcaggcagcctcggggcctctgcgggtccctctaccacagca

SEQ ID NO: 73297 - DNA, 154 bp, Homo sapiens
  misc_feature 1..154: note = chr11:67811705-67811859
  misc_feature 1..154: note = hypo
  source 1..154: mol_type = genomic DNA
cctgaaccagtgcagcgtgagcaccacgcacaagtgcctcattgccgaggcctggtgctctgtgcgagacctgcccgccctgcaggaggccctgcgggacagctcggtgagcagcctgaggcctcgccccctctccgcccgcccctcctaccag

SEQ ID NO: 73298 - DNA, 23 bp, Homo sapiens
  misc_feature 1..23: note = chr11:67865088-67865111
  misc_feature 1..23: note = hypo
  source 1..23: mol_type = genomic DNA
caagactccgtctcaaaaaaaaa

SEQ ID NO: 73299 - DNA, 405 bp, Homo sapiens
  misc_feature 1..405: note = chr11:67895795-67896200
  misc_feature 1..405: note = hyper
  source 1..405: mol_type = genomic DNA
accctcctcccccagcgctactgcccgggccgaattccaaggccagcggctgcccgctgagaaggaatccggaccaacgggattctggcttccctctggcccctcctggcgagagcggcgccgggaggagggggcctcagaaggggcgggcaggggcggggcccgcggggtaggcggagctcccaggaaaacagcgggcggggcctcgcgcgaggggcggggttggcggcgaggcgtcccaggacccccattcctccctccgccccggggcttctggggagcggcgcagcttgactgccaccgactgcgggcctccctgccctacaagcccccacccccgcccccccttgggacctggcgaggagttgccccgcaaagttggggctggtgcggggttaaggggat

SEQ ID NO: 73300 - DNA, 187 bp, Homo sapiens
  misc_feature 1..187: note = chr11:67915941-67916128
  misc_feature 1..187: note = hypo
  source 1..187: mol_type = genomic DNA
ttttgagtgaccagccgttattcggcactcaaatagggaaggctgtcaggggagcagctgactgcagagagactgccttggaaggaggagaggcccgggggtggagcggaggtttcgggtaaacagaggcggcctgactgacagaggggcatcagccaggggaaaatagaaccgggatccaggatcg

SEQ ID NO: 73301 - DNA, 68 bp, Homo sapiens
  misc_feature 1..68: note = chr11:67984320-67984388
  misc_feature 1..68: note = hypo
  source 1..68: mol_type = genomic DNA
ggagggagagtggggcgtacccggctttcccagtggcccctctgggcggctggcgggtttcctggtca

SEQ ID NO: 73302 - DNA, 45 bp, Homo sapiens
  misc_feature 1..45: note = chr11:68096122-68096167
  misc_feature 1..45: note = hyper
  source 1..45: mol_type = genomic DNA
atggctcaggggcaccgcagtctgcacctccgtccctggatccgt

SEQ ID NO: 73303 - DNA, 154 bp, Homo sapiens; identical to SEQ ID NO: 15587
  misc_feature 1..154: note = chr11:68111091-68111245
  misc_feature 1..154: note = hypo
  source 1..154: mol_type = genomic DNA

SEQ ID NO: 73304 - DNA, 236 bp, Homo sapiens
  misc_feature 1..236: note = chr11:68132977-68133213
  misc_feature 1..236: note = hypo
  source 1..236: mol_type = genomic DNA
ttcagaaacaagtgacggtcctcttctggaaccttctctcactctgtcctggttttctcagtccacactcgctgtgaggaggacaatggcggctgctcccacctgtgcctgctgtccccaagcgagcctttctacacatgcgcctgccccacgggtgtgcagctgcaggacaacggcaggacgtgtaaggcaggtgaggcggtgggacgggacggggcgggcgggcggggcggggc

SEQ ID NO: 73305 - DNA, 30 bp, Homo sapiens
  misc_feature 1..30: note = chr11:68133516-68133546
  misc_feature 1..30: note = hypo
  source 1..30: mol_type = genomic DNA
ttccaggtgtcggttcggggcgggcccttc

SEQ ID NO: 73306 - DNA, 81 bp, Homo sapiens
  misc_feature 1..81: note = chr11:68210051-68210132
  misc_feature 1..81: note = hypo
  source 1..81: mol_type = genomic DNA
gtgttttcgtaagcccgaaagatagcatctgaagagtcaacattgagccttgccttttgctgctaacgatgtataaaagct

SEQ ID NO: 73307 - DNA, 76 bp, Homo sapiens
  misc_feature 1..76: note = chr11:68225302-68225378
  misc_feature 1..76: note = hypo
  source 1..76: mol_type = genomic DNA
ggtgctccctgctctcgcttccagccatcttctctagagtatggccagcccttcttctgcccggaagctttccttg

SEQ ID NO: 73308 - DNA, 42 bp, Homo sapiens
  misc_feature 1..42: note = chr11:68226707-68226749
  misc_feature 1..42: note = hypo
  source 1..42: mol_type = genomic DNA
gtgctgggattacaggcgtgaccgcgccgtgacctcctgtgg

SEQ ID NO: 73309 - DNA, 82 bp, Homo sapiens; identical to SEQ ID NO: 43183
  misc_feature 1..82: note = chr11:68385159-68385241
  misc_feature 1..82: note = hypo
  source 1..82: mol_type = genomic DNA

SEQ ID NO: 73310 - DNA, 201 bp, Homo sapiens
  misc_feature 1..201: note = chr11:68385532-68385733
  misc_feature 1..201: note = hypo
  source 1..201: mol_type = genomic DNA
ctgcctttcctaccccgccaaggaggagagaccgaggagcagggcatgctctgggctccagcctggatttgcccgcccatggagaggacacgttccggatcgtcctcttccacacagtagactctgtcctgccgaagggagaagtctgcatccctgggttagacacgtctcatggagtcctctgcccgtgaccaggggggg

SEQ ID NO: 73311 - DNA, 30 bp, Homo sapiens
  misc_feature 1..30: note = chr11:68400244-68400274
  misc_feature 1..30: note = hypo
  source 1..30: mol_type = genomic DNA
cttcacacggatgcacgtgaaatttaccac

SEQ ID NO: 73312 - DNA, 30 bp, Homo sapiens
  misc_feature 1..30: note = chr11:68409085-68409115
  misc_feature 1..30: note = hypo
  source 1..30: mol_type = genomic DNA
caggagacagctgagcgccagggcaattta

SEQ ID NO: 73313 - DNA, 38 bp, Homo sapiens
  misc_feature 1..38: note = chr11:68409607-68409645
  misc_feature 1..38: note = hypo
  source 1..38: mol_type = genomic DNA
gacccttctccccaacgaagcttcgcactgccaacgcc

SEQ ID NO: 73314 - DNA, 30 bp, Homo sapiens; identical to SEQ ID NO: 43185
  misc_feature 1..30: note = chr11:68412854-68412884
  misc_feature 1..30: note = hypo
  source 1..30: mol_type = genomic DNA

SEQ ID NO: 73315 - DNA, 197 bp, Homo sapiens
  misc_feature 1..197: note = chr11:68417837-68418034
  misc_feature 1..197: note = hypo
  source 1..197: mol_type = genomic DNA
aggccctggggacatcgtggccctggggacatcatggtccctgcctccatggagctgacgctctagaggagccggacacaaaaggcaaaatgaaagcacgcgagcttcatcatcagccagactacaggcttaaaagagcgttggcgccacaactaaaattcaactggcggtgggcgcggtggctcacacctgtaatc

SEQ ID NO: 73316 - DNA, 41 bp, Homo sapiens
  misc_feature 1..41: note = chr11:68418419-68418460
  misc_feature 1..41: note = hypo
  source 1..41: mol_type = genomic DNA
tccctgtccccctcccgaaggcagcccggccgagggcaagg

SEQ ID NO: 73317 - DNA, 242 bp, Homo sapiens; identical to SEQ ID NO: 43187
  misc_feature 1..242: note = chr11:68432989-68433231
  misc_feature 1..242: note = hypo
  source 1..242: mol_type = genomic DNA

SEQ ID NO: 73318 - DNA, 456 bp, Homo sapiens
  misc_feature 1..456: note = chr11:68437415-68437871
  misc_feature 1..456: note = hypo
  source 1..456: mol_type = genomic DNA
ttctagaacaaggttcgaactctgttcctgcaggtggcctgaccgcccccaaaaggccttcccacctgggggctgtggacagtggaaggcgagcgtcctcctggaaggttttcaggcacaagggggaccaaattgtggacacgcgtgaacaggtcctgggagtgagcaagaacccctgaggcccctcccaggaagaggttcagcaggggacagcatagccagaccgtccacagtctcggcggaccaaggccacgccacagacgctccaccccaggtggagaagaggcggctggcaggagtcctttctccgggggcccccccgggcacttcacagctcccccgcacgctagagctgcacgttagagctgggccaccggcctcgagtttcctttcatccccacagaaccagctctcgaggggccctgggcgtggggaccaccccgccctgcctcttgc

SEQ ID NO: 73319 - DNA, 878 bp, Homo sapiens
  misc_feature 1..878: note = chr11:68451662-68452540
  misc_feature 1..878: note = hyper
  source 1..878: mol_type = genomic DNA
ctggggctgggaccccggggggagcagtggggttgacgccacagcgatgacttgggccacgggtctgggggctctcccgcggggcgattgggctctgtctttcgggattagggtctctcccacagggtttggggttctctctgcagatttgggggagtctctcccgcgggatgagggggggctctccgccgcacccgcctatgatggcccagaggacccgagctcgggtcactcccgtcgccctcggggctcggcgagggtgcaggaggcgggcgctgagccggtgacgcgactccgggcggctcccgggtgcgccgcatatatagcagcggcggcggtggcggcggccacaccgggcggcggacacgtggagggacccggcccgcgccttctgcccctgctgccggccgcgccatgcggtgagcgccccaggccgccagagcccacccgacccggcccgacgcccggacctgccgcccagacccgccaccgcacccggaccccgacgctccgaacccgggcgcagccgcagctcaaggtactactggcgccgggccgaccctgcgcccccgggaggcctccccttcggctttcctctgcccagggacggttctgccagggccctggcccggccgccgcctctgctcctccccgcagccccggcactccttgcctcggggcgcagcccactccgggttccgacccgcccgccctgtccttcccttccagatggcccgaggcagcgccctcctgctcgcctccctcctcctcgccgcggccctttctgcctctgcggggctctggtcgccggtaagtgcggggcgcgtctcctccgagcgaaggggacatcagagccggccgggcgtggagggcttcct

SEQ ID NO: 73320 - DNA, 319 bp, Homo sapiens
  misc_feature 1..319: note = chr11:68460889-68461208
  misc_feature 1..319: note = hypo
  source 1..319: mol_type = genomic DNA
gcactgcacatggctcgcacgagcctcctgagcagtgttcaaaaagggccaaggagcccagcctccatgcaggtgtgcggcctctgtgcaggggtgcggcctccatgcaggtgtgcagcctccgtgcaggtgtgggacttctgtgcaggggtgcgggccccagggtcagcagcacaaaggtgtcggactctccccctgtggcatcatctacctccttgtctaaaccttgccttccttttaggtataaacggagtgtggcaggtggcagccagaaggtgagggaaaggaagtgaggggccaggagcggctgtggtgccat

SEQ ID NO: 73321 - DNA, 36 bp, Homo sapiens
  misc_feature 1..36: note = chr11:68564345-68564381
  misc_feature 1..36: note = hypo
  source 1..36: mol_type = genomic DNA
accatgagcggccctcgtcctcggaggtagatgtac

SEQ ID NO: 73322 - DNA, 153 bp, Homo sapiens
  misc_feature 1..153: note = chr11:68607258-68607411
  misc_feature 1..153: note = hyper
  source 1..153: mol_type = genomic DNA
gaggcccaacttgaccgctcggtgaccactggtccggggccggggccaaacgcagcagccgcagcagtatcggaagggacccagtttaattctcttcccctccagggtaggcggcttgtttttagtaccaactcgaaacgttattttggcctg

SEQ ID NO: 73323 - DNA, 30 bp, Homo sapiens; identical to SEQ ID NO: 43189
  misc_feature 1..30: note = chr11:68672906-68672936
  misc_feature 1..30: note = hypo
  source 1..30: mol_type = genomic DNA

SEQ ID NO: 73324 - DNA, 30 bp, Homo sapiens; identical to SEQ ID NO: 43190
  misc_feature 1..30: note = chr11:68692056-68692086
  misc_feature 1..30: note = hypo
  source 1..30: mol_type = genomic DNA

SEQ ID NO: 73325 - DNA, 38 bp, Homo sapiens; identical to SEQ ID NO: 43191
  misc_feature 1..38: note = chr11:68771669-68771707
  misc_feature 1..38: note = hypo
  source 1..38: mol_type = genomic DNA

SEQ ID NO: 73326 - DNA, 76 bp, Homo sapiens; identical to SEQ ID NO: 43192
  misc_feature 1..76: note = chr11:68804728-68804804
  misc_feature 1..76: note = hypo
  source 1..76: mol_type = genomic DNA

SEQ ID NO: 73327 - DNA, 30 bp, Homo sapiens
  misc_feature 1..30: note = chr11:68902975-68903005
  misc_feature 1..30: note = hypo
  source 1..30: mol_type = genomic DNA
agactctccatgccccgatgaagttgtgag

SEQ ID NO: 73328 - DNA, 172 bp, Homo sapiens
  misc_feature 1..172: note = chr11:68965052-68965224
  misc_feature 1..172: note = hypo
  source 1..172: mol_type = genomic DNA
ccccagtggtggatccgtttttggtcctcatagctctgccttttctagaatcgcatcaatagacccatgcagttggcagtctcttcagtgtggcttctttcactttgtattatgcctttaacatccagccatagttacagggacatcgctggcacctcgcaggctgggtggc

SEQ ID NO: 73329 - DNA, 30 bp, Homo sapiens
  misc_feature 1..30: note = chr11:68975015-68975045
  misc_feature 1..30: note = hypo
  source 1..30: mol_type = genomic DNA
caagctgagaggtgacgtcaggactgaact

SEQ ID NO: 73330 - DNA, 376 bp, Homo sapiens
  misc_feature 1..376: note = chr11:69192450-69192826
  misc_feature 1..376: note = hypo
  source 1..376: mol_type = genomic DNA
taccaagggcggcgtcgcacaaactgtgggattaggtggcagaggctgttccgaggctgctccgatgtgtgggaactgagggggttcccaggatgtgagactttcagtgctgaaactgggaaagtcctgggcgagccgggacaagtcgctcaccctactagagacagttgggcgaaggagacacattgggatcagtctcccatggccttcaagtgtcagggcaggggctggggacctcccatataacgagcagcctcaggagactccaggcaggcaggagcgtcgggggctgcgactccagaatggccaaggcttctaccgtccagcccctttgtaacacagagcacccaacgggcgcagccgcccccatgcctca

SEQ ID NO: 73331 - DNA, 30 bp, Homo sapiens
  misc_feature 1..30: note = chr11:69193336-69193366
  misc_feature 1..30: note = hypo
  source 1..30: mol_type = genomic DNA
gagccctgggccaggcggttctggaggctg

SEQ ID NO: 73332 - DNA, 30 bp, Homo sapiens; identical to SEQ ID NO: 43195
  misc_feature 1..30: note = chr11:69206384-69206414
  misc_feature 1..30: note = hypo
  source 1..30: mol_type = genomic DNA

SEQ ID NO: 73333 - DNA, 148 bp, Homo sapiens
  misc_feature 1..148: note = chr11:69227108-69227256
  misc_feature 1..148: note = hypo
  source 1..148: mol_type = genomic DNA
gaaccaaatatcatacgagatagacagatagattaataggttacctctgtgtggagtaacaggccatttcaatttttaaatgatcctctggctggcagcagagctggggagcgcaaggcggtgctcattaatagcagttggggccggg

SEQ ID NO: 73334 - DNA, 30 bp, Homo sapiens
  misc_feature 1..30: note = chr11:69253125-69253155
  misc_feature 1..30: note = hypo
  source 1..30: mol_type = genomic DNA
actagggtgagggcacgggattgcagtggg

SEQ ID NO: 73335 - DNA, 94 bp, Homo sapiens
  misc_feature 1..94: note = chr11:69269195-69269289
  misc_feature 1..94: note = hypo
  source 1..94: mol_type = genomic DNA
agcctacacagacctcgtgagctgatgagtctcaccatcttattatttattctttattattaacaaagccagacatgcacgcaggactccccgt

SEQ ID NO: 73336 - DNA, 111 bp, Homo sapiens
  misc_feature 1..111: note = chr11:69279556-69279667
  misc_feature 1..111: note = hypo
  source 1..111: mol_type = genomic DNA
gagcccacagaccaccgggaggcccagccaggggctgtgggagatggagctgtgctggagccactgctgagtgggtgatgggtggggccggagcagcgccgtatgcaaaga

SEQ ID NO: 73337 - DNA, 190 bp, Homo sapiens
  misc_feature 1..190: note = chr11:69280486-69280676
  misc_feature 1..190: note = hypo
  source 1..190: mol_type = genomic DNA
aatctgtccggggtgcggtctgggcatgaaaagtttttcaggctctccaggtgattctcgtgtgcagccaagttagagaacactgactcccggggaggtggattacctgtcctcccggcaaagcgcaggactcgcagtttggcaagcttccagcagcagcgagttcgggtggctccgtggggagccttac

SEQ ID NO: 73338 - DNA, 67 bp, Homo sapiens; identical to SEQ ID NO: 43197
  misc_feature 1..67: note = chr11:69339948-69340015
  misc_feature 1..67: note = hypo
  source 1..67: mol_type = genomic DNA

SEQ ID NO: 73339 - DNA, 167 bp, Homo sapiens; identical to SEQ ID NO: 43198
  misc_feature 1..167: note = chr11:69360946-69361113
  misc_feature 1..167: note = hypo
  source 1..167: mol_type = genomic DNA

SEQ ID NO: 73340 - DNA, 30 bp, Homo sapiens
  misc_feature 1..30: note = chr11:69431611-69431641
  misc_feature 1..30: note = hypo
  source 1..30: mol_type = genomic DNA
gcctcacagggtgcacggtctactgcaagg

SEQ ID NO: 73341 - DNA, 91 bp, Homo sapiens
  misc_feature 1..91: note = chr11:69452198-69452289
  misc_feature 1..91: note = hyper
  source 1..91: mol_type = genomic DNA
ggccaggcctgactgcgggggagagggccgaacgtgacctccgaggtcacccccagccagctttctctcctgtggtcggaagtggttttct

SEQ ID NO: 73342 - DNA, 711 bp, Homo sapiens
  misc_feature 1..711: note = chr11:69452657-69453368
  misc_feature 1..711: note = hyper
  source 1..711: mol_type = genomic DNA
ctaattgatctggagcggaaacgcacgtctgcggttggggcgatggggggggcggtgcggctgtccatgtgccgagcgtgtggctgtctcgggtgggcactggggccggagttcgccccggcccacctcgcagttttggggcgcctgggatcggcgctacgtaagcgaagcagagctgccatagcacgtgggccgccacgcgcaccccaaaagcaagcagtgtggggggaaggggagctcgagcgccttcggagcccaggggccggctttcggaagcgttttcccgggcgacttaagggcttaacaatggaaaactcgcggagcctgagccaagtcctttcaagtcgccgccaggtatgcggctgcaggtgaccccacctgggtgcgcccgcccgccagccgccctggtggaaaagcgggtgcgggaggtcgctggcgaaaggtcgggactggtccctgcaccacccgcccccaacccaagccccgagccccgcggcgcgcagccgcgctgagtcccggggtctgcgtcgcggcgcgccggttcctgaatgaacgcgctcccttcccccgcctgaatgaaggttcccacagccagggacggtggcgaacacgcgcctgcagcggaattcgctttctcctgaccgaccatccgcccaggccgcggtcaccggggcgggggccagggggcgaggaaagcgtgaaggtgatttc

SEQ ID NO: 73343 - DNA, 48 bp, Homo sapiens
  misc_feature 1..48: note = chr11:69458766-69458814
  misc_feature 1..48: note = hypo
  source 1..48: mol_type = genomic DNA
aggcccggcagcccccggcctccccttgagagccggctccttaggtga

SEQ ID NO: 73344 - DNA, 64 bp, Homo sapiens
  misc_feature 1..64: note = chr11:69466049-69466113
  misc_feature 1..64: note = hypo
  source 1..64: mol_type = genomic DNA
agggcgccaggcaggcgggcgccaccgccacccgcagcgagggcggagccggccccaggtgctc

SEQ ID NO: 73345 - DNA, 59 bp, Homo sapiens
  misc_feature 1..59: note = chr11:69468423-69468482
  misc_feature 1..59: note = hypo
  source 1..59: mol_type = genomic DNA
ctcttctcttccctgcgcctgtgatgctgggcacttcatctgatcgggggcgtagcatc

SEQ ID NO: 73346 - DNA, 714 bp, Homo sapiens
  misc_feature 1..714: note = chr11:6947603-6948317
  misc_feature 1..714: note = hyper
  source 1..714: mol_type = genomic DNA
agagttccaagtgtgcggcgtgggcggggcctgcagaaagggacggggcctgcagaaagggacggggctggcaaaggcctggtctacctcaccgatccgggtcgcgggggctcctagggggttccttccacagctggtgcgcgtgcgcaagagtgcgtcgaggttgttccgcggcaatttatgaaactcggagccggcagtgagttgagggttcggcgaggtcagggattcctagttgcagcgtgattaccaacgccagctcccttcactgtccaagacagcgattccgcggctcctctgagaactggcgcttgtgagtgactgaacgggccactggagaggagcggtgctcacgggtatcgttctcgtcagcgggcggtggggacgcggggtcttggaattgggaatcacgcttgagggcgtccatgcggaacgtgcagcttacctcagcttgcttgcagttacccagtttccacgctgccctccaaggtctgtgccggaaaacctggaggagggcgcgagctgacgggagggatggaaacgtgggctgcggaagtaagacaagcgttgagagcagcgacagagggcgagggggtgggcggcgggacggctggggtcaggatccagctccgctaaagcaaggatttaaccacactcctgtcgcctcttccactctgcaataggggcagtctccagacgcgcagagtggttagt

SEQ ID NO: 73347 - DNA, 32 bp, Homo sapiens
  misc_feature 1..32: note = chr11:69481718-69481750
  misc_feature 1..32: note = hypo
  source 1..32: mol_type = genomic DNA
accaggcaatcccttcgcgtctcccctccctc

SEQ ID NO: 73348 - DNA, 154 bp, Homo sapiens
  misc_feature 1..154: note = chr11:69498956-69499110
  misc_feature 1..154: note = hypo
  source 1..154: mol_type = genomic DNA
tgaggcagccgaggacgcatagtggctaccggggacccagccctgccatggcctgaggcattgtccctctaggtgggagcgtgtaggactcatgcacccccccgggaggctccaagagagtcccccatttgacctacaccccttatttcttaga

SEQ ID NO: 73349 - DNA, 472 bp, Homo sapiens
  misc_feature 1..472: note = chr11:69516989-69517461
  misc_feature 1..472: note = hyper
  source 1..472: mol_type = genomic DNA
aaaacctgaaacaggcgctccgagtacacggagcacggcagaggcaccgagcaattttgagactctaaaatgctttgtcccgctgttcacaaaggagctggttgggccggaggcggccccgcctctgcatcctttctggggtgggggccccgggcaggcgcggccacccccgccctggcccctgctccgccagggagtccggggctgcgtgtgaggcctgcgcgggccgagacctcacacagcctcctctgcgcgcggggccgcgggaggggcgcgggttcgttcctttgaactcccagcctttgttcccggccaccagagccccagcgctcgtacacttccggccccgggacctctgcggttacctgggccttccctgccagcccccaccccctgcccccaccagaaagcgtttacaggacaggtgaggcccgcaggaggaaaagcactcccctggcgcaacatgactcca

SEQ ID NO: 73350 - DNA, 478 bp, Homo sapiens
  misc_feature 1..478: note = chr11:69517719-69518197
  misc_feature 1..478: note = hyper
  source 1..478: mol_type = genomic DNA
aatatcaaaggaggccgaataatgggtttcctcggtccggctaggccggcctttgactcaattggaaatgcaaaggcagcttttgcctattctctggctgctggctgagaccctaaatttccgtaggaaatcgtcggacatgcacttaatcggtctttgcaatctttccctcgaagttgcacgcgggtctgggcggaggaggcgaggaaaccctggattcgaaccagcgcctttctctccttcaggcctccgcccggggacaggcgccggtcccccgccccggcgcatccgccccgtggggacacttaccagcccctgcatcttgccgtcggcgcccatgcagaggtaccgcacgctgtgcacgcccttgatggccacggtccgcagagcgactgccttgatctccagcaaacctaggcgcaggggaagcgagaagctgcagcaaggaccgctgggcccgcaccacgtgggtgcggtc

SEQ ID NO: 73351 - DNA, 418 bp, Homo sapiens
  misc_feature 1..418: note = chr11:69518198-69518616
  misc_feature 1..418: note = hyper
  source 1..418: mol_type = genomic DNA
gtccacaagcctgtgcttctccctagcgtcccgcgctgtttggggactaacggagggatcctaacgtccaggtgccaaaacctggggttcccaggagttgaggggtccgcaggagcctaagggtggcaaaggaaggaagggcgctggggtggggcgcgcgcagcggggtggggtgcgcgcggcggggcgggcgggggtgctggcgggcactcactgtgcgcgctctggccccgcgcgcagtccacgacgccgtcggcacggatgcgcaggaagcagctggagagcccgtgggggccggaggtgtacaggtgccgcaggcggatggggtcgccccagccgtagtgcacgtggggccccgcgtccgagaaggcgagggggcgcccggccacggccagccagaggccggccaggatccata

SEQ ID NO: 73352 - DNA, 870 bp, Homo sapiens
  misc_feature 1..870: note = chr11:69519059-69519929
  misc_feature 1..870: note = hyper
  source 1..870: mol_type = genomic DNA
ggaactcctccccaccgcgcagcggccccgaggttcttggctgggagagtttgactttgtaaagcaatcgacaactggggcccttcccccaggcctcaggctcccagtggatgcactcggcgtggggcactagcgggggcggggtcaggaaccccggggccagaggttggggggcaccgagttttgcccccttcaccctctgtcgggaaaagcctcacctcggccttagtgcccttccccttaaaagcccactcgcactccctcccccgactttcgcagccccgcacatctgacgtcaaagccgtcccgtagaattttccccggcagttccgacagtctcaggttctttcagcttcatcttcttgcaattcctgccccgccccttttatccgggtaaattgccccccgacggggggccgggcgcgctctcggccggcggggaaacaatggaagccgcgcggactgtaggtggcgccgcagcctcggcgtccgcctgggctttgcgctcctggccccgcgcccctgcctgctccgcgctcgccccggccccgcggctgtgcgcgagatgcaacctgaaagggggcactgggaaggaggctctcgggcagggtgggcgggccagctgcgggattggtgaaccccagcttctcggctggagggtggtggaggcaggggcgcagggagggaggcctgggcctccgtttcccgttttttgagctgtcttgtgtcgggggtctggtttttgagtccccgagtccctgcgcacggggtcaggaggaacagcacggtcggggaggtcgagagcgccttacctggtggggaggggtcgggaaggggcccaggaacggtgatgggcgcccctggcgtccg

SEQ ID NO: 73353 - DNA, 101 bp, Homo sapiens
  misc_feature 1..101: note = chr11:69533072-69533173
  misc_feature 1..101: note = hyper
  source 1..101: mol_type = genomic DNA
tctcacaccagcccacgagggggcaggttttcctgcctgaggccacacagctcttcagctgcagggtggggactcacagccgaccgcgggactctgatgag

SEQ ID NO: 73354 - DNA, 670 bp, Homo sapiens
  misc_feature 1..670: note = chr11:69588847-69589517
  misc_feature 1..670: note = hyper
  source 1..670: mol_type = genomic DNA
cgaagatgctcaccacgccccgctccacgggcgagagctccagcaggcctgggggcggggcgcaggtcattgcggggcaggtgatccctggcccactccgcccctcggcttgttcgcctccggggaccctatttctggggtggggttggggataaagggccagggttcccggcgcagccgcccccaagggcctccagagcccaagctgccctctagggcctccggagcccaagcctgcgctagctcagattagcttgcctgtgtaggggacccccggcggccgcacccagtcccggaccttcagacgcgagcccgaccccagcggttccccagcctgggccaggccggggcgcgtgtctcgggccccctgtggctgcaccgcgcgccctgtgcccacgggcgaaggcgctggaattcggcgctcggagcccgagtttctgaaggcgggaggcggcgcccgacctcaggggttgcgctgggctgccggagccaagagtgtctgcgtccccagccccgcgtcagaagggaccggagcccgagtccgccccggttcccggggcccccgagcaggtgcccgccgagggtctcagagtgtgactgagcgggttggcccggcggccgttgccccccgcccccgccccttcgcgcctggccgcgccactcactgtcg

SEQ ID NO: 73355 - DNA, 367 bp, Homo sapiens
  misc_feature 1..367: note = chr11:69589746-69590113
  misc_feature 1..367: note = hyper
  source 1..367: mol_type = genomic DNA
tgggtgcagtgggtgcggcggcgccccctcggcccgcccagggcgccagcaaggccagcaggaccgccgggagcagcgctaccgcggccgtcccgggccccgacatcccggcccgagggccgtgcgtcggtcaggcggtcagtgcgcccgggaagctggggggcagagctgcgcctgtggcgtcccgcgggagcgcacggccgacctcgggcaggagtgcgcaaccgaggaggtgcgggaggcaagcgacggggcccccgggcgccgggctctaccccggctgcatggagcggcgagccgggcggaaagcgcgcggctggagctgggactctgaggagcagtgcgcgcctccctgagcgccaggccc

SEQ ID NO: 73356 - DNA, 521 bp, Homo sapiens; identical to SEQ ID NO: 33939
  misc_feature 1..521: note = chr11:69590114-69590635
  misc_feature 1..521: note = hyper
  source 1..521: mol_type = genomic DNA

SEQ ID NO: 73357 - DNA, 99 bp, Homo sapiens
  misc_feature 1..99: note = chr11:69611957-69612056
  misc_feature 1..99: note = hypo
  source 1..99: mol_type = genomic DNA
gcgccaggctggctctttgttgcttacattgtgtgagtgcctcactggtgtcagccgcacagacccaagggccggcccatcccacgtcctctccctgca

SEQ ID NO: 73358 - DNA, 30 bp, Homo sapiens
  misc_feature 1..30: note = chr11:698834-698864
  misc_feature 1..30: note = hypo
  source 1..30: mol_type = genomic DNA
gtcaggccttgctcacggcccctttctctt

SEQ ID NO: 73359 - DNA, 184 bp, Homo sapiens
  misc_feature 1..184: note = chr11:69970448-69970632
  misc_feature 1..184: note = hypo
  source 1..184: mol_type = genomic DNA
ccctcagctcctgtacgaagagtgggcacgctatggagttttctataagtaccagcccatcgacctggtcaggtaagaacgcgccacagcctgcgggaatcaagtccctactccgatggcagtcggataacatccctgtgggtttcaaccgctctgaatgttcagtacccgggaacgtgtttga

SEQ ID NO: 73360 - DNA, 50 bp, Homo sapiens
  misc_feature 1..50: note = chr11:70005678-70005728
  misc_feature 1..50: note = hypo
  source 1..50: mol_type = genomic DNA
aggatgtgccccacacgcccctggtcctggggatgcgggggagatggacc

SEQ ID NO: 73361 - DNA, 36 bp, Homo sapiens
  misc_feature 1..36: note = chr11:70017163-70017199
  misc_feature 1..36: note = hypo
  source 1..36: mol_type = genomic DNA
cggcagaaccggttccgagtgcgtgctgggtttggg

SEQ ID NO: 73362 - DNA, 30 bp, Homo sapiens; identical to SEQ ID NO: 43204
  misc_feature 1..30: note = chr11:70022959-70022989
  misc_feature 1..30: note = hypo
  source 1..30: mol_type = genomic DNA

SEQ ID NO: 73363 - DNA, 30 bp, Homo sapiens
  misc_feature 1..30: note = chr11:70023256-70023286
  misc_feature 1..30: note = hypo
  source 1..30: mol_type = genomic DNA
ctgagtcctgcacttcgacggccctgaact

SEQ ID NO: 73364 - DNA, 265 bp, Homo sapiens
  misc_feature 1..265: note = chr11:70050901-70051166
  misc_feature 1..265: note = hypo
  source 1..265: mol_type = genomic DNA
attgcattttaaaggcggtctacgaaacatagctgacatttgagatgtatgtgtgcttggttttatttatatcgtcatgtagttactgtgtgctgggaaaagtacaccagaaggtgagcggtgggtatggacaggttggtagcgggcgactctgccttcctccccagaagttcagcatagcggttaagggtcgactctggcaccacactcttagggtttcagaacatggctctgccatcgtctagctacacgatctcaggaatgt

SEQ ID NO: 73365 - DNA, 42 bp, Homo sapiens
  misc_feature 1..42: note = chr11:70098175-70098217
  misc_feature 1..42: note = hypo
  source 1..42: mol_type = genomic DNA
tcctttctgcagctccgcctctcccagcggctcctaaacccc

SEQ ID NO: 73366 - DNA, 38 bp, Homo sapiens
  misc_feature 1..38: note = chr11:7041865-7041903
  misc_feature 1..38: note = hyper
  source 1..38: mol_type = genomic DNA
ccaccgcgacgaccccgaggaaacgctgtcaggtcgcc

SEQ ID NO: 73367 - DNA, 66 bp, Homo sapiens
  misc_feature 1..66: note = chr11:707906-707972
  misc_feature 1..66: note = hypo
  source 1..66: mol_type = genomic DNA
gcaaacactcaggctcgccactgagcccgtgaacattccagacattctccacggatagatggatgg

SEQ ID NO: 73368 - DNA, 98 bp, Homo sapiens
  misc_feature 1..98: note = chr11:71098921-71099019
  misc_feature 1..98: note = hypo
  source 1..98: mol_type = genomic DNA
acatcccaagagtcccgacgtcctgatagtcccaacatcccaacagtcccaacattccgacagtcccaacatcctgacagtcccgacattctgacagt

SEQ ID NO: 73369 - DNA, 30 bp, Homo sapiens
  misc_feature 1..30: note = chr11:71108366-71108396
  misc_feature 1..30: note = hypo
  source 1..30: mol_type = genomic DNA
agtaggagcctgctgcgccccaaccaggca

SEQ ID NO: 73370 - DNA, 57 bp, Homo sapiens; identical to SEQ ID NO: 43207
  misc_feature 1..57: note = chr11:71117658-71117715
  misc_feature 1..57: note = hypo
  source 1..57: mol_type = genomic DNA

SEQ ID NO: 73371 - DNA, 185 bp, Homo sapiens
  misc_feature 1..185: note = chr11:71192648-71192833
  misc_feature 1..185: note = hypo
  source 1..185: mol_type = genomic DNA
cctttggaggctcagcggaacccagcccatcagcattcagggtcacgctcaccatcttgccagcattgtaatcatgcgtatctgcagttcgtcggtggagtcagcctctgacacgccccgcagtgaagtgtcttttttccctctgaaaaatccattcatcctgccacgtgcgggtatttgtcctg

SEQ ID NO: 73372 - DNA, 54 bp, Homo sapiens; identical to SEQ ID NO: 33940
  misc_feature 1..54: note = chr11:71274712-71274766
  misc_feature 1..54: note = hyper
  source 1..54: mol_type = genomic DNA

SEQ ID NO: 73373 - DNA, 536 bp, Homo sapiens; identical to SEQ ID NO: 33941
  misc_feature 1..536: note = chr11:71318274-71318810
  misc_feature 1..536: note = hyper
  source 1..536: mol_type = genomic DNA

SEQ ID NO: 73374 - DNA, 105 bp, Homo sapiens
  misc_feature 1..105: note = chr11:71318952-71319057
  misc_feature 1..105: note = hyper
  source 1..105: mol_type = genomic DNA
cgctccagatccccccagctctcggcggcggacccgggccgcgtgtgagcgcgctttgcacctcctatccccagggtccgccgagagccacgattttttacagaa

SEQ ID NO: 73375 - DNA, 19 bp, Homo sapiens
  misc_feature 1..19: note = chr11:713388-713407
  misc_feature 1..19: note = hypo
  source 1..19: mol_type = genomic DNA
tttgtgtgtttgagacgga

SEQ ID NO: 73376 - DNA, 98 bp, Homo sapiens
  misc_feature 1..98: note = chr11:71507939-71508037
  misc_feature 1..98: note = hypo
  source 1..98: mol_type = genomic DNA
ctgcacacagagacacggacaagccagtgcctgtccacgtggggcagcccgttaactacagagccaacaaacaagccaggacacgaagacatactggg

SEQ ID NO: 73377 - DNA, 29 bp, Homo sapiens
  misc_feature 1..29: note = chr11:71781578-71781607
  misc_feature 1..29: note = hypo
  source 1..29: mol_type = genomic DNA
cccagtggctcacagcggtaatcccagca

SEQ ID NO: 73378 - DNA, 30 bp, Homo sapiens
  misc_feature 1..30: note = chr11:71792634-71792664
  misc_feature 1..30: note = hypo
  source 1..30: mol_type = genomic DNA
ctcttccaagacatgcggttagcattagat

SEQ ID NO: 73379 - DNA, 30 bp, Homo sapiens
  misc_feature 1..30: note = chr11:71850743-71850773
  misc_feature 1..30: note = hypo
  source 1..30: mol_type = genomic DNA
agtcgagggagcggccgctgcatccagatg

SEQ ID NO: 73380 - DNA, 30 bp, Homo sapiens
  misc_feature 1..30: note = chr11:71939243-71939273
  misc_feature 1..30: note = hypo
  source 1..30: mol_type = genomic DNA
catgtgcacacgtatcgcattctgcctgat

SEQ ID NO: 73381 - DNA, 203 bp, Homo sapiens
  misc_feature 1..203: note = chr11:71951172-71951375
  misc_feature 1..203: note = hyper
  source 1..203: mol_type = genomic DNA
ccgccgcgcccttggcgctggccgcgcgctcctgtttgcggaacttggcccggcggttctggaaccagacctgcgggcacaggggccagtcagcctggacgagggtcggagaacgcacggggtcagcccgcggccgcaaggctcgagtgagatcctggttcggaaagaaccgggcccgggttcttactagttggaggggcctt

SEQ ID NO: 73382 - DNA, 332 bp, Homo sapiens
  misc_feature 1..332: note = chr11:71951406-71951738
  misc_feature 1..332: note = hyper
  source 1..332: mol_type = genomic DNA
cgctccactggcccctgcctccagatccctgggttcttgcccttgggatccactcacccgctgactctgctgcctcccagcactcttggtctcccggaggggaccctgccttcgttctcctcactctaagttcttcccccaattccttcttttaggaagctctgggacttccctcctggagtgttccagggccgtggagagcagtttagggcgccagtaaaccttttgtctagggcatccagtcaaggcgggccaactgaacatctgtacacggagttgtacaaatagacaacagtctgctctagcccggctctcttcggccctgtgcctgc

SEQ ID NO: 73383 - DNA, 282 bp, Homo sapiens; identical to SEQ ID NO: 33945
  misc_feature 1..282: note = chr11:71952135-71952417
  misc_feature 1..282: note = hyper
  source 1..282: mol_type = genomic DNA

SEQ ID NO: 73384 - DNA, 83 bp, Homo sapiens
  misc_feature 1..83: note = chr11:71952458-71952541
  misc_feature 1..83: note = hyper
  source 1..83: mol_type = genomic DNA
cgtcttggtcccggcagcctggggccgagcgtcctccctattactcaatggagccggcgggataaaggcggagggagatcagg

SEQ ID NO: 73385 - DNA, 231 bp, Homo sapiens; identical to SEQ ID NO: 33947
  misc_feature 1..231: note = chr11:71954593-71954824
  misc_feature 1..231: note = hyper
  source 1..231: mol_type = genomic DNA

SEQ ID NO: 73386 - DNA, 119 bp, Homo sapiens
  misc_feature 1..119: note = chr11:71955006-71955125
  misc_feature 1..119: note = hyper
  source 1..119: mol_type = genomic DNA
cgccacgcacgagtcgtacgaattgaggtaggagtagtccatcggcccggggggcgggggcgggggccgggccaggccgggtcggggtcggggtccgggtggaggtcggaagggaggtt

SEQ ID NO: 73387 - DNA, 330 bp, Homo sapiens
  misc_feature 1..330: note = chr11:71955189-71955519
  misc_feature 1..330: note = hyper
  source 1..330: mol_type = genomic DNA
cggccgcactcagcccgggtgcaacgcaagtgcagccagcccggcccgcgcgccttttaacgcgcaggaccccgcggaggggggcggggcggggcgagctccgaaggggcggggcctaggaggcccagacaccgcccaaagccgccccgacccccaccccgaagggtccccgccgccgtcttagggctcagaggtgtggagctgggatgcgcgggaccctatccccggagtccctatcctgccccaatccggaccagaccttcggtctctacacagcgtccgaggccagagggtcccgacccttttcccgggcctccccacctgcggccc

SEQ ID NO: 73388 - DNA, 50 bp, Homo sapiens
  misc_feature 1..50: note = chr11:71955549-71955599
  misc_feature 1..50: note = hyper
  source 1..50: mol_type = genomic DNA
cgctcgtgtgaagaagttaattcaattcgctctgataaccgagttattcc

SEQ ID NO: 73389 - DNA, 777 bp, Homo sapiens
  misc_feature 1..777: note = chr11:71955600-71956377
  misc_feature 1..777: note = hyper
  source 1..777: mol_type = genomic DNA
atctggcccctcagccccgcccccagcgaggtcccatcccggcggagactgcggaggcggcccaggaagggggatggagaccgggaagagacggagcctgggatggggacagggaagggacgtggatagacagaggaaacagagaccgggagagaaaggggcagaaacagtgatggagacagggacaagagatacaggtacacagagggagacaaggacggaacatacacagcgaaagacaggatggagcggggacagggcagagacaggagatgagggtaagagagagacaggatggagcggggacagggcagagacaggagatgaggttaagagagagacaagaggagacagggagacagggggacgagaaagagagtgagggaggcatggagacagaaggggtcgggatgagacatggacggcaaccaggactgcggtggagagcaagggagggatgagacaaaacagaggcaggaatcgtgagacagacacatatgcccagggacagtctgagagagacagggccagggacagccacaagcgcgggagcagaggctgagagcggagagaaaacgcctccggggagcttagacacgagggctggagcgcagaggggcccagggatgatgctggaggctctggggtgcggcctccacggggctgcggagagggagggtcgtgggagccaggtccctctaccctgacttgtcccgaggcccacacgaccttgcaccttcagggcccgcctgcctctccccccgttccctcagctcc

SEQ ID NO: 73390 - DNA, 269 bp, Homo sapiens
  misc_feature 1..269: note = chr11:72109412-72109681
  misc_feature 1..269: note = hypo
  source 1..269: mol_type = genomic DNA
gggttcgaatcaagtcgcccgagagcggatactcagccattgtgtccagttttaatcctgtgttttcccaagtaattaagccttcttgcttatgaacttgtgactaagtaaagcatcaccgagaggttgtaacatcaaagtgccttccaccgtctgtccgtgtttggtaaaattggatttcttttccttcttaaagaaaaactaattgaatttagctgaaggctgtgtatatttgcacaagccggtgaaggctacgctaagtcacagtg

SEQ ID NO: 73391 - DNA, 174 bp, Homo sapiens
  misc_feature 1..174: note = chr11:72125662-72125836
  misc_feature 1..174: note = hypo
  source 1..174: mol_type = genomic DNA
ggcattgacagacaccgaagtcaatcagacatgaatcttgcctacaaggagctcttattctgagctggaggagggaaaatgaaacaagcgcacaaataagtgcactaagtatcacaggtgctcagagatgtttacacaggctcagggagcacaactcaccgccttgcaaagctc

SEQ ID NO: 73392 - DNA, 24 bp, Homo sapiens
  misc_feature 1..24: note = chr11:72146622-72146646
  misc_feature 1..24: note = hypo
  source 1..24: mol_type = genomic DNA
gagccactgcgcctggccctgatt

SEQ ID NO: 73393 - DNA, 169 bp, Homo sapiens
  misc_feature 1..169: note = chr11:72388041-72388210
  misc_feature 1..169: note = hyper
  source 1..169: mol_type = genomic DNA
aagacctgcccgccccgccgccctgccgggagtcaagaaacaccgttttttgttagctggggaactggaggtgggatggcaggaaggatgctcctgggaggtagggtggctgcccaaagcgatgggaagattcagttctggaatccggcctccgcgctgcccccatagc

SEQ ID NO: 73394 - DNA, 322 bp, Homo sapiens; identical to SEQ ID NO: 33953
  misc_feature 1..322: note = chr11:72432837-72433159
  misc_feature 1..322: note = hyper
  source 1..322: mol_type = genomic DNA

SEQ ID NO: 73395 - DNA, 253 bp, Homo sapiens
  misc_feature 1..253: note = chr11:72433380-72433633
  misc_feature 1..253: note = hyper
  source 1..253: mol_type = genomic DNA
aaaacactgagaaagcgaaaagtcacccagaatcccccggggcagacacttcctccccgcccccaggctgcacccccacccaagctgggaagagacaaccaacagtgtccactgatcttgcaggccctcacagggtggatgcccaggaagtcctgactgacaagccctggcggtggcctctccaccactccacccgcataaggagacagagaggctaggaaagaggctctctgaagggcgcaagttctgccct

SEQ ID NO: 73396 - DNA, 431 bp, Homo sapiens
  misc_feature 1..431: note = chr11:72465657-72466088
  misc_feature 1..431: note = hypo
  source 1..431: mol_type = genomic DNA
tgctggaaggatcaacggccggatgatcaacaaccttaacaaaattaagggcagacgcaggggaccgcggcagcggccatgaggcaggtgggaagcaggcacagtgatgagccggctgaggctgtgggatcgtttattggggctctgtccagccaggctgcagcacccgcctgggcctggcccggtgccaccaggtgccgggtgggggaggggagaaagtgcaggagcggccgccgccccagggctcgcccggtcctgtctccgtccctgaagcggtgcggcgctcaggtgagcgaggtgtcgtcgtcgctgccctcgccgcccgcgccgcccatccgctcctctctgctctcggccaccgcgctctcgtcgatgttctccagtgagtccgcatgctgcaccgacagctccgacagcgccaggctcggcaa

SEQ ID NO: 73397 - DNA, 46 bp, Homo sapiens; identical to SEQ ID NO: 43212
  misc_feature 1..46: note = chr11:72475677-72475723
  misc_feature 1..46: note = hypo
  source 1..46: mol_type = genomic DNA

SEQ ID NO: 73398 - DNA, 30 bp, Homo sapiens
  misc_feature 1..30: note = chr11:72492307-72492337
  misc_feature 1..30: note = hyper
  source 1..30: mol_type = genomic DNA
ggctgcagatgctgacgccaccttcctggg

SEQ ID NO: 73399 - DNA, 204 bp, Homo sapiens
  misc_feature 1..204: note = chr11:72532174-72532378
  misc_feature 1..204: note = hypo
  source 1..204: mol_type = genomic DNA
caaatctcttagctacgtgactttgggcaagacacttaaacctctctgtcggtgtccttgtctgtgaagtgagagtggcagtaccagcctcctggtgtggtgaggatggaaggagcgtgtagcctgctgggaacatcatggcgcccgagggccggatgggcatttggcagcctctgcgcgaggagtcctcgcagtggttatgca

SEQ ID NO: 73400 - DNA, 42 bp, Homo sapiens
  misc_feature 1..42: note = chr11:72532613-72532655
  misc_feature 1..42: note = hypo
  source 1..42: mol_type = genomic DNA
gggcaggtgagcagccgactcccttagcgccttcggccccgg

SEQ ID NO: 73401 - DNA, 203 bp, Homo sapiens; identical to SEQ ID NO: 33582
  misc_feature 1..203: note = chr11:726307-726510
  misc_feature 1..203: note = hyper
  source 1..203: mol_type = genomic DNA

SEQ ID NO: 73402 - DNA, 69 bp, Homo sapiens
  misc_feature 1..69: note = chr11:7272860-7272929
  misc_feature 1..69: note = hyper
  source 1..69: mol_type = genomic DNA
actcggcggtgggagcgggtgcttggtttgcatcagggatgaggggtggagtagcgaaagcgcccggag

SEQ ID NO: 73403 - DNA, 82 bp, Homo sapiens
  misc_feature 1..82: note = chr11:7273066-7273148
  misc_feature 1..82: note = hyper
  source 1..82: mol_type = genomic DNA
cgcgcactcctgacctggccccgccccccggcggccgcgagtagcgggcggagcgcaagcagagaggcgctctgggctgtgc

SEQ ID NO: 73404 - DNA, 111 bp, Homo sapiens; identical to SEQ ID NO: 33609
  misc_feature 1..111: note = chr11:7273149-7273260
  misc_feature 1..111: note = hyper
  source 1..111: mol_type = genomic DNA

SEQ ID NO: 73405 - DNA, 220 bp, Homo sapiens; identical to SEQ ID NO: 33610
  misc_feature 1..220: note = chr11:7273679-7273899
  misc_feature 1..220: note = hyper
  source 1..220: mol_type = genomic DNA

SEQ ID NO: 73406 - DNA, 173 bp, Homo sapiens; identical to SEQ ID NO: 33611
  misc_feature 1..173: note = chr11:7274075-7274248
  misc_feature 1..173: note = hyper
  source 1..173: mol_type = genomic DNA

SEQ ID NO: 73407 - DNA, 228 bp, Homo sapiens
  misc_feature 1..228: note = chr11:72905832-72906060
  misc_feature 1..228: note = hypo
  source 1..228: mol_type = genomic DNA
cttccttcagcctgccgccctgtcctgagtcatgcagttccctagcactcctgggacagctgagccctgtgcatgcatgcacgcagcattcccctgcagcctgcgctcacaccaccccccacgcaccaccctccacctggtcctggacatacttcgctacctcaaggtatccaatggccaaaatccaaggctaccactggggaagattcttcacgggtttgcagtgtg

SEQ ID NO: 73408 - DNA, 388 bp, Homo sapiens
  misc_feature 1..388: note = chr11:72929267-72929655
  misc_feature 1..388: note = hyper
  source 1..388: mol_type = genomic DNA
cgggcgggttgagggcggtgccagggtcagtcaaaagtccgccccgccccctgcctggcccggcttcggggttggggaacagcgcagggaggtgggtagccgggctcccaggcacgtgggtctctgcggctgcggcgggacccgggcactggcacccgggagcggcggcgacggcaccctgagaggagaagcgcagcgcagtggcgagaggtggggtggggcgtctggagggaacaaggcgctgggagaggcccggggaagcggcgggccagactggcgcaggtgcggactgggcgcggggcaggggagggcgctgtggagcggctgtcgccccggggcacagttgcgagccggcgtgtagcgcataactggacggcttgaacgcgcc

SEQ ID NO: 73409 - DNA, 266 bp, Homo sapiens
  misc_feature 1..266: note = chr11:73019833-73020099
  misc_feature 1..266: note = hyper
  source 1..266: mol_type = genomic DNA
cggggccagccctctcggcgcgtgtccaagctggcgtctgggcccctggccgcccccgcgcagccgcgcccgctccgcagcctctcgccgtcggttcgccagctctcccggcgcttcgacgcgccgcgtctggacgacggctccgctgggacccgagacggaggcgtcttacccgcggccgcggaagaagcggccgagggcccagcgcgaggagcctggcccagcgtcaccgagatgcgcaagctcttcggcggtcctggctccag

SEQ ID NO: 73410 - DNA, 762 bp, Homo sapiens
  misc_feature 1..762: note = chr11:73072907-73073669
  misc_feature 1..762: note = hypo
  source 1..762: mol_type = genomic DNA
aaaagggtcctgtgccgcgtgtatgtgtacgcgtgtgtagaagggtgtatagggcatccacacacacacacccatgcaggcctgcctccctccattctgccggggtttcccaggagtggggaatgctggcagcagttcctccattcaccttctcctgtccattggcgcctcctgcagttctcctgtgcggctcccaccctgaacagctgcccggagccctcgcctgaggtatgggtctgcaacagcgacggctacgtgggccaggtgtgcctgctgagcctgcgcgccgagccggacgtggaggcctgcatcgccgtctgttccgcccgcatcctctgcatcggggcggtgcccgggctgcagcctcgctgccaccggtgaggcctgggcggcggggtgggcggcaccgcgggcctgggagaaccaacccctgtcccagcacactctcaggccgccccggcgtggttgtgggcggggcccggcgagtgtgggcggggtcggtgggcgtgtccaccaccggggccccgtctggctcgtagctgctgtcatcctcactccgtcttctcgcagggagcctcctccgtcgctgaggagtcctccagagacggcaccggagcccgccgggccggagctggacgtcgaggccgctgcagacgaggaagccgcgacgctcgcggagccggggccgcagccctgccttcacatctccattgcaggctcgggcttggagatgacgccgggcctcggcgagggtgacccccg

SEQ ID NO: 73411 - DNA, 153 bp, Homo sapiens
  misc_feature 1..153: note = chr11:73310292-73310445
  misc_feature 1..153: note = hypo
  source 1..153: mol_type = genomic DNA
ttcaggaaagaggttcgccaaaatattagcaatgattatcttgggggaaagggtgtcagattgcacgtaggttttttttgttttttgagacggagtctggatctatagccaggctggagtaaagtgggggcgatcgcaggtcactgcaacctc

SEQ ID NO: 73412 - DNA, 26 bp, Homo sapiens
  misc_feature 1..26: note = chr11:73507247-73507273
  misc_feature 1..26: note = hypo
  source 1..26: mol_type = genomic DNA
ttccgagtgcagttacggccgcccaa

SEQ ID NO: 73413 - DNA, 266 bp, Homo sapiens
  misc_feature 1..266: note = chr11:736495-736761
  misc_feature 1..266: note = hypo
  source 1..266: mol_type = genomic DNA
aggggaaagcagggccggggtgggcgtgtggaaggttttggggtgtggcttcaggtgagtcttcaggaggcttcgttaggattgggcatgtttgggacggaagtggttcgggactgatggacataagaagggtttggagtgagtctggagactgagcccagctgtgctgtccgctcacaggtcctaggcaacgactgtcaggaagttcccaaaataagtcactcacaacctcatcgtcctgggtaagtttcctgatatgttccaca

SEQ ID NO: 73414 - DNA, 135 bp, Homo sapiens
  misc_feature 1..135: note = chr11:73662980-73663115
  misc_feature 1..135: note = hypo
  source 1..135: mol_type = genomic DNA
gcacctggccaaaaacatgtttttttttttaacaaatatttattgagcgtctaccacaagggttgagagggtacttcactcctgctgcagtggtagcagctggagataaatgtcggaatccgacatcgacactcc

SEQ ID NO: 73415 - DNA, 84 bp, Homo sapiens
  misc_feature 1..84: note = chr11:73679409-73679493
  misc_feature 1..84: note = hypo
  source 1..84: mol_type = genomic DNA
agacatcattttcatcgtaaaggagaagctacaccctcgcttccgcagggagaatgacaacctcttcttcgtgaaccccatccc

SEQ ID NO: 73416 - DNA, 30 bp, Homo sapiens
  misc_feature 1..30: note = chr11:73679852-73679882
  misc_feature 1..30: note = hypo
  source 1..30: mol_type = genomic DNA
ctcccgccccttcgccgcatagcaccctgc

SEQ ID NO: 73417 - DNA, 30 bp, Homo sapiens
  misc_feature 1..30: note = chr11:73764263-73764293
  misc_feature 1..30: note = hypo
  source 1..30: mol_type = genomic DNA
taattttatttttaccgtcaagaattagag

SEQ ID NO: 73418 - DNA, 30 bp, Homo sapiens; identical to SEQ ID NO: 43218
  misc_feature 1..30: note = chr11:73805524-73805554
  misc_feature 1..30: note = hypo
  source 1..30: mol_type = genomic DNA

SEQ ID NO: 73419 - DNA, 33 bp, Homo sapiens
  misc_feature 1..33: note = chr11:73883502-73883535
  misc_feature 1..33: note = hypo
  source 1..33: mol_type = genomic DNA
tagatctgagggaagcgacgtactggcctaaga

SEQ ID NO: 73420 - DNA, 28 bp, Homo sapiens
  misc_feature 1..28: note = chr11:7388589-7388617
  misc_feature 1..28: note = hypo
  source 1..28: mol_type = genomic DNA
gcgtgagccaccgcgcccggccttccag

SEQ ID NO: 73421 - DNA, 37 bp, Homo sapiens
  misc_feature 1..37: note = chr11:74022679-74022716
  misc_feature 1..37: note = hyper
  source 1..37: mol_type = genomic DNA
tcagacagtcctggccgcgcggcggcagccgctcccg

SEQ ID NO: 73422 - DNA, 141 bp, Homo sapiens
  misc_feature 1..141: note = chr11:74064904-74065045
  misc_feature 1..141: note = hypo
  source 1..141: mol_type = genomic DNA
agatggggtggctgccgggcgggggctgaaaacccagaatgtttaaaacaaacaaaactgttctggagggatgctcccacatttcaagccacaaaaaagattctctccataagtcctgaaagctcacgtgaaaatttataa

SEQ ID NO: 73423 - DNA, 23 bp, Homo sapiens
  misc_feature 1..23: note = chr11:74100854-74100877
  misc_feature 1..23: note = hypo
  source 1..23: mol_type = genomic DNA
cttgaaggaactggccgggtgcg

SEQ ID NO: 73424 - DNA, 39 bp, Homo sapiens
  misc_feature 1..39: note = chr11:74107733-74107772
  misc_feature 1..39: note = hypo
  source 1..39: mol_type = genomic DNA
caggcctgagccacggcgcccggccggaaattcattctt

SEQ ID NO: 73425 - DNA, 36 bp, Homo sapiens; identical to SEQ ID NO: 33956
  misc_feature 1..36: note = chr11:74178590-74178626
  misc_feature 1..36: note = hyper
  source 1..36: mol_type = genomic DNA

SEQ ID NO: 73426 - DNA, 36 bp, Homo sapiens
  misc_feature 1..36: note = chr11:74246640-74246676
  misc_feature 1..36: note = hypo
  source 1..36: mol_type = genomic DNA
acggcacccagcccaagatgacgtttatatcttctc

SEQ ID NO: 73427 - DNA, 119 bp, Homo sapiens
  misc_feature 1..119: note = chr11:74302524-74302643
  misc_feature 1..119: note = hypo
  source 1..119: mol_type = genomic DNA
caccgcgcccggtctgctaccctattttaaaccaccactatctttcacttaaaaatctcagaatgtaagttacatgtgaacaggctcggtttattattgctcatagctgcagccccagc

SEQ ID NO: 73428 - DNA, 30 bp, Homo sapiens; identical to SEQ ID NO: 43010
  misc_feature 1..30: note = chr11:7439190-7439220
  misc_feature 1..30: note = hypo
  source 1..30: mol_type = genomic DNA

SEQ ID NO: 73429 - DNA, 242 bp, Homo sapiens
  misc_feature 1..242: note = chr11:74394395-74394637
  misc_feature 1..242: note = hyper
  source 1..242: mol_type = genomic DNA
ggtggccctgggtagcgagcgcggccgggcgggcgccgtggcctcaggggccctccccgggctgggcacccccacgccgcccgggcactgctcgcggccgcgctttacaagcgaaaacaaacacggccacaagcagcccctgtgcgacgcggccccgcgcccgccagcgccgccgccgcccggtcaaagccggctttgtgcccgtcccgccgcccccgcggcccaggcgattttaattagcg

SEQ ID NO: 73430 - DNA, 37 bp, Homo sapiens
  misc_feature 1..37: note = chr11:74394860-74394897
  misc_feature 1..37: note = hyper
  source 1..37: mol_type = genomic DNA
ccccattattaatagcgctagccggagccagccctta

SEQ ID NO: 73431 - DNA, 808 bp, Homo sapiens
  misc_feature 1..808: note = chr11:74441835-74442643
  misc_feature 1..808: note = hyper
  source 1..808: mol_type = genomic DNA
ctcccggtctacttacgggctcgagcgtgggagtccagggggaaccagagcagcgcgagtcccagcaaggaggagaggaccctcacctcgggaaccatcctttccccagggtcaggccgctggtccgggagcggagtcgggaggaagggagacgaaaaggacacggaggcacaggggccacagatcaacccacagaccccaggaggtctgctgctagagcggggtcggagaagggccaggaagcagcggtgggcaggaaaggagggcaggaagggaggtctaaggtgggaagaagagaaaggtggaaagagaacgcggggaaaggagggagagatggagagacgaaggaaggtccagcagaagggagaggcgatcaaagaaagggggaaggtgagagggagaggaggagaaagcagggagaggaccggcgtctgccgagcgcgcagcgccgggcgaggcgcgcgggaccagcgggtgttgcgggcgcgcgggctagaggcggccggcgccccctgctcggtgggctcggggtcgggccgcgggggcctggggcccggcggggcggcggtcccagcagcggcggcggcgcggcggccgcggagggaggctgagcgcgggccggctgtgctcgccaagggcttcaggcgccgcgctcgggcgcatttgtactttgccgcgggaagcaggcagcccggcctggcgctggcctagcgctggcgcctcctctggggcaccgcgggctcggtggattggccacccgagaaacaggcccactttttcccctcctctcttgtgcgggtctccggga

SEQ ID NO: 73432 - DNA, 168 bp, Homo sapiens
  misc_feature 1..168: note = chr11:74442705-74442873
  misc_feature 1..168: note = hyper
  source 1..168: mol_type = genomic DNA
cgggccacggggtttaacccctgactccccgcgacgccaagaatgcaggagggcagagttgagggagacctcaggtggaactttcaggtggggaaggctgagctgtcggggctgcgggtaccgggaaggctcagggtaaggcgctcggcggtgcgtgcccggaactcc

SEQ ID NO: 73433 - DNA, 167 bp, Homo sapiens
  misc_feature 1..167: note = chr11:74951632-74951799
  misc_feature 1..167: note = hyper
  source 1..167: mol_type = genomic DNA
aggagccaaacttctcggcagcccggaggggcgggggcggagaggatgaagagaaagcgcagcagccgacagccctgattctcgggagcctcccaccccgcctcccacggcgaggagggcgcggagactccgctgggggcggaggacgagaccgggaggcggggagg

SEQ ID NO: 73434 - DNA, 606 bp, Homo sapiens
  misc_feature 1..606: note = chr11:74952123-74952729
  misc_feature 1..606: note = hyper
  source 1..606: mol_type = genomic DNA
ccaggggctgctgctcgtggcggcggcgctgagccagcccgcggcaccctgccccttccagtgctactgcttcggcggccccaagctgctgctgcgctgcgcgtcgggagccgagctccgccagcctccgcgggacgtgccgcccgacgcgcgcaacctcaccatcgtaggcgccaacctgacggtgctgcgcgcggccgccttcgccggcggggacggggacggcgaccaggcggcgggcgtgcgcctgccgctcctgagcgcgctgcgcctcacgcacaaccacatcgaggtggtggaggacggcgccttcgacgggctgcccagcctggcggcgctcgacctcagccacaacccgctgcgcgccctgggcggcggcgccttccgcgggctgcccgcgctgcgctcgctgcagctcaaccacgcgctggtgcgcggcggccccgcgctgctggccgcgctggacgctgcgctggcaccgctggccgagcttcgcctgctgggcctagcgggcaacgcgctgagccgtctgccgccagccgccctgcgcctggcgcgcctggagcagctggacgtgcgcctcaacgcgctggccggcctggaccc

SEQ ID NO: 73435 - DNA, 389 bp, Homo sapiens
  misc_feature 1..389: note = chr11:74952948-74953337
  misc_feature 1..389: note = hyper
  source 1..389: mol_type = genomic DNA
cgcggacagcggcgccgacgctcgcggagaggaggcggaggccgccggcccggagctggaagcctcctacgtgttcttcgggctggtgctggcactcatcggcctcatcttcctcatggtgctctacctaaaccgccgcggcatccagcgctggatgcgcaacctgcgcgaggcgtgccgggaccagatggagggctaccactaccgctacgagcaggacgccgacccgcgccgcgcgcccgcgcccgccgcgcccgcgggctcccgcgccacctccccgggctcggggctctgagcggcgcccccgggctcggggcttcccttgcctggcccgaagccgtggagatgagacacccgcgagccccgagctctgagaccttcccctgact

SEQ ID NO: 73436 - DNA, 35 bp, Homo sapiens; identical to SEQ ID NO: 43221
  misc_feature 1..35: note = chr11:75100584-75100619
  misc_feature 1..35: note = hypo
  source 1..35: mol_type = genomic DNA

SEQ ID NO: 73437 - DNA, 33 bp, Homo sapiens
  misc_feature 1..33: note = chr11:75140949-75140982
  misc_feature 1..33: note = hyper
  source 1..33: mol_type = genomic DNA
acgtgctccagcaggcgtcgcagctggccgcgg

SEQ ID NO: 73438 - DNA, 660 bp, Homo sapiens
  misc_feature 1..660: note = chr11:75141202-75141862
  misc_feature 1..660: note = hyper
  source 1..660: mol_type = genomic DNA
gcgctaggctgttggcggcgcgcaggcggccctcgagaaagcgcacgcaggcctcgcgcaggcccgccacgcccagccgctccgccagcgccagcacggccgccgcctcgtcctccgcgcgcagccgcacgcccgctccgtacacgtagtcgagcaccacggccagcgccgccgccgccccggccgggctcgtgcctggcgcctcgggagctactggcaccactggcaccacggccgggccgcgctcgggccgcccggccgcgaacaagctgcggaagtaggcgctgcccgcgctgagcgccgcgcggtggcacggaaagtcgcgcccgccggcgcgcagcaccacgtcggtgagggtgccgctccgccggtaggcgttcagggcctgcagcacgcgctgcgcgtggcacggacccgcgcacggcgcttcgcagcccggctccgactcctccggcgcatggccttgccgcatcctgccggggagagaacacaaacagcgtcggggaagccacctggctgcgcccgggagaggcgacagccctcatccgtttatttcctctcttgaccatttgttcagcgactctcccctccgttcagcatccaggttccttacggctacagtgccccagccccgcctcaccagcgcgacattctgccctg

SEQ ID NO: 73439 - DNA, 30 bp, Homo sapiens
  misc_feature 1..30: note = chr11:75146658-75146688
  misc_feature 1..30: note = hypo
  source 1..30: mol_type = genomic DNA
atacggagagcacatcggagacctctacac

SEQ ID NO: 73440 - DNA, 56 bp, Homo sapiens; identical to SEQ ID NO: 43222
  misc_feature 1..56: note = chr11:75152480-75152536
  misc_feature 1..56: note = hypo
  source 1..56: mol_type = genomic DNA

SEQ ID NO: 73441 - DNA, 30 bp, Homo sapiens
  misc_feature 1..30: note = chr11:75160673-75160703
  misc_feature 1..30: note = hypo
  source 1..30: mol_type = genomic DNA
aagggagaccagtaacgcccagctctgccc

SEQ ID NO: 73442 - DNA, 30 bp, Homo sapiens
  misc_feature 1..30: note = chr11:75163174-75163204
  misc_feature 1..30: note = hypo
  source 1..30: mol_type = genomic DNA
gaggaggtggaaccccgccttgcagaggtg

SEQ ID NO: 73443 - DNA, 49 bp, Homo sapiens
  misc_feature 1..49: note = chr11:75221046-75221095
  misc_feature 1..49: note = hypo
  source 1..49: mol_type = genomic DNA
gcagagctccctccccgtgctaagctgcagcatgcgctcaatgccactg

SEQ ID NO: 73444 - DNA, 30 bp, Homo sapiens
  misc_feature 1..30: note = chr11:75229378-75229408
  misc_feature 1..30: note = hypo
  source 1..30: mol_type = genomic DNA
gggaggaagcagcctcggaaggaatgagct

SEQ ID NO: 73445 - DNA, 247 bp, Homo sapiens; identical to SEQ ID NO: 33966
  misc_feature 1..247: note = chr11:75294375-75294622
  misc_feature 1..247: note = hyper
  source 1..247: mol_type = genomic DNA

SEQ ID NO: 73446 - DNA, 94 bp, Homo sapiens
  misc_feature 1..94: note = chr11:75294662-75294756
  misc_feature 1..94: note = hyper
  source 1..94: mol_type = genomic DNA
cgggtggggagcctcccattccagagaccccccgactccctgcccctcgcggcgtaggggcgccctttctgcggcgccgcggggccgtcctctc

SEQ ID NO: 73447 - DNA, 848 bp, Homo sapiens; identical to SEQ ID NO: 33968
  misc_feature 1..848: note = chr11:75378401-75379249
  misc_feature 1..848: note = hyper
  source 1..848: mol_type = genomic DNA

SEQ ID NO: 73448 - DNA, 828 bp, Homo sapiens
  misc_feature 1..828: note = chr11:75379282-75380110
  misc_feature 1..828: note = hyper
  source 1..828: mol_type = genomic DNA
cggcggggcgcccgggtgctcggtggcctccgagtacttggtgaaaaccagcggcacagcgatgtccgctttgtccaactggttccagaagcgggcgatgcagcaggccctcgtgatgcacggccacgccatgatgctagctgaaaagccggcctcctctttcttcttgtggttctaaagcaagtctctataatcttccttcagcctccgatcctgaccggccaatgtggttcccaccgttttctacccccgatcagccggagctagttcgccctcctccctcagcgagcacccggggagagctgtcctaggagagtctgtagagtccctcgattaccggtcgcaaacgcctttgggagcgcagtctgctgcgagcgccgaagggtgagacgcacggcgttcccgagtccccggcgagggtgtctgggacgcgcccctccctgcggctgcggcggcgcacagacctcggtcgagcgaggcgacgtgaggagaggtggctacaggcttaagccatggcgcagaggaggggccgggcggtgtggccgcagggtccgcggaccgggctcgagtctccttcctgccggcgtcctagtgcagccggccacctagcagggctgggaggccatcacctccagcggagaccgagcattgctgcctccgccgctgcccgcgaggatgccgcagccgccgccgccaccgcctcttctcctgggaagcgaccccacccttttctgcagctctcggtctccgccgctgcccgcgaatgatgctgcagccgctgccgccgccgcctctgcctctgctgcagggaagcggccccaccctttt

SEQ ID NO: 73449 - DNA, 55 bp, Homo sapiens
  misc_feature 1..55: note = chr11:75428929-75428984
  misc_feature 1..55: note = hypo
  source 1..55: mol_type = genomic DNA
cagcatggtagagttcgcgcccttgtttatgccgtgggagcgcaggctgcagaca

SEQ ID NO: 73450 - DNA, 91 bp, Homo sapiens; identical to SEQ ID NO: 15601
  misc_feature 1..91: note = chr11:75459473-75459564
  misc_feature 1..91: note = hypo
  source 1..91: mol_type = genomic DNA

SEQ ID NO: 73451 - DNA, 718 bp, Homo sapiens
  misc_feature 1..718: note = chr11:75863175-75863893
  misc_feature 1..718: note = hyper
  source 1..718: mol_type = genomic DNA
aaaactggatagattcgtcttggtgtgttgagtgtccattttacagaggaagcagttgggacccggagaagttagtcttggctaagttcacagagctaaaaagtgacagagctaggacttgaaatcaggacctttgagtcacgtctctgcctgacctcagccctgcgggccccgttcccgccattccttcctgcctctcacgttgactgggctccccctgtcggtcggcactggctgaacagccatggagtggcgctttggggaaaccacgggcgaccaggaaagatctcaggcaagcctcgggtaagtgagctgtaaactgagacctgaacccagacacagcccatgccaggccgagcgaagagcctgtgcaggggcttggagtagagaagagcacggctcctgtgaaggattcagaggctggagctgggcgatgggccaccgcgcggaggaggcgcgggcggtggtccgagttcctcaagggatctacagacggcgcccctcctacccagggtgtttcctgatgattgtattttgtatttcagcgttgatgattttttttttcactacttcaccccctcccaaacgcccaaaactgcctggtgattttttttttttttttcaaagtgcatcctgacccctctggctgcctccatagactcagctttagtcccggcccatcctgctggcacaaggaagccaccgcatgtgatggggt

SEQ ID NO: 73452 - DNA, 30 bp, Homo sapiens; identical to SEQ ID NO: 43224
  misc_feature 1..30: note = chr11:75879446-75879476
  misc_feature 1..30: note = hypo
  source 1..30: mol_type = genomic DNA

SEQ ID NO: 73453 - DNA, 30 bp, Homo sapiens
  misc_feature 1..30: note = chr11:75921359-75921389
  misc_feature 1..30: note = hyper
  source 1..30: mol_type = genomic DNA
aaaggtatggaggagcgcttggtttgctta

SEQ ID NO: 73454 - DNA, 320 bp, Homo sapiens
  misc_feature 1..320: note = chr11:76032896-76033216
  misc_feature 1..320: note = hyper
  source 1..320: mol_type = genomic DNA
tgccctgcccatgcccgccccacaaggcccacgcttgcgccctcgggctgcgcagggcgagggtttgggggcgcggtactgacgggtgtccaggcctctcctcgaagggttccgcgcgcagaaaggtgggccggggccagaagacgcgctggaaaggcgttttctgccccctccgggcctcgggaatatttgtgggctgccggcggggcaggcggggtgggggaggctgcccggcgggcgggaagccccgcgcactcgggtcccctgcggtccccggcgggggtcggcgcgtgcggaaagcggcccgagcccccaacctc

SEQ ID NO: 73455 - DNA, 38 bp, Homo sapiens
  misc_feature 1..38: note = chr11:762939-762977
  misc_feature 1..38: note = hypo
  source 1..38: mol_type = genomic DNA
tctgggatgaggtgacggcctggcgcaagagcacgggc

SEQ ID NO: 73456 - DNA, 716 bp, Homo sapiens
  misc_feature 1..716: note = chr11:763302-764018
  misc_feature 1..716: note = hypo
  source 1..716: mol_type = genomic DNA
cgccctcacctgccccgccctcacctgtccccgccccgcagggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggtgagggtccctctgtggtaatggggtaaggggagcagcctcagcagcacctcaggcaggaagagcccgagacggagctgccgcatcaacaagcagtgaggtgcacaggtcggcgcggggcaggcaggggtggcggctcaaggtagtgcagccggcaggcactgggagggcaggtggggtggtacctctgccgaagccttcctggtcacagcttggtctctttccaggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcgggtgaggccccactgcccagctgtggctcctgctcgggcaaggccagcactgccgtgccacgctgccctgtgggt

SEQ ID NO: 73457 - DNA, 609 bp, Homo sapiens; identical to SEQ ID NO: 43225
  misc_feature 1..609: note = chr11:76371627-76372236
  misc_feature 1..609: note = hypo
  source 1..609: mol_type = genomic DNA

SEQ ID NO: 73458 - DNA, 243 bp, Homo sapiens
  misc_feature 1..243: note = chr11:76382021-76382264
  misc_feature 1..243: note = hyper
  source 1..243: mol_type = genomic DNA
gggttgcagaggaagcgccgtgggagcgaggcccatcccagcggccgccgcacgtgcagttcgcggccccgcggggtccggaggggggcgcggtggctctaggagccgcaggtccacagaggaaatccggcctggccccgatttcccagctgctggcgccgccgcacttaacgcgggggcaaacaggcgaggtgacggcggggctgaatgcggaaggaaatgacccttcgctggccctggggc

SEQ ID NO: 73459 - DNA, 77 bp, Homo sapiens
  misc_feature 1..77: note = chr11:76510624-76510701
  misc_feature 1..77: note = hyper
  source 1..77: mol_type = genomic DNA
ccctggcgcccagggcgagggcttcgaatcttacacaatcaggaaaattcgtgcaaagaatccgttttggaattcac

SEQ ID NO: 73460 - DNA, 21 bp, Homo sapiens
  misc_feature 1..21: note = chr11:76571168-76571189
  misc_feature 1..21: note = hypo
  source 1..21: mol_type = genomic DNA
cccagacgggggctgggagta

SEQ ID NO: 73461 - DNA, 282 bp, Homo sapiens
  misc_feature 1..282: note = chr11:76902405-76902687
  misc_feature 1..282: note = hypo
  source 1..282: mol_type = genomic DNA
acctgagggaaaacccagcagtaggatgtcctcagtcctgtgtcctcaggcccagtgaatcctctcctggtgctgaaggaagagcatggcacaggctgatgggagggctgcgcagcccttgtgtgcagatgggaatggaattccctctcaggttgccacggcatctgatggagaaactcctcagcaaacaggagttccttcacacttgccctgaagcagctggagtgtgggcgtcccgcagactcacctcggaggctggagcctcctcggctgagcgggacc

SEQ ID NO: 73462 - DNA, 18 bp, Homo sapiens
  misc_feature 1..18: note = chr11:77025115-77025133
  misc_feature 1..18: note = hypo
  source 1..18: mol_type = genomic DNA
aaaaatatttaaggccgg

SEQ ID NO: 73463 - DNA, 154 bp, Homo sapiens
  misc_feature 1..154: note = chr11:77116020-77116174
  misc_feature 1..154: note = hypo
  source 1..154: mol_type = genomic DNA
aatatgagggggaggcgcatgcatggggcatggtacataaaagaagataatcaagacaggcttctctgagaaacagttacttaagacctcatttaaatgagacagcaaatcatagtaatatctggaaaagcattttaagcgaaggagtaataag

SEQ ID NO: 73464 - DNA, 40 bp, Homo sapiens
  misc_feature 1..40: note = chr11:77186167-77186207
  misc_feature 1..40: note = hypo
  source 1..40: mol_type = genomic DNA
caaaattgcttcttacgttcctttccgttctcaatgaatg

SEQ ID NO: 73465 - DNA, 41 bp, Homo sapiens
  misc_feature 1..41: note = chr11:77301363-77301404
  misc_feature 1..41: note = hyper
  source 1..41: mol_type = genomic DNA
ggggggcatgtcccccgagacgggtgcggtgaggctattgg

SEQ ID NO: 73466 - DNA, 94 bp, Homo sapiens
  misc_feature 1..94: note = chr11:77309684-77309778
  misc_feature 1..94: note = hypo
  source 1..94: mol_type = genomic DNA
ctactcttccttccacggtaatccttgtctctgatgtttgtgttacaaccttccaaactggttgtttttgttgttgttttttgggtttttcttg

SEQ ID NO: 73467 - DNA, 101 bp, Homo sapiens
  misc_feature 1..101: note = chr11:77534272-77534373
  misc_feature 1..101: note = hypo
  source 1..101: mol_type = genomic DNA
aaaaaaaagaaattaaaatcctacttcaggaaaatatctttatggttatgaattatcactgccaaagaagttttaatttaataagtcggaaaatattgttt

SEQ ID NO: 73468 - DNA, 443 bp, Homo sapiens
  misc_feature 1..443: note = chr11:782133-782576
  misc_feature 1..443: note = hypo
  source 1..443: mol_type = genomic DNA
tgaactggccagagacgtcagacgtggtacatgccggcctctgtggcctggaggggcttgcaacaaggaggcaggccctgtcccaagctggcctagcctagtgtccaggacatggaggacagggtgcagcagccccggggaggggtggggccgttccctcccaagcacacttctggagctgctgcagtcgggggtgaccctaacctaccttgtgccttccttcccatgtgccggggcgggtcccacacacctctctcctgccccgactggctcccacctggggcacgcagttgggcaacccaggccctgctctgcccgtcgagcctccagggcaagtgcaagctcagcctgggcctggagacggcggatcggagcgtgtccaggtgctcagggactggtcaccgaaaggcaaggagccctccctgggacgagggagacaccca

SEQ ID NO: 73469 - DNA, 30 bp, Homo sapiens
  misc_feature 1..30: note = chr11:78262164-78262194
  misc_feature 1..30: note = hypo
  source 1..30: mol_type = genomic DNA
gtcctcaaattagaccgtggtgattggctg

SEQ ID NO: 73470 - DNA, 30 bp, Homo sapiens
  misc_feature 1..30: note = chr11:78369244-78369274
  misc_feature 1..30: note = hypo
  source 1..30: mol_type = genomic DNA
ccctctgtccaggcccgcaggccttcctcc

SEQ ID NO: 73471 - DNA, 30 bp, Homo sapiens
  misc_feature 1..30: note = chr11:78381201-78381231
  misc_feature 1..30: note = hypo
  source 1..30: mol_type = genomic DNA
aggggcccaatctgacggtagcggatggtg

SEQ ID NO: 73472 - DNA, 162 bp, Homo sapiens
  misc_feature 1..162: note = chr11:78387174-78387336
  misc_feature 1..162: note = hypo
  source 1..162: mol_type = genomic DNA
cacctccagaggcctcgctcacccgcagccggcgcccaaagacagtgacctggccccgagcctgctctttgcgctggcgccactccaccaggttgaggccgttgtcgatgggcagcgtgacattcctcttgcccacggtggggttgacggtgccagccagca

SEQ ID NO: 73473 - DNA, 427 bp, Homo sapiens; identical to SEQ ID NO: 33973
  misc_feature 1..427: note = chr11:78672891-78673318
  misc_feature 1..427: note = hyper
  source 1..427: mol_type = genomic DNA

SEQ ID NO: 73474 - DNA, 181 bp, Homo sapiens
  misc_feature 1..181: note = chr11:787323-787504
  misc_feature 1..181: note = hypo
  source 1..181: mol_type = genomic DNA
acagtgtgtgacggtcgccgccaaaagcagttctactctacctgttattgcattatacgctggttagactcaggtggtgctgggtgcaagctggaggggcagtctagcggggcagggcgggcacagctgtgaggggccctcgacatccctgcctccccgccggcgtcggggctcccctgga

SEQ ID NO: 73475 - DNA, 30 bp, Homo sapiens
  misc_feature 1..30: note = chr11:78775970-78776000
  misc_feature 1..30: note = hypo
  source 1..30: mol_type = genomic DNA
aggccaatgtctgtccggtacagggtcccg

SEQ ID NO: 73476 - DNA, 188 bp, Homo sapiens
  misc_feature 1..188: note = chr11:7905970-7906158
  misc_feature 1..188: note = hypo
  source 1..188: mol_type = genomic DNA
acgaagtgggaggcccggatctgtagccactgatccggttgttgcagctgcacctgggagggtggggctcctgcctgttccatgaagcaggaggcccaggtctacagctgcagtgtgggtagctgcagggcaccctgggagctccaaccccaactcggaacaggcagggctcccgcttgtccaaggat

SEQ ID NO: 73477 - DNA, 33 bp, Homo sapiens
  misc_feature 1..33: note = chr11:7909927-7909960
  misc_feature 1..33: note = hypo
  source 1..33: mol_type = genomic DNA
aagtgttgggattacaggcgtgagccaccaggc

SEQ ID NO: 73478 - DNA, 135 bp, Homo sapiens
  misc_feature 1..135: note = chr11:79148413-79148548
  misc_feature 1..135: note = hyper
  source 1..135: mol_type = genomic DNA
agcgcgctgtgagtccgcaggaacgcggccgggccggggacgggagaaaggcgcggccgggaccctgcactgtgccgcgcggcgcttgcggctggaacttggcctggaacgcggtcttctcggctccagtttccc

SEQ ID NO: 73479 - DNA, 204 bp, Homo sapiens
  misc_feature 1..204: note = chr11:79148811-79149015
  misc_feature 1..204: note = hyper
  source 1..204: mol_type = genomic DNA
ccgcgacctgattcccgccctgcccggggagctaacccagccgcctccggggcgccctccttcttcctggattcccacggctggaccagagcccctctggcagccgggttaaaggctccttcagcaaggtcaaggcgcggccggctggcacctggggatttttttccagccgagcactggcttttcaatcgcattgttaaggat

SEQ ID NO: 73480 - DNA, 621 bp, Homo sapiens
  misc_feature 1..621: note = chr11:79149239-79149860
  misc_feature 1..621: note = hyper
  source 1..621: mol_type = genomic DNA
cttcagcgttccccacggctgtgtcagggctggggtggcttatccccctacagacgaaaatcaagatttaaaagcatactcttactgtggtttctctatcaaagcccatcaacgtgatacacaggctgcggcgctggagggaagcggcgaaacggggagaataaacgcaacagaagcaaactgctgtctgcagaggcgagaggcgaaggaacggaagccatacccgaccccagccccatcccgtccccatcagcgccgggctagcgcaggaaaccaggaataggtgtaggtaagggtggcagcccggcagagccagcgttctactccctctaacccctcgccagcgtgggcctggatggctgggctgcctgggcatctccaagggggaccaggcaccgcgggcaggtttctaaacacgtgaagggcacagggcttgaaagacaaggaggggcgcccaggaagggcggaaaagaggggctttggggctccccaggacaccaagtcagtttctgaaaacggcgttccctggaaggccttccaacacctccgagggaagacttggagctctgaagacccaatgaaacctcagttctgactgactcctcctctgcgatcaattcc

SEQ ID NO: 73481 - DNA, 475 bp, Homo sapiens
  misc_feature 1..475: note = chr11:79149861-79150336
  misc_feature 1..475: note = hyper
  source 1..475: mol_type = genomic DNA
gatgcccccacttagtccctgcctcggtaaccggttctttggggacagcagcatcagcacccgacgcccatcgcacaagtgggcgccgtggtgcgaggcgtatcctagctacccaggccggggtgggggcgccccggtacttacactccccaagcaggcaaactttcaggcttgtctttcgagaaccgggagctcgcatcacagttccgggtaatcaccgaggcagcttatgtaattgcccgcgatgccgctcagcagatctctctccttactcggcctcagagctcagtacatgggcaccctcttccccccaccccccaccccggcgattggaatcccgagcttgccccaccaccgccttctacaaagcagcggggtgatctcgtgtgctacaaacaccaagccagtatgcaggttcaggcaaaactctggctgcctccctgcgcccctttcactgcgtcgatggtttacagat

SEQ ID NO: 73482 - DNA, 1801 bp, Homo sapiens
  misc_feature 1..1801: note = chr11:79150674-79152475
  misc_feature 1..1801: note = hyper
  source 1..1801: mol_type = genomic DNA
tggttgtgtattcctcggttgcgtgtgtgtgtccacacacacacacacacacacacacacacgccgccccactaccttccagtctgctcctccaatgtaacgaccgcatttaaaaatggcaattaaaatgactgaggagctcggtgatcacatttcaacccagagcacatttcccgaagctgggggtgagagtagtcatacagtcacactcacacccgggagccctccaagcgtccatctggcggctgcagcctcagttggctcctagacgaacatcaataccgcggccgggcgcccggtgaggagaggcgggcgccccgcgggttgcagagggcgaggagctggggtcgcatctccaggatctgagctccaaccaccgcccgtgcggggctgctgcagccggcacttgccccgcagggcaggctgcagccgctgaagcccggcgccgcctcgcgggctcctccagcgcccgacgggggcctggggcgagctagtctgcagaggggctgcaggcgaccgggccggggcggggaacgggatccgggagaggcagacgaacctggggcgcgccgcctccctcccacccgcttcccacctccctgccctcccccaacccttgctcccaggctccagtccgcggcgggctccgggggctgcggcggctccaggctccagaacagcttgcctcttcggccacccgcgccctagcctccctcctcctgggccaggggagcaagcaaacatctcccggagccctcggcagccgcgtgagctacccgaaccctgcccgggccagcagtgcagagggcgatggagctggcgaggcgtcgccgcggtccccaaggcgcttttccgtagagcggatcacgccgccttaccgtggctgcaggctgctaccgccggggaagcggcgaggacggcggcagggaggcaaggcgccgcgccggtggctcctctctctctcggcggcgcggctcctctgctccgcgagccgtagcggggcgcccaggaaggagcaggtccgggctctgcgctcagctccagcgagaccaacaatagctcccgcggggagcggagccccagcgagcctccagccgcgcgcgcacgaccggctcccgctcccggccgctcccggccggcgtccctgccagcactgctgccccacatgaaacagctgcaatcccgaggcttctggggggttggggcgggtgtgtgcgcgcgcgtgtgtgagtgtgtgtgtgtgtgtgtgtgtttaatagcttcccttctcttcttcccctccctgcctgctcgcctgcctgcctccgtcccccaccctcgctctcttacacacagaaagagagggcgagcgagagagagacacacacacacacgcacacgcacacgcaggttacatgaatgggaggcggtagccaatcctacgaggccggcgagccgcgcggcgcactggcgctgggagcagggccgcactccggcgcgggggggcgccacgcaggtgatgggcgcctctccgggggccacgcgcggccgctccctcaccccagtctcggttcctctgtctccttcccccttcctctccgccgccttctccatcttctctccttttacctcctttgctttctcgagttctccgagctctctcagttcggtatctttctggtctctttcttcttttaccctccttgcttgctttctcttcccctttctgaaactttctcttttcctttctggactttcttgtacttcctctcctcttgccttttgttctttcctcctcctttggctttctctccaggctccc

SEQ ID NO: 73483 - DNA, 15 bp, Homo sapiens
  misc_feature 1..15: note = chr11:79152508-79152523
  misc_feature 1..15: note = hyper
  source 1..15: mol_type = genomic DNA
cgcctttccctgggt

SEQ ID NO: 73484 - DNA, 151 bp, Homo sapiens
  misc_feature 1..151: note = chr11:79152734-79152885
  misc_feature 1..151: note = hyper
  source 1..151: mol_type = genomic DNA
taacagctactgagtcgtgataacaatcacttaaaaaatagcagtgattgcggtccaagagatttctgtccctcgaatgtttggatcgtgatggcaagcacatttccaagagaagggcatttttatgtgatgagagcggtagtttgactga

SEQ ID NO: 73485 - DNA, 41 bp, Homo sapiens
  misc_feature 1..41: note = chr11:796141-796182
  misc_feature 1..41: note = hyper
  source 1..41: mol_type = genomic DNA
caccgacccccgctccgccacctgcccgctggtcctgctct

SEQ ID NO: 73486 - DNA, 290 bp, Homo sapiens
  misc_feature 1..290: note = chr11:8040261-8040551
  misc_feature 1..290: note = hyper
  source 1..290: mol_type = genomic DNA
gaagagaggaggggacggtggtttcaagacttccaccctggggaagaagggacggggagacggcgggaatctaggaaattgggggatggctatttccattcctgagaaggggggaacttgattgtgggaggttggctgaagactcccacgccggaaaggagggcgcctctgcggaagggccccgagtggcgacagcggatccgggactcccaagcaagcaggagccggagcagcctcttagcaacccctgtcccgggaaggtttgaaagcagcggtgccctagtgacgcc

SEQ ID NO: 73487 - DNA, 30 bp, Homo sapiens
  misc_feature 1..30: note = chr11:804039-804069
  misc_feature 1..30: note = hypo
  source 1..30: mol_type = genomic DNA
agaggcagggcagagcgagagatggagaca

SEQ ID NO: 73488 - DNA, 12 bp, Homo sapiens
  misc_feature 1..12: note = chr11:8040552-8040564
  misc_feature 1..12: note = hyper
  source 1..12: mol_type = genomic DNA
gaaaagatggag

SEQ ID NO: 73489 - DNA, 195 bp, Homo sapiens
  misc_feature 1..195: note = chr11:8040581-8040776
  misc_feature 1..195: note = hyper
  source 1..195: mol_type = genomic DNA
cggagcacacctcggaaataaataaataagcgcccaggctgccgcagccgcgcccccgcgggacccgagcgagggggagggggcctcacgggcccgggtccccgcagtcgcgcgtccccgccattggcagagccggagggggtcaccccccggggggcgaatggtacagtcctccgcccgcgcctcggccgggcc

SEQ ID NO: 73490 - DNA, 189 bp, Homo sapiens
  misc_feature 1..189: note = chr11:8040960-8041149
  misc_feature 1..189: note = hyper
  source 1..189: mol_type = genomic DNA
cgggagaagcgggcctccgggggctaggactggcgcgagcgcccgacccccagggtgggcttgggcacccggaccctcgggcatccgggacccagagcctcgggtacggcgcagcggagctccagcgagggtagtgtccccacacccacggggcagagctgtcggaggagggcacgcggccactgggac

SEQ ID NO: 73491 - DNA, 108 bp, Homo sapiens
  misc_feature 1..108: note = chr11:8041493-8041601
  misc_feature 1..108: note = hyper
  source 1..108: mol_type = genomic DNA
gccccgcggggatggcgagcggctgccggcgtgggcggtttggagctgcgctccccacgcactcgtcctggaggaaggagtcatcctcccaggcgaaatgaaaaaaat

SEQ ID NO: 73492 - DNA, 594 bp, Homo sapiens
  misc_feature 1..594: note = chr11:8102561-8103155
  misc_feature 1..594: note = hyper
  source 1..594: mol_type = genomic DNA
ctggcccggctgcagcgccgccgttagccgaaggtgggagccggcgcggtcacgcgcatggagcgtggatcgcgacgatttcgggggagggggcaagggcgctccgcaggccctgagccggccggggggtggggtctctgcggggcggggcggggcggggcgagggagaaggggcaggccgccgctgccacgcagtactcccgccttggcgccagaggggcgcgggacggtgcggtcggcctccccgcctccacgcgcgcgcacgacccgcgcactcccggagcttcgcccatctcgcctcgccgcgccgcgcaggcagccgctcgcagagccagcagccggggccctggcgtgcagcgcgggcctcggcggggcccagcgccccggcccgggaggatgcggcccggggcggcccgggagctgagcagggcccccgcgccggcccctccgggccccggcctccagagccgcagccaccgccccgcccccgagagacatgacttccaagccgcattccgactggattccctacaggtacgcgggcgccgggccggggcgcccaccactcccgactcgggacgtgagctggctggg

SEQ ID NO: 73493 - DNA, 24 bp, Homo sapiens
  misc_feature 1..24: note = chr11:81697887-81697911
  misc_feature 1..24: note = hypo
  source 1..24: mol_type = genomic DNA
agaattcaagcatggcgtgggtgg

SEQ ID NO: 73494 - DNA, 820 bp, Homo sapiens
  misc_feature 1..820: note = chr11:8189946-8190766
  misc_feature 1..820: note = hyper
  source 1..820: mol_type = genomic DNA
gttgaaaaaacataacgacttaaggtttgctgtaccaattccatttgccttgatttcgtaccaagcggcgcgtcagaaagtacacggaaaacctaaagagggaaacccaactgggaacccttgactcaaagcacgtgaacaaatggtgacgagatgagttaagccagcggggtaagagagaagggactgcgcctaaacgggagtacgcaaggccacctagaggatgcacagacctgcatgcatacgttcctgacccttccagcagcagaaccatctgggccgccacccgctgataacaacggaaccgtgggcattggcccttcaacgccgtctcgcccgccctctccagtcagtttggtggatatttcggtgaaggctgcagactctcagagtcacccctccctcaagcagcgttctccgtactcttcggcgccgggaagctcagagggagctggcctgctcttaccttcaggtgtcggcggcggctcctgccgcttcccgcgggacaggaaggccttgggcagcagcagcgacagagccaggacaagcccagaagccagagcgactctctgcactgtggagtacgccatgactgctcacggtggtcgcaggtgcagacgccagccggaaccggaaccggaaccggagcacgggctgccgctcccgaccgaaccgcgggcggcgcggacggcgtcgcgcgagggacaaggtgcgcgaggcgcacgcatcttcacctccactgtcgggagttgacctgctcctcccgcgtggttacccgtcgctgtaaatggtaccctcgccttcccgttcatactaacta

SEQ ID NO: 73495 - DNA, 30 bp, Homo sapiens
  misc_feature 1..30: note = chr11:8213825-8213855
  misc_feature 1..30: note = hypo
  source 1..30: mol_type = genomic DNA
ccttaggcagattggcggcagcacttccat

SEQ ID NO: 73496 - DNA, 44 bp, Homo sapiens
  misc_feature 1..44: note = chr11:82214275-82214319
  misc_feature 1..44: note = hypo
  source 1..44: mol_type = genomic DNA
ctatcttttaccagtcatatgaccttggtcggttattcaaattc

SEQ ID NO: 73497 - DNA, 30 bp, Homo sapiens
  misc_feature 1..30: note = chr11:823464-823494
  misc_feature 1..30: note = hypo
  source 1..30: mol_type = genomic DNA
attccaggggcagaacgggcatccctggct

SEQ ID NO: 73498 - DNA, 104 bp, Homo sapiens; identical to SEQ ID NO: 42855
  misc_feature 1..104: note = chr11:823903-824007
  misc_feature 1..104: note = hypo
  source 1..104: mol_type = genomic DNA

SEQ ID NO: 73499 - DNA, 190 bp, Homo sapiens
  misc_feature 1..190: note = chr11:82443379-82443569
  misc_feature 1..190: note = hyper
  source 1..190: mol_type = genomic DNA
ctggtttcatctccacgtgcattttcccatcgttcttcagatttaggagaaacccacggaggcgcggcgctctccacagccgtctctaatgaagggaagcgtgcctcgaagtcagtcccggtgcgccccctcctcccccggcgccccttcccaaaccccgtcggatctccaaaggctggaataggcggtg

SEQ ID NO: 73500 - DNA, 1541 bp, Homo sapiens
  misc_feature 1..1541: note = chr11:82443651-82445192
  misc_feature 1..1541: note = hyper
  source 1..1541: mol_type = genomic DNA
cgaaagaggccaaatggccccgcccgtcctccccgccgggagaatccgcagcggcggggtacagggggctcaagggctcgttcaaggtcaagccgccgcggggggcagtcagggggctctttttggtcggggagcagcccgggacgctccagggctcggggtacagtaggtttcccaccactgccggcggcggctcaaagaggccgggctccagctccgggggtccccgcagtacggaggctccggcggggaacacgtcgagaggctcggcggcaagcaagactgccgcctccgtgccggcgccgtagtcgggccccagcagctcaaagaactccacggcctccgcgcccttctccaggtcgcccaagctcacgtccggccccgacgggccacacccgccgccgcctgcccgggacggctccgtgaagaaggacggaggcagattgcgtgcccgcagcgggaccttcctggcccctgggatcgccgtggcccccgcggggcctgccacgtcccctcccgcgcccccagtgcccgcacctcctagcccggccgccggcgcagccacctcaccccccgccggctcggcacccccggggacgtggcgcagcgagtcgaagagcgcggccagacttcggctttgcaagctggcggccgcggcggcctgcgacgcctcccgccggggggcagccttgccgtgggccggggccgcgactgtcggggcgctaggggcggccagcggccgtttggctggcgtgtcggcggcgctcggggagggcgggccggggggcgcggcgcccatgaggccgctgcagcgcttgatctgcttctgcaggtacttgcggtggttcaccttccgcttcgacttgcccggcttgtccagcgccagcttgatgttgctggacgccgagtcaatgaagctgagtagatcgcgggtggcctcgcgcacgtcccctccttcggctcccgacagcagcgcacccgccggagccccggtctcatcgtcctcgaaacagcagcccttgtccagggctccgaaggcgccccctagcccgtccggggagcccccgaagccgaagggcacgaaagggtgcgtgctgaggagcgccgcctgcaccgccatcgccgcggctcccgggctgtccgcagcgctgcccgtgcgcccccgccagctcctgcccgccgcccagacccagctcccgccccggcgcggcgcgcgcggcgcagcctactagttccgggcctggctcgctgcgctgcctcccgggggagctcattaggtcttgtaagcaaggggcggagggagggagcgcgcggcgaccgtcccggtggtagaggggaggggcttacttagcctggcttggaggagtggggggtcgctttagttttctgagctttctgaagctcaacgccttaactccttcgtttccctttgccccgtggtgtttctcttgactcctctaaccgcaaggggtgaggaagagatggctggtctcaaactccagttcaggcccatgaggccgctgcagcgcttgataggcttc

SEQ ID NO: 73501 - DNA, 156 bp, Homo sapiens
  misc_feature 1..156: note = chr11:824828-824984
  misc_feature 1..156: note = hypo
  source 1..156: mol_type = genomic DNA
ggcccggcccgtgatcggggccctggggctgtgagaccccgaccctctcgaggaaccctgcctgagacgcctccattaccactgcgcagtgagatgaggggactcacagttgccaagaggggtctttgccgtgggccccctcgccagccactcacc

SEQ ID NO: 73502 - DNA, 87 bp, Homo sapiens
  misc_feature 1..87: note = chr11:8284225-8284312
  misc_feature 1..87: note = hyper
  source 1..87: mol_type = genomic DNA
tctgggccaaactcccgcctccgcgctcagagagacagggagctagcgggccggcacaagaggcggctctctttctcaccgagtcac

SEQ ID NO: 73503 - DNA, 32 bp, Homo sapiens
  misc_feature 1..32: note = chr11:8284313-8284345
  misc_feature 1..32: note = hyper
  source 1..32: mol_type = genomic DNA
ctcatgcagatgtcccccggagggtccaaccc

SEQ ID NO: 73504 - DNA, 393 bp, Homo sapiens
  misc_feature 1..393: note = chr11:8284568-8284961
  misc_feature 1..393: note = hyper
  source 1..393: mol_type = genomic DNA
gggagccccagcctccgcgcggccccgcggcgcagcacacggccagtgcacagctcctcggctcgcggccgggacccggggggcgtgcggccccgggcgcgtgcagcccggggctcgacctcctccccccgcaagttccgcccggctgtcccccggtacttccccccgccccagccccggcccccagcgcgccgcccgccccgcaatccccgcacagcccagcaggtgtgcgcccgtgtccccgcgtgtgtgtgcctgcgcgccgcggcagggggcgagggggtgaggggcgtcgagaccccggcccgccacctaccgtcctccttgtccagcaccatcatctcgggcgctccgtgtccagccgcagctaggctcggccgggagaagggcgcc

SEQ ID NO: 73505 - DNA, 84 bp, Homo sapiens
  misc_feature 1..84: note = chr11:82851824-82851908
  misc_feature 1..84: note = hypo
  source 1..84: mol_type = genomic DNA
gtgagccaccacgcccggccaggaggggtgctttctaattgctacccttagcactcagggatgttttctcggacctcacccaga

SEQ ID NO: 73506 - DNA, 447 bp, Homo sapiens
  misc_feature 1..447: note = chr11:8289527-8289974
  misc_feature 1..447: note = hyper
  source 1..447: mol_type = genomic DNA
caccccgctgggatccgttccgcagtagggtgcggaaggggaacgtgcagacacccagagaggctgggagactggctggcagtgggcactgccgggaagcccgcggtgcgggtcgcagaggcgctccggatgcccgcaaggcggcaagagtccgtgagaaagttcccagccggagcgcgcagggctggcggcctcgttgggaccgggagacttcctaatcccgccgccgccgaagcccgggcgctgagcctggcaccgccgaccccggcaccggcgcacacatcagccgccgcgcttccgggaagccacccatcagccggaggaggcccgcgggtgctgagggctctgccgccgctagcggggtggactccgcagggccagcgccgcagtctccgccccacgtcccgcgtgcccccgggcaccggcaccgggcgccgggcacctacc

SEQ ID NO: 73507 - DNA, 46 bp, Homo sapiens
  misc_feature 1..46: note = chr11:8289975-8290021
  misc_feature 1..46: note = hyper
  source 1..46: mol_type = genomic DNA
tcctcctggtccaacaccatggtcccgacggctccagccggactag

SEQ ID NO: 73508 - DNA, 366 bp, Homo sapiens; identical to SEQ ID NO: 33622
  misc_feature 1..366: note = chr11:8290057-8290423
  misc_feature 1..366: note = hyper
  source 1..366: mol_type = genomic DNA

SEQ ID NO: 73509 - skipped

SEQ ID NO: 73510 - DNA, 30 bp, Homo sapiens; identical to SEQ ID NO: 43229
  misc_feature 1..30: note = chr11:83561479-83561509
  misc_feature 1..30: note = hypo
  source 1..30: mol_type = genomic DNA

SEQ ID NO: 73511 - DNA, 104 bp, Homo sapiens
  misc_feature 1..104: note = chr11:84431431-84431535
  misc_feature 1..104: note = hyper
  source 1..104: mol_type = genomic DNA
aggggacattccttccgggctgcggcagtggcagctcgctgggggacccaaacgctgtgctcgccgggcacatggagcgacagcctagaccgagctgccgcttc

SEQ ID NO: 73512 - DNA, 164 bp, Homo sapiens; identical to SEQ ID NO: 33989
  misc_feature 1..164: note = chr11:84431536-84431700
  misc_feature 1..164: note = hyper
  source 1..164: mol_type = genomic DNA

SEQ ID NO: 73513 - DNA, 316 bp, Homo sapiens; identical to SEQ ID NO: 33990
  misc_feature 1..316: note = chr11:84431954-84432270
  misc_feature 1..316: note = hyper
  source 1..316: mol_type = genomic DNA

SEQ ID NO: 73514 - DNA, 45 bp, Homo sapiens
  misc_feature 1..45: note = chr11:84578824-84578869
  misc_feature 1..45: note = hypo
  source 1..45: mol_type = genomic DNA
taataattatggggccggacgtggtggctcacgcctgtaatccca

SEQ ID NO: 73515 - DNA, 30 bp, Homo sapiens
  misc_feature 1..30: note = chr11:847531-847561
  misc_feature 1..30: note = hypo
  source 1..30: mol_type = genomic DNA
ccgggcccctgactgcgtctgggcaaccca

SEQ ID NO: 73516 - DNA, 561 bp, Homo sapiens
  misc_feature 1..561: note = chr11:850546-851107
  misc_feature 1..561: note = hypo
  source 1..561: mol_type = genomic DNA
gaaggtttgcaccatcgcggggtccgccccctgcactcagagcggctgccccacgccctggtcccctctcctctcctctcctctcctcacttgatgagacgggacacgttgcacacgtgcgcgccggacagggccacccgggcactgcgcctctcctagggtcggggttcgagtccgggtcgtggccagttttgcgcggggccccggtgcctcctctgcgcccgctccctcctcggtgcagccgttatccttgcctcggccccgcccctccaggcaggcgacctgtcgggcccagggactcacttccgagggtttgagccggctgccgccaaggtcccccagtcgccgggaggcgctgcggaagggaatcctggacactgagcagggccgtgggccatcagtgttcgcgggagacactggctttcccgcgcctccggcagcagaggcttccctaacttttgcggaggtggggtcaggtgtgctcagacctgcagtggtgtccgggggggccctgtgtgctggatggagcagagctgaggtagagggcggacagggttccac

SEQ ID NO: 73517 - DNA, 198 bp, Homo sapiens
  misc_feature 1..198: note = chr11:85071077-85071275
  misc_feature 1..198: note = hypo
  source 1..198: mol_type = genomic DNA
tgtgctgaagcagagcgaaagattacccacaggcattatacagatgatccctgtgctgtgtgaaggattcagttggacggaaaagtcctctacaattcaaaactcctgtggtatgatttttaacacacttgtcagcggtttctagttgtcagtttagaaaacaagggttttaaaataaaagtacgcaatacactgtaa

SEQ ID NO: 73518 - DNA, 150 bp, Homo sapiens
  misc_feature 1..150: note = chr11:85359853-85360003
  misc_feature 1..150: note = hypo
  source 1..150: mol_type = genomic DNA
caaatgacctcttatcgatataaaacaggtagcaataaatatttaaacgagtgcctgtaatgttgtaggaaatgagaaaatctggtttcataaaagcatgttttcctttgttgttatccctgaactgtttttttttttttttttgtagac

SEQ ID NO: 73519 - DNA, 40 bp, Homo sapiens
  misc_feature 1..40: note = chr11:85379748-85379788
  misc_feature 1..40: note = hypo
  source 1..40: mol_type = genomic DNA
agattaagaaacatgcggccgggcgcggtggctcacgcct

SEQ ID NO: 73520 - DNA, 30 bp, Homo sapiens
  misc_feature 1..30: note = chr11:854103-854133
  misc_feature 1..30: note = hypo
  source 1..30: mol_type = genomic DNA
ggggcctgctcttcccgcctgtcagggatg

SEQ ID NO: 73521 - DNA, 30 bp, Homo sapiens
  misc_feature 1..30: note = chr11:85521596-85521626
  misc_feature 1..30: note = hyper
  source 1..30: mol_type = genomic DNA
gtaaacaggtgctgacgctcctacctttct

SEQ ID NO: 73522 - DNA, 213 bp, Homo sapiens
  misc_feature 1..213: note = chr11:85564766-85564979
  misc_feature 1..213: note = hypo
  source 1..213: mol_type = genomic DNA
aaaccccatagtaaacgaacaagatagaccttaactactgactaattctccaaagcaaaaagtcaggaaaataaaaaaatctcgttaagctgtaaaaaataaaaataaaaataaaaatacatatccaggtacatactctttctttctttgagacagaggctcgctctgtcacccgtgcagtggcagtctcggctcactgagatctcagccttc

SEQ ID NO: 73523 - DNA, 199 bp, Homo sapiens
  misc_feature 1..199: note = chr11:858423-858622
  misc_feature 1..199: note = hypo
  source 1..199: mol_type = genomic DNA
ctggcacttctgccacggagctggcctctggtcctgcacactccagacacatccaccctggctcacacacaccctggctcacatgcaccccggatcccacccccgctgacactcaccccggttcccatgcaccccaggctcacatgcactcccggctcacacgcacccctgctcacacgcacttcggctcacacgcact

SEQ ID NO: 73524 - DNA, 399 bp, Homo sapiens
  misc_feature 1..399: note = chr11:858987-859386
  misc_feature 1..399: note = hypo
  source 1..399: mol_type = genomic DNA
cacccctgggtcacacgcatccccgctcacatgcaccccagctctcacgcacccccgggctcacaccaacagcttgcacccccggcacacatgcaccccggctcacacgcacccccgggctcacacgtgccctggctcacacgcacccctgggctcacatgcaccccggctcacacgcaccccaggtcacacgcatcccctcacatgcacccaggctcacacacccacccccagcccacactcatccccgctcacacacacccccactcacacacaccctggcccacacgcaccttggctcacgtgcaccccggctcacacgcaccccccctttcacacgcaccccgggctcacacgcaccccgggctcacacgcaccccccctttcacacgcaccccg

SEQ ID NO: 73525 - DNA, 39 bp, Homo sapiens
  misc_feature 1..39: note = chr11:85906236-85906275
  misc_feature 1..39: note = hypo
  source 1..39: mol_type = genomic DNA
agcccccgccccagccgcacccaccgctgccccaggagc

SEQ ID NO: 73526 - DNA, 121 bp, Homo sapiens
  misc_feature 1..121: note = chr11:86085741-86085862
  misc_feature 1..121: note = hyper
  source 1..121: mol_type = genomic DNA
ctaagggggtgaggtcgaatcccagccttgacgccttagcaaccgagcgagcctttctcgcgtcccagcaacgcgcccttccctctgccgggcctattctccctggtgcccctcccttcct

SEQ ID NO: 73527 - DNA, 60 bp, Homo sapiens; identical to SEQ ID NO: 3775
  misc_feature 1..60: note = chr11:86085931-86085991
  misc_feature 1..60: note = hyper
  source 1..60: mol_type = genomic DNA

SEQ ID NO: 73528 - DNA, 33 bp, Homo sapiens; identical to SEQ ID NO: 42861
  misc_feature 1..33: note = chr11:860888-860921
  misc_feature 1..33: note = hypo
  source 1..33: mol_type = genomic DNA

SEQ ID NO: 73529 - DNA, 599 bp, Homo sapiens
  misc_feature 1..599: note = chr11:8615288-8615887
  misc_feature 1..599: note = hyper
  source 1..599: mol_type = genomic DNA
accccacagtaagttcgcttctaaactttcaaaaagtttcacgtcccaagatggggtgaaggtgagacggtggagatgaaccggggcagacagagaccaccccaaataccggacccgggggaaatggggtaccaacggctgggccccaggagacactcggaggggtccgcgggctcggcccggtccctccgctggggggttaccagccggccggcagcgagatacccagaggcccgtttttccaccgcgttgccatagcaacggcctggccggctgcgccccgggccgcccgccccatcccgcgggcccgccctgagccagtgactccagggaccactcaccgcggccggcggactggcgggtctccgacaggtgcgcacactcggcgcaggctgtcgctgagcccggaattctgcaccgggagaaacttttcagcccgcagagcaaccgcagggcagtggacgggggccgcgcgaggacaaacagcggcggcgggtgcaaagccccttctccaagccgcggggttggccgggaggtgccggctgcacaacggcgcccacgtgacccaggtgcagccccaggcgcgcccaagggcagct

SEQ ID NO: 73530 - DNA, 140 bp, Homo sapiens
  misc_feature 1..140: note = chr11:861908-862048
  misc_feature 1..140: note = hypo
  source 1..140: mol_type = genomic DNA
tgagactccatctccaaaaaaagaaaaaaagaaagaaatcataaccaggagcagagtgtgagggaatcagcgtttctcctgccacgagtgacaggggacagctggggacatcacagagatcttgtcgggagctgggaatc

SEQ ID NO: 73531 - DNA, 476 bp, Homo sapiens; identical to SEQ ID NO: 42862
  misc_feature 1..476: note = chr11:862616-863092
  misc_feature 1..476: note = hypo
  source 1..476: mol_type = genomic DNA

SEQ ID NO: 73532 - DNA, 259 bp, Homo sapiens
  misc_feature 1..259: note = chr11:86382846-86383105
  misc_feature 1..259: note = hyper
  source 1..259: mol_type = genomic DNA
ttcaggggcacagggcgcgccgggccaggcttggagtggcagccttgggcgggcgcggtgggtgtccagcgcgggagggcgccgcaggcccggcccggccagggagccagccgcgtgcctgtccccagcgcggcacccatggtccttggcagacctggcacgggagagaaagcaaggtcagggcctccttccagccagccaggacccacgcgcgctgcggggcaccgggcctgatccggggacgcgccctctgggagag

SEQ ID NO: 73533 - DNA, 69 bp, Homo sapiens
  misc_feature 1..69: note = chr11:86385660-86385729
  misc_feature 1..69: note = hypo
  source 1..69: mol_type = genomic DNA
tctgtagctgttgcccgcctctacacagcgctaacaccatgttagcatcccagccgtggaaagcgggaa

SEQ ID NO: 73534 - DNA, 101 bp, Homo sapiens
  misc_feature 1..101: note = chr11:864732-864833
  misc_feature 1..101: note = hypo
  source 1..101: mol_type = genomic DNA
cccacccggagggtgcgccccaggttgtcccccgccctctgacgcagcgtcctgagccgtctgctcccagcgccccatccgggccgcgcaccgtggggttc

SEQ ID NO: 73535 - DNA, 470 bp, Homo sapiens; identical to SEQ ID NO: 42864
  misc_feature 1..470: note = chr11:865657-866127
  misc_feature 1..470: note = hypo
  source 1..470: mol_type = genomic DNA

SEQ ID NO: 73536 - DNA, 33 bp, Homo sapiens
  misc_feature 1..33: note = chr11:86641548-86641581
  misc_feature 1..33: note = hypo
  source 1..33: mol_type = genomic DNA
cagggccgggcgcggcggctcacgtctgtaatc

SEQ ID NO: 73537 - DNA, 42 bp, Homo sapiens
  misc_feature 1..42: note = chr11:866956-866998
  misc_feature 1..42: note = hypo
  source 1..42: mol_type = genomic DNA
tggaaaacaggttggcgctggaggagccgggtcttggcatcc

SEQ ID NO: 73538 - DNA, 30 bp, Homo sapiens
  misc_feature 1..30: note = chr11:868485-868515
  misc_feature 1..30: note = hypo
  source 1..30: mol_type = genomic DNA
attacaggcatgaaccgccgcacacaccac

SEQ ID NO: 73539 - DNA, 265 bp, Homo sapiens
  misc_feature 1..265: note = chr11:869823-870088
  misc_feature 1..265: note = hypo
  source 1..265: mol_type = genomic DNA
agaacacgtccaccgcggaggccgcaatgcccacctagagcaggtcgtagaagtagtccaggccctggcccagctcccagatagagaccccaacgcccagctcccgggccagctccagccgcacctgcagggactgggcacagatggaggtgtgagcacctgctggggcctgtccccccaacacccagggatgtcctccaggccgaggggcagcaccgcctggaccccaggccagtgcctgctgtgctgtcgcatggcccacccc

SEQ ID NO: 73540 - DNA, 141 bp, Homo sapiens
  misc_feature 1..141: note = chr11:875376-875517
  misc_feature 1..141: note = hypo
  source 1..141: mol_type = genomic DNA
gggcgtggctgggcccgcaggtaatgccagccagtccctgcacctggccccattggggatgtgctcaggagctgctgctagtcagccaaggctcccagaggcacaagctgtagacactgagggccccgggtgtggagaaga

SEQ ID NO: 73541 - DNA, 217 bp, Homo sapiens
  misc_feature 1..217: note = chr11:87908267-87908484
  misc_feature 1..217: note = hyper
  source 1..217: mol_type = genomic DNA
cgcttggccgcaagccgctgcctcgagactggaaaccggccgcgaggcgctctatccccctgaccccctccccccgcgctcacctgcgatatcccagagctgcaggcgcaccacagtctccgggtcccagtggagcaccttgagcgcgaagtccacgccgattgtggcccggtagtgcgaagagaagttctggtgcacgtagcgcttgatgatactg

SEQ ID NO: 73542 - DNA, 271 bp, Homo sapiens
  misc_feature 1..271: note = chr11:88241705-88241976
  misc_feature 1..271: note = hyper
  source 1..271: mol_type = genomic DNA
gaacacggggggctccgctccgcacgcgcaggccggcgtgctttccagggacattcacaacgacgaggagctctgagtgtaatctcttatgataagagtgtcatatttgggagacgacgggatacagagggccgactcggacactggcgagttgggggttgtgctccccgagtccaccgagtctctgaagggggacggcggggtgagagccaccagctcctccaggtctggcttggcggccgcagcctcgggaccggccgcggggctctcc

SEQ ID NO: 73543 - DNA, 145 bp, Homo sapiens; identical to SEQ ID NO: 989
  misc_feature 1..145: note = chr11:88242130-88242275
  misc_feature 1..145: note = hyper
  source 1..145: mol_type = genomic DNA

SEQ ID NO: 73544 - DNA, 266 bp, Homo sapiens; identical to SEQ ID NO: 33997
  misc_feature 1..266: note = chr11:88242358-88242624
  misc_feature 1..266: note = hyper
  source 1..266: mol_type = genomic DNA

SEQ ID NO: 73545 - DNA, 73 bp, Homo sapiens
  misc_feature 1..73: note = chr11:8832710-8832783
  misc_feature 1..73: note = hypo
  source 1..73: mol_type = genomic DNA
cacttgggatttttccgggcagcagttggggcggaaatgcactcacatcccaggagctcgcctggactggcct

SEQ ID NO: 73546 - DNA, 30 bp, Homo sapiens
  misc_feature 1..30: note = chr11:88796652-88796682
  misc_feature 1..30: note = hyper
  source 1..30: mol_type = genomic DNA
ctgttggctgcgctgcgagcagtgagactc

SEQ ID NO: 73547 - DNA, 185 bp, Homo sapiens; identical to SEQ ID NO: 33998
  misc_feature 1..185: note = chr11:88798746-88798931
  misc_feature 1..185: note = hyper
  source 1..185: mol_type = genomic DNA

SEQ ID NO: 73548 - DNA, 262 bp, Homo sapiens
  misc_feature 1..262: note = chr11:88798965-88799227
  misc_feature 1..262: note = hyper
  source 1..262: mol_type = genomic DNA
cgcccccaggcagccgctcctcgagggcttcctgcgctctcgtagcggccttggctgcagctggagcgctagtgtcggcgatggaggcagcggtgacagcaggcagaacggctgcggggcccgcggcggtggcgctcgctctctcgcgccagcgccgggagcacgtgccgcgctcgggcagacgcagctggaagcgcagcgcagggctggcttatactcccgcagcgcgcggcgggggttggcagaacggccagggcataga

SEQ ID NO: 73549 - DNA, 39 bp, Homo sapiens
  misc_feature 1..39: note = chr11:891173-891212
  misc_feature 1..39: note = hypo
  source 1..39: mol_type = genomic DNA
cctcagcaccttcaccggccccgccgactgggagggcac

SEQ ID NO: 73550 - DNA, 350 bp, Homo sapiens
  misc_feature 1..350: note = chr11:89224313-89224663
  misc_feature 1..350: note = hyper
  source 1..350: mol_type = genomic DNA
gcaggacagagagaacgcaaggagagcctagcccgccatcctaccaggcagaggtgtttaaccccttcgttggcgagccagctcctccaggacacagccatgccgccggccccgccgcgctgcgctctgtgcccgccggaccgagaaggagcgggcggcggccggggcagcggttacagttgtgcggcctgccgggccgctgagcgaggaccgagggtcaaagactgagtggaagcccgaaggcccggcgccgagccagcccgggcggggtctgctacccagagccgggttttccgggcgccctgactcccacccgcaccgggtcagctctgcccactcagctgcccaga

SEQ ID NO: 73551 - DNA, 53 bp, Homo sapiens
  misc_feature 1..53: note = chr11:89224735-89224788
  misc_feature 1..53: note = hyper
  source 1..53: mol_type = genomic DNA
cgagcctgttgttgtggctgctgctgttcaggatgtcccgggtgggaacttgg

SEQ ID NO: 73552 - DNA, 70 bp, Homo sapiens
  misc_feature 1..70: note = chr11:89785710-89785780
  misc_feature 1..70: note = hyper
  source 1..70: mol_type = genomic DNA
cgccctctcgtggagcggaggcagctcaagctggtacttttcccccaaccgctcccggcaggggcgctcc

SEQ ID NO: 73553 - DNA, 21 bp, Homo sapiens
  misc_feature 1..21: note = chr11:89899713-89899734
  misc_feature 1..21: note = hypo
  source 1..21: mol_type = genomic DNA
tacagattggctgggcgcggt

SEQ ID NO: 73554 - DNA, 30 bp, Homo sapiens
  misc_feature 1..30: note = chr11:89957319-89957349
  misc_feature 1..30: note = hypo
  source 1..30: mol_type = genomic DNA
cattgttacaaatgacggagtattctgttg

SEQ ID NO: 73555 - DNA, 1338 bp, Homo sapiens
  misc_feature 1..1338: note = chr11:9025010-9026348
  misc_feature 1..1338: note = hyper
  source 1..1338: mol_type = genomic DNA
aaaagaaagaagacccgagggcaagagggcagggcaggacctcttctttctactggagaagagacatccagggaggaggcacagccgaggggagcgcaagctagaaaagctacgacggaatccccaccgaaaccgcagcaggggtactggaaggggaggaatccgcgacgcagcgaccgcgagccaagggcagcggcgggccgggccgtgactcagtgaaagccgcaacggccgggcctcggaaaacggcgggcgcgaagccgccggggccggggcgagaacggcggcgggggctcaccatgtccttggacgagcccagcttcttgaggccgtccaggggcagcaggtcggcggagtccttgtggatgaactgcaccgcctgcttcatccggcgctgctgtcgcagtgacgccgcctcccgcatgtcggtctccttgcggccgccctcagtgaggagccctgagtaaaacatcgctgaggcgccggcggcccggtagcccacagccccccggcagcctcagcctcgagctcctccagcgccgcaagggccccgagccgcgccttttatagccgagcgtgacgtcgcggggagcagccagtgcgcgcgcggggggcggggccggcacagagtccacgccccgcgcggctccctcgcgtcccgcgtcccgcgtcccgcgtcccctgctcacccggtggcaaagccggcgaggaggcggcggcgctggtggggactgacccggcagtccgagaatccaccgcggccttttcacccaaccgccccctcctgcgtgggggccccgcatcccctggactggcgtgggctctggggcccgatgccctggcagccccggccatctctgccgctggccgcgggtacctgctcacctgtccacgccgtggccgacccggggatcaccgacagccgggccatgcctcgagtcccgccgcccgcgccgctgctcggcttctcagaaacgcacctccacgccgccagccggggctccagggtccaccgcccgggcccggaggactggcgactccctccgaggttgggagcgctccggatttctccaacttcaggtcggtccccacccaccgggccacgtgactggggagggggcagccggtgcaggcgtgtggaggaggctttcgggacctcctcccccgggcaccctctgcctgcagcccggcacccggcccgcgtttccgagccgggggagcaggtgcagtcggaagcccgcgggtgggcgtggggcgggggagtggcgagggtcccccgcctccgcgggagcgcacgcggctgcgagccctacacctgctctccgaccaaagaagcac

SEQ ID NO: 73556 - DNA, 30 bp, Homo sapiens
  misc_feature 1..30: note = chr11:90705557-90705587
  misc_feature 1..30: note = hypo
  source 1..30: mol_type = genomic DNA
tttgctctgcggtcccggggacgcctgcgc

SEQ ID NO: 73557 - DNA, 140 bp, Homo sapiens; identical to SEQ ID NO: 3690
  misc_feature 1..140: note = chr11:9112446-9112586
  misc_feature 1..140: note = hyper
  source 1..140: mol_type = genomic DNA

SEQ ID NO: 73558 - DNA, 332 bp, Homo sapiens
  misc_feature 1..332: note = chr11:9112639-9112971
  misc_feature 1..332: note = hyper
  source 1..332: mol_type = genomic DNA
cgcaccctcctgcctgctcgccggcgacggtctgactagcaggcgctctggaggcatccggaccggggcgggaaccgtcagcagctccgggtccgaggccgggccgaaggactcagggccccagcggtcgtggcgccttggcccggccggcgggtgaggtcccggggggagcagaggcccccgcggagctgcagccgccagccccgagccccgcgcgcccggctctggactccgccggggacctaaacactcttcctggccctgcctgctgtgccaggtgcgcccccgcggccggacactcaccctcctgcggccccgcggcacggccccga

SEQ ID NO: 73559 - DNA, 465 bp, Homo sapiens
  misc_feature 1..465: note = chr11:9113031-9113496
  misc_feature 1..465: note = hyper
  source 1..465: mol_type = genomic DNA
accgcccaggccgccccgggacggttgcggcccgcgacccccatggatggctcagcggttgcgggcagaggcggcggagtgcgggcggtggcggcggcggcgcggggaggtgtgcgcggacgccctgcccgctgccgctgccacccccggcccggccccgcccgccccccgagccccggcctcattttcacacggtccctcccgggccggggcgggaagcgcaggcgggagcagtgccgccccgcccggcctcctcccgtcccctccccggcctcgggtggagggggcgcggccgcggtggcccgagcgcggctgtcagcctggcggggcggcagcaccgtgcctcgcgccccgcgcagccctggcacccagcccgctgccccccgcatccccgctccgctccaacgctcggagccctcggtgccgcgcctgttccagtgtgttacaactcgacccaggccctca

SEQ ID NO: 73560 - DNA, 674 bp, Homo sapiens
  misc_feature 1..674: note = chr11:91957315-91957989
  misc_feature 1..674: note = hyper
  source 1..674: mol_type = genomic DNA
gaagagattggaccacgttagctgcttagtctagttccctcctccacaaggcaatcggatgaccccaggatctcaatgtttaggaaagtcgtaggagccctcactgggaggcacatttttagtccagaggcacgacatttgatggtttaatcttcacactacaaactagccttgggacgttatataaaccatgttaacctcgatgtgcctcagtttcctctttgtcccaggagagtaacgcgttctctgtcttcacagggatgtggtgcgggtgagactcaatgcactgtgcgaaagctctcccaagccagcaagcaccacgctctccccgcggcaggaaagtacgttggtgtcatcctagagccccagagggctgagggaagactcgagctctaaaattagccgcttccaggcccggcgccgggaatgccctccagttcgccgcgcctcctccgccgccccctcccgcgcgccccctctcccctgcgccacgctcctagatcgctagtcatccccgccgccgaggctcctctccccctcgcccttttcgctcgcggtttgggaggaggagactgcgagagacaagcgcgagggggagactggagaggggcttggccgtgcgtcggcgtcggctgtgatggggagcccggagcagccaggcggcgagcagtagc

SEQ ID NO: 73561 - DNA, 1337 bp, Homo sapiens
  misc_feature 1..1337: note = chr11:91957990-91959327
  misc_feature 1..1337: note = hyper
  source 1..1337: mol_type = genomic DNA
gcggcggctgcagctcggagcagacaggagagccggcgctcctccccgcaggctgcgctgtgaactggcctgcggattgggatctcgcgcctcccgtccctctcctcccgctgctgttctcttcatctcggctcccctcctccgcttgcgaacccccggcggcggcggcggcggcgtcccgagcgcagagcgcttctgctcgcggcctcagtcccggctagcgcgcggtgggcgctgcggcggcagcagccgggggaccggctcgcccggagcaagagcgccgagcaccgggtgaagaagaccacgggggaggcgcctcgtagagccgtggatcgccagcggaggcaagggtgcgtggggatttgtagcgtgatgatttggctgcctggtgcaccgactggagcgcgcctgccggagcacagcctcagctgctgggtgcaaatgggctgcgaggtgggctggggaggcgagagccgacgaagcgcgtgggggaaacttttcaccttgtaaagttccaacctccgcgcagccccgagccgccgttgctaccgctgcaaacaggagaagagggtggcttggccccgcggcgggagccgggaggtttacacggagagttggccaagtttggggctgaggatctggggaggggttgcgaggggggttgcggatcagtgcacccatccccggctcccagccgcccctgcaggtggatgagaaggttcaggtggcgagcctgcttggcagccggtgcctctcgggcgcagtgggggatgttcagatgccgatggatgatgcacttaggggaccccgaggtgcaagttgggtcatcgctaggcgaggcgcggcgcagagagggagcccagcctccactttcgctaggaaagggaaagggttaccagtctgcgggtccgttccccacgcctgactcgggcttgcggggcttgtggtcagggtgagatgtagtgaacggcggcggcggctcttcgactggggacgacatcctttacggagtggttggggacagagactgtccctgctatcttgacaaggagagggaaccggaatgctttgcgagagtgcatgatttttggcgggcgtgtgggaaggctgcttgtctttgaaaagaaagcagcgcgggtctgaccatccccaggagtgcggaggagctgtctccggattgggggcgagaacgccaggggcaccagctccgagctcaggccccactcccgggcggttcgggacgaatcccctctacaggccagtgtgtgtgcagggcaagtgtagggggctgaggggcgctggcggggaggcagtagaggtggcctggaccatcttgg

SEQ ID NO: 73562 - DNA, 275 bp, Homo sapiens
  misc_feature 1..275: note = chr11:91959354-91959629
  misc_feature 1..275: note = hyper
  source 1..275: mol_type = genomic DNA
cgccagtgggagtcgctgagctaaagtgcatctggccccccggcttgcatgatggcgagcccggatatttttagctgtgctgtgatctgaattccctcctctcctctctcgttgacttttgtcacatgtgctttccgagatggtttaacattgaacatgattgggctttgcggaaagcaacttttattcactttccaccgttctcctcttgtgggcggggggtggcgggggcgtgcttggggcaaggatgcaggggtggccggagtttggctgcg

SEQ ID NO: 73563 - DNA, 128 bp, Homo sapiens
  misc_feature 1..128: note = chr11:91959986-91960114
  misc_feature 1..128: note = hyper
  source 1..128: mol_type = genomic DNA
cgaacctgcagcagccgcggcgggagggagggacgctgggaccgcggtaatgattgaagtctttttcccccctctcccctcctcccgctcctctccgcccccagactctggcgcgtttgttttccaag

SEQ ID NO: 73564 - DNA, 101 bp, Homo sapiens; identical to SEQ ID NO: 34006
  misc_feature 1..101: note = chr11:91960369-91960470
  misc_feature 1..101: note = hyper
  source 1..101: mol_type = genomic DNA

SEQ ID NO: 73565 - DNA, 73 bp, Homo sapiens; identical to SEQ ID NO: 34007
  misc_feature 1..73: note = chr11:92675236-92675309
  misc_feature 1..73: note = hyper
  source 1..73: mol_type = genomic DNA

SEQ ID NO: 73566 - DNA, 30 bp, Homo sapiens
  misc_feature 1..30: note = chr11:9285492-9285522
  misc_feature 1..30: note = hyper
  source 1..30: mol_type = genomic DNA
caggataatcactttcgaaagagaaacttt

SEQ ID NO: 73567 - DNA, 85 bp, Homo sapiens
  misc_feature 1..85: note = chr11:92929479-92929564
  misc_feature 1..85: note = hypo
  source 1..85: mol_type = genomic DNA
cattacttatttcctcgggaaatattctgaaggagaattgctgggtcaaacgataagcactttttttttttgagacagagtctcg

SEQ ID NO: 73568 - DNA, 30 bp, Homo sapiens
  misc_feature 1..30: note = chr11:92931349-92931379
  misc_feature 1..30: note = hyper
  source 1..30: mol_type = genomic DNA
aacttaaatttggggcgcctgtccgtatgc

SEQ ID NO: 73569 - DNA, 610 bp, Homo sapiens
  misc_feature 1..610: note = chr11:93063447-93064057
  misc_feature 1..610: note = hyper
  source 1..610: mol_type = genomic DNA
tgatgaactccccagcggtttacagttccttcgtgatctatttggttcattcattcaacaagtatttccgggctgcagcttgggtgcccagccttggggtaggcagtgggactacaaagaggaaaggacccagaatagagggggcactggacgtataactgcgggacagcgaggtcgcgctcgcgcggggtgaggttggaggcagccgaggagccgcacagggcagcgcctgccgccgccgccgcgcccatcccccactccgacggccacgagttcgggccgcgacgtccccatggcaacacgcggcggcgccgcgcgcggggagggagaggcccaactgcctcgttggtcgcgcggcgggagggcccaggcggcgggagcgcggcggcgggtggcggggccccttggggcgggcctggcggggcgggaggtgacatacgcggtcctgcgccctcgcctcagacctctcgggcgagcgcggcgcagcgcaggtaatggctcctggccttcccggccccgcctcgcccctgaccctcacccaaaggccaggctgcgcgggtcctcgagcgggacaggggaaccccaaaagggcggccgctctgcgggaggc

SEQ ID NO: 73570 - DNA, 88 bp, Homo sapiens
  misc_feature 1..88: note = chr11:93476681-93476769
  misc_feature 1..88: note = hypo
  source 1..88: mol_type = genomic DNA
cacccaggcctgctgcgctccaccctttatgggagggtgcgtgggggtgagcagatgctggagccggagcgagcgcttttggtcgccg

SEQ ID NO: 73571 - DNA, 157 bp, Homo sapiens; identical to SEQ ID NO: 43011
  misc_feature 1..157: note = chr11:9405392-9405549
  misc_feature 1..157: note = hypo
  source 1..157: mol_type = genomic DNA

SEQ ID NO: 73572 - DNA, 37 bp, Homo sapiens; identical to SEQ ID NO: 43012
  misc_feature 1..37: note = chr11:9405789-9405826
  misc_feature 1..37: note = hypo
  source 1..37: mol_type = genomic DNA

SEQ ID NO: 73573 - DNA, 21 bp, Homo sapiens
  misc_feature 1..21: note = chr11:94064788-94064809
  misc_feature 1..21: note = hypo
  source 1..21: mol_type = genomic DNA
ccaccgcgcctggcccaagaa

SEQ ID NO: 73574 - DNA, 415 bp, Homo sapiens; identical to SEQ ID NO: 34009
  misc_feature 1..415: note = chr11:94134049-94134464
  misc_feature 1..415: note = hyper
  source 1..415: mol_type = genomic DNA

SEQ ID NO: 73575 - DNA, 179 bp, Homo sapiens
  misc_feature 1..179: note = chr11:94134682-94134861
  misc_feature 1..179: note = hyper
  source 1..179: mol_type = genomic DNA
cgacggtgacgcgctctggctctgacaagcctggctccccccaccctaccgggtggcgccgttgctgaccccacgcccagccgttcccactcccgcctgaaactcctccgacagggcttcgcttcgggggctcagtccccagcgcgtacacactcgcgtggtgtcggcttagcctcttg

SEQ ID NO: 73576 - DNA, 169 bp, Homo sapiens
  misc_feature 1..169: note = chr11:94156922-94157091
  misc_feature 1..169: note = hypo
  source 1..169: mol_type = genomic DNA
ccctgagggtccagacgatggagccacaggctggtcccagtgctacagggctacagcacacagctggggctgtcgagctaagagctggggctggcactcaagtaggggagaaatcccactttcagaacactgaaaggagtgagacacgtgggttcgtgggccagtgcag

SEQ ID NO: 73577 - DNA, 30 bp, Homo sapiens
  misc_feature 1..30: note = chr11:94275224-94275254
  misc_feature 1..30: note = hypo
  source 1..30: mol_type = genomic DNA
atatgcatgagacctcgggcattcttcagg

SEQ ID NO: 73578 - DNA, 26 bp, Homo sapiens
  misc_feature 1..26: note = chr11:94275794-94275820
  misc_feature 1..26: note = hypo
  source 1..26: mol_type = genomic DNA
ttttttttttttttccgagacggagt

SEQ ID NO: 73579 - DNA, 26 bp, Homo sapiens
  misc_feature 1..26: note = chr11:94276060-94276086
  misc_feature 1..26: note = hypo
  source 1..26: mol_type = genomic DNA
gggagtataggcgtgagccaccgcgc

SEQ ID NO: 73580 - DNA, 190 bp, Homo sapiens
  misc_feature 1..190: note = chr11:94277933-94278123
  misc_feature 1..190: note = hyper
  source 1..190: mol_type = genomic DNA
ggctgcgcttcaacatcagcggctgccgcctgctcaccgaccgcgcgtcctacggagaggctcaggccgtgcttttccaccaccgcgacctcgtgaaggggccccccgactggcccccgccctggggcatccaggcgcacactgccgaggaggtggatctgcgcgtgttggactacgaggaggcagcggc

SEQ ID NO: 73581 - DNA, 248 bp, Homo sapiens; identical to SEQ ID NO: 34012
  misc_feature 1..248: note = chr11:94473423-94473671
  misc_feature 1..248: note = hyper
  source 1..248: mol_type = genomic DNA

SEQ ID NO: 73582 - DNA, 97 bp, Homo sapiens; identical to SEQ ID NO: 3783
  misc_feature 1..97: note = chr11:94473672-94473769
  misc_feature 1..97: note = hyper
  source 1..97: mol_type = genomic DNA

SEQ ID NO: 73583 - DNA, 108 bp, Homo sapiens
  misc_feature 1..108: note = chr11:94473802-94473910
  misc_feature 1..108: note = hyper
  source 1..108: mol_type = genomic DNA
cggcccagcgcccggccgggggagccgcggggtggcacgcggggaaagttggcgcgcgcctgaccgcgcctggaagccgcgcggtgccagggccgagttgtcccccaa

SEQ ID NO: 73584 - DNA, 58 bp, Homo sapiens; identical to SEQ ID NO: 34015
  misc_feature 1..58: note = chr11:94474489-94474547
  misc_feature 1..58: note = hyper
  source 1..58: mol_type = genomic DNA

SEQ ID NO: 73585 - DNA, 613 bp, Homo sapiens
  misc_feature 1..613: note = chr11:94501445-94502058
  misc_feature 1..613: note = hyper
  source 1..613: mol_type = genomic DNA
gtagggttctagtgacgagcccgggcgaccctccccggcccgcgcgcggggagcggggagcgcggacggcggcgggagcgcgcgagaagctctaggacccagcagcggttgtcgggtttggggctggaggtgaagccctgtgtgaatggggttgattgtccggcgccacttccccgcgctgcccggcagccgtcttccccagccgagggactgaactagccatgatcgcctcatgtggagggcaaagttgcgccggggaacttgtgagcctgcggtgaaaggtaaccagcccccactcgaggtgccgggagggcgtctccgagtctcccacgcgaagaacccagtcgccccgggctccccgggcccctgctgctcacggaagggggcagcttctgggggcccggggctgagatcccagattgttgtttttaagcgggttcccttgccccgctccaggtccagttgcctgcgggccgggcctcagcgtcttgccgccccgcgacccacgttgactgaagttgtggccccggggtttgggccccggggtgctgcgcgcccgacgcggggctggcctttcctgaggggcgcagccatatggccagacactccgagg

SEQ ID NO: 73586 - DNA, 180 bp, Homo sapiens
  misc_feature 1..180: note = chr11:94502372-94502552
  misc_feature 1..180: note = hyper
  source 1..180: mol_type = genomic DNA
acaataatctgctttcgcggggagaaaatttaaactttccaaatggaactgttttttcttggaatgtgacatttgtggcaggagggagagtggtacgttggccgatgacagccgagcggaacggtggcctagtgccgggacagggaccgagcgtgccccataggcggccgggctggagga

SEQ ID NO: 73587 - DNA, 15 bp, Homo sapiens
  misc_feature 1..15: note = chr11:94502757-94502772
  misc_feature 1..15: note = hyper
  source 1..15: mol_type = genomic DNA
cgaagatttttgcct

SEQ ID NO: 73588 - DNA, 247 bp, Homo sapiens
  misc_feature 1..247: note = chr11:94884155-94884402
  misc_feature 1..247: note = hyper
  source 1..247: mol_type = genomic DNA
ctctttccctttctccggatgcgggcctttgagagtcagcgacgccttagactcctcccagaaaaatgcaccctcatctacccaattctgccctaccctttggagctcctggaccctctaaccgctcggtggggtcagagcccacccccggaagggccgctggtcggggactggttcgccctctcctggcctcctcggaccagtgcgcggggaggatcccgctaacgccgggcgcctgcagaccttg

SEQ ID NO: 73589 - DNA, 18 bp, Homo sapiens
  misc_feature 1..18: note = chr11:94885458-94885476
  misc_feature 1..18: note = hypo
  source 1..18: mol_type = genomic DNA
agtaggataaaaggccgg

SEQ ID NO: 73590 - DNA, 26 bp, Homo sapiens
  misc_feature 1..26: note = chr11:94892054-94892080
  misc_feature 1..26: note = hypo
  source 1..26: mol_type = genomic DNA
tcctccctgggcgacaaagcaagact

SEQ ID NO: 73591 - DNA, 24 bp, Homo sapiens
  misc_feature 1..24: note = chr11:94895717-94895741
  misc_feature 1..24: note = hypo
  source 1..24: mol_type = genomic DNA
gcgagactccgtctcaaaaaaaaa

SEQ ID NO: 73592 - DNA, 30 bp, Homo sapiens; identical to SEQ ID NO: 43237
  misc_feature 1..30: note = chr11:94924721-94924751
  misc_feature 1..30: note = hypo
  source 1..30: mol_type = genomic DNA

SEQ ID NO: 73593 - DNA, 30 bp, Homo sapiens
  misc_feature 1..30: note = chr11:94965054-94965084
  misc_feature 1..30: note = hyper
  source 1..30: mol_type = genomic DNA
atttacgcaagtaatcgagtttgaggggag

SEQ ID NO: 73594 - DNA, 146 bp, Homo sapiens
  misc_feature 1..146: note = chr11:95007432-95007578
  misc_feature 1..146: note = hypo
  source 1..146: mol_type = genomic DNA
cacttcatccaaatccgttaatttaatgattaaaaaaaatctccatccatttggtcctcactgggcccgttatggaatcagactgttaaagctagaagatgcaagagaccattgatatggttaggatttctgtccccacccaaatg

SEQ ID NO: 73595 - DNA, 30 bp, Homo sapiens
  misc_feature 1..30: note = chr11:95462538-95462568
  misc_feature 1..30: note = hypo
  source 1..30: mol_type = genomic DNA
caccacagttctaaacgaataaacgaatga

SEQ ID NO: 73596 - DNA, 94 bp, Homo sapiens
  misc_feature 1..94: note = chr11:95488635-95488729
  misc_feature 1..94: note = hypo
  source 1..94: mol_type = genomic DNA
gaggatagaagtgaccgggcaaagaagagaatctgctatgtgaagagcaccaacaggattctatgacatgaaggaagcccgttagatatctctg

SEQ ID NO: 73597 - DNA, 43 bp, Homo sapiens
  misc_feature 1..43: note = chr11:95658708-95658751
  misc_feature 1..43: note = hypo
  source 1..43: mol_type = genomic DNA
ttctctgtgcagagtcggttgcacagtacggtctcactaagta

SEQ ID NO: 73598 - DNA, 26 bp, Homo sapiens
  misc_feature 1..26: note = chr11:9567879-9567905
  misc_feature 1..26: note = hypo
  source 1..26: mol_type = genomic DNA
ctgttcctattcggccatcttggctc

SEQ ID NO: 73599 - DNA, 30 bp, Homo sapiens
  misc_feature 1..30: note = chr11:9593400-9593430
  misc_feature 1..30: note = hypo
  source 1..30: mol_type = genomic DNA
acaaaaccacatcaacgaacatccactgat

SEQ ID NO: 73600 - DNA, 35 bp, Homo sapiens
  misc_feature 1..35: note = chr11:971825-971860
  misc_feature 1..35: note = hypo
  source 1..35: mol_type = genomic DNA
tgtgccccacaggaacgctgcgccatgagagcatc

SEQ ID NO: 73601 - DNA, 46 bp, Homo sapiens
  misc_feature 1..46: note = chr11:9830623-9830669
  misc_feature 1..46: note = hypo
  source 1..46: mol_type = genomic DNA
ccctggataatcaaacgacttagggataaagcgcttgcacaaaaga

SEQ ID NO: 73602 - DNA, 172 bp, Homo sapiens
  misc_feature 1..172: note = chr11:98437969-98438141
  misc_feature 1..172: note = hypo
  source 1..172: mol_type = genomic DNA
cccattgcagagtaccggacaggagcggctataatggctgtggaaatcactcttggccacctcagtgcctttctctctttgttgccagggacactcaacagcgctgggctaaccatgtaagctttaagggtcgggtgcccagctaaggccaacacagcgcagtggcattcta

SEQ ID NO: 73603 - DNA, 120 bp, Homo sapiens
  misc_feature 1..120: note = chr11:98480681-98480801
  misc_feature 1..120: note = hypo
  source 1..120: mol_type = genomic DNA
gactccgtccccccaaaaaaacatacctttgattaccatataattttagaatatttaatataatctcacacaagtccatttttatagtagttgaaaaagttttttttgttgttgttgttt

SEQ ID NO: 73604 - DNA, 199 bp, Homo sapiens
  misc_feature 1..199: note = chr11:985267-985466
  misc_feature 1..199: note = hypo
  source 1..199: mol_type = genomic DNA
ccaccgtgcccggcctgtctcagttttgtaaatgcttccagctgggtacacaaatgtgaatgaactatattaaaaatgctctcatgatgtatgggtgcagccgggaggggcagggtgggctgcgggccactggagactggtgagcaccgttctgtcttgcccagaagaccctgcagtgcgaggccgcctgactgagtgc

SEQ ID NO: 73605 - DNA, 30 bp, Homo sapiens
  misc_feature 1..30: note = chr11:98627345-98627375
  misc_feature 1..30: note = hypo
  source 1..30: mol_type = genomic DNA
tccgttttgacagggcgtggaagtaagcgt

SEQ ID NO: 73606 - DNA, 146 bp, Homo sapiens
  misc_feature 1..146: note = chr11:986867-987013
  misc_feature 1..146: note = hypo
  source 1..146: mol_type = genomic DNA
tggagagcatgtgcacgctggccagctctgagttctcccatgaggctgtcaagacgcacatcgagacggtcatcaacgccctgaaggcgagtgccctgtccttgggttctgctcactccctgagcaggtgccgtgggtcttcctgt

SEQ ID NO: 73607 - DNA, 818 bp, Homo sapiens
  misc_feature 1..818: note = chr11:98891098-98891916
  misc_feature 1..818: note = hyper
  source 1..818: mol_type = genomic DNA
agtccttagatgaaacgcgtaagtgcagaaacaaaagagaagtgcttcccattcaggacttaagaaaattctgcaaagtgaaaaagtccactctcaaaccgacctaagtgaacgcgtcagtctgtgctgctgctgtcagaggtgtgagccggggactacaggaatcagagtgaagacaggagcggaggaagggactctcgcctggatctcccgtgccgactccagccagcacgtttgctttgtaatctatgaatgttaaatacggaggggttgcagagcagaaacgctcggggaaggggggcaggtcctctgtacttagcagggaaggaaaatgccggttgactagtgagacgagtggagaaacacagagcaccctccgggaggcgcacagttcgttaagcccagggacatgctcaatgaacctttgcagcaagaggcagtgaggcgctggacgcgggcgccggtgacagcgcgggcggccggggaggggcgaggggccgccccgggaggacacagccagtcagaggcgcggggcgcagggcgcgcggacgcattggaggaaaacacgcgagccccaaacacaccagccgcaggaggcgccgcacctacttcccaatataaccaactacggcgtgggggagcggaactgcgagaaggcggcagccaaagtgccattaaagctcggggcggagaggatgcgttacctgggtcccgtctgctgcgagaggcagggcaagctggaggattccctctgaatgattaagaactccgcaattcgcctctgccacaggctgcaaaggacccgaggaaccgctctc

SEQ ID NO: 73608 - DNA, 258 bp, Homo sapiens
  misc_feature 1..258: note = chr12:10029304-10029562
  misc_feature 1..258: note = hypo
  source 1..258: mol_type = genomic DNA
agccatgtaacttaccgcactgtgtaataccagaggtatcaacggtgagaaaaaattttgtggaatttatggccaagtcctaacgggtgaaacataatttctactgatcctttgagtcctagagcaataccaggtcaattatagctaagcatttatagagcttttgtgaaatagctcctggcatgctactggaccttgcagaaatagattacttggatgtgagtcagcaggcatccgtatgttctgaactgccattaa

SEQ ID NO: 73609 - DNA, 33 bp, Homo sapiens
  misc_feature 1..33: note = chr12:100595448-100595481
  misc_feature 1..33: note = hypo
  source 1..33: mol_type = genomic DNA
ccgaggctggagtgccgtggtgcgatctcagct

SEQ ID NO: 73610 - DNA, 29 bp, Homo sapiens
  misc_feature 1..29: note = chr12:10085916-10085945
  misc_feature 1..29: note = hypo
  source 1..29: mol_type = genomic DNA
gtaaaactggctgggcgcggtgtctgtca

SEQ ID NO: 73611 - DNA, 28 bp, Homo sapiens
  misc_feature 1..28: note = chr12:10086245-10086273
  misc_feature 1..28: note = hypo
  source 1..28: mol_type = genomic DNA
gcttttggtgcttcggtgcagagacaga

SEQ ID NO: 73612 - DNA, 26 bp, Homo sapiens
  misc_feature 1..26: note = chr12:100969543-100969569
  misc_feature 1..26: note = hypo
  source 1..26: mol_type = genomic DNA
ccgcgcctggccgttatctctatttt

SEQ ID NO: 73613 - DNA, 151 bp, Homo sapiens
  misc_feature 1..151: note = chr12:101025396-101025547
  misc_feature 1..151: note = hypo
  source 1..151: mol_type = genomic DNA
ggatttcttttgttgcgttaacatctagagattgtagtatttttacagaagaaagatgctggaaacgtcccaatttattgtctaggtttttttttttgttttaaaatatttattttcagggttgtgagaggctactcggagcgtaacactg

SEQ ID NO: 73614 - DNA, 30 bp, Homo sapiens
  misc_feature 1..30: note = chr12:101109113-101109143
  misc_feature 1..30: note = hypo
  source 1..30: mol_type = genomic DNA
aattaaagtgcaattcgtaactcattgtga

SEQ ID NO: 73615 - DNA, 858 bp, Homo sapiens
  misc_feature 1..858: note = chr12:101110839-101111697
  misc_feature 1..858: note = hyper
  source 1..858: mol_type = genomic DNA
cccgagaggctgtggcgcgcctgggactccccgacccttgccacgacatccctgccaccccttttggcgtgaacccaccggggatcccgcccgacgccggctgcgctgggccaaatccgcggcgcgcctctgccgggcacctcccacctccagcttcgcccctcccctctcccggccgcgcgtcctccgcggctggttcaatccccgcggggacccggagcgcggctgccggtctacgccctctctcctgccgctctcgcggcgcagcccggccgggggcccccgcgcgccggcagctctaggggcgagcgcggcgcgctgactgggcgtgctcagccgcggagcgcccgggcgccgctagagccaagcgcatgcactcgccgggccgggccgtccaggggcgcagcgcgcagggggccgctctagccgacgccctggccagtctgggcaggacgcgggccaggatggcctccctcaccgcatacggtaactggggccgtcgcgggttcctggggcggcggggcggaagggaggggcccagggagccgtcgaaacacccggggaaacttcggggttcgcctctgcggaggggtctggaagggagggagacggcggccgtgcgcgccgctcctgaggggccgatgttccgcggggtttcgggccgcgggtaacccgggaaccgggtgtctgcgggaaaaacgcttcaaaatttgggaggatctgggagcttcgggactctagaaacattcccctcgcttccgaccactcaggggaagggacgcgggtgttaagtcctcctctagcggggtgaggcttggagttgggagatgtgcgttcagccagcgcttatcttgtccc

SEQ ID NO: 73616 - DNA, 21 bp, Homo sapiens
  misc_feature 1..21: note = chr12:101254680-101254701
  misc_feature 1..21: note = hypo
  source 1..21: mol_type = genomic DNA
cttcaagaatggggccgcgga

SEQ ID NO: 73617 - DNA, 100 bp, Homo sapiens
  misc_feature 1..100: note = chr12:10187643-10187743
  misc_feature 1..100: note = hypo
  source 1..100: mol_type = genomic DNA
cctggagtctggccactcagtggcccaggctctcctctgattgtcccggccaaactctgccttgtttcaccagttggtggcctgccgatatgctcttgac

SEQ ID NO: 73618 - DNA, 30 bp, Homo sapiens; identical to SEQ ID NO: 43532
  misc_feature 1..30: note = chr12:102158693-102158723
  misc_feature 1..30: note = hypo
  source 1..30: mol_type = genomic DNA

SEQ ID NO: 73619 - DNA, 137 bp, Homo sapiens
  misc_feature 1..137: note = chr12:10243173-10243310
  misc_feature 1..137: note = hypo
  source 1..137: mol_type = genomic DNA
gagatttatatgaaacgttatttccaaatggggaatgataactagtaaagaatatagaaatagacagtataattactatcctctggaacttacaatctagtaggcaaaataagttaaagtctcggagaagacatact

SEQ ID NO: 73620 - DNA, 48 bp, Homo sapiens
  misc_feature 1..48: note = chr12:10264235-10264283
  misc_feature 1..48: note = hypo
  source 1..48: mol_type = genomic DNA
gtggggacaagtgggcgagtagccgccgcgactcggcctatcatgtcc

SEQ ID NO: 73621 - DNA, 30 bp, Homo sapiens
  misc_feature 1..30: note = chr12:10264869-10264899
  misc_feature 1..30: note = hypo
  source 1..30: mol_type = genomic DNA
atcagtggaagtaagcgtgagatcacggtg

SEQ ID NO: 73622 - DNA, 30 bp, Homo sapiens
  misc_feature 1..30: note = chr12:10268125-10268155
  misc_feature 1..30: note = hypo
  source 1..30: mol_type = genomic DNA
ccggcgtcctgagtgcggtgagtaaagatg

SEQ ID NO: 73623 - DNA, 179 bp, Homo sapiens
  misc_feature 1..179: note = chr12:10306356-10306535
  misc_feature 1..179: note = hyper
  source 1..179: mol_type = genomic DNA
cccagccagcacatccgccatcctgcaccccaggttccggcacgggctgcgacggggcctcggaactgctcccaagcggctgggaaagaactcagtcaggcatgtcggcctgcaaagcacccaggatgggcagtggagtctgcaccgttgacaggctcctagagcggccaggcagagga

SEQ ID NO: 73624 - DNA, 91 bp, Homo sapiens
  misc_feature 1..91: note = chr12:103100245-103100336
  misc_feature 1..91: note = hypo
  source 1..91: mol_type = genomic DNA
gccaatcacctagacttattataattagagttactagtcccttcaggttaccagtgaatttttttctataaagcaccgaggcttcaaagac

SEQ ID NO: 73625 - DNA, 361 bp, Homo sapiens
  misc_feature 1..361: note = chr12:103218204-103218565
  misc_feature 1..361: note = hyper
  source 1..361: mol_type = genomic DNA
tagatcttcatcgggcgcccctttctcatctctcgggctctgactcctcttggggtgcttagttcaaggctggacagcctagaagacacccaccaagtgtgggtggggaagaagcagagcaagggcaggccgacccgatctgcagccacactccttgtcctccgggtgaaactgcagaccgcacagcgctgggaggacacatgggccacagggcgggagctgtccgtggttctggccggcgtcgacccgtgggtatttaagggttggggcagcccgcctaccttctgctaaaccgcagggaggagtcgggggctgcagaacctggattggttttaattaacccacgcgcaggcaaggtctg

SEQ ID NO: 73626 - DNA, 130 bp, Homo sapiens
  misc_feature 1..130: note = chr12:103311160-103311290
  misc_feature 1..130: note = hyper
  source 1..130: mol_type = genomic DNA
ggagggtgtgggggacgcaggaggcaccacttcgctgcccgccctgggtaaagggaagaagccagggagcgacgggccacccaagccccgtcgattagacaggtttaggcacttccgggactctcagaag

SEQ ID NO: 73627 - DNA, 115 bp, Homo sapiens
  misc_feature 1..115: note = chr12:103344593-103344708
  misc_feature 1..115: note = hyper
  source 1..115: mol_type = genomic DNA
ttgggggctgagactcgccaggacgcactcagaatgaactttccgcgcaggtcagatataggcacccaggggttttgtgacgtcacaatgccgtctgacccggtgaaaggcaaag

SEQ ID NO: 73628 - DNA, 106 bp, Homo sapiens
  misc_feature 1..106: note = chr12:103350198-103350304
  misc_feature 1..106: note = hyper
  source 1..106: mol_type = genomic DNA
agcgacggctgcaagcgcctccccctccctctcggcgccagcacgcggccccgccgggctccgctcccagtcgcctgccaccgggccgccgggcacacgcctgggg

SEQ ID NO: 73629 - DNA, 239 bp, Homo sapiens; identical to SEQ ID NO: 34577
  misc_feature 1..239: note = chr12:103350383-103350622
  misc_feature 1..239: note = hyper
  source 1..239: mol_type = genomic DNA

SEQ ID NO: 73630 - DNA, 570 bp, Homo sapiens
  misc_feature 1..570: note = chr12:103351416-103351986
  misc_feature 1..570: note = hyper
  source 1..570: mol_type = genomic DNA
gtcccattgaaaaggcggacgcactccggcagcccagcactctctcacttctggccagggaacgtggaaggcgcaccgacagggatccggccagggagggcgagtgaaagaaggaaatcagaaaggaagggagttaacaaaataataaaaacagcctgagccacggctggagagaccgagacccggcgcaagagagcgcagccttagtaggagaggaacgcgagacgcggcagagcgcgttcagcactgacttttgctgctgcttctgcttttttttttcttagaaacaagaaggcgccagcggcagcctcacacgcgagcgccacgcgaggctcccgaagccaacccgcgaagggaggaggggagggaggaggaggcggcgtgcagggaggagaaaaagcattttcactttttttgctcccactctaagaagtctcccggggattttgtatatattttttaacttccgtcagggctcccgcttcatatttccttttctttccctctctgttcctgcacccaagttctctctgtgtccccctcgcgggccccgcacctcgcgtcccggat

SEQ ID NO: 73631 - DNA, 104 bp, Homo sapiens; identical to SEQ ID NO: 1058
  misc_feature 1..104: note = chr12:103352051-103352155
  misc_feature 1..104: note = hyper
  source 1..104: mol_type = genomic DNA

SEQ ID NO: 73632 - DNA, 97 bp, Homo sapiens; identical to SEQ ID NO: 1059
  misc_feature 1..97: note = chr12:103352170-103352267
  misc_feature 1..97: note = hyper
  source 1..97: mol_type = genomic DNA

SEQ ID NO: 73633 - DNA, 15 bp, Homo sapiens
  misc_feature 1..15: note = chr12:103352268-103352283
  misc_feature 1..15: note = hyper
  source 1..15: mol_type = genomic DNA
cccaagcaagtcaag

SEQ ID NO: 73634 - DNA, 524 bp, Homo sapiens
  misc_feature 1..524: note = chr12:103352313-103352837
  misc_feature 1..524: note = hyper
  source 1..524: mol_type = genomic DNA
cgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacgacccgctcagccccgaggagcaggagcttctcgacttcaccaactggttctgaggggctcggcctggtcaggccctggtgcgaatggactttggaagcaggtaggttgcattttggggtgggcaggggggtattcttgccttcgtcctccctctgag

SEQ ID NO: 73635 - DNA, 312 bp, Homo sapiens
  misc_feature 1..312: note = chr12:103358661-103358973
  misc_feature 1..312: note = hyper
  source 1..312: mol_type = genomic DNA
gttctttacccactgcgaaagcgaatggcttggatctagcgcaggtcgaagttatattccttcttcctttgtatgcaagattaggttgttacaaaagagggtgtgtaggttaatggcaggaagcaagttgcagcgcggagcgcgggccctgagcgcgtgtcaggcttaatgatttattcaagctgcagcgcatccgggcgttgattggctgcaggcatgcgtccgctgtcagctgcgcgcgccgggaactctccaggctacctgaagctggggggaggaagaggaggcgtggggacccgaggggagaggtgt

SEQ ID NO: 73636 - DNA, 339 bp, Homo sapiens
  misc_feature 1..339: note = chr12:103359233-103359572
  misc_feature 1..339: note = hyper
  source 1..339: mol_type = genomic DNA
gagacaggagtgggacgcgctcccagaacgtcccgcgtgcgcccccctctaggcagccagcgggcggccgcttacaaagccgcctttgatgctctggctaccagggctattttggggacgagatgggggaaagccgccaacccacactccttggagggagtcactttctgcaaagtgcgttggagaggactgggccctgggtccgggctgtcgaagcaggaagtggatgtaggggacaaaagctccgcacctgccaaatgcgagaccttagagagagcctccccctcgccgctccctgctcccccgcgggcccgggaagcttgcactaccgggctcagc

SEQ ID NO: 73637 - DNA, 145 bp, Homo sapiens; identical to SEQ ID NO: 34585
  misc_feature 1..145: note = chr12:103359573-103359718
  misc_feature 1..145: note = hyper
  source 1..145: mol_type = genomic DNA

SEQ ID NO: 73638 - DNA, 41 bp, Homo sapiens; identical to SEQ ID NO: 43385
  misc_feature 1..41: note = chr12:10363278-10363319
  misc_feature 1..41: note = hypo
  source 1..41: mol_type = genomic DNA

SEQ ID NO: 73639 - DNA, 222 bp, Homo sapiens
  misc_feature 1..222: note = chr12:10364324-10364546
  misc_feature 1..222: note = hypo
  source 1..222: mol_type = genomic DNA
tggggaaatccagaacgaggcttcgcctcacctgccctaatgcccaatcttctactagcattccaggcagcgctttctagtcacgtgagggatacctaaccactggaactaaataagatgtgggggaacaactgaggtcatcacctaaattgcttgatactctcttttccagaagacgagccccctttctgagtttatggcagaaagtgaatccctccctcc

SEQ ID NO: 73640 - DNA, 30 bp, Homo sapiens
  misc_feature 1..30: note = chr12:10366550-10366580
  misc_feature 1..30: note = hyper
  source 1..30: mol_type = genomic DNA
agtagttaaaactaccgcaggcagtgagta

SEQ ID NO: 73641 - DNA, 351 bp, Homo sapiens
  misc_feature 1..351: note = chr12:103889165-103889516
  misc_feature 1..351: note = hyper
  source 1..351: mol_type = genomic DNA
cgcccccaaccgctccgcccggcccctcccccgctccctcccccacccctcccccttcctgtattagcatgcgggcggcggcgagccggccgggtggggagggcggcggtggcatcgctgcgcggggcgcattgtgggccgcgctcgcctccgcgggggaccatctgctcgctgtcaatgcatcacctgctcgtctgggccgtcgccggggcaacggggggcgggggattaaggagcgtgtgcgtctcggtccgggccgaggcggcgaggtgggggttggggcgggggaggagagctccttggccccccacccccctgccccgagacgggtcgacccgctcgggggccggc

SEQ ID NO: 73642 - DNA, 197 bp, Homo sapiens; identical to SEQ ID NO: 1063
  misc_feature 1..197: note = chr12:103889517-103889714
  misc_feature 1..197: note = hyper
  source 1..197: mol_type = genomic DNA

SEQ ID NO: 73643 - DNA, 237 bp, Homo sapiens; identical to SEQ ID NO: 34588
  misc_feature 1..237: note = chr12:103889788-103890025
  misc_feature 1..237: note = hyper
  source 1..237: mol_type = genomic DNA

SEQ ID NO: 73644 - DNA, 30 bp, Homo sapiens
  misc_feature 1..30: note = chr12:103897121-103897151
  misc_feature 1..30: note = hypo
  source 1..30: mol_type = genomic DNA
tcacagtcctcgttccgccccctcgcccac

SEQ ID NO: 73645 - DNA, 207 bp, Homo sapiens
  misc_feature 1..207: note = chr12:103922840-103923047
  misc_feature 1..207: note = hypo
  source 1..207: mol_type = genomic DNA
aacaacgaaaaaaaacgccattgcaaactataccatgaaaaccaataaatgcccatcctccaggtgcctgagcatgacttaaaaataggggtgaatcctatccacgtatcggcatctggtgtcaaatcatcacaatgaacagtagcacaagatctcaacctttgtgttcacttattttactcctctctttaccgttattaatagctg

SEQ ID NO: 73646 - DNA, 175 bp, Homo sapiens
  misc_feature 1..175: note = chr12:104322966-104323141
  misc_feature 1..175: note = hyper
  source 1..175: mol_type = genomic DNA
gcatcctcctgcactcgttaaactaagggttttccttttctgtgctagacccgcttttacgaccacgctctccacctgattcacagaaagggttctacgaccgtcaggtcaccgccgcctttgtactttattggggagtcgaaggcctcagcgctgctcgcgatttccctaaggt

SEQ ID NO: 73647 - DNA, 18 bp, Homo sapiens
  misc_feature 1..18: note = chr12:104354143-104354161
  misc_feature 1..18: note = hypo
  source 1..18: mol_type = genomic DNA
acccggccaatctgtacc

SEQ ID NO: 73648 - DNA, 30 bp, Homo sapiens
  misc_feature 1..30: note = chr12:104539506-104539536
  misc_feature 1..30: note = hypo
  source 1..30: mol_type = genomic DNA
taaggcatttatattcgtctgttctcacgc

SEQ ID NO: 73649 - DNA, 190 bp, Homo sapiens; identical to SEQ ID NO: 34590
  misc_feature 1..190: note = chr12:104609336-104609526
  misc_feature 1..190: note = hyper
  source 1..190: mol_type = genomic DNA

SEQ ID NO: 73650 - DNA, 270 bp, Homo sapiens; identical to SEQ ID NO: 1066
  misc_feature 1..270: note = chr12:104609527-104609797
  misc_feature 1..270: note = hyper
  source 1..270: mol_type = genomic DNA

SEQ ID NO: 73651 - DNA, 158 bp, Homo sapiens
  misc_feature 1..158: note = chr12:104671514-104671672
  misc_feature 1..158: note = hypo
  source 1..158: mol_type = genomic DNA
acttgttgtttttaccggtttttagcctgttcctcactctatattatttaattgtaagacaaacaatggatttggaggtaggcacagttggatttatataccagctccaacacttacctggtttgtgacctttggcaagattcttttttttttttttt

SEQ ID NO: 73652 - DNA, 30 bp, Homo sapiens; identical to SEQ ID NO: 15682
  misc_feature 1..30: note = chr12:104690709-104690739
  misc_feature 1..30: note = hypo
  source 1..30: mol_type = genomic DNA

SEQ ID NO: 73653 - DNA, 84 bp, Homo sapiens
  misc_feature 1..84: note = chr12:104695390-104695474
  misc_feature 1..84: note = hypo
  source 1..84: mol_type = genomic DNA
aggcgtgagccaccgtgcccggctgcttttgttgaatttaaagtggatgtgagaagctcctaagaatatcgttcactgtaaaag

SEQ ID NO: 73654 - DNA, 102 bp, Homo sapiens; identical to SEQ ID NO: 43535
  misc_feature 1..102: note = chr12:104696536-104696638
  misc_feature 1..102: note = hypo
  source 1..102: mol_type = genomic DNA

SEQ ID NO: 73655 - DNA, 30 bp, Homo sapiens; identical to SEQ ID NO: 43536
  misc_feature 1..30: note = chr12:104698273-104698303
  misc_feature 1..30: note = hypo
  source 1..30: mol_type = genomic DNA

SEQ ID NO: 73656 - DNA, 293 bp, Homo sapiens; identical to SEQ ID NO: 34592
  misc_feature 1..293: note = chr12:104850244-104850537
  misc_feature 1..293: note = hyper
  source 1..293: mol_type = genomic DNA

SEQ ID NO: 73657 - DNA, 968 bp, Homo sapiens
  misc_feature 1..968: note = chr12:104850577-104851545
  misc_feature 1..968: note = hyper
  source 1..968: mol_type = genomic DNA
cgcacaccgcactccccgggcaacagctggacgcgaccatatcccgggtaggggcggggggagcgcgacgctccgccccggcgctagggtccctccctcctcccggctctccgcaggcgccctcccctcgccgggggccgcgagttgcatttggtaaaacccagccccggaatatatagatcgttggagcgcaatgaagtagcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggcggcggagcggcgaggaggaggagcaggagcgcgcagccagcgggtccacgcatctcagcacttccagaccaactccggcaccttccacacccctgcccgggctgggggctccgagagcggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtgatgaggatgaacagaatctgccggatggtgctggccacttgcttgggatcctttatcctggtcatcttctatttccaaagtatgttgcacccaggtagggggcgcgttagcgtggttttgttggatattttcttctctctcgcgctctagctcgctccgcctgatttctgcctcttccaaccctacctctccgccttcggcctcttcggggctcctggctgcccagagctcctggctgcccagatctacccgggtcaccgcgtcgggatggggaggagaagggaaggtgtgcttcgccctcttcttcctaccggctccgggctggaggatgg

SEQ ID NO: 73658 - DNA, 258 bp, Homo sapiens
  misc_feature 1..258: note = chr12:104851893-104852151
  misc_feature 1..258: note = hyper
  source 1..258: mol_type = genomic DNA
ggtgtggagagtggtcgggtgcccagcgttgcccctccaccacgcgccggccgtttgcccccggggtccgggtccgcagtgaccttgcggctggtgccccggggcctgctccagcccccagccctgagctggaaactccgagctcctgggtcacgccttgaccactgcagttttggaggaaactttggccaggtcctgggctgaccgtccgtttgcatcccccacttctgggatccgagcaacgggaatcccccgggc

SEQ ID NO: 73659 - DNA, 287 bp, Homo sapiens; identical to SEQ ID NO: 11387
  misc_feature 1..287: note = chr12:104852152-104852439
  misc_feature 1..287: note = hyper
  source 1..287: mol_type = genomic DNA

SEQ ID NO: 73660 - skipped

SEQ ID NO: 73661 - DNA, 385 bp, Homo sapiens
  misc_feature 1..385: note = chr12:104852447-104852832
  misc_feature 1..385: note = hyper
  source 1..385: mol_type = genomic DNA
ttggctcagaaatccattttctacgcctccgagttgcctttctcagcgtagtcacagcaataatttgcttttctaattgcaaggaggagggaggtggaaacgcatttccttccagggaagtggggttggtgtttttcatttttgcctcccgccttctcctttcactgtgtatctaacactttaaacagacgcagtcccgaattcatcaagcctgcgtttgggtcgatggcagaggaataaagctgttctttccatcaaacaggcagggctgcaggctgcagattccttgacagcgcagggacagacggcccctttgccccactcggtctggagcagttgttaaggcagccacactgccaaggatatggtccgactctaccacatg

SEQ ID NO: 73662 - DNA, 30 bp, Homo sapiens
  misc_feature 1..30: note = chr12:104858624-104858654
  misc_feature 1..30: note = hypo
  source 1..30: mol_type = genomic DNA
gatgaaatggatcagcgctctgggagtgga

SEQ ID NO: 73663 - DNA, 39 bp, Homo sapiens
  misc_feature 1..39: note = chr12:104975776-104975815
  misc_feature 1..39: note = hypo
  source 1..39: mol_type = genomic DNA
gtaagggatgcactacgtcattatcgtcagcatcatcat

SEQ ID NO: 73664 - DNA, 76 bp, Homo sapiens
  misc_feature 1..76: note = chr12:104983800-104983876
  misc_feature 1..76: note = hypo
  source 1..76: mol_type = genomic DNA
aaataaataaataaatgaagatgcctcaccctagctggcccgtcccttggctattaggtgccgcatgacccttgta

SEQ ID NO: 73665 - DNA, 78 bp, Homo sapiens; identical to SEQ ID NO: 43538
  misc_feature 1..78: note = chr12:105018625-105018703
  misc_feature 1..78: note = hypo
  source 1..78: mol_type = genomic DNA

SEQ ID NO: 73666 - DNA, 39 bp, Homo sapiens
  misc_feature 1..39: note = chr12:105025106-105025145
  misc_feature 1..39: note = hypo
  source 1..39: mol_type = genomic DNA
aagtcattttattgacggtggtagcggaccctgttggtg

SEQ ID NO: 73667 - DNA, 96 bp, Homo sapiens
  misc_feature 1..96: note = chr12:105029202-105029298
  misc_feature 1..96: note = hypo
  source 1..96: mol_type = genomic DNA
agaagatgtaattgccggttgtcttacaagcagtcatctcatcacaggggggttggaaggagaattcaggagccaaacagccgcaagagcacctgg

SEQ ID NO: 73668 - DNA, 96 bp, Homo sapiens
  misc_feature 1..96: note = chr12:105056873-105056969
  misc_feature 1..96: note = hypo
  source 1..96: mol_type = genomic DNA
agactagggagcacccgggaggatccagcaggctggcctgtgttgggtcagtgcaacaaggcttccttccagaggcctgggcgagccctgtctaac

SEQ ID NO: 73669 - DNA, 153 bp, Homo sapiens
  misc_feature 1..153: note = chr12:105069312-105069465
  misc_feature 1..153: note = hypo
  source 1..153: mol_type = genomic DNA
aatgaatgaatgaaccgaactaacaaccgctgttatgagccgagtgcttactcagtgccaagtgctttgtttggactttattcaatccaggggttgaagaaccactcactctggagtcagattcctggtcctaaaccacgtacttaagcaaat

SEQ ID NO: 73670 - DNA, 88 bp, Homo sapiens
  misc_feature 1..88: note = chr12:105100669-105100757
  misc_feature 1..88: note = hypo
  source 1..88: mol_type = genomic DNA
gaggagagaaggggtcgggaggaggatgggatcacagcgaggctctgaattgaggtccatttccaccctttggcggcatagactggaa

SEQ ID NO: 73671 - DNA, 30 bp, Homo sapiens
  misc_feature 1..30: note = chr12:105103480-105103510
  misc_feature 1..30: note = hypo
  source 1..30: mol_type = genomic DNA
cagaataggcaaatccgtggagacagagag

SEQ ID NO: 73672 - DNA, 42 bp, Homo sapiens
  misc_feature 1..42: note = chr12:105104150-105104192
  misc_feature 1..42: note = hypo
  source 1..42: mol_type = genomic DNA
gcaggctcttttcttcggtggcacttccgtgggctctctggg

SEQ ID NO: 73673 - DNA, 119 bp, Homo sapiens
  misc_feature 1..119: note = chr12:105140973-105141092
  misc_feature 1..119: note = hypo
  source 1..119: mol_type = genomic DNA
cggctgcccgggagccgataactcccgggtgggtctccagaccccaggaggctgcaccatgcagggtctcagaccacagtctgcctggactcgaaccccagacccggttcctagctccc

SEQ ID NO: 73674 - DNA, 30 bp, Homo sapiens
  misc_feature 1..30: note = chr12:105147152-105147182
  misc_feature 1..30: note = hypo
  source 1..30: mol_type = genomic DNA
ttacctggctcacaacgagcactcacccag

SEQ ID NO: 73675 - DNA, 30 bp, Homo sapiens
  misc_feature 1..30: note = chr12:105150821-105150851
  misc_feature 1..30: note = hypo
  source 1..30: mol_type = genomic DNA
ggtgctgacccccaacgacctgaagcactt

SEQ ID NO: 73676 - DNA, 30 bp, Homo sapiens
  misc_feature 1..30: note = chr12:105392811-105392841
  misc_feature 1..30: note = hypo
  source 1..30: mol_type = genomic DNA
tggcagtgttggtgtcggagtggggtactg

SEQ ID NO: 73677 - DNA, 30 bp, Homo sapiens
  misc_feature 1..30: note = chr12:105393128-105393158
  misc_feature 1..30: note = hypo
  source 1..30: mol_type = genomic DNA
tctgccattcaggcacgatctgccaactca

SEQ ID NO: 73678 - DNA, 333 bp, Homo sapiens
  misc_feature 1..333: note = chr12:105478020-105478353
  misc_feature 1..333: note = hyper
  source 1..333: mol_type = genomic DNA
tttgtttgttttaaacgctgtcttggtgtttagcaaagtctaagcatcgctgctcatccccagccccaccgccccggccctcccgccccggagtctggaaaccaggacagggtgacagccgggacgctcgcccgggccggactcacccggccagtggagaagcgccggagcgcctggctgccccgccgcagcatgctggagaggagcgctagcactggcgacgcggcagcgcgggaggcaggcgggcggcgcagcctgggcgcggcctgggcgcggcctgcagtctggatgccccggactgcctggctcgcggctcgccgctctcggcctctg

SEQ ID NO: 73679 - DNA, 30 bp, Homo sapiens
  misc_feature 1..30: note = chr12:105673102-105673132
  misc_feature 1..30: note = hypo
  source 1..30: mol_type = genomic DNA
cactgcaattactttcgcaccaacctaata

SEQ ID NO: 73680 - DNA, 31 bp, Homo sapiens
  misc_feature 1..31: note = chr12:1057793-1057824
  misc_feature 1..31: note = hypo
  source 1..31: mol_type = genomic DNA
agcctgggcaacagagcgagactatgtctcc

SEQ ID NO: 73681 - DNA, 82 bp, Homo sapiens
  misc_feature 1..82: note = chr12:1059279-1059361
  misc_feature 1..82: note = hyper
  source 1..82: mol_type = genomic DNA
gaccttcccagattccgcccgggccgaggcagcggtggacctggtggttctcgcggcctctcaccaccgccgcgcacatcca

SEQ ID NO: 73682 - DNA, 189 bp, Homo sapiens
  misc_feature 1..189: note = chr12:106532217-106532406
  misc_feature 1..189: note = hyper
  source 1..189: mol_type = genomic DNA
cccgcttgactttgccgtaggtgcctttgcccagggtctcctgcagctcgtagcggtgcttcaagttgtgcttgtggtgatgccgcttcaccccgtgcggcttcctgggctccagggctgcagtcgcccccgccaccgcctctcggggagagcccggcgcccccagccccaagtcggggcggtcccccg

SEQ ID NO: 73683 - DNA, 30 bp, Homo sapiens
  misc_feature 1..30: note = chr12:106533379-106533409
  misc_feature 1..30: note = hyper
  source 1..30: mol_type = genomic DNA
gaggctggcaccccgcggggcagagctgcg

SEQ ID NO: 73684 - DNA, 35 bp, Homo sapiens
  misc_feature 1..35: note = chr12:10658417-10658452
  misc_feature 1..35: note = hypo
  source 1..35: mol_type = genomic DNA
cggcctccgcatccccgccccgcactaggacccct

SEQ ID NO: 73685 - DNA, 696 bp, Homo sapiens
  misc_feature 1..696: note = chr12:106974297-106974993
  misc_feature 1..696: note = hyper
  source 1..696: mol_type = genomic DNA
ggctccgggttcttccgcctcactcctggcctgtgagcccggctcacctcaccctacccacctccactctgcgtgcaaaaattataataataatagcaacaataatagtctcatccgccctggagaccacccgtgcccccgtggcatccctcaaggactctccgggcggtggcagccgcccaccctggggacgcgctccttgctgccaccggaacgcccctggccaggctccatctacgcgctgtcagaccctcccgccgtctgaagaaggcttttactcttcagcctattccagtggcagagaagctaaggctacaaaggcgaacgcgaacagtcagatctgacttcgaattccgctgtcattgctgccaggcgcaccacgaggacgcgcggtgaccgccaccatggcattcggctgccaaaggtttccatcgacctctttcccatcaccagcatcgcagcgggaaagaatgtgcctggcgcccttctgggcactgggcatggggtggtgaacaaagtcctccagaaataaaccgggtaatgagcccggcagcggccggggcaggaagggaccttcgcagagagtggtcaggcacagcccctccgaggaggcgacgctcagctgagaccagggtgacgcaaaggtgtcggccggttaggcacctgtgaggaaggaggagccggcagagtgccaag

SEQ ID NO: 73686 - DNA, 481 bp, Homo sapiens
  misc_feature 1..481: note = chr12:106975246-106975727
  misc_feature 1..481: note = hyper
  source 1..481: mol_type = genomic DNA
gggctccccagtctccgtacattgtcccactcagctctgattgtggggagggggcggaccgagggggcggggggcgtctttccgaaggatcgcggaaagccgcgcgctgccaggggcccggggttagagacccccactcccgcacggcgttagggactccgcgcttccccgcccccgccgcggcccgccggctctgcctctgtccatggtcaaagcacccggggtaatccgcctttctcttccgcccgccgggccccattcatattctaatcacagcgcggccgacccgcgaacggccactttatcggggcccgcaggagacgcagcttgctccccctcacttccacttccagcaccccccggccctcgcccccctctttctgcactttcaactccgccgaggagggggtccctgggaaaaccgcgtccccacttggatgccggggcttctcacaaacttcgaggccgactgggggacggc

SEQ ID NO: 73687 - DNA, 377 bp, Homo sapiens
  misc_feature 1..377: note = chr12:106976403-106976780
  misc_feature 1..377: note = hyper
  source 1..377: mol_type = genomic DNA
cccggcctgccagcacggcgcggggcccgatggtggggaagggccgggagggggagggggccacatctaagccaattttgatttcgcctataatgagtgccgggcgaaggctggagaaggcctctggaactttaaataagaaaaacgttgctaatgctataatagaagggggaagtcggagggctgggattgcgtcgctctgagccccccttttcggaggcggcttttcttattcaaaacaggcccacaatgggcttcacagtgcgcctcgccacggccccatctgacgagcggccattcatcaggccggctggcctatcaatgacattgctcccatcggggctcctataaaatgatgctttttcccatgaaacatc

SEQ ID NO: 73688 - DNA, 45 bp, Homo sapiens
  misc_feature 1..45: note = chr12:106976842-106976887
  misc_feature 1..45: note = hyper
  source 1..45: mol_type = genomic DNA
cgctttttctctctcccccttctccgagctcgctcccttctctcc

SEQ ID NO: 73689 - DNA, 459 bp, Homo sapiens
  misc_feature 1..459: note = chr12:106977393-106977852
  misc_feature 1..459: note = hyper
  source 1..459: mol_type = genomic DNA
tttcgcttgccctggacacaaagttacgtaaagatgcgctggctcgcggcgagctcgaggtgccacttgcagaaactttgccagccgaccgccccctcccggacccaggtcctcctagggtatgggggcctcggaatagcggtgcgctcggggtctggcggccagggccgggaagccgagcggaacgccccgaggcgggggagggtgacggcttcgcactgcgcctgggaggtggggaccgaggctccggctggtagagacgcgcagctggagggagtggcggcggcgaacccggtggtccgggggaatccgcagaaacgggaggtgggagtcctgggctgtggggtcgggcttttagcttttctgccaggaaggggcacccaacgccgggctccactagggagctgtgaccttgctggagggagggcaggacgcagactggcccgctaaactcggcgt

SEQ ID NO: 73690 - DNA, 72 bp, Homo sapiens
  misc_feature 1..72: note = chr12:106978702-106978774
  misc_feature 1..72: note = hyper
  source 1..72: mol_type = genomic DNA
ccctgcgtgcctctccggacacggcaggccccgctgaggtctctactggcggtaaagcgggagcccagagag

SEQ ID NO: 73691 - DNA, 557 bp, Homo sapiens
  misc_feature 1..557: note = chr12:106979033-106979590
  misc_feature 1..557: note = hyper
  source 1..557: mol_type = genomic DNA
gctgtggattcgtggcgttttctgttctcgatgcaactggtgctcgtgggggcaccgggtcctcttcacctcaactgcaaacactccagagacgttctgaaatgaaatcctttccccatccacttctctcccttttgtatatccgagacatccctaggtcaccaccctgaacgcaaaatcaaaagttttggtacacgacagtgtgaagaaatgacactagacgcaccaggtgacatttcactccgacttgcaaaaccgacgacaagggaagtgcggctcggcgtggtccagtccagaagccttccctcacctcccttccagagaatttaatccaattagcctttcttctgagtttcccttgttatgtaaagggtcttttctcctggcttgcagagacgcgcgctccatggagcagttcgattctgctccttttgtataagatcgcgcgcgatcagaaccaggaatattgctgttattatatcattccgaaaggactggaacaaccgactcacagcaagtgctggggcgaagtaggaaacgtccaggataagagaggc

SEQ ID NO: 73692 - DNA, 238 bp, Homo sapiens; identical to SEQ ID NO: 34610
  misc_feature 1..238: note = chr12:106979636-106979874
  misc_feature 1..238: note = hyper
  source 1..238: mol_type = genomic DNA

SEQ ID NO: 73693 - DNA, 872 bp, Homo sapiens
  misc_feature 1..872: note = chr12:106979875-106980747
  misc_feature 1..872: note = hyper
  source 1..872: mol_type = genomic DNA
agcccgacaaagcaaagcccctctcggaggcaaagccccagcttgccgcgcgccgcggtgctccggcaggaggcaaaggcgacaggcgcgcgcaggggcagtcgacgcaccttctggccggtgcgcggtttgcagtaagcgcaggcgcgcgtcccgctcggcccgcgctacagccccacgccgcgcaaaagtgggtgctgagccccgcgtggcctgcgctccccacgcgggccaccggcagctacgtgtttgtggccgccgggtccaatcagggctgctctgcccgggtgatcgttgctcagttactcaagttatccggaaattcgagaacgatgggggaaagtgggtagaattttaggccaccgagaacttgtgcaaagtgggccgggccgggtcggtcgcctacgcaacagaaggatcatttcttttaaaacgggatggcgcgttagagagggccactgccaagctggagctggaaacttctgcctccatccactttccgctcccatctccagaacccagagctgaggcggccaaagtacttcctggagccggatttgagttccccgggccgcatcggtgggagggcacgctagtttacaggcccccagctcagcacaaattctttctaaaattctaccaccaaattaattatatgcctttgtgggcccggggtagggatgtccagtggccttggcgccgtgcccacaaggcaaagtgcgtcctggagggaacagggcccgagcctcctccattcttgcccaggcacagccctggggaaggagccactgtctgcgggcttgggagagcaaggagccggaggtccgagccttgctccagcgcccaaaccagacagtctcgccctccccggg

SEQ ID NO: 73694 - DNA, 741 bp, Homo sapiens
  misc_feature 1..741: note = chr12:106980911-106981652
  misc_feature 1..741: note = hyper
  source 1..741: mol_type = genomic DNA
cgcaggctgggtcctcggagtcccggattcagcacgcgactctgtgcggcagcctgggacagcgcgctttcctacccggcctgcaggtcccagagactcggaaaagtttgcaggggccgcccggcgcctcgggcctgggatttccaaagccgctcccgcccccgtccccagcgcgtcaccatggagactgctggaagttggtggtggaaaacagacctggcgcaaagcaaaatattatgagtgcagttggggtgacttcagggggcggggggaccggagggcaggagcgggagccagaggcagaggccgacaacaaagggcccagtgcgaggaagagagaggagtttgcacggggcctccccgccgctgtgtgagtgctggaccatcctgcttcccagaggctccgaggtctctaatttctctccagcagctataccttttctcagcccgccttggagcccttgctccctccctcctctccgggttctcttccagcctcccccctcacccgtccggaggttaggcgccagctgggcagtgcgcccgcctccccaggagccacaggctcaccaacgtgaaaggttctggcttttcttccccacgacccgtgggtcgcccagggtgagtttctcaccccctatctcaaacccgatctgaaagggtgatgggttagaataaggtgggaacggaacgggaagagaagggagcgtctggccagaaatcttgcgagtggggatgggt

SEQ ID NO: 73695 - DNA, 200 bp, Homo sapiens; identical to SEQ ID NO: 43542
  misc_feature 1..200: note = chr12:107138858-107139058
  misc_feature 1..200: note = hypo
  source 1..200: mol_type = genomic DNA

SEQ ID NO: 73696 - DNA, 47 bp, Homo sapiens
  misc_feature 1..47: note = chr12:107297268-107297315
  misc_feature 1..47: note = hyper
  source 1..47: mol_type = genomic DNA
tgactgggaagcttccgcagggaattccgccccggacccctggagac

SEQ ID NO: 73697 - DNA, 50 bp, Homo sapiens
  misc_feature 1..50: note = chr12:1073029-1073079
  misc_feature 1..50: note = hypo
  source 1..50: mol_type = genomic DNA
gagtgacgagggcagcggtactctttcaaatggagcgattgcttagggaa

SEQ ID NO: 73698 - DNA, 30 bp, Homo sapiens
  misc_feature 1..30: note = chr12:107432746-107432776
  misc_feature 1..30: note = hypo
  source 1..30: mol_type = genomic DNA
acacagagtgctgggcgtggtggtgcatgc

SEQ ID NO: 73699 - DNA, 146 bp, Homo sapiens; identical to SEQ ID NO: 34616
  misc_feature 1..146: note = chr12:107486450-107486596
  misc_feature 1..146: note = hyper
  source 1..146: mol_type = genomic DNA

SEQ ID NO: 73700 - DNA, 645 bp, Homo sapiens
  misc_feature 1..645: note = chr12:107487210-107487855
  misc_feature 1..645: note = hyper
  source 1..645: mol_type = genomic DNA
ggcgacgctgtctctcggcccgggagaaaggaccgggaacggaggctagaggcggtggtcgaggccgctggacggttgccggccggtgaccggtcccgaggctgcccgggtgactctgccgccgccgccgcgtcagcggcctcggccccgcccccggctcctcattggagggcgcgctcccctcgtgaccaccggcacctcacgtttctgaagtgtgtttactacactggctcggaggggtaatctgctcgcgcttcggtcgcttttggaggagcggcagccgcttgatcccaaacttgttgaccctcgtccacacgctgaactcactgcctctgcccctttcctgtgccgactggtggccgtcccttggaagcaaatcgcgttgaccacaggccccttgtgagggaaggcttagccccgcccccaagggccatgagcggccaccattggccgaggctcgctgagacccggatgagcacggggatgcggggagcttgcgggcgcgcgcgctgctccgttaggcgcgcgtgcgctctcgctgcgttccagagggtaagggggcggggccggcgggcaggagcgcgctcggcgattcctcccgtgggatttggggagggcctggaaattgtccggtttccttcagga

SEQ ID NO: 73701 - DNA, 387 bp, Homo sapiens
  misc_feature 1..387: note = chr12:107711950-107712337
  misc_feature 1..387: note = hyper
  source 1..387: mol_type = genomic DNA
agggggcagcatccacgtctctacgcttgcaagggttccccaagtccctggccactgctccccacttcctgcagcctcggtgtccgccgggggcgtgtgtgaggggcggggccgcatggggaggagggatttaaaaaaaaaaaaaaaaagcgaggtaattagcattctccgattccactggctctccgccgcccctgctttgcatacgcccgtcccactggctgcccggggtttgctggggttcggcaaggtttgcagccgccacggccgctgctgcgctccggtgcagggcaggctggcgccgagcgaaccagggccgggaactgggagccgggagccgggagccagctgcccgcggagctgcggcggcggcggcatctggggtgg

SEQ ID NO: 73702 - DNA, 222 bp, Homo sapiens
  misc_feature 1..222: note = chr12:107713205-107713427
  misc_feature 1..222: note = hyper
  source 1..222: mol_type = genomic DNA
gagcgccatggagatcgtgctgtcctggggcctggccgcgcactgtacggcggctgcgctggccgcactgtccctctacaacatgagcagcgccggcggcgaccgcctgggccgcggcaagtcggcccgctgcggcctcaccttctccgtgggccgcgtgtatcgctggatggtggacagccgcgtggcgctgcgcatccacgagcacgccgccatctacct

SEQ ID NO: 73703 - DNA, 40 bp, Homo sapiens
  misc_feature 1..40: note = chr12:107714075-107714115
  misc_feature 1..40: note = hyper
  source 1..40: mol_type = genomic DNA
gcgaggttccgcccccggtgcggggcggggcgacagctgc

SEQ ID NO: 73704 - DNA, 657 bp, Homo sapiens
  misc_feature 1..657: note = chr12:107714660-107715317
  misc_feature 1..657: note = hyper
  source 1..657: mol_type = genomic DNA
gttagtttagggcgtcgtttccagcaggttctatcatcgtctcttcatgccccactgttttgaaggcctgacttgggtaggtttgaacccgcagttctgtccttgaagggggtggggccggggcgcttgttttcgagagctcgcgctggcggtgctgcccgtctgcgaaagccggagctagacacttcaaagcttcaattttccacaggaaatggtagaaacgtaactggagactctaaaggcgaaataaaactttgttacatattcggcggtttggccagaggttgcgcggttggagctgaaatgcagtctttctgggcagatttcattcatgttgctgcctgtctgtttcccgggggctggaggagcactgcggtgggcggtgccaagggtgtgcatgtgcgtgtgagagtctgtgtgcgcgcgcgtctgtgcgtgtgtaagtgtgcttgtgagtgtgcgcaggaacaagcgggcgcgcagggcgcccggctccagccgaagcctttggaaaccgaccctgccgccctcggtcccttcacctggatttgatcgtcagtgggggaggggaaggaaggagcaaagcgggtgtgtgtttgtgtgtgttggggaggggaatccgcactgatctcggagactcttcgggatctctttgcc

SEQ ID NO: 73705 - DNA, 86 bp, Homo sapiens
  misc_feature 1..86: note = chr12:1079112-1079198
  misc_feature 1..86: note = hypo
  source 1..86: mol_type = genomic DNA
tgttgacagactttgcgtcagtgtgaagtgagacacattgtcttcatatatcccactccatttctggtgatataatttagggctgg

SEQ ID NO: 73706 - DNA, 218 bp, Homo sapiens
  misc_feature 1..218: note = chr12:10813764-10813982
  misc_feature 1..218: note = hypo
  source 1..218: mol_type = genomic DNA
aacatcatgagtttacgatcaaaattccagaggaaaatcctgaaaagtttttgcctaatttttatttacattaaacaacaaatatatattaagtgctgttaaccattccttgctactcctccatatgtcccctctaacataattttgggccttttcccaggacccaagtaagatggcaaaatttagatgttatattcttgatccgtgtcatctcttcc

SEQ ID NO: 73707 - DNA, 492 bp, Homo sapiens; identical to SEQ ID NO: 1068
  misc_feature 1..492: note = chr12:108168922-108169414
  misc_feature 1..492: note = hyper
  source 1..492: mol_type = genomic DNA

SEQ ID NO: 73708 - DNA, 55 bp, Homo sapiens; identical to SEQ ID NO: 34622
  misc_feature 1..55: note = chr12:108169549-108169604
  misc_feature 1..55: note = hyper
  source 1..55: mol_type = genomic DNA

SEQ ID NO: 73709 - DNA, 30 bp, Homo sapiens
  misc_feature 1..30: note = chr12:108199937-108199967
  misc_feature 1..30: note = hypo
  source 1..30: mol_type = genomic DNA
tgtgctggcctgtcccggggatccctcccc

SEQ ID NO: 73710 - DNA, 178 bp, Homo sapiens
  misc_feature 1..178: note = chr12:108237347-108237525
  misc_feature 1..178: note = hyper
  source 1..178: mol_type = genomic DNA
gtgctaccaggaatccgagtagaagtggtcagggatggagcccagggccacctcatccttcttcctcctggagccaaacagcttcttcatcgcggcagcttcggagaagcctcagctaccctgcagctccccttcgccttttcgcggaatccggagtccagtcacaattagctaagcc

SEQ ID NO: 73711 - DNA, 134 bp, Homo sapiens
  misc_feature 1..134: note = chr12:108237660-108237794
  misc_feature 1..134: note = hyper
  source 1..134: mol_type = genomic DNA
cggctggcgctgggcttccagtgccggactgccagaacaggctgggagcgctggggtcttggcgctctgcagccaccagagatctggccgagtgggtctggttacccccacccctgtgccgccacagcccggca

SEQ ID NO: 73712 - DNA, 389 bp, Homo sapiens
  misc_feature 1..389: note = chr12:108238125-108238514
  misc_feature 1..389: note = hyper
  source 1..389: mol_type = genomic DNA
gcccccagctctgtgcgcccgctgaggaggagacagccagcagcgtggtcaggcaggctctcgcgctgaggaggcagtgcactcaggatactgaggccgcccagagcacgccccgccaacccacctaggcgcctgagctgcagcctctgcgccgtctctgccgcggtccggcaggccgcctggattggccgccgccgctgctgccaccacggtgtccacccaacgactctaatgtgggaagtctggcggtggagggtgtcgcgggctctccggcagacccgtagctggtggtggagctgagggccctggggcatggcgggcagggacttgaggcccgcaggaggagggggccgtgccgatgctggctgtgccggggctgcctgagaacc

SEQ ID NO: 73713 - DNA, 32 bp, Homo sapiens; identical to SEQ ID NO: 43387
  misc_feature 1..32: note = chr12:10823904-10823936
  misc_feature 1..32: note = hypo
  source 1..32: mol_type = genomic DNA

SEQ ID NO: 73714 - DNA, 433 bp, Homo sapiens; identical to SEQ ID NO: 34625
  misc_feature 1..433: note = chr12:108297323-108297756
  misc_feature 1..433: note = hyper
  source 1..433: mol_type = genomic DNA

SEQ ID NO: 73715 - DNA, 231 bp, Homo sapiens
  misc_feature 1..231: note = chr12:108523208-108523439
  misc_feature 1..231: note = hyper
  source 1..231: mol_type = genomic DNA
gcagccggtgccctgcgcgcaccgggcccgggcatctccatccccggggcgggtgcccgcgcggggcctcgccgcggctcggggcacccgcagtgccgcccgcccgagcgccaggctcacaggagcccggctttcacttcctctcgcttccgcccgcctccctggctcgccggctggcgtcgccaccgcctcctcgtccccggccaccgctgtcgccgctgctgcaattca

SEQ ID NO: 73716 - DNA, 36 bp, Homo sapiens
  misc_feature 1..36: note = chr12:108523736-108523772
  misc_feature 1..36: note = hyper
  source 1..36: mol_type = genomic DNA
gctccaggagggagccgggcgcggagctggtgcgaa

SEQ ID NO: 73717 - DNA, 22 bp, Homo sapiens
  misc_feature 1..22: note = chr12:108569903-108569925
  misc_feature 1..22: note = hypo
  source 1..22: mol_type = genomic DNA
ccacgcccggcctattgttata

SEQ ID NO: 73718 - DNA, 17 bp, Homo sapiens
  misc_feature 1..17: note = chr12:10857716-10857733
  misc_feature 1..17: note = hypo
  source 1..17: mol_type = genomic DNA
ggagtctcactctgtcg

SEQ ID NO: 73719 - DNA, 76 bp, Homo sapiens
  misc_feature 1..76: note = chr12:108603987-108604063
  misc_feature 1..76: note = hypo
  source 1..76: mol_type = genomic DNA
catggagtgcaagggcgagcgaggcagcgtgtgcggcggcgccaaccgcctctctgtctaccggctgcagctggcc

SEQ ID NO: 73720 - DNA, 174 bp, Homo sapiens
  misc_feature 1..174: note = chr12:10875104-10875278
  misc_feature 1..174: note = hyper
  source 1..174: mol_type = genomic DNA
cctttcttctccaaacgcaggcattttccaccacgcgaatccgcaacagtgcccgtctgggagacagaagttaagacctaaactttctggcccggaaccagaagggagatgcacacggccgccaggagcgcagggcgcagcgcgctcacctgggagcgccggcaagggaggcgg

SEQ ID NO: 73721 - DNA, 55 bp, Homo sapiens
  misc_feature 1..55: note = chr12:108871619-108871674
  misc_feature 1..55: note = hypo
  source 1..55: mol_type = genomic DNA
caaatgctatgtaaacgtcacacctgatccagccaatctgcggtccctacctaaa

SEQ ID NO: 73722 - DNA, 97 bp, Homo sapiens
  misc_feature 1..97: note = chr12:108891814-108891911
  misc_feature 1..97: note = hypo
  source 1..97: mol_type = genomic DNA
tcaaaaaaaaaaaaagtgttccattcatactgaaaatatctgggaggtttgcactgtgtgcaagatctgcactgggggctgccgacaagggctgccc

SEQ ID NO: 73723 - DNA, 161 bp, Homo sapiens
  misc_feature 1..161: note = chr12:108898965-108899126
  misc_feature 1..161: note = hypo
  source 1..161: mol_type = genomic DNA
gtcagacatagatgccggcagttgagccaatcatgttaaagacagcggctccatctccccttgtctttgtcagccacgtgtacagcaaacaccagacatgatgaccccagtcaactggaaagcctattcacataacaagattagggtggggtggccagcct

SEQ ID NO: 73724 - DNA, 30 bp, Homo sapiens
  misc_feature 1..30: note = chr12:108926148-108926178
  misc_feature 1..30: note = hypo
  source 1..30: mol_type = genomic DNA
aaagtggaaggcactcgaagggagaggccg

SEQ ID NO: 73725 - DNA, 193 bp, Homo sapiens
  misc_feature 1..193: note = chr12:108982619-108982812
  misc_feature 1..193: note = hypo
  source 1..193: mol_type = genomic DNA
tcctctggagggtcccgctgagcattagtggaagactgcagactggagccgctgatcagggagctcacccccgtctgcacccccagggtctctaatgattgcttctgttttactagatttttatgtattcaagggaagcttcatgcacttcccagtcacgtcacaacaactaacaccccgcaggagcttggga

SEQ ID NO: 73726 - DNA, 26 bp, Homo sapiens
  misc_feature 1..26: note = chr12:109162468-109162494
  misc_feature 1..26: note = hyper
  source 1..26: mol_type = genomic DNA
ggccggcagacactccgggcctgcag

SEQ ID NO: 73727 - DNA, 30 bp, Homo sapiens
  misc_feature 1..30: note = chr12:109162732-109162762
  misc_feature 1..30: note = hyper
  source 1..30: mol_type = genomic DNA
ccatctggcacagagcgtccctgccctgcc

SEQ ID NO: 73728 - DNA, 58 bp, Homo sapiens; identical to SEQ ID NO: 43544
  misc_feature 1..58: note = chr12:109208616-109208674
  misc_feature 1..58: note = hypo
  source 1..58: mol_type = genomic DNA

SEQ ID NO: 73729 - DNA, 30 bp, Homo sapiens
  misc_feature 1..30: note = chr12:109305521-109305551
  misc_feature 1..30: note = hypo
  source 1..30: mol_type = genomic DNA
cggaaccgtggccttcgctgcttcagaagg

SEQ ID NO: 73730 - DNA, 191 bp, Homo sapiens
  misc_feature 1..191: note = chr12:109343498-109343689
  misc_feature 1..191: note = hypo
  source 1..191: mol_type = genomic DNA
acagcacactgtcagcgttccacccaaacatccccattcttagcatgtccacgcatgccagtccaccttctaactgccagtacctgtgaccctttccagagaactttctctggtcagtaaagcttggctggccagcctttgtggcaggccagaagtgccgaagaatttaaacttcccgggagtagccctca

SEQ ID NO: 73731 - DNA, 30 bp, Homo sapiens; identical to SEQ ID NO: 43546
  misc_feature 1..30: note = chr12:109719635-109719665
  misc_feature 1..30: note = hypo
  source 1..30: mol_type = genomic DNA

SEQ ID NO: 73732 - DNA, 30 bp, Homo sapiens; identical to SEQ ID NO: 34627
  misc_feature 1..30: note = chr12:109746889-109746919
  misc_feature 1..30: note = hyper
  source 1..30: mol_type = genomic DNA

SEQ ID NO: 73733 - DNA, 36 bp, Homo sapiens
  misc_feature 1..36: note = chr12:109873504-109873540
  misc_feature 1..36: note = hypo
  source 1..36: mol_type = genomic DNA
tgacataggtgctatcgtctccgctttctatgcagg

SEQ ID NO: 73734 - DNA, 36 bp, Homo sapiens
  misc_feature 1..36: note = chr12:109886472-109886508
  misc_feature 1..36: note = hypo
  source 1..36: mol_type = genomic DNA
ttttattttacatgtcgccaacgtttgtacaacata

SEQ ID NO: 73735 - DNA, 30 bp, Homo sapiens
  misc_feature 1..30: note = chr12:109970653-109970683
  misc_feature 1..30: note = hypo
  source 1..30: mol_type = genomic DNA
ttgcacagggtcccccggggccccagcaca

SEQ ID NO: 73736 - DNA, 78 bp, Homo sapiens
  misc_feature 1..78: note = chr12:110030802-110030880
  misc_feature 1..78: note = hypo
  source 1..78: mol_type = genomic DNA
tttggctgtggcagccgctgaaatgtgcagctcagctcctggacagctttgcactcaaaccagcgaactgttctcctg

SEQ ID NO: 73737 - DNA, 30 bp, Homo sapiens
  misc_feature 1..30: note = chr12:110039080-110039110
  misc_feature 1..30: note = hypo
  source 1..30: mol_type = genomic DNA
gccctgctcttagcccgtgtctagactctc

SEQ ID NO: 73738 - DNA, 156 bp, Homo sapiens
  misc_feature 1..156: note = chr12:110240870-110241026
  misc_feature 1..156: note = hypo
  source 1..156: mol_type = genomic DNA
gcacagggatggtgtcgttgcggccattgctcaggttcagcaaggccttgggcaggcaggtcttccccgtagatggctctagcaagagagacacacaagatgacgcagtgctccagcccatgaccttgaacttccaggcatcggggtacagaacac

SEQ ID NO: 73739 - DNA, 228 bp, Homo sapiens
  misc_feature 1..228: note = chr12:110258634-110258862
  misc_feature 1..228: note = hypo
  source 1..228: mol_type = genomic DNA
gccctattaagggatcgtaatagggtcgttgtgagaggtatataccttgagtcaagtgcctggcataaagaaagcctcaataaacagcagattgcacaacagatggcttctctctgagaatcccggattcaaaggcggtggaggtctctggctccgtccccatgccccaacttgcggagggtggaaaaaggggcccatcctcggggttacccgcggctttgcctgatc

SEQ ID NO: 73740 - DNA, 136 bp, Homo sapiens
  misc_feature 1..136: note = chr12:110271059-110271195
  misc_feature 1..136: note = hyper
  source 1..136: mol_type = genomic DNA
gggaccccccggagccggacgggccacggagatgtccccaggggcgcgaggggacctcggctgagccgcccctcccgggcccgggccccacttacctccgggacggctgggcgccggcggccgggagatccgcgct

SEQ ID NO: 73741 - DNA, 30 bp, Homo sapiens
  misc_feature 1..30: note = chr12:110271432-110271462
  misc_feature 1..30: note = hyper
  source 1..30: mol_type = genomic DNA
gggtgtcgcgatccccggatagagcggcag

SEQ ID NO: 73742 - DNA, 30 bp, Homo sapiens
  misc_feature 1..30: note = chr12:110299819-110299849
  misc_feature 1..30: note = hypo
  source 1..30: mol_type = genomic DNA
ctccgggcatgctgtcgtcatgctaggcca

SEQ ID NO: 73743 - DNA, 40 bp, Homo sapiens
  misc_feature 1..40: note = chr12:110353414-110353454
  misc_feature 1..40: note = hypo
  source 1..40: mol_type = genomic DNA
cctgggcctgctcatcgccccgcgccggggtctgctctcc

SEQ ID NO: 73744 - DNA, 153 bp, Homo sapiens
  misc_feature 1..153: note = chr12:110367786-110367939
  misc_feature 1..153: note = hypo
  source 1..153: mol_type = genomic DNA
tcttttctaggaacacgttaccttcaaccaggacaaggaaagaaagaaaactatactattggaaagctcatgggtgccattgaggacaaaaacaggcgagttttgctcttggttctgcaactgaatcacttgagaagccgtgcacagctcccg

SEQ ID NO: 73745 - DNA, 17 bp, Homo sapiens
  misc_feature 1..17: note = chr12:110506948-110506965
  misc_feature 1..17: note = hypo
  source 1..17: mol_type = genomic DNA
aaaatcatggctcatcg

SEQ ID NO: 73746 - DNA, 98 bp, Homo sapiens
  misc_feature 1..98: note = chr12:110563148-110563246
  misc_feature 1..98: note = hypo
  source 1..98: mol_type = genomic DNA
taataattatttgtgcgtaatttttcatcattgtggagaaattatcttttttattttattttttctgttgagacggagtctctctctgtcccccaggc

SEQ ID NO: 73747 - DNA, 34 bp, Homo sapiens
  misc_feature 1..34: note = chr12:110563785-110563819
  misc_feature 1..34: note = hypo
  source 1..34: mol_type = genomic DNA
gaactagcacaagatcggccaggcgcggtggctc

SEQ ID NO: 73748 - DNA, 468 bp, Homo sapiens
  misc_feature 1..468: note = chr12:110717498-110717966
  misc_feature 1..468: note = hypo
  source 1..468: mol_type = genomic DNA
ctgcagtgcttctatcggtcctgaaagagacagaggaggtaagggagaagaattggtacgaaatggtgcagagctggtctcagagggcaacaacagccagccctccatgaccacactcccaccgtgcactcacgtgcccctcttgaagcggctctgatcctgtgacctaaccagtttccacctggcttctctcagtgcgttgccatatagtataattttttgtttgtttgtttcgtgtagggttttgttggttcttttccaagtatcaatcaaaactacatgccaacgtccactccttggaaataattaaatgacatgacgtgcctgattttttcagctggtgatgcactgtaatttgcatctgctgaaggaatttatcttaagtcctgaagcccagccacttgagacaactgaggtgatttttctgctctgcttttgctcatgcggatggtgcgttattgttaaaca

SEQ ID NO: 73749 - DNA, 181 bp, Homo sapiens
  misc_feature 1..181: note = chr12:110782679-110782860
  misc_feature 1..181: note = hypo
  source 1..181: mol_type = genomic DNA
tttgttcccaggttacgtcggcgctgctaccgtgggtgctgctgcatggtggttcattgctgctgacggtggtccaagagtgtccttctaccagctggtactcagtcacctttctttctgtaccttacatgagaagtgttgtgaggccttgacctttctgtggtttcggtatctatcaaat

SEQ ID NO: 73750 - DNA, 179 bp, Homo sapiens
  misc_feature 1..179: note = chr12:110784092-110784271
  misc_feature 1..179: note = hypo
  source 1..179: mol_type = genomic DNA
ctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtc

SEQ ID NO: 73751 - DNA, 29 bp, Homo sapiens
  misc_feature 1..29: note = chr12:110840419-110840448
  misc_feature 1..29: note = hypo
  source 1..29: mol_type = genomic DNA
tgagccactacgcccggccaataaaggat

SEQ ID NO: 73752 - DNA, 153 bp, Homo sapiens
  misc_feature 1..153: note = chr12:110886947-110887100
  misc_feature 1..153: note = hypo
  source 1..153: mol_type = genomic DNA
acacttttattgtctcgactcccgatttgaatgtacattctttaagattagggatttgttgaacttatttgctgctgtaaatacagcctggcaggcagcaggtgctcgttaacgtttgttaaaaataatgtgtgagcaggctgggcgcgatgg

SEQ ID NO: 73753 - DNA, 39 bp, Homo sapiens; identical to SEQ ID NO: 43552
  misc_feature 1..39: note = chr12:110908132-110908171
  misc_feature 1..39: note = hypo
  source 1..39: mol_type = genomic DNA

SEQ ID NO: 73754 - DNA, 205 bp, Homo sapiens
  misc_feature 1..205: note = chr12:111127155-111127360
  misc_feature 1..205: note = hyper
  source 1..205: mol_type = genomic DNA
ctgtcctgggcctcccgcagttacaaaggtcccgcccgtgggagcgaatcgcggatcacaaaaatcctgccccgggccagcctaagggaagggtgggcgggggaaccacttccttcctccgccggctggagcggggcgaatccaccccgccaacccctttcggggagcttctgctccatcccaccgtctccgggccacccctgcc

SEQ ID NO: 73755 - DNA, 23 bp, Homo sapiens
  misc_feature 1..23: note = chr12:111153712-111153735
  misc_feature 1..23: note = hypo
  source 1..23: mol_type = genomic DNA
accgtgcccggccagtatgctac

SEQ ID NO: 73756 - DNA, 430 bp, Homo sapiens
  misc_feature 1..430: note = chr12:111284604-111285034
  misc_feature 1..430: note = hyper
  source 1..430: mol_type = genomic DNA
cgctggagagtgtgtcgcccctctcccccaaccaaaagcttccctccaaccagctgctcttgtcctctcctcccgagggccctgtgccctcccagcggacttgcaggggagaacgtccatgtttgtgcgagtcacaaaggcgcccgttccaggggtcccagaacgcccgggcgtggggctgggggtgtggcgcagcgaggccgcgcagcaagcagtcctcccggcaccgtcggaagcgcagttgcagcagccgtcggacaagcggccggagcagccacggacaagcagtccgggccccgccactggtaagtttcgccgcccgcccggccgcgcctgctgcgccacagctccccctgccagggaaaaggaaagagcggtcgcggtccccagtccattcatatctcgctgccctaagcgttgaaagtatcag

SEQ ID NO: 73757 - DNA, 30 bp, Homo sapiens; identical to SEQ ID NO: 15686
  misc_feature 1..30: note = chr12:111296630-111296660
  misc_feature 1..30: note = hypo
  source 1..30: mol_type = genomic DNA

SEQ ID NO: 73758 - DNA, 30 bp, Homo sapiens; identical to SEQ ID NO: 43555
  misc_feature 1..30: note = chr12:111355976-111356006
  misc_feature 1..30: note = hypo
  source 1..30: mol_type = genomic DNA

SEQ ID NO: 73759 - DNA, 30 bp, Homo sapiens
  misc_feature 1..30: note = chr12:111358838-111358868
  misc_feature 1..30: note = hypo
  source 1..30: mol_type = genomic DNA
tgagtgaagcctccccgaccaccatcttta

SEQ ID NO: 73760 - DNA, 352 bp, Homo sapiens
  misc_feature 1..352: note = chr12:111369069-111369421
  misc_feature 1..352: note = hypo
  source 1..352: mol_type = genomic DNA
caggatcccagagctcggatccagcctcaacgacccagatagccctgcagtggctttcttgtccctggtatttttagccctcggtcatctatcttgcctgcactggggacagcggcactcagacaagcccatttttactggtgcccttcagatgcccgcgggctcagctgtctcggtgcctggcattccgggggtattgttcctctctacgagtcccagattccagcaacagctgctgccccaggctcccccgccagcttccccctgcgctccccctgcccgcctgccagagcccccttgctgaagaacgtggcacagtgacagccgaacctggtcccgcatgcctgggccc

SEQ ID NO: 73761 - DNA, 127 bp, Homo sapiens
  misc_feature 1..127: note = chr12:111375004-111375131
  misc_feature 1..127: note = hyper
  source 1..127: mol_type = genomic DNA
tgtatctggcccaatcgctgagcgtccgcgctgcatttctccaaactgcccagcagggggcggtgctacctcggctccgcgcagccacggcttcccgctggcgaaccaagggcgcggaatctggaga

SEQ ID NO: 73762 - DNA, 144 bp, Homo sapiens; identical to SEQ ID NO: 34631
  misc_feature 1..144: note = chr12:111471165-111471309
  misc_feature 1..144: note = hyper
  source 1..144: mol_type = genomic DNA

SEQ ID NO: 73763 - DNA, 650 bp, Homo sapiens; identical to SEQ ID NO: 34632
  misc_feature 1..650: note = chr12:111471310-111471960
  misc_feature 1..650: note = hyper
  source 1..650: mol_type = genomic DNA

SEQ ID NO: 73764 - DNA, 138 bp, Homo sapiens; identical to SEQ ID NO: 3943
  misc_feature 1..138: note = chr12:111472058-111472196
  misc_feature 1..138: note = hyper
  source 1..138: mol_type = genomic DNA

SEQ ID NO: 73765 - DNA, 155 bp, Homo sapiens; identical to SEQ ID NO: 34634
  misc_feature 1..155: note = chr12:111472356-111472511
  misc_feature 1..155: note = hyper
  source 1..155: mol_type = genomic DNA

SEQ ID NO: 73766 - DNA, 101 bp, Homo sapiens; identical to SEQ ID NO: 34635
  misc_feature 1..101: note = chr12:111472571-111472672
  misc_feature 1..101: note = hyper
  source 1..101: mol_type = genomic DNA

SEQ ID NO: 73767 - DNA, 166 bp, Homo sapiens; identical to SEQ ID NO: 3946
  misc_feature 1..166: note = chr12:111472851-111473017
  misc_feature 1..166: note = hyper
  source 1..166: mol_type = genomic DNA

SEQ ID NO: 73768 - DNA, 90 bp, Homo sapiens
  misc_feature 1..90: note = chr12:111535426-111535516
  misc_feature 1..90: note = hypo
  source 1..90: mol_type = genomic DNA
caggggggtcactggcgtgagcagaccacccgtgactgcacaagacagcgttttctcacagcagcaggtcctgctcggcaagcgaggcgc

SEQ ID NO: 73769 - DNA, 30 bp, Homo sapiens
  misc_feature 1..30: note = chr12:111590629-111590659
  misc_feature 1..30: note = hypo
  source 1..30: mol_type = genomic DNA
ggactggggacaagccgctctagatggggc

SEQ ID NO: 73770 - DNA, 30 bp, Homo sapiens
  misc_feature 1..30: note = chr12:111692613-111692643
  misc_feature 1..30: note = hypo
  source 1..30: mol_type = genomic DNA
acaggtggccaaatgcgttaattctgttcc

SEQ ID NO: 73771 - DNA, 30 bp, Homo sapiens
  misc_feature 1..30: note = chr12:111706217-111706247
  misc_feature 1..30: note = hypo
  source 1..30: mol_type = genomic DNA
ttcacaggttccaggcgttaggacacagag

SEQ ID NO: 73772 - DNA, 54 bp, Homo sapiens
  misc_feature 1..54: note = chr12:111725510-111725564
  misc_feature 1..54: note = hypo
  source 1..54: mol_type = genomic DNA
accgccgccttcccgcgcacctgcttacctcggcatggacgcccattgtccaag

SEQ ID NO: 73773 - DNA, 30 bp, Homo sapiens
  misc_feature 1..30: note = chr12:111760419-111760449
  misc_feature 1..30: note = hypo
  source 1..30: mol_type = genomic DNA
caaacttcccacctgcgcagtggcatgtcc

SEQ ID NO: 73774 - DNA, 17 bp, Homo sapiens
  misc_feature 1..17: note = chr12:111763135-111763152
  misc_feature 1..17: note = hypo
  source 1..17: mol_type = genomic DNA
accgctgccacttacca

SEQ ID NO: 73775 - DNA, 30 bp, Homo sapiens
  misc_feature 1..30: note = chr12:111783547-111783577
  misc_feature 1..30: note = hypo
  source 1..30: mol_type = genomic DNA
aaaaaaaaagtttcacgaaaaagaaaaaaa

SEQ ID NO: 73776 - DNA, 80 bp, Homo sapiens
  misc_feature 1..80: note = chr12:111844610-111844690
  misc_feature 1..80: note = hyper
  source 1..80: mol_type = genomic DNA
actgccgaggtcgaccgggccaggcccccgcatgctgctgaattgggcggttcaccagggctaggcgtcccagagacagg

SEQ ID NO: 73777 - DNA, 133 bp, Homo sapiens
  misc_feature 1..133: note = chr12:111872804-111872937
  misc_feature 1..133: note = hyper
  source 1..133: mol_type = genomic DNA
cttcttctgaatcatcgttcttcgaaggcaggcagtagctaccgttgtctggggctttggggatcttggtggtgatgagtcccctctcctctggtgcactctccccacccgagacgggcgacagaggtttttt

SEQ ID NO: 73778 - DNA, 30 bp, Homo sapiens
  misc_feature 1..30: note = chr12:112083284-112083314
  misc_feature 1..30: note = hypo
  source 1..30: mol_type = genomic DNA
ttaaataggtgccttcgagatgatagctgt

SEQ ID NO: 73779 - DNA, 37 bp, Homo sapiens
  misc_feature 1..37: note = chr12:112149584-112149621
  misc_feature 1..37: note = hypo
  source 1..37: mol_type = genomic DNA
ggattacaggcgtgagccaccgcgcccagctatgcta

SEQ ID NO: 73780 - DNA, 91 bp, Homo sapiens
  misc_feature 1..91: note = chr12:112196381-112196472
  misc_feature 1..91: note = hypo
  source 1..91: mol_type = genomic DNA
agctgggagtgacaccgaaagaacaggctccagtgatctctgctgcttgtacccattgtcagtcccccagggttgtcggtcaccacccagg

SEQ ID NO: 73781 - DNA, 34 bp, Homo sapiens
  misc_feature 1..34: note = chr12:112204378-112204412
  misc_feature 1..34: note = hyper
  source 1..34: mol_type = genomic DNA
tcgcttttgggtttacggccggtctcttcacctg

SEQ ID NO: 73782 - DNA, 73 bp, Homo sapiens
  misc_feature 1..73: note = chr12:112204919-112204992
  misc_feature 1..73: note = hyper
  source 1..73: mol_type = genomic DNA
tcgcgctttgttttccggcccgagtcccccgcaggcccctaggaaggccccgcgccgccgtgggccttagtgt

SEQ ID NO: 73783 - DNA, 19 bp, Homo sapiens
  misc_feature 1..19: note = chr12:112281623-112281642
  misc_feature 1..19: note = hypo
  source 1..19: mol_type = genomic DNA
tgtttgtttttgagacgga

SEQ ID NO: 73784 - DNA, 30 bp, Homo sapiens
  misc_feature 1..30: note = chr12:112591860-112591890
  misc_feature 1..30: note = hypo
  source 1..30: mol_type = genomic DNA
atggaacactagacacgggaaccatgcggc

SEQ ID NO: 73785 - DNA, 351 bp, Homo sapiens
  misc_feature 1..351: note = chr12:112605505-112605856
  misc_feature 1..351: note = hypo
  source 1..351: mol_type = genomic DNA
ggagggtttctgaaacggtttggctttgatgagacacacactgcccgccaccccagccactgcgcaggacatgagctcgggggcgtggagcctcctcccggcctctgcctaccttgttcttattgacagctgagctggggcacagcagcagcagcgacagcgaggaactctgcagctccttacacacctgccacaggaagtggcggaaagagccgcctgtaggacagacgagacacatgggcacctggggtgtcccggcgggaggcgacaccgttccctccctctcacctgctggctggagcggctactccttccacggcctacctgccgctgtggcggggtagaaagaag

SEQ ID NO: 73786 - DNA, 91 bp, Homo sapiens; identical to SEQ ID NO: 43561
  misc_feature 1..91: note = chr12:112610355-112610446
  misc_feature 1..91: note = hypo
  source 1..91: mol_type = genomic DNA

SEQ ID NO: 73787 - DNA, 160 bp, Homo sapiens
  misc_feature 1..160: note = chr12:112628549-112628709
  misc_feature 1..160: note = hypo
  source 1..160: mol_type = genomic DNA
ccccaccctagattccgatccccagggaaggcagcctcacctagcagctccaccacctgcaggaggacggatgtcggaatggtgtcaggctcatcttcggacttcccttcactgtcctctgatttccaggacagcagctgctctgcgaaggccatagcca

SEQ ID NO: 73788 - DNA, 91 bp, Homo sapiens
  misc_feature 1..91: note = chr12:112630855-112630946
  misc_feature 1..91: note = hypo
  source 1..91: mol_type = genomic DNA
gcaacttactctttgcggaatccagattgactttctttacaagacacaacaacaaaagctgccccggggaaattcacgtccatgttgactt

SEQ ID NO: 73789 - DNA, 30 bp, Homo sapiens; identical to SEQ ID NO: 43564
  misc_feature 1..30: note = chr12:112820695-112820725
  misc_feature 1..30: note = hypo
  source 1..30: mol_type = genomic DNA

SEQ ID NO: 73790 - DNA, 157 bp, Homo sapiens
  misc_feature 1..157: note = chr12:112825977-112826134
  misc_feature 1..157: note = hypo
  source 1..157: mol_type = genomic DNA
ctgcactccagcctgggcaacctaacgagtccatctcaaaaaataaaaataaaaataaaaataaaaaagttgttagcacaaaggaaaagtggacaaaagatattattgaagagttttcactcaaggaaaagcaaacactgtacgtttttgttccttc

SEQ ID NO: 73791 - DNA, 146 bp, Homo sapiens
  misc_feature 1..146: note = chr12:112919565-112919711
  misc_feature 1..146: note = hypo
  source 1..146: mol_type = genomic DNA
gattacaggcatgagccactgcgccccagctgattctttacagataaacaaacattgactctgctttgacatgtgcttggatcaggtaactgcaccagctgcctttctcctcccacttctgcctggtcctccgaatgcctgctttt

SEQ ID NO: 73792 - DNA, 325 bp, Homo sapiens; identical to SEQ ID NO: 1070
  misc_feature 1..325: note = chr12:113012954-113013279
  misc_feature 1..325: note = hyper
  source 1..325: mol_type = genomic DNA

SEQ ID NO: 73793 - DNA, 147 bp, Homo sapiens
  misc_feature 1..147: note = chr12:113013320-113013467
  misc_feature 1..147: note = hyper
  source 1..147: mol_type = genomic DNA
cgcaggacccgtgctatcctttgggattttgaggggcgggtccggcaaggccccccaaagtggctgctcctgcgagtctccgagaggggaacaggtggtcgcggggtggctgcggcgaaggtagctcctctccggtagccacggggt

SEQ ID NO: 73794 - DNA, 30 bp, Homo sapiens
  misc_feature 1..30: note = chr12:113229160-113229190
  misc_feature 1..30: note = hyper
  source 1..30: mol_type = genomic DNA
tgctctgagagtgagcgacagtattagaaa

SEQ ID NO: 73795 - DNA, 74 bp, Homo sapiens
  misc_feature 1..74: note = chr12:113229420-113229494
  misc_feature 1..74: note = hyper
  source 1..74: mol_type = genomic DNA
cccaacctcccctcccggcctcccacctttctttctccaggcaccgcacacataaatcacgggtgggaggcagg

SEQ ID NO: 73796 - DNA, 110 bp, Homo sapiens
  misc_feature 1..110: note = chr12:113494306-113494416
  misc_feature 1..110: note = hyper
  source 1..110: mol_type = genomic DNA
gacaaagattcaagccggtgactcctaaacatcccactccctgcctcacgctctgcttggggtcagaaggccccttggggtctcgggagggcctggccgaggatttgggg

SEQ ID NO: 73797 - DNA, 607 bp, Homo sapiens; identical to SEQ ID NO: 34641
  misc_feature 1..607: note = chr12:113494430-113495037
  misc_feature 1..607: note = hyper
  source 1..607: mol_type = genomic DNA

SEQ ID NO: 73798 - DNA, 89 bp, Homo sapiens
  misc_feature 1..89: note = chr12:113495038-113495127
  misc_feature 1..89: note = hyper
  source 1..89: mol_type = genomic DNA
ccccccaggcggagagtctcggaaaaccgcgcccccggcccctgccttccctccaggcctgccccaagggaaagcgggcggggcgaccc

SEQ ID NO: 73799 - DNA, 632 bp, Homo sapiens
  misc_feature 1..632: note = chr12:113541503-113542135
  misc_feature 1..632: note = hyper
  source 1..632: mol_type = genomic DNA
actttagaaataacacgtcgcatacgccaagcagcgtcctatgctctttgtgtaaatcaagtcatttaattatcacaactccacgagataggcactgttatcaacctcatttcacagttgaggagactgaggcatagagaggttgagtaacttgcccaaggttgcacagccagcccaggcggaagtgggacacccgctgattgacgggtggggagggcggagcctgcagtccgccctgccccctcacctgagcgctcagcctggaggcagcaggtccagcgcgcgctgcggaaggcaccggggtggcaggcggccagcttgttcgggttgggggcgctggccttgcgcaaggccgagagccactggttgagctcattcacattctgcagcgggtgggaggcgatcagggggcgggtgggaacagagggacgccccccgctccccatcgcggtggggtctcaccttgcactggaggtaggtggtgtgcagcgcccccgtgccgtcctgcgtcaccacctgcatcacgtggggcagttggaaggcgccctcgtctacgcgctccacggcgcggatgtgagacacggggatggagtgacacatctggggaagaggattgtcgctgcaggatgggc

SEQ ID NO: 73800 - DNA, 385 bp, Homo sapiens
  misc_feature 1..385: note = chr12:113592078-113592463
  misc_feature 1..385: note = hyper
  source 1..385: mol_type = genomic DNA
tctctaacaaatggaggttgacatttaagtcactttccagaaagattattccaataataaggaacgctggcggccaggtgggatggagagggtaaggcactgcaggcccatgtgagtcccttccccgcccccgactctagttccaagaggttccggagctggtggcgcgcttcgacggcctggccgagacgcaggcggcgctgaggctcagggagcgcgagcagctcgcggagctggaggcggcgcgagcgcggctgcagcagctgcgggacgcctggccggacgaggtgctcgcacagggccagcggcgggcacagctgcaggagcgcctggaggctgccagggagcgtacgctgcagtgggtacgacccgccctaggtggggg

SEQ ID NO: 73801 - DNA, 36 bp, Homo sapiens; identical to SEQ ID NO: 43567
  misc_feature 1..36: note = chr12:113677751-113677787
  misc_feature 1..36: note = hypo
  source 1..36: mol_type = genomic DNA

SEQ ID NO: 73802 - DNA, 30 bp, Homo sapiens
  misc_feature 1..30: note = chr12:113690294-113690324
  misc_feature 1..30: note = hypo
  source 1..30: mol_type = genomic DNA
ggtcttcacggcagccgctcacatagacac

SEQ ID NO: 73803 - DNA, 155 bp, Homo sapiens
  misc_feature 1..155: note = chr12:113725857-113726012
  misc_feature 1..155: note = hypo
  source 1..155: mol_type = genomic DNA
ctcacctgtcttcaccgcatggcgtgtggaaggcggggccggcatgttctgagggcgggggctgaggcgtgcacctgtgtgtggaggtgacgggtgtcctcctcgctcaggttgtttaagttgaaggagcgctaccgcaacgtgctggacaccat

SEQ ID NO: 73804 - DNA, 36 bp, Homo sapiens; identical to SEQ ID NO: 43569
  misc_feature 1..36: note = chr12:113795723-113795759
  misc_feature 1..36: note = hypo
  source 1..36: mol_type = genomic DNA

SEQ ID NO: 73805 - DNA, 30 bp, Homo sapiens
  misc_feature 1..30: note = chr12:113835162-113835192
  misc_feature 1..30: note = hypo
  source 1..30: mol_type = genomic DNA
ccttcagctctttcacgatggaagcgtggc

SEQ ID NO: 73806 - DNA, 149 bp, Homo sapiens
  misc_feature 1..149: note = chr12:113849535-113849684
  misc_feature 1..149: note = hypo
  source 1..149: mol_type = genomic DNA
acaggcgtgagccaccgtgcccagctgccctgttcttgtgtcatttggtgtaatggaatcacacaatgtgtgggcttttgtgtccagctgctttcactggtggcacgttttcacgattcatccacatcgcagcacgtaccagtcctcca

SEQ ID NO: 73807 - DNA, 513 bp, Homo sapiens
  misc_feature 1..513: note = chr12:113900165-113900678
  misc_feature 1..513: note = hyper
  source 1..513: mol_type = genomic DNA
gcccagcaatcctggcgccccacccagggggagagcaggatgtgtgcgtgttcgagtccggcctgctccctcgggctcaacataaacgtcaaagtaaggaagagcgggagctggacccggctggccacttcctgacccacagccctattcctagagaagctgaccttgagcctcaagattggccaccagggagcgccagcgtgcaggtggctcggtctccctctcggtggctcccggttcacgcgagttcctcgctcgctctccgtcttctccctctggctgacgctgtctctccatctcctcctcatcttgccccctttcctctccctctctttcaatctctctccttttcttatcatctttttttttaaagacggggaaagcacagcgagaaataagattacaaaatgccactcggattgcagagagagggaaaaacaccgtctccgccccttggcctcaccctctctcagtccaaagaggtggcggtggctgggtgggtgggtgggggcc

SEQ ID NO: 73808 - DNA, 407 bp, Homo sapiens; identical to SEQ ID NO: 34646
  misc_feature 1..407: note = chr12:113900752-113901159
  misc_feature 1..407: note = hyper
  source 1..407: mol_type = genomic DNA

SEQ ID NO: 73809 - DNA, 611 bp, Homo sapiens; identical to SEQ ID NO: 34647
  misc_feature 1..611: note = chr12:113901407-113902018
  misc_feature 1..611: note = hyper
  source 1..611: mol_type = genomic DNA

SEQ ID NO: 73810 - DNA, 312 bp, Homo sapiens; identical to SEQ ID NO: 34648
  misc_feature 1..312: note = chr12:113902041-113902353
  misc_feature 1..312: note = hyper
  source 1..312: mol_type = genomic DNA

SEQ ID NO: 73811 - DNA, 963 bp, Homo sapiens
  misc_feature 1..963: note = chr12:113902608-113903571
  misc_feature 1..963: note = hyper
  source 1..963: mol_type = genomic DNA
gaggtgtagggactccggattgcaaacccattctgcctcaacaaatctgtatcaactctctgaccgccccacatagccccttttccagaaccttcgggatatcctgccttcccccaccaggtggggccctgaaggactgacgtgggggacgtcacgaaaggaccaccttgtaccaggcacccgctttgtacggcgggaaaaccagcgagtccagaagcctgagtctcttctgcaaatccactccccctgctgagtcctgggatctcagtcaaggggcgaattcctgatgccccctgccaccctcttccctctccaaaccctgaaatctgtccaaatggggggtgtctggaggcgtggcttggaggcagtttaagcaacagctaaaacggttgccaattactttttaaaaccattaatttaattctccccgaaagtgaaggggaagatggggagcggcaaatttggagccccaaagggacagggatgggagacggccgcggcccgcggcgagccggaaaaccagcgaaggccgctgcccccgcgccgtgcgcgccgcctccgcccatatggcggccgggccggaggtaattggaacaaacgccgtctgaaaagggcacaaaagccgcagctggggctttgtccgcgctcccacggggagccgccggccccgccgcccggcccctttctcgcccgctgccggtcgccaccgccgggatctcccagcgcggattaggcggggctgcctcgctgggggctggggagtcttccccaccattacggggaacgaggggcccccagtatccagctccccacctcatccagcgcgcagggagaggaggcggtgggataggtcggggcgggggcgaagtggtcctcggggaaaccttggttaattatccaggcggggaaaaattccgggccggtaccgcccccactacctcgctgctccgggcccagattttg

SEQ ID NO: 73812 - DNA, 30 bp, Homo sapiens
  misc_feature 1..30: note = chr12:113903957-113903987
  misc_feature 1..30: note = hyper
  source 1..30: mol_type = genomic DNA
cctcttcctaacctgcgttacaactcagaa

SEQ ID NO: 73813 - DNA, 346 bp, Homo sapiens
  misc_feature 1..346: note = chr12:113904732-113905078
  misc_feature 1..346: note = hyper
  source 1..346: mol_type = genomic DNA
tggaatttacctatacgtgatcgtgcgatcgtgtctagacgtgtgtccctggagtctctgaacgcaagtgtgagtgcaccttgtgccctgcgtgggtgaatgtgtcactgtatctcgtgtgtgcttctgtgtgcatcactgtatgggtgagaccatgtatctgattttgtgtccaggacatgtgggtgagtgtacatgtgtctgtgatcgtgtgtccagcgagtgggcgatgttctggagcggcggaaagcgtgctggccgggacccttcgccctcagctcccggaataggacaggtgcggaacagcgaatcccggggcgccccttacctccgtagtaggtgtacg

SEQ ID NO: 73814 - DNA, 1054 bp, Homo sapiens
  misc_feature 1..1054: note = chr12:113905380-113906434
  misc_feature 1..1054: note = hyper
  source 1..1054: mol_type = genomic DNA
ggtggagagaggcttcggcgaaccagccaagggtgaaggatttcgcggacccgtggggcgactcataaagacttgggcttcctggtccccggctcgcccgcggcctgacggctctataaaggcctccctcccggcacggctctcgcctcggcccctcggctccggagccagcctctggccgtttgtctgcccgcgcttcggcgcagggagggagggggcatcgcctgtttctctgctcgaaaggtggaggtaaagagggatcccggaccccagagaggcttacaaccttccataagcaaggcggggggcggaattcagagaggtaaagtgacccgcccccaaatcgcaataccaggaggacagcagggctagatggaatctttcggttcacagtccccgacctcgggcaagtgccccactcgggcgcacggtctgctcccagaccagaaccaggcgcgctcgtagccaaggaagcttggcgggagactcctccgaggctcccggctcccaggccagcggggctaaggagctgtgcccgccccgggccgcacctggatgacgcgcatgttgaggccggtctcctgcgccagctgctcgcggatgtggcgcgtgggcttgggcgtggcggcgaaggcagccttgagcgtctccagctgcttggccttgatggtggtgcgggggccgcgccgcttggtgcccgagttctgctcctcgttctcgttgttggccgtctccttgtccgacgaggtcgagttgtccgtctctttggggtcgtcctgcagtgcgtcctggaggtccggggacaaactgcggtccgtacaggatgacactgcgggcggacggatcgggaaggggacagcggcgtcagcgacggccagacgcctcttcagtccagtggcgggttcccgccggcccaagctacggcctgcccaggctacggccagccccgctggattccctcccaaacctgcgacagcccctcccccagggacccggtgcccgcccactctctccaggcggggctgggcctttggaggggcgctcttaagccctc

SEQ ID NO: 73815 - DNA, 47 bp, Homo sapiens
  misc_feature 1..47: note = chr12:113906828-113906875
  misc_feature 1..47: note = hyper
  source 1..47: mol_type = genomic DNA
gcacagacagcacaccgggggccaagtagggagtgccaggctgggca

SEQ ID NO: 73816 - DNA, 58 bp, Homo sapiens
  misc_feature 1..58: note = chr12:113907104-113907162
  misc_feature 1..58: note = hyper
  source 1..58: mol_type = genomic DNA
gggcgagatgccttgcgcgcagccggcgcatttcgtgccaaagcgcctgtggacacaa

SEQ ID NO: 73817 - DNA, 42 bp, Homo sapiens
  misc_feature 1..42: note = chr12:113908232-113908274
  misc_feature 1..42: note = hyper
  source 1..42: mol_type = genomic DNA
tccagggagttaacacgtgtaaaggagcggctgacattttct

SEQ ID NO: 73818 - DNA, 576 bp, Homo sapiens
  misc_feature 1..576: note = chr12:113908739-113909315
  misc_feature 1..576: note = hyper
  source 1..576: mol_type = genomic DNA
cgagaagccttcaggcgtctctaactcatgcaaaaatccttcctctctctcgggacggggcttgaagcttctgtcttggggttgcagctgcttggaaggggcggagaggagtggatagcaagtttgtcagggcttcctccctctgccccgccagcgctctgagccggcctcgagccaacgtgaggcagcgaagcagcgtccttcttcctccgcctgggctcgggacctttcctggaccaaggacaggaggagagcaaagtgctgcccgctccccatctaagcttgtgatccggggaggctgggatggggatgggggtatccccttccccagcgccccagtggagcgcgcgcagggtgggcgcgcaggcagcagagcggcgcggcctcttacctgaaaaagtcatttttgcagtagagcttgccctcgcgcgagaagcacttctccgagaggttggttttgcactcgcagcactgaacacatttgatgtgccacgcgcggtccagcacgttcagcagaaagcggtcgaggatgggccgctcgcaaccggcgcagtgcaccatcatagccccgcgccc

SEQ ID NO: 73819 - DNA, 175 bp, Homo sapiens
  misc_feature 1..175: note = chr12:113909328-113909503
  misc_feature 1..175: note = hyper
  source 1..175: mol_type = genomic DNA
cgccttgccctccctttgggcccctggccctcgggcctgccgggccctccgctgcccttcgcctcttgtctcagcagctgcagggcgagtctggtccggaccaagactcagccggtccagtccttgggcaatctctggcctggcgctgggctgcccggagtggggtggtgggggg

SEQ ID NO: 73820 - DNA, 123 bp, Homo sapiens; identical to SEQ ID NO: 34657
  misc_feature 1..123: note = chr12:113909534-113909657
  misc_feature 1..123: note = hyper
  source 1..123: mol_type = genomic DNA

SEQ ID NO: 73821 - DNA, 977 bp, Homo sapiens
  misc_feature 1..977: note = chr12:113909717-113910694
  misc_feature 1..977: note = hyper
  source 1..977: mol_type = genomic DNA
cgtggcgctgcacgtagggggcccagcggccaatgggcgcaccgtggccatggcaacctcttaaatttatagcatatctaaattggctacagcgttgctgtccggacagagcaaaaaaaacaaggcatcagtattgttgagtattagcttgtacctggttcggaggctaagtaagtatttaccttccagtttggggctgacggggcgggggcagcgcgaaacgaaaattgcgtctctcttcctctctctttctcctcacaaatatttgggggtcacgggttccaaggcctagtccgggaggtacccctgcccccttcgccatccctggaacttgcagaagttgccccacgccccacacttcgctccccttctccagcccagccagcccagattggattcccccacccccgcgccccctctgcgccctgaagctgcgtcagcgcggttctcccggctcctggagccggccccggcttctttttgtcatacacggggctggggcccagccgggcctttctcatggagagagctagtggagaccgcgcggcctgggtagttttccccgcccggccgccgagcccaggcccaggcccagggtggggaggcgggggagcaggaggggtgccatttggcctggtcccgaactccagagtttcaggcctgagtgcgctgctcacggggctctgagggagatgtggacagggggagattcagggtggacgggtcttcccgcagacagctcggaggtggcactcaccacgtctctcctttcctcgctgcaccttccagattccaggtcagcctatggggcactgtggtgagtgggtcgtacggctgaggcgggggacaccagcgactatgagagcgctgtttgtattcacgccgtgcgggctgggtgtgcaagttcgtcccctcattgggcgcaggagaagcggcgcacgtatgttccgtgctcggcagggcgcccagagtgtgag

SEQ ID NO: 73822 - DNA, 853 bp, Homo sapiens
  misc_feature 1..853: note = chr12:113912829-113913682
  misc_feature 1..853: note = hyper
  source 1..853: mol_type = genomic DNA
agtcccctagagttgcgttgggggcctcatcctcagtacagctcagccccagttcgagaactccctggacctgggctcagccaagctgcccagaacccgcccggccttctctagcccaccaccttccccggtgcacagcatcggaaaatgccagcagaccagctattagactcatcccgacctaacagcgctaacagatggcgaccaggcagcgaaatcccctcctatatgtaactaataaaccgcttgtgtcttaacagggtaatgcatggagacgcaatgtcacttatacaagatgttgatggaatttactatataaaaatcttcctcctagagtaaagagtatcaacattacaactcgacagacggcggcgggataagtaaaacagacaaaagacaaacaagataataatctgtttccaatcacttaagccctgtagagttagtaatatgcggtttgcatattcccccttgagttcggtaattaattactggcgaggaggcgcacactagcctggggtgggagttttggggagcgctgagctggggcgtggggcatacctctcttgagttctccagcccgggacaccgggcagcggccggaatgagggcgcttccagaggtttggagctgacccacccgcgggttgaagaggtcgtttcagttgcacctccctattcctcaccggaaagcctccggcctgggagattctgcagccaagcaggaaagggggtcttctctggcagccagtgtctctcctggctcctcttaaagcatcctctccttcgaacggccgggagtggcagctttattgggaaacgcgcgctctgggggcccaggtggctggggggac

SEQ ID NO: 73823 - skipped

SEQ ID NO: 73824 - DNA, 336 bp, Homo sapiens
  misc_feature 1..336: note = chr12:113913888-113914224
  misc_feature 1..336: note = hyper
  source 1..336: mol_type = genomic DNA
gcgttacaaattgtaaatttaaattgctcgccggattcattacctcccctctttgatttcagccagccgtgaaaaattatactggtgtaccactgagaaactgttttgccgcaaagagcctacgcctaatcactggctttctccctccgacaaaagtgtaattattttgtttggggtgtaaatataggccgcgcctcgcacacacactcagcgtcccgcagcgccgcagagcaccgcccgccgccggaaggaatcgggcccccgagtaggagcgggcgtgaaggctgagccccgctgtctggaggccggaggagagcggctggtgtggcgctccgg

SEQ ID NO: 73825 - DNA, 228 bp, Homo sapiens; identical to SEQ ID NO: 34662
  misc_feature 1..228: note = chr12:113914300-113914528
  misc_feature 1..228: note = hyper
  source 1..228: mol_type = genomic DNA

SEQ ID NO: 73826 - DNA, 44 bp, Homo sapiens; identical to SEQ ID NO: 34663
  misc_feature 1..44: note = chr12:113916222-113916266
  misc_feature 1..44: note = hyper
  source 1..44: mol_type = genomic DNA

SEQ ID NO: 73827 - DNA, 404 bp, Homo sapiens; identical to SEQ ID NO: 34664
  misc_feature 1..404: note = chr12:113916326-113916730
  misc_feature 1..404: note = hyper
  source 1..404: mol_type = genomic DNA

SEQ ID NO: 73828 - DNA, 40 bp, Homo sapiens
  misc_feature 1..40: note = chr12:113916972-113917012
  misc_feature 1..40: note = hyper
  source 1..40: mol_type = genomic DNA
acaggaagagccttccgtgcgtgggcgggggttggagagg

SEQ ID NO: 73829 - DNA, 291 bp, Homo sapiens
  misc_feature 1..291: note = chr12:113917226-113917517
  misc_feature 1..291: note = hyper
  source 1..291: mol_type = genomic DNA
ttggcgagtgagcttcgtgcacggcatttttcaccctctggaagaagccagatttcgggcaaggtagaacgtgagaagaatcccttttatactggctcctacgaaaggaaccagaaaaaaaaataatacacattttgagcagcctctgtgggtgcagcttgttgaactcggagccagacgctttttctggcgaaacggagaaaaaacgccgcggaaacggtgcgcagggttggggagtataggttctgattgcaacataattccgcaagcttttttattttttatttttcc

SEQ ID NO: 73830 - DNA, 121 bp, Homo sapiens; identical to SEQ ID NO: 34666
  misc_feature 1..121: note = chr12:113917580-113917701
  misc_feature 1..121: note = hyper
  source 1..121: mol_type = genomic DNA

SEQ ID NO: 73831 - DNA, 575 bp, Homo sapiens
  misc_feature 1..575: note = chr12:113917730-113918305
  misc_feature 1..575: note = hyper
  source 1..575: mol_type = genomic DNA
cgcggccggctggggcctcgggcagtgacagtgaaacgaattccaaacccattctgaactcgccatggcgctctcctgccctccaacacccaccccaaacaccgtgtaggcagaagcgaggttccccgtgaagccgggttaaaatcggcagctgagatgcggtgggatgggatcatagccgagttcggaggatgcggggagagaatagaaaaatctccatcgttctgctctgctctctttctttctcctctaagcaggtttgccggagaaggcaggggtgagccacggtggctgcccggctgtgcaccggcgccggagtttggaccaagacaaagacaggagctgtccgcggtgctgaatcggcggcgccgtcgccggagcaagggggcttctgtaaccagccctctgctcatttactccccatccttctagctccccttcgctctgtgactcttgccttcccctgaatttatttcccttttgggggactcaccttagaacctgcgccctgtacacaggtgtatatacatatatcaaagaacaaaacgattgattgaaaacggtgtcttctcctt

SEQ ID NO: 73832 - DNA, 254 bp, Homo sapiens
  misc_feature 1..254: note = chr12:113952930-113953184
  misc_feature 1..254: note = hyper
  source 1..254: mol_type = genomic DNA
gaagtaactctaaaacgcgtgatggaggccaaggggccgccgcccgggctgcagctgaaacggcgctttcacaaacaagacgtaaattggatgcaaacatctaattaaccttctccctcagttccctccgcagagggggaggtgggcctcctagggctcccagcgcctgtcttccctcgggggatggatttgggggaagggaggaggaggggaggcaggcgcgaggggaggaagccaggcgttttctttctttt

SEQ ID NO: 73833 - DNA, 42 bp, Homo sapiens; identical to SEQ ID NO: 34670
  misc_feature 1..42: note = chr12:113953467-113953509
  misc_feature 1..42: note = hyper
  source 1..42: mol_type = genomic DNA

SEQ ID NO: 73834 - DNA, 425 bp, Homo sapiens
  misc_feature 1..425: note = chr12:113957582-113958007
  misc_feature 1..425: note = hyper
  source 1..425: mol_type = genomic DNA
gatgtgtgattgattcggccccccttccctctgcccttctggtagaaaattaaaagaccatttgttaaggggcgaaagtcctcaggtgcatcccgaggctggacaatttgtctctgtgaaaaggacgctattatcagagaggctggatgcaggcggagggcgggcccgaggggcggcttgggagggggaggctcggaggagcgaaggggctcaggcaggggtgggggggcggaggccgagacaatggggggaaaaataataaatacatcggagcgtgccagccgcggggatcctggctggagaggcgcgaggggcaggggggctgcttggggctggaggagctcatgtgctcgggcctcggaagccaattcctttttcatgacccttgtccaggaccagaagggtgtcgccggggagctctgccg

SEQ ID NO: 73835 - DNA, 30 bp, Homo sapiens
  misc_feature 1..30: note = chr12:113972789-113972819
  misc_feature 1..30: note = hypo
  source 1..30: mol_type = genomic DNA
ctgagtgcagagctgcgggttggagacgta

SEQ ID NO: 73836 - DNA, 61 bp, Homo sapiens
  misc_feature 1..61: note = chr12:114029358-114029419
  misc_feature 1..61: note = hyper
  source 1..61: mol_type = genomic DNA
ctagagtgtccctagcgtcacgccctgtcgccctcccctgagctcccggaagcccatgggg

SEQ ID NO: 73837 - DNA, 249 bp, Homo sapiens
  misc_feature 1..249: note = chr12:114029630-114029879
  misc_feature 1..249: note = hyper
  source 1..249: mol_type = genomic DNA
acctgcagctcaacccgcctaggagaggcgctcgccgagctcgattctccgggtgccataaattaggacgccagtcgccggcgaacgctgggggcttccagtataccttccagcgcagcccgcaggctatttttatctccctcagcacctcggcacctcggaggagcttctgctaattcactaccccgacaccgtctcatctcccctgcaaccaaacccaagtctattcccaggcgtaggggagttggg

SEQ ID NO: 73838 - DNA, 96 bp, Homo sapiens; identical to SEQ ID NO: 34673
  misc_feature 1..96: note = chr12:114075780-114075876
  misc_feature 1..96: note = hyper
  source 1..96: mol_type = genomic DNA

SEQ ID NO: 73839 - DNA, 184 bp, Homo sapiens; identical to SEQ ID NO: 34674
  misc_feature 1..184: note = chr12:114075909-114076093
  misc_feature 1..184: note = hyper
  source 1..184: mol_type = genomic DNA

SEQ ID NO: 73840 - DNA, 84 bp, Homo sapiens
  misc_feature 1..84: note = chr12:114107345-114107429
  misc_feature 1..84: note = hypo
  source 1..84: mol_type = genomic DNA
agcctgcgtcctaaacgtgcaaagcacttcactcccatgcaaaagcaggttctggggaagagcattgcacggtgttttaagacc

SEQ ID NO: 73841 - DNA, 153 bp, Homo sapiens
  misc_feature 1..153: note = chr12:114130067-114130220
  misc_feature 1..153: note = hypo
  source 1..153: mol_type = genomic DNA
actcaccccagcatgcgcacccatgcgccgcacacactccgacacatgcaccctccagctcaaataggtggacgtgcttgggaaaaccatggagtaagtgagccccacagagagggaccgtgaaatccctgttgccgccggggccaccagaat

SEQ ID NO: 73842 - DNA, 109 bp, Homo sapiens
  misc_feature 1..109: note = chr12:114236423-114236532
  misc_feature 1..109: note = hypo
  source 1..109: mol_type = genomic DNA
tgtgttgaggggccccggacaagcttcctcccggtcatcctcagggcagctgtagcatgactgtcacctcatcagcgaggccgtgcctgggtcccgagtgagggcgctc

SEQ ID NO: 73843 - DNA, 242 bp, Homo sapiens
  misc_feature 1..242: note = chr12:114240196-114240438
  misc_feature 1..242: note = hypo
  source 1..242: mol_type = genomic DNA
ctcatccaatgcccacggtgtgcaggggcctttctacctcccatttcagtctcctggcctcaccctacagatggggacgtggctcagggaggtacagtgcttgcctgagtcacacagccgggaggcgacacgcccgggtgcgctcagttaatcctcggagatgagtgttcctctcatgcccgttttacagaggaggaaactgaggcacagaacaaccctgaggtaaccgccctgaggtcaca

SEQ ID NO: 73844 - DNA, 84 bp, Homo sapiens
  misc_feature 1..84: note = chr12:114273766-114273850
  misc_feature 1..84: note = hypo
  source 1..84: mol_type = genomic DNA
accattatattctctcggctgcgctcgcaggtactgtggcctgccgcggccctgaaagcttctcgatgccgtgaccctgctggt

SEQ ID NO: 73845 - DNA, 44 bp, Homo sapiens
  misc_feature 1..44: note = chr12:114282443-114282487
  misc_feature 1..44: note = hypo
  source 1..44: mol_type = genomic DNA
gtcagcccaaaagaccgtcccgctcctaccgtgaaagtgagcgg

SEQ ID NO: 73846 - DNA, 249 bp, Homo sapiens
  misc_feature 1..249: note = chr12:114290668-114290917
  misc_feature 1..249: note = hypo
  source 1..249: mol_type = genomic DNA
ctcagtttaaacaaacgtgttgaacgcacgccactgacaatctaatagcgatggtttactgtgcacacaacacggctcagcactgtgctgggtgcgctgggcacccggcgaggaggaaggctgtcccggccttaatgagctttgtccggctcgctcatcattggtcccttccactacaggtcctgtttggctagaatctgccaggtgaagacagtaggctcacagaacactcctcgagaggcccagtgc

SEQ ID NO: 73847 - DNA, 44 bp, Homo sapiens
  misc_feature 1..44: note = chr12:114295503-114295547
  misc_feature 1..44: note = hypo
  source 1..44: mol_type = genomic DNA
gctggcgaggctctccgagggtccccatgcgccttctctgcctg

SEQ ID NO: 73848 - DNA, 152 bp, Homo sapiens; identical to SEQ ID NO: 43574
  misc_feature 1..152: note = chr12:114329563-114329715
  misc_feature 1..152: note = hypo
  source 1..152: mol_type = genomic DNA

SEQ ID NO: 73849 - DNA, 30 bp, Homo sapiens
  misc_feature 1..30: note = chr12:114337104-114337134
  misc_feature 1..30: note = hypo
  source 1..30: mol_type = genomic DNA
tgtattactgaagtccgaggcaggagccac

SEQ ID NO: 73850 - DNA, 58 bp, Homo sapiens
  misc_feature 1..58: note = chr12:114337939-114337997
  misc_feature 1..58: note = hypo
  source 1..58: mol_type = genomic DNA
ggaagcccgagcctgcgaaatctcaaaggaaggacgaaaacaacggcaagaaaaccct

SEQ ID NO: 73851 - DNA, 32 bp, Homo sapiens
  misc_feature 1..32: note = chr12:114402798-114402830
  misc_feature 1..32: note = hypo
  source 1..32: mol_type = genomic DNA
aggtgcagtggctcacgcctgtaatcccagca

SEQ ID NO: 73852 - DNA, 390 bp, Homo sapiens
  misc_feature 1..390: note = chr12:114833759-114834149
  misc_feature 1..390: note = hyper
  source 1..390: mol_type = genomic DNA
ctgacacatccccaccgaacttgcgaatcgccgcgtttaacagcctgaaaatctggcctgctttttcccgggaactgcggaggttgtctctgtgactttgattatttgcattgatgaccctggggcaagattcttggaccaaccctggagtccggccccgatcgagtggaggtagttgggggaggcgagccgcggccgggggcgggggagggacgaggaactcgcgggccccgcggctgcccgaccccgggccgcgcgtctctaatctccggccgccgtggcccggccgcctccccggccgatagcgacgccgaccggggcggcgtggcgacagagagacgcagcggggccccgctggccgccacagtccccggccggcggggccatcgg

SEQ ID NO: 73853 - DNA, 30 bp, Homo sapiens; identical to SEQ ID NO: 34676
  misc_feature 1..30: note = chr12:114834466-114834496
  misc_feature 1..30: note = hyper
  source 1..30: mol_type = genomic DNA

SEQ ID NO: 73854 - DNA, 534 bp, Homo sapiens
  misc_feature 1..534: note = chr12:114838368-114838902
  misc_feature 1..534: note = hyper
  source 1..534: mol_type = genomic DNA
cgaatggaggcctctccctccgagccccggagccaaagcctcgcagtgtttatcagcctgagcgagcgcgcccggaggcggaggcgcagaagacttcgcaggccttttatagttaaatcctcacggctcaggctcggggggaaagagggactcggacgtgtctttccttcctgggggaataggaagaggactgcagttcgttgatataaacagaacgcgcctcctagttcactcaggccttgggccgagcggggagcagactttgtttaattttaaataataataaatgtcactgttgtcagtttattgagggaggcttcggctggagaacgggggcggggggcgtctggaaaggcggctccaccctcccccttcacacactcggtggcttgggcctaccgttcgcctgctccacacgcctgctcggggcatcctctggctttttgctttgcgggacgcggaagacccgtccagcacgggtagggatgtggccaggacgtccccaggcctgggcgcgcgcgtgcacatgctcac

SEQ ID NO: 73855 - DNA, 154 bp, Homo sapiens
  misc_feature 1..154: note = chr12:114841029-114841183
  misc_feature 1..154: note = hyper
  source 1..154: mol_type = genomic DNA
gcaagacaaatggtgcggcgcgcgggtctagtcggcggcgcggaggaggcaggaggaggcaggaggaggcgggaggaggcgaaggctacggaagatcagaagaggggtcaagccatcgctcatgccggcctgaatcggccgctgacctggccct

SEQ ID NO: 73856 - DNA, 324 bp, Homo sapiens
  misc_feature 1..324: note = chr12:114841672-114841996
  misc_feature 1..324: note = hyper
  source 1..324: mol_type = genomic DNA
ccaggccaaagccctcgtctgcgtcggccatggtgcgcccagggccctgtgcccgcgcaaggttctgctctgaggacaagaagcagggggagatgggggtggggaggacagagagagaacgagagaaaggttggagagcacaattctagtgacaggagggagcagtttggcccccagtttccagctaccagcacctccgttcccagccgaaggtgactgcagaaggccctagaattattactgttactagtattcctagtagtattactattactttataagcaggcacaacttcttgcaaaagacccgcgtcagacccggaga

SEQ ID NO: 73857 - DNA, 227 bp, Homo sapiens
  misc_feature 1..227: note = chr12:114842960-114843187
  misc_feature 1..227: note = hyper
  source 1..227: mol_type = genomic DNA
atctagaaatggggccgaggagaaggacagcttctgaggcctgacttgcaagcagctttcttcgcctcgttctcggggcttcagggaggcggcgactggagccccgctgcctactcacaacaaaagaaagcagggctggcgcccctacacgcgctcccattcactgccggccgcggggagaatcctaccccgcgccctcgccagggtcccggggagctctgggctgg

SEQ ID NO: 73858 - DNA, 545 bp, Homo sapiens
  misc_feature 1..545: note = chr12:114843260-114843805
  misc_feature 1..545: note = hyper
  source 1..545: mol_type = genomic DNA
cggcggcctcccagactccatttgccggggagctccgagccgcgcaaaatctctgcaagctgtgctctgcagaatgcaaagccgggctggaatccgccattcccgccgccccagccgactcggccgacgagctccctcctgagcctcccgggccatctgccgggacggttacctcgttcggtgaagccggtgcattcaccacatcctctgctgctcctagcagggaagccggcggtgaggcgggggagcaggcatggtggctccggggtttatgcggggtttactgcttacccagaatagcggctactgctgcctactagggcgcacctaccgctggagcctccgcggcgactgcccacctccaacacacacctcctctgctgtgcgcttgctctccctaaatacttcccagttggcaagcgccaaagaacacaaaatagcctccaagagcaccggcaaccatataatctcagtgccccgctcctcctttacacccccagggagggaaagttggaagcccagtgaatggtcgaagtcctttctga

SEQ ID NO: 73859 - DNA, 193 bp, Homo sapiens
  misc_feature 1..193: note = chr12:114844184-114844377
  misc_feature 1..193: note = hyper
  source 1..193: mol_type = genomic DNA
acaaatcatttcaaacgcggtcggcttctaatcgggaagtaatctcagtgacgctggcggtgcagagaaccgagtctggacgcacacacacaaacacaccgcgggcctccgcagccttgcagacattctctccaacgctgacctcgagaaggagagctgcctgaccccgcctggccggcgctcgccttcctga

SEQ ID NO: 73860 - DNA, 1101 bp, Homo sapiens
  misc_feature 1..1101: note = chr12:114845846-114846947
  misc_feature 1..1101: note = hyper
  source 1..1101: mol_type = genomic DNA
aaagaggcaaccaggcgatagcgactatctcaccagccgctgcacctataggacttggagacgtcacgagtcacgcaaccggcccgcgcgctgtcacgtttggctggggggcagcggcgggaggtaaatttctctccgtcttcgcctatcagtgccgggtctgcgcagccacaggttccggacgtcttggccccgggaataaataaagacataaaccaacccggctttctccggaggaatgagggtgatgaacataagacacaaatagagccaagatcgactttcttaggaagggggagaggagggaactcttcacgaagggaggtgggagtccacctcagacctctattggaaggaaatcgagttgttccgggggactgaggtctcttgcataaggcatgggatccttattattattattattatttttaaatcccccgcggaggagctctgggcaaatgaataccgaggcgccgctctagctggttaggcttgggatgcgataactcagtgccctcttgcagacttgcatagaaataattactgggttgtcgtggaggggacacgagacagagggagttctccgtaatgtgccttgcggagagaaaggtccaagaatgcaattcgtcccagagtggcccggcaggggcggggtgcgagtgggtggtggagtaggggtgggagtggagagaggtggtttctgtagagaataattattgtaccagggcccgccgaggcacgaggcactctattttgttttgtaatcacgacgactattatttttagtctgatcaatgggcacaatttctaagcagcgcagtggtggatgctcgcaaacttttgcgcaccgctggaaacccactaggttgagttgcaaaacgtaccgcgtagacgcccctggtggcgccgagagaagagctaggcctgcccagcacagagccggagagcgtcgggccttccggaagggtaagttctccgccaaggggtcccgagggagctggacgtctgaatctggacttgcccccagcttcggggttcgattctgggttttgcgcgtccccaacccccagggctttccgaagcatggcctggctccaggcc

SEQ ID NO: 73861 - DNA, 122 bp, Homo sapiens; identical to SEQ ID NO: 3956
  misc_feature 1..122: note = chr12:114847042-114847164
  misc_feature 1..122: note = hyper
  source 1..122: mol_type = genomic DNA

SEQ ID NO: 73862 - DNA, 272 bp, Homo sapiens; identical to SEQ ID NO: 3957
  misc_feature 1..272: note = chr12:114847165-114847437
  misc_feature 1..272: note = hyper
  source 1..272: mol_type = genomic DNA

SEQ ID NO: 73863 - DNA, 78 bp, Homo sapiens; identical to SEQ ID NO: 3958
  misc_feature 1..78: note = chr12:114847577-114847655
  misc_feature 1..78: note = hyper
  source 1..78: mol_type = genomic DNA

SEQ ID NO: 73864 - DNA, 142 bp, Homo sapiens
  misc_feature 1..142: note = chr12:114852047-114852189
  misc_feature 1..142: note = hyper
  source 1..142: mol_type = genomic DNA
tcagtctgcggagggcgccccggtgaagtgtggagttcgcagtcggacgcggccgcccggcctctcggttccgggccttcccctcccaggcactgcgttctgcggccgggacagcacccgccaggcgcggcccttctcctat

SEQ ID NO: 73865 - DNA, 244 bp, Homo sapiens
  misc_feature 1..244: note = chr12:114877144-114877388
  misc_feature 1..244: note = hyper
  source 1..244: mol_type = genomic DNA
attaagtctaattagcgagcccgagctaaaaggccgccacagcggcggggcccagggagaaaaagcagcgttcccaattcccatgcttccagctccaggttgtcggtcttttgtcagcctccgaagccagggtgctcaacctggccccctttctttcctgctggtgaggccacccgctttgggacagaactctgggcctgcgcctcagctctccctcttagcgccccggcgccccggcttccca

SEQ ID NO: 73866 - DNA, 350 bp, Homo sapiens
  misc_feature 1..350: note = chr12:114878244-114878594
  misc_feature 1..350: note = hyper
  source 1..350: mol_type = genomic DNA
caaataatgtgtgtgcgcaaagacgtttctgtctacagataattacgcgtaaattatccgtggcaaacaacatatgcaaacgacatatgcaaacaacatatgcaaacgattatctatgtgcagataattccatgcccacgagccgacagatttgcaattctcaagtacttctatgtgcatgtaattctacgggcaaattgttccgagtgcaagggatttggtgtgtgtgtcagtgattgcaccgctgaaaacaattctgtagatgtgtcgatgcctttagaagaaagggctccaaagaatcgtgtctcgatggttggtcagcgcgcgcatctgcggcactggctaaatcc

SEQ ID NO: 73867 - DNA, 204 bp, Homo sapiens; identical to SEQ ID NO: 11455
  misc_feature 1..204: note = chr12:114878808-114879012
  misc_feature 1..204: note = hyper
  source 1..204: mol_type = genomic DNA

SEQ ID NO: 73868 - DNA, 542 bp, Homo sapiens
  misc_feature 1..542: note = chr12:114881542-114882084
  misc_feature 1..542: note = hyper
  source 1..542: mol_type = genomic DNA
aggcagagaacagcccgtcccggtggccacttttcttggccaagcccccagagcaaatccctgggggccctgcagggctagagtggaggccactgggaggggagggtcgctggggtcgctgggcgcgcgcgcgcggagcaaatttgcccgcgcgcacccagaaacgatgacataagtggcgctgatgagcgctgcgcggctgaaacgcgactacataaagggtccgccggcagcgtgggccggagggattgcttcacactccggaattgggcccagacacatttagaaatgttttgctggacgtgtgccccgcaagggcgacagcggcagccggcagcctgggtgaagctgcgccgctggtcacaggctggcgcgcggcggcggccacagaggcgtcctaggtggagaatgcttctgcctttgcctgttctcccctaacccccacgtttgtatgcctcctggggacaggggtctgtctgcagcctgcagcgccccagctgtgaccagagaagcattaaggagcggcgcgggcaagaatttgg

SEQ ID NO: 73869 - DNA, 78 bp, Homo sapiens
  misc_feature 1..78: note = chr12:114882568-114882646
  misc_feature 1..78: note = hyper
  source 1..78: mol_type = genomic DNA
cccgtgctcggaaggcgggcgttgctacagggcacgatgaatgttgagcccgtgccccaatttcgccagacttaacga

SEQ ID NO: 73870 - DNA, 30 bp, Homo sapiens
  misc_feature 1..30: note = chr12:114883016-114883046
  misc_feature 1..30: note = hyper
  source 1..30: mol_type = genomic DNA
actagggcgcaaacccggatcctgcgcgct

SEQ ID NO: 73871 - DNA, 83 bp, Homo sapiens; identical to SEQ ID NO: 34694
  misc_feature 1..83: note = chr12:114883452-114883535
  misc_feature 1..83: note = hyper
  source 1..83: mol_type = genomic DNA

SEQ ID NO: 73872 - DNA, 91 bp, Homo sapiens
  misc_feature 1..91: note = chr12:114883793-114883884
  misc_feature 1..91: note = hyper
  source 1..91: mol_type = genomic DNA
tagccaggggtttgccggactaaggcaataactgggaggtgtgccattgtgggtcggctgttgggttgtgtgtgagcgaggatcccattat

SEQ ID NO: 73873 - DNA, 86 bp, Homo sapiens
  misc_feature 1..86: note = chr12:114885098-114885184
  misc_feature 1..86: note = hyper
  source 1..86: mol_type = genomic DNA
gagaagccgcctcagcgagcctctgggctccgggccatgtgagccggttggccagagcctggcgggttccgtgcttggctagccag

SEQ ID NO: 73874 - DNA, 295 bp, Homo sapiens
  misc_feature 1..295: note = chr12:114885371-114885666
  misc_feature 1..295: note = hyper
  source 1..295: mol_type = genomic DNA
cgctggaagaaacgaactgggggccgagttcgggcggcgatctgccggggacccagtcctgagcggcttgtttgggatactgggattaaggcctcagaggagcacatggctagcctctgcagccctcggagggtcactgacgccccctgcttttccttccaaatgtctttccccgaggctggggacacctgttctgagcagaagagggcaatggttcaacctgtttgaccccgcccgggtctccttctgcgggaacatacgccccagtcagctgaggtgccggctgactttcccc

SEQ ID NO: 73875 - DNA, 388 bp, Homo sapiens
  misc_feature 1..388: note = chr12:114886043-114886431
  misc_feature 1..388: note = hyper
  source 1..388: mol_type = genomic DNA
agagaaaatgcggatcggaggtcaggtgcacccttaccggcaacttggggtacacaaccggggtcccagcatcacctcccctcgccccgcgctcatgtccccactctgaggcccgtgggcactgaggtggcaccgacctcccaggacccctgcattgcctcacactttcacttccctccctgctccgcagtgtccataaaataccagccgttcacctgcctatagcgaacggatccgagggtggaggcaatgacttacctggttgtgggtggatggatgaagaaggcctttacttggagcctaagccctggcgcgcgcgcaccacggcgcgaactgctccatcaagcatccactggcctccagccgcgtttccggttgtagcactggg

SEQ ID NO: 73876 - DNA, 421 bp, Homo sapiens; identical to SEQ ID NO: 34699
  misc_feature 1..421: note = chr12:114917674-114918095
  misc_feature 1..421: note = hyper
  source 1..421: mol_type = genomic DNA

SEQ ID NO: 73877 - DNA, 150 bp, Homo sapiens
  misc_feature 1..150: note = chr12:114918587-114918737
  misc_feature 1..150: note = hyper
  source 1..150: mol_type = genomic DNA
ggagaaggcaagatccggcaggcgacgctgattagctgggggtctccgatgcgaccccggactcggagcaggaaatcctgggtgctcctgaagctccgcctgccccgggttccagcgagagcacctcgtcacactcggggcgctgtcccc

SEQ ID NO: 73878 - DNA, 66 bp, Homo sapiens
  misc_feature 1..66: note = chr12:114939117-114939183
  misc_feature 1..66: note = hyper
  source 1..66: mol_type = genomic DNA
gggcaggcctgctggcggtcagtgatgcatgatggaaggaaccgggaggcgcgccctggaagcagc

SEQ ID NO: 73879 - DNA, 30 bp, Homo sapiens
  misc_feature 1..30: note = chr12:115106216-115106246
  misc_feature 1..30: note = hyper
  source 1..30: mol_type = genomic DNA
atcccctccaccccccgcccatcagcgcta

SEQ ID NO: 73880 - DNA, 38 bp, Homo sapiens; identical to SEQ ID NO: 11459
  misc_feature 1..38: note = chr12:115106464-115106502
  misc_feature 1..38: note = hyper
  source 1..38: mol_type = genomic DNA

SEQ ID NO: 73881 - DNA, 38 bp, Homo sapiens
  misc_feature 1..38: note = chr12:115120626-115120664
  misc_feature 1..38: note = hyper
  source 1..38: mol_type = genomic DNA
tggtaatgaccatctcggtgccccgcttgtgaaactga

SEQ ID NO: 73882 - DNA, 39 bp, Homo sapiens
  misc_feature 1..39: note = chr12:115121505-115121544
  misc_feature 1..39: note = hyper
  source 1..39: mol_type = genomic DNA
cctctccctctttctcgctggtggcgtctgcagctgtgc

SEQ ID NO: 73883 - DNA, 130 bp, Homo sapiens; identical to SEQ ID NO: 34702
  misc_feature 1..130: note = chr12:115121885-115122015
  misc_feature 1..130: note = hyper
  source 1..130: mol_type = genomic DNA

SEQ ID NO: 73884 - DNA, 288 bp, Homo sapiens
  misc_feature 1..288: note = chr12:115122236-115122524
  misc_feature 1..288: note = hyper
  source 1..288: mol_type = genomic DNA
gcgcgcgcacagagtcgcctctaggtggcttatcgagagatcgctgcagcccctgagctcgctcgctcgctctggttcagcccacgtctgaaatgcctcagtcatccagccggggatcgagggaggaggcagggccaaggaggaagggggagggagagagggagggagccagcgagcaggcgagccgggcggggaaggcggagagcgcgcccgggcgccgggcaggggcgctcgcctctcttgcactccgctcgcctctccgaccgccgcggccggttctctctccag

SEQ ID NO: 73885 - DNA, 102 bp, Homo sapiens
  misc_feature 1..102: note = chr12:115130675-115130777
  misc_feature 1..102: note = hyper
  source 1..102: mol_type = genomic DNA
caggctcagagagaacgcagccgagcgggggaatcttcgtgcgcgaagccgggagggttgcggggagggagagttctcctctcccaccgctggggtgtgttt

SEQ ID NO: 73886 - DNA, 65 bp, Homo sapiens
  misc_feature 1..65: note = chr12:115135302-115135367
  misc_feature 1..65: note = hyper
  source 1..65: mol_type = genomic DNA
ctccctagtagatttcgttcttgaacttctcggccttggaatcagacgcccgggtcattgcgcag

SEQ ID NO: 73887 - DNA, 123 bp, Homo sapiens
  misc_feature 1..123: note = chr12:115136240-115136363
  misc_feature 1..123: note = hyper
  source 1..123: mol_type = genomic DNA
ttgggcggagtggggcgcggtggggaacacagcttggacgcctaggcgtcctgagcccggcaccctgcgcgcagagcagacccaggcgctctcgcgagctctagcgtccgtcatgtttcctct

SEQ ID NO: 73888 - DNA, 73 bp, Homo sapiens; identical to SEQ ID NO: 34704
  misc_feature 1..73: note = chr12:115889703-115889776
  misc_feature 1..73: note = hyper
  source 1..73: mol_type = genomic DNA

SEQ ID NO: 73889 - DNA, 15 bp, Homo sapiens
  misc_feature 1..15: note = chr12:11653449-11653464
  misc_feature 1..15: note = hyper
  source 1..15: mol_type = genomic DNA
ggagctcagggccat

SEQ ID NO: 73890 - DNA, 279 bp, Homo sapiens; identical to SEQ ID NO: 34245
  misc_feature 1..279: note = chr12:11653509-11653788
  misc_feature 1..279: note = hyper
  source 1..279: mol_type = genomic DNA

SEQ ID NO: 73891 - DNA, 352 bp, Homo sapiens
  misc_feature 1..352: note = chr12:116755878-116756230
  misc_feature 1..352: note = hypo
  source 1..352: mol_type = genomic DNA
gagcctcaggttcttcgtatgggaaacaggggtagtgctttgcctacctcgggagatagggggatgattcattagctatgcctggtatgtacctggcatgcagaaattgtttcatgaacgtctgctgtgatggcaaacctttcgggtagatccatctagtttctcacgcgtgcggcaagcggctgccgtgtttaccgaccgtcctgtgactgtggggactggcaaagctaaatggcctgagtgggttgaactgtggccgcacctggttagcaccgttctttttcttcttctgaaggaaaggcgtggctgttccgaggtgccttgtgaaatagccagccgtcctgggctgccc

SEQ ID NO: 73892 - DNA, 142 bp, Homo sapiens
  misc_feature 1..142: note = chr12:116842262-116842404
  misc_feature 1..142: note = hypo
  source 1..142: mol_type = genomic DNA
ttggtgtctggtcaccgcacgtcgttattcagttcacacacagctaagcgtgcagctgtgttgcctccttctctctgggtgataactcacttgacattttacataaatggatagtaaaaagaaggaattagccaacaaagat

SEQ ID NO: 73893 - DNA, 186 bp, Homo sapiens
  misc_feature 1..186: note = chr12:116941184-116941370
  misc_feature 1..186: note = hypo
  source 1..186: mol_type = genomic DNA
atggtgtacacagggcgtgggacgctggataaaacctaaagagacctgacccactgccctctaggtgcttagcctctgaccacaccaagctagcgacattccaatctctcataaaaagcatttcaaaatgaaagagactgggcaaataaatcgtggtacatgcacggaatgcgatggccttcaggc

SEQ ID NO: 73894 - DNA, 114 bp, Homo sapiens
  misc_feature 1..114: note = chr12:116946086-116946200
  misc_feature 1..114: note = hyper
  source 1..114: mol_type = genomic DNA
tctgcaagctctcagcggctccagcgttttcaaggagcggggtcaaggtcaaagggcccctcccaggctgcccgggcggggctgtagtgggatgctggtccccaggctgcgcct

SEQ ID NO: 73895 - DNA, 298 bp, Homo sapiens
  misc_feature 1..298: note = chr12:116946250-116946548
  misc_feature 1..298: note = hyper
  source 1..298: mol_type = genomic DNA
cgccgccggagagggtcccagcgcgcccaggcctcccgcaggcgggacgcggcgtcggggggctgctgcgctgctcggccccagcgggcccgccgcgccgccgcggctctggctgcctcctgcatgccaattaggccctaatttgatttctgttctatctgtgcgaaccccattaaaacccaattccgcttattaccaacagctttcttgcaacgcgacgcctctccctcccagggccgctgctcaggcgcgccgaggagccaggctccgcgcaccaggctggcggggacaccttccc

SEQ ID NO: 73896 - DNA, 39 bp, Homo sapiens
  misc_feature 1..39: note = chr12:117155588-117155627
  misc_feature 1..39: note = hypo
  source 1..39: mol_type = genomic DNA
aggctggagcaagtccgctgcacccgtcaagcggggaag

SEQ ID NO: 73897 - DNA, 30 bp, Homo sapiens
  misc_feature 1..30: note = chr12:117157142-117157172
  misc_feature 1..30: note = hypo
  source 1..30: mol_type = genomic DNA
tcctaaaataaacagcgactccatcccaga

SEQ ID NO: 73898 - DNA, 41 bp, Homo sapiens
  misc_feature 1..41: note = chr12:117300848-117300889
  misc_feature 1..41: note = hypo
  source 1..41: mol_type = genomic DNA
ggacagataaggtggctataagttagcgggggagataagaa

SEQ ID NO: 73899 - DNA, 30 bp, Homo sapiens
  misc_feature 1..30: note = chr12:117316744-117316774
  misc_feature 1..30: note = hyper
  source 1..30: mol_type = genomic DNA
cgccctcccctgcagcgcaggccccagtta

SEQ ID NO: 73900 - DNA, 32 bp, Homo sapiens
  misc_feature 1..32: note = chr12:117317256-117317288
  misc_feature 1..32: note = hyper
  source 1..32: mol_type = genomic DNA
cctttttctgcaccccgcgatccatccaaaat

SEQ ID NO: 73901 - DNA, 47 bp, Homo sapiens
  misc_feature 1..47: note = chr12:117318318-117318365
  misc_feature 1..47: note = hyper
  source 1..47: mol_type = genomic DNA
caaaggtgatggagacgggggcgactcaggaacggcaagaggattgg

SEQ ID NO: 73902 - DNA, 110 bp, Homo sapiens
  misc_feature 1..110: note = chr12:117319409-117319519
  misc_feature 1..110: note = hyper
  source 1..110: mol_type = genomic DNA
gcgaggtttgggagacggggagcgcggcgcggggcggcgcgagaaggctccccgcagcggaggtcctgggctttgggggtctcgggggacccccgcggaggcgcggagcg

SEQ ID NO: 73903 - DNA, 338 bp, Homo sapiens
  misc_feature 1..338: note = chr12:117319758-117320096
  misc_feature 1..338: note = hyper
  source 1..338: mol_type = genomic DNA
tcagcctgaccctaacgtgcccccagcgcctggctagaaacctgaccctaaagtgcccccagcgcccggtgggaggctggatgggcccacctgagctcgcgtggggcgcggacggaggcattctcgctgcccggcacccgcacccaaaagaccctcgcaaggggctttctaaagggaaacttcttgtctgctttctttgtgaacattattttcctgatggcgttacagttttctgcgatgaccccgatttaatgcgcagtggagaccctaaggggtcggcgagaggaggggcgcgggggactttaattcccccttttccaatccgacagccactcctg

SEQ ID NO: 73904 - DNA, 30 bp, Homo sapiens
  misc_feature 1..30: note = chr12:117408106-117408136
  misc_feature 1..30: note = hypo
  source 1..30: mol_type = genomic DNA
atgaggaagcctggacgggacagccagcag

SEQ ID NO: 73905 - DNA, 41 bp, Homo sapiens
  misc_feature 1..41: note = chr12:11745619-11745660
  misc_feature 1..41: note = hypo
  source 1..41: mol_type = genomic DNA
gcattcctcccagtgcgcagacaggtcggaggttctgcagg

SEQ ID NO: 73906 - DNA, 502 bp, Homo sapiens
  misc_feature 1..502: note = chr12:117472595-117473097
  misc_feature 1..502: note = hypo
  source 1..502: mol_type = genomic DNA
gcccgaggcacagaccgcagtgcccagatggtggggctgactgagatccgtgcccggggcagcaaccctcggtctgtgttgatcaaaggccagcagccccacaagacgcatcagcctgccccttctgggatcaggtttgcaccaactcatcgccaaccctgatcgttcccgggatgccacagacaatgccaggagccgggcaggagagcgccaggtgatttctgcatccacgctctggcggaaatgagccctaaccctgccaattagaggacaccctcagtgattatgcacaaatgagctttcttctgagcagtgtggactgggctcacggtaactcaacctcattttaattagctgtttagataagcggtggcccaaagcttcaaagacatcaggcaggcctcagtggcccaaacaggggagcacatttgatgtgtgcccatcgtggccacatctcccaaactaaaactcggggcacaggggctgacggaagatgatttat

SEQ ID NO: 73907 - DNA, 211 bp, Homo sapiens; identical to SEQ ID NO: 43581
  misc_feature 1..211: note = chr12:117473987-117474198
  misc_feature 1..211: note = hypo
  source 1..211: mol_type = genomic DNA

SEQ ID NO: 73908 - DNA, 198 bp, Homo sapiens; identical to SEQ ID NO: 43582
  misc_feature 1..198: note = chr12:117474577-117474775
  misc_feature 1..198: note = hypo
  source 1..198: mol_type = genomic DNA

SEQ ID NO: 73909 - DNA, 30 bp, Homo sapiens; identical to SEQ ID NO: 43583
  misc_feature 1..30: note = chr12:117484341-117484371
  misc_feature 1..30: note = hypo
  source 1..30: mol_type = genomic DNA

SEQ ID NO: 73910 - DNA, 89 bp, Homo sapiens
  misc_feature 1..89: note = chr12:117498335-117498424
  misc_feature 1..89: note = hypo
  source 1..89: mol_type = genomic DNA
cagggagatgatctacgaaatcacgatcggatgacaatgacagctacagctcacaaccgtgcaagcaacttggccggagccacctcgct

SEQ ID NO: 73911 - DNA, 38 bp, Homo sapiens
  misc_feature 1..38: note = chr12:117512545-117512583
  misc_feature 1..38: note = hypo
  source 1..38: mol_type = genomic DNA
tgaagagcccttcctcgcttccacgatagttataattt

SEQ ID NO: 73912 - DNA, 30 bp, Homo sapiens
  misc_feature 1..30: note = chr12:117512972-117513002
  misc_feature 1..30: note = hypo
  source 1..30: mol_type = genomic DNA
gaaaacaactacccccgctactcagcactc

SEQ ID NO: 73913 - DNA, 523 bp, Homo sapiens
  misc_feature 1..523: note = chr12:117529736-117530259
  misc_feature 1..523: note = hypo
  source 1..523: mol_type = genomic DNA
ggggttctcggcatgcgggagaggcggtttctcccggcactgcacttggcaaatcccactagaaggcctggttttgagtctggattccctacccagcaactaagtgatcttgggcagtcatttcctctgtccaaacctcagtttgcccatctataaactggcagcaatagtcccaccctcaaagggcttttcggcagatcagatgattgacaagtgctcaagaaagagcagctgtcacctcattcacagctggctgcgttttttaaggagcggaactggtggctcaaagaaggacacagcctggatgagacatctgagcgaagtggcacaggacggctccagcaccgagctcagtgcacatggaacgccatcctccagggtcccgctctgtggctgcgacagatggtgagatgatggggcccaggtgaacagaatgaaaaataccagcatgggctagagcaggcaggtgcctttggttgatccccagccctgtgggaagcttccacagcgggcattctcctgc

SEQ ID NO: 73914 - DNA, 136 bp, Homo sapiens
  misc_feature 1..136: note = chr12:117530986-117531122
  misc_feature 1..136: note = hypo
  source 1..136: mol_type = genomic DNA
ctggagggcagggaccgcatctggtccaccctggtagcagaatatggcaattggtgaatgagccgaggccaccgtctgaggccacttaaagactttagaaccaagaagtattacccaggggcgagaacgcagtgga

SEQ ID NO: 73915 - DNA, 141 bp, Homo sapiens
  misc_feature 1..141: note = chr12:117532388-117532529
  misc_feature 1..141: note = hypo
  source 1..141: mol_type = genomic DNA
tgatgcctgctattgcgggctccaggagcgctgaggatgggtgtttaacccttaaaggtcggatggagagatggctttctggatgggagcagcaggtaagccaacccctgaacaataatgagcattcgtttcataaagaga

SEQ ID NO: 73916 - DNA, 148 bp, Homo sapiens
  misc_feature 1..148: note = chr12:117533174-117533322
  misc_feature 1..148: note = hypo
  source 1..148: mol_type = genomic DNA
gcctagaccttaccctgggtggagacagagaaaggctcccgtacgtaaacacctgattgtacacatcaaatgaaaacagtgctccaggcagaggaacagcttttgtgcaaaggcctgaaggtgagaaaaaatacgggagtcttttcct

SEQ ID NO: 73917 - DNA, 67 bp, Homo sapiens; identical to SEQ ID NO: 43588
  misc_feature 1..67: note = chr12:117544227-117544294
  misc_feature 1..67: note = hypo
  source 1..67: mol_type = genomic DNA

SEQ ID NO: 73918 - DNA, 82 bp, Homo sapiens
  misc_feature 1..82: note = chr12:117563218-117563300
  misc_feature 1..82: note = hypo
  source 1..82: mol_type = genomic DNA
gggttgctgtgcagccgagactgagggtgactcatgccgaatatatactgcctagacagtgacaattcgcagcatctctcac

SEQ ID NO: 73919 - DNA, 100 bp, Homo sapiens
  misc_feature 1..100: note = chr12:117564823-117564923
  misc_feature 1..100: note = hypo
  source 1..100: mol_type = genomic DNA
aaagcatgtaacacacgtatgagaatgctaccatgtaatatgcatgacagtggcacgtaattgccacatgataggcatgccttaacgtgagtggcatgta

SEQ ID NO: 73920 - DNA, 30 bp, Homo sapiens
  misc_feature 1..30: note = chr12:117669835-117669865
  misc_feature 1..30: note = hypo
  source 1..30: mol_type = genomic DNA
cagaggcgttggtggcgtggtgatgtccag

SEQ ID NO: 73921 - DNA, 24 bp, Homo sapiens
  misc_feature 1..24: note = chr12:117716889-117716913
  misc_feature 1..24: note = hypo
  source 1..24: mol_type = genomic DNA
aaatgatcaatgggccgggcgcgg

SEQ ID NO: 73922 - DNA, 152 bp, Homo sapiens
  misc_feature 1..152: note = chr12:117718680-117718832
  misc_feature 1..152: note = hypo
  source 1..152: mol_type = genomic DNA
agagaggggaacacccggcatcagggcgggacttgcgctgtgggaacatactaaacatggcgccacccagggcgacagctgcttgaggctcagggtagattacctccgtgccaaggtccccagggccaatggagcagcggtcggaagggatg

SEQ ID NO: 73923 - DNA, 34 bp, Homo sapiens
  misc_feature 1..34: note = chr12:117796936-117796970
  misc_feature 1..34: note = hyper
  source 1..34: mol_type = genomic DNA
tgtcagtggcagagccgtgcgcccctcagggcgc

SEQ ID NO: 73924 - DNA, 36 bp, Homo sapiens
  misc_feature 1..36: note = chr12:117797434-117797470
  misc_feature 1..36: note = hyper
  source 1..36: mol_type = genomic DNA
cctccgtggtggctgcgtgcgcgcttttcttaggcc

SEQ ID NO: 73925 - DNA, 371 bp, Homo sapiens
  misc_feature 1..371: note = chr12:117798084-117798455
  misc_feature 1..371: note = hyper
  source 1..371: mol_type = genomic DNA
tggcgtcctctggggcgcagtcccgagagagccccttccgggacctcggacgcaaggcccctgagtggccctggaagttggatcccccggggaccctgctccgaaccctggccacctggaagcaacctcatcgagcgctccttccactgcccagccccgaaccgtggcggaacgcgcccctcggcctccctagagcctcctttgcgggagaagcacaactttcccaggttttggagacggcgctcttacaccccaatctcgcccagacggaagaagtgagaggtgcgggcggccccgccatgaccgcgggaggagagcgcaaggaggctcctcgcaaagttggaggccaggccggagcgatgttccgggag

SEQ ID NO: 73926 - DNA, 193 bp, Homo sapiens; identical to SEQ ID NO: 34709
  misc_feature 1..193: note = chr12:117799086-117799279
  misc_feature 1..193: note = hyper
  source 1..193: mol_type = genomic DNA

SEQ ID NO: 73927 - DNA, 261 bp, Homo sapiens
  misc_feature 1..261: note = chr12:117799330-117799591
  misc_feature 1..261: note = hyper
  source 1..261: mol_type = genomic DNA
cgctgctcgctgcccggccgcccctcggaggagccgcggcgctaagtagctcctcacccagcggctggaaacgcggcataaatatgtagggactgagccgtgagctcagcgagggtcgtgagggggaatttatttcttaatgtccctcctttatcctatcatcactgaaacgaattagcagtgacgtccaacccgactggtttatgggtgtggggagggagacgtcgcaaccctcattaaaagagccgctctgggctccaa

SEQ ID NO: 73928 - DNA, 36 bp, Homo sapiens
  misc_feature 1..36: note = chr12:118177132-118177168
  misc_feature 1..36: note = hypo
  source 1..36: mol_type = genomic DNA
ctgggcgacagagcaagactccgcctcaaaaatata

SEQ ID NO: 73929 - DNA, 265 bp, Homo sapiens
  misc_feature 1..265: note = chr12:118198608-118198873
  misc_feature 1..265: note = hypo
  source 1..265: mol_type = genomic DNA
atcgtattttttaaacggccaattctgggaaattctgttctattcatttgctcagaaccctctgtgaaaagccatttttcattcaaccagagtctggaacgcaagtctgttcccggtttccttgacctgggcagttcctgggaccaaggggcagcccctcgcaggccgggtttcgaccgccccagggcacccaccgatcgcactcacttgggcgtgtgggcctcgtccacgcggtgccccagctggaactcgtgggatttgctcc

SEQ ID NO: 73930 - DNA, 45 bp, Homo sapiens
  misc_feature 1..45: note = chr12:118324438-118324483
  misc_feature 1..45: note = hypo
  source 1..45: mol_type = genomic DNA
catttctcagaacgtatccccgtcatttagcgacatatgacagta

SEQ ID NO: 73931 - DNA, 30 bp, Homo sapiens
  misc_feature 1..30: note = chr12:118331639-118331669
  misc_feature 1..30: note = hypo
  source 1..30: mol_type = genomic DNA
ataaatatattttaacgcagcattttaaaa

SEQ ID NO: 73932 - DNA, 16 bp, Homo sapiens
  misc_feature 1..16: note = chr12:118711017-118711033
  misc_feature 1..16: note = hypo
  source 1..16: mol_type = genomic DNA
aaaaaatagggccagc

SEQ ID NO: 73933 - DNA, 157 bp, Homo sapiens
  misc_feature 1..157: note = chr12:118795285-118795442
  misc_feature 1..157: note = hyper
  source 1..157: mol_type = genomic DNA
agagaaggttaagcacgttttaagtaattcaggagtttaaaacttgtcatctatgtataaaacaagcaaacagttataagtggttaaataaacatgtacaaattaataggatggagtttgtaacttctacttttcccttcaacgagtgtcattttgg

SEQ ID NO: 73934 - DNA, 30 bp, Homo sapiens
  misc_feature 1..30: note = chr12:118830447-118830477
  misc_feature 1..30: note = hypo
  source 1..30: mol_type = genomic DNA
taccagtctgcctgccggcttttggacctg

SEQ ID NO: 73935 - DNA, 39 bp, Homo sapiens; identical to SEQ ID NO: 43592
  misc_feature 1..39: note = chr12:118860397-118860436
  misc_feature 1..39: note = hypo
  source 1..39: mol_type = genomic DNA

SEQ ID NO: 73936 - DNA, 88 bp, Homo sapiens; identical to SEQ ID NO: 34711
  misc_feature 1..88: note = chr12:119212112-119212200
  misc_feature 1..88: note = hyper
  source 1..88: mol_type = genomic DNA

SEQ ID NO: 73937 - DNA, 88 bp, Homo sapiens; identical to SEQ ID NO: 34712
  misc_feature 1..88: note = chr12:119212318-119212406
  misc_feature 1..88: note = hyper
  source 1..88: mol_type = genomic DNA

SEQ ID NO: 73938 - DNA, 99 bp, Homo sapiens
  misc_feature 1..99: note = chr12:119417727-119417826
  misc_feature 1..99: note = hyper
  source 1..99: mol_type = genomic DNA
agcaaatgcacctctcgttgttgaccagaaggggtcactgcagagcaagtagcgctctcaggcactcaaataagcggacgcaggcgtgtcgaacacaca

SEQ ID NO: 73939 - DNA, 808 bp, Homo sapiens; identical to SEQ ID NO: 34714
  misc_feature 1..808: note = chr12:119418516-119419324
  misc_feature 1..808: note = hyper
  source 1..808: mol_type = genomic DNA

SEQ ID NO: 73940 - DNA, 455 bp, Homo sapiens
  misc_feature 1..455: note = chr12:119419368-119419823
  misc_feature 1..455: note = hyper
  source 1..455: mol_type = genomic DNA
cgtcgcctcttctctcctggtgctgcccagaaagccagccctcccttcccttcttggggcgcagaggctcagccagctcagagcgcagcctggagccgacccagaagggcgaagaaagcccagcggacgagcctcctttctctgctgcctgcccgggctggggcgtcccatcccccgccctgaactccgatctctcccaccccacccctctctgggtttcacccggacagagccgggagctgggtgtcgcccccgtttggaatccacgtttcagcactttggacagcgccccggacgccccggcccctttgggttggcgatggcgagcgttcagcaaggcgagaagcagctttttgagaagttctggcgaggaaccttcaaagcggtggccaccccccgtcccgagagcatcattgtcgccagtatcacggcccgcaagccgctgccaaggtaat

SEQ ID NO: 73941 - DNA, 80 bp, Homo sapiens
  misc_feature 1..80: note = chr12:119446570-119446650
  misc_feature 1..80: note = hyper
  source 1..80: mol_type = genomic DNA
accagccagagccaacgggccgccccttcctccaccagctctccggcctttgacactaattgatacggagtttccccctc

SEQ ID NO: 73942 - DNA, 91 bp, Homo sapiens; identical to SEQ ID NO: 34717
  misc_feature 1..91: note = chr12:119458719-119458810
  misc_feature 1..91: note = hyper
  source 1..91: mol_type = genomic DNA

SEQ ID NO: 73943 - DNA, 318 bp, Homo sapiens
  misc_feature 1..318: note = chr12:119499049-119499367
  misc_feature 1..318: note = hyper
  source 1..318: mol_type = genomic DNA
attatcttgttccaacggtgggggcagagtgtccttgagatgtggttagaaaagaaaaaaaggtgtagccctgcgtgtgcacttgggtgtgttggcagaacttccgctcaaatccaggggctttgctgattcatgtttcctagagcctgacggcggttcagcaccagggacagcgaccactgattaaataacaggctgcagtgaatccaaccatgaaagcactacctggctgttgcagccgtccttgcctattgaacctactagttacattacttttcaggtgtctctcacttttacggaatgcgtgctattgaaaag

SEQ ID NO: 73944 - DNA, 83 bp, Homo sapiens
  misc_feature 1..83: note = chr12:119616507-119616590
  misc_feature 1..83: note = hyper
  source 1..83: mol_type = genomic DNA
gagggcggagctgagcggagtggccaggggaggagagagtgtccggagaggccggctgaacttggacgcggcccctcccagct

SEQ ID NO: 73945 - DNA, 32 bp, Homo sapiens
  misc_feature 1..32: note = chr12:119730037-119730069
  misc_feature 1..32: note = hypo
  source 1..32: mol_type = genomic DNA
ggatgtacatacccacgcgggcttgcagaaac

SEQ ID NO: 73946 - DNA, 36 bp, Homo sapiens
  misc_feature 1..36: note = chr12:120001632-120001668
  misc_feature 1..36: note = hypo
  source 1..36: mol_type = genomic DNA
taaaaataagccgggcgcagtgattcacacctgtaa

SEQ ID NO: 73947 - DNA, 380 bp, Homo sapiens
  misc_feature 1..380: note = chr12:120031519-120031899
  misc_feature 1..380: note = hyper
  source 1..380: mol_type = genomic DNA
gaaggggtgaggtcacgtctcccttgagccccgagccgctggcttttcagagcctcgccacaagccggcggccagagccccagaccacacagaccgtgcgctcctccgccctcccggcgccgccggcctcgcccatgtctcagtacgcccctagcccggacttcaagagggctttggacagcagtcccgaggccaacactgaagatgacaagaccgaggaggacgtgcccatgcccaagaactacctgtggctcaccatcgtctcgtgtttttgccctgcgtaccccatcaacatcgtggctttggtcttttccatcatggtgagtgaatcacggccagaggcagcctgggaggagagacccgggcggctttgagcccct

SEQ ID NO: 73948 - DNA, 118 bp, Homo sapiens
  misc_feature 1..118: note = chr12:120032256-120032374
  misc_feature 1..118: note = hyper
  source 1..118: mol_type = genomic DNA
agcatgcaggctctacgttcctttccctgccgctccgggggctcctgctctccagcgcccaggactgtctctatctcagcctgtgctcccttctctctttgctgcgcccaagggcacc

SEQ ID NO: 73949 - DNA, 56 bp, Homo sapiens; identical to SEQ ID NO: 34721
  misc_feature 1..56: note = chr12:120032375-120032431
  misc_feature 1..56: note = hyper
  source 1..56: mol_type = genomic DNA

SEQ ID NO: 73950 - DNA, 866 bp, Homo sapiens
  misc_feature 1..866: note = chr12:120032454-120033320
  misc_feature 1..866: note = hyper
  source 1..866: mol_type = genomic DNA
cgctctgtccaggcaacagtttcctctcgcttcttcctacacccaacttcctctccttgcctccctccggcgccccctttttaacgcgcccgaggctggctcacacccactacctctttaggcctttcttaggctccccgtgtgcccccctcaccagcaaagtgggtgcgcctctcttactctttctacccagcgcgtcgtagttcctccccgtttgctgcgcactggccctaacctctcttctcttggtgtcccccagagctcccaggcgcccctccaccgctctgtcctgcgcccggggctctcccgggaatgaactaggggattccacgcaacgtgcggctccgcccgccctctgcgctcagacctcccgagctgcccgcctctctaggagtggccgctggggcctctagtccgcccttccggagctcagctccctagccctcttcaaccctggtaggaacacccgagcgaaccccaccaggagggcgacgagcgcctgctaggccctcgccttattgactgcagcagctggcccgggggtggcggcggggtgaggttcgtaccggcactgtcccgggacaacccttgcagttgcgctccctcccccaccggctcacctcgcctgcagctgggccacggaactccccggccacagacgcagagccctgattcagcgctgtgaaaatcgctagccacccgtcccccatcaagtccgcccacacttgcccacgggtggtggcaccatattcgattcgtgggcacctgcaaggctccatttgcacccgtaacttgccctttcccaaacccggtttgtggacagcgtctgcaccgatatgaaagcgtgcagccgctgaagttcagac

SEQ ID NO: 73951 - DNA, 25 bp, Homo sapiens
  misc_feature 1..25: note = chr12:120087669-120087694
  misc_feature 1..25: note = hypo
  source 1..25: mol_type = genomic DNA
aaaaaaaaaaagggccgggcgcgtt

SEQ ID NO: 73952 - DNA, 184 bp, Homo sapiens
  misc_feature 1..184: note = chr12:120148212-120148396
  misc_feature 1..184: note = hypo
  source 1..184: mol_type = genomic DNA
ggcagaacataagcacggtcacgtcaccagaacaatctctagtaagagcaacaaggcctccacagccctttctttcttgatggggtgtggctgtaaccagacaccagctggccgtgcccatgcaagcattacctggtcactgaagggcagcgtgcagttcatgtctagacggtcatcaccttcc

SEQ ID NO: 73953 - DNA, 380 bp, Homo sapiens
  misc_feature 1..380: note = chr12:120148731-120149111
  misc_feature 1..380: note = hypo
  source 1..380: mol_type = genomic DNA
aggagatttcacctgcgcagggttaataagacacatgaaagactccttcccccataaggctgcagcagaagtgcaaaggcgccgtgttagcagcgagccagcacgcctctgcatctctttacctgaacccaggcaggcagaagctcgtaagaaacacagtcgcgggcctattgtacacatattaacaaggatttcagtaaaagctcacgtgtgaaacgaccaacaagtcatccaaacaggtctaaccactgagtaaagcccttttcaggaggcttgtggttaagaatctgccaattgctaacacataaagtgtttattaggagtgaagagtctgaaaagagctgtttggtcttcgctggagcaaacgtcaatgagcaatg

SEQ ID NO: 73954 - DNA, 54 bp, Homo sapiens
  misc_feature 1..54: note = chr12:120152051-120152105
  misc_feature 1..54: note = hypo
  source 1..54: mol_type = genomic DNA
gcacactttgtggctcgcatgttcagtcctacgttgaatcggtgaggaatattg

SEQ ID NO: 73955 - DNA, 81 bp, Homo sapiens
  misc_feature 1..81: note = chr12:120173056-120173137
  misc_feature 1..81: note = hypo
  source 1..81: mol_type = genomic DNA
cgccagaagcctcatcgagttgtttggacaagtagaagttttggttgttgagttcagcgttgtcctcggtcagctggttta

SEQ ID NO: 73956 - DNA, 30 bp, Homo sapiens
  misc_feature 1..30: note = chr12:120353676-120353706
  misc_feature 1..30: note = hypo
  source 1..30: mol_type = genomic DNA
agctccaggcaaccacgactctactttctg

SEQ ID NO: 73957 - DNA, 22 bp, Homo sapiens
  misc_feature 1..22: note = chr12:120411854-120411876
  misc_feature 1..22: note = hypo
  source 1..22: mol_type = genomic DNA
aggcgcggtggctcacgcctgt

SEQ ID NO: 73958 - DNA, 67 bp, Homo sapiens
  misc_feature 1..67: note = chr12:120574326-120574393
  misc_feature 1..67: note = hypo
  source 1..67: mol_type = genomic DNA
tgtctcgagcagagccgccttcacattccagctgaacctgtcccccaggatgcggatcagagggcca

SEQ ID NO: 73959 - DNA, 63 bp, Homo sapiens; identical to SEQ ID NO: 43596
  misc_feature 1..63: note = chr12:120580446-120580509
  misc_feature 1..63: note = hypo
  source 1..63: mol_type = genomic DNA

SEQ ID NO: 73960 - DNA, 30 bp, Homo sapiens
  misc_feature 1..30: note = chr12:120620325-120620355
  misc_feature 1..30: note = hypo
  source 1..30: mol_type = genomic DNA
cgaaacctggctttgcgacaactctttgag

SEQ ID NO: 73961 - DNA, 30 bp, Homo sapiens
  misc_feature 1..30: note = chr12:120661930-120661960
  misc_feature 1..30: note = hypo
  source 1..30: mol_type = genomic DNA
cccagccactgtccccgcctcacctgctgg

SEQ ID NO: 73962 - DNA, 30 bp, Homo sapiens
  misc_feature 1..30: note = chr12:120724619-120724649
  misc_feature 1..30: note = hypo
  source 1..30: mol_type = genomic DNA
acaaaagatactcaccgaacctctctggta

SEQ ID NO: 73963 - DNA, 42 bp, Homo sapiens
  misc_feature 1..42: note = chr12:120728061-120728103
  misc_feature 1..42: note = hypo
  source 1..42: mol_type = genomic DNA
gcactcttcttttcacgttatttctaagttttggataacttt

SEQ ID NO: 73964 - DNA, 30 bp, Homo sapiens; identical to SEQ ID NO: 43597
  misc_feature 1..30: note = chr12:120740933-120740963
  misc_feature 1..30: note = hypo
  source 1..30: mol_type = genomic DNA

SEQ ID NO: 73965 - DNA, 30 bp, Homo sapiens
  misc_feature 1..30: note = chr12:120750504-120750534
  misc_feature 1..30: note = hypo
  source 1..30: mol_type = genomic DNA
gcgtgtaaaagaagccgactccctcttggt

SEQ ID NO: 73966 - DNA, 26 bp, Homo sapiens
  misc_feature 1..26: note = chr12:120758797-120758823
  misc_feature 1..26: note = hypo
  source 1..26: mol_type = genomic DNA
tttagaaaagaaagtcgtggccgtgt

SEQ ID NO: 73967 - DNA, 444 bp, Homo sapiens
  misc_feature 1..444: note = chr12:120806287-120806731
  misc_feature 1..444: note = hyper
  source 1..444: mol_type = genomic DNA
gggctggaagggggacggctccggccgggttcccgccgctccgggagcagcctcacaaaagtttgagccgcaggtgcgagcggagttggcgctgccgccggcgggtcccgggggcccagcccaccccccgataccccctgaacccctcatctgctcccctccacccgctgggccgggtgcgctcgcggatcgccctgcgctctcggggtctccgggcggggcgcgaaagagggcgcgagggcgcccggggtcagcagggcgcagggccgggctggggtgtccgggtccggggcgccggggggtccggggtgccctgccggaccggcgggcgctcccgggctcgctcaccctgcgtagtctgccaactgagtcccccgatgaacatcttgctgcgggaggaggagagacacaaagggcccgcgtgagcgccgggcgccagggcgc

SEQ ID NO: 73968 - DNA, 580 bp, Homo sapiens
  misc_feature 1..580: note = chr12:120807457-120808037
  misc_feature 1..580: note = hyper
  source 1..580: mol_type = genomic DNA
ctccatttccccagtcggagcgagaagccgccctcagagcccccagtttcctcccaacctaatttacagccccccacccccaccccagggctctaatttagagccctcgctccgttcccaggatcccatatccagtttgggggacccactcagtgcctcgcgtcccgagtggggaacctccatcagcaccccagtagaaaccgtatcctcttccccaatccgtcctcagcccttggtgtccaaagtgagagtcccccttagtttccccaaatccctgccgtccacattagtggaccctatggtctgttgagaaaatcccgcgccccaagcccgggttctcagtttgccgccacccccacctcccggtgtgaggagtctcccctggttctctccctccctggccggtttttgtgagatccattcagactcctgtcctgattcgggaaacccggttccagacactcaccacccccaccacaccgaggctggaggaaaaggcagtgcctcttagagcctcctgtttccagtttaggagcccaacgcctcagctgtgcaccgtcccctccgaatgacccccttc

SEQ ID NO: 73969 - DNA, 165 bp, Homo sapiens
  misc_feature 1..165: note = chr12:120826806-120826971
  misc_feature 1..165: note = hyper
  source 1..165: mol_type = genomic DNA
agccagtcggcatcacgtgatctttcgggaagaaaaggtgggcagagccctgggtcggtggccacctgcttttgggtagggcactaatacagggtgctgaagcgggaaggtgaggccgagctgggcggccctgggaacccgggaaggaggcgaggctggagtgga

SEQ ID NO: 73970 - DNA, 26 bp, Homo sapiens
  misc_feature 1..26: note = chr12:120868614-120868640
  misc_feature 1..26: note = hypo
  source 1..26: mol_type = genomic DNA
tttttttttttgagacggagtttcgc

SEQ ID NO: 73971 - DNA, 20 bp, Homo sapiens
  misc_feature 1..20: note = chr12:120877324-120877344
  misc_feature 1..20: note = hypo
  source 1..20: mol_type = genomic DNA
aactccgtctcaaaaaaaaa

SEQ ID NO: 73972 - DNA, 27 bp, Homo sapiens
  misc_feature 1..27: note = chr12:120885154-120885181
  misc_feature 1..27: note = hypo
  source 1..27: mol_type = genomic DNA
ggtgtgagccaccgcgcctggcctaat

SEQ ID NO: 73973 - DNA, 42 bp, Homo sapiens; identical to SEQ ID NO: 43598
  misc_feature 1..42: note = chr12:120932999-120933041
  misc_feature 1..42: note = hypo
  source 1..42: mol_type = genomic DNA

SEQ ID NO: 73974 - DNA, 62 bp, Homo sapiens
  misc_feature 1..62: note = chr12:121163445-121163507
  misc_feature 1..62: note = hyper
  source 1..62: mol_type = genomic DNA
tagcattttgattaacgaatgtgggcacgaacagccagctgaccgaccgcgcgcgcagtcga

SEQ ID NO: 73975 - DNA, 30 bp, Homo sapiens
  misc_feature 1..30: note = chr12:121163726-121163756
  misc_feature 1..30: note = hyper
  source 1..30: mol_type = genomic DNA
ccgcagaggtgagtgcgctggggatccgta

SEQ ID NO: 73976 - DNA, 30 bp, Homo sapiens
  misc_feature 1..30: note = chr12:121197853-121197883
  misc_feature 1..30: note = hypo
  source 1..30: mol_type = genomic DNA
aaagctagaagctcacgtggtggctacact

SEQ ID NO: 73977 - DNA, 30 bp, Homo sapiens
  misc_feature 1..30: note = chr12:121204975-121205005
  misc_feature 1..30: note = hypo
  source 1..30: mol_type = genomic DNA
ctgcttttcctacaacgttcttcagataca

SEQ ID NO: 73978 - DNA, 30 bp, Homo sapiens
  misc_feature 1..30: note = chr12:121211742-121211772
  misc_feature 1..30: note = hypo
  source 1..30: mol_type = genomic DNA
acttcatcctaactgcgcaggagccttgaa

SEQ ID NO: 73979 - DNA, 209 bp, Homo sapiens
  misc_feature 1..209: note = chr12:121366974-121367183
  misc_feature 1..209: note = hypo
  source 1..209: mol_type = genomic DNA
caagtgagccctcttcgtctcagagcagtgaaggctatgggaggatgaggaggggctgaatctgggggttcaaacacagcctcagattgtttctggaaccccccttctctccaatctccagactcagccctcaagtcaggcgggctgggtgtcttccttctgcagttttctcctggagcacccccatcccctcccgcccctgcaacttc

SEQ ID NO: 73980 - DNA, 169 bp, Homo sapiens
  misc_feature 1..169: note = chr12:121394362-121394531
  misc_feature 1..169: note = hypo
  source 1..169: mol_type = genomic DNA
gtgtatgtgcactcacgctgtggagtgaagatgcaaatgactgtgatgatccaaaccctggcaggaaggtggcagccccgtagggcatggggatcagaggtaactccactgtgtgtgccttccgctgtgtgtgccctccactgtgtgtgccctccgctgtgtgtgccct

SEQ ID NO: 73981 - DNA, 191 bp, Homo sapiens; identical to SEQ ID NO: 34727
  misc_feature 1..191: note = chr12:121566850-121567041
  misc_feature 1..191: note = hyper
  source 1..191: mol_type = genomic DNA

SEQ ID NO: 73982 - DNA, 93 bp, Homo sapiens
  misc_feature 1..93: note = chr12:121622470-121622563
  misc_feature 1..93: note = hypo
  source 1..93: mol_type = genomic DNA
tgctacgccacctggcgcttcggctcccaggacatggctgactttgccaacctgcccagctgctgccgctggaggatccggaaagagtttccg

SEQ ID NO: 73983 - DNA, 30 bp, Homo sapiens; identical to SEQ ID NO: 43600
  misc_feature 1..30: note = chr12:121641645-121641675
  misc_feature 1..30: note = hypo
  source 1..30: mol_type = genomic DNA

SEQ ID NO: 73984 - DNA, 30 bp, Homo sapiens
  misc_feature 1..30: note = chr12:121653407-121653437
  misc_feature 1..30: note = hypo
  source 1..30: mol_type = genomic DNA
taggattccttatgacgtattcactgtctc

SEQ ID NO: 73985 - DNA, 44 bp, Homo sapiens
  misc_feature 1..44: note = chr12:121667860-121667904
  misc_feature 1..44: note = hypo
  source 1..44: mol_type = genomic DNA
ccaggtaaatttccacgtaccctttgttgcatttttcacagtcc

SEQ ID NO: 73986 - DNA, 30 bp, Homo sapiens; identical to SEQ ID NO: 43601
  misc_feature 1..30: note = chr12:121688301-121688331
  misc_feature 1..30: note = hypo
  source 1..30: mol_type = genomic DNA

SEQ ID NO: 73987 - DNA, 30 bp, Homo sapiens
  misc_feature 1..30: note = chr12:121740282-121740312
  misc_feature 1..30: note = hypo
  source 1..30: mol_type = genomic DNA
ttatcttcacaggtgcgggggacataggac

SEQ ID NO: 73988 - DNA, 82 bp, Homo sapiens; identical to SEQ ID NO: 43602
  misc_feature 1..82: note = chr12:122107201-122107283
  misc_feature 1..82: note = hypo
  source 1..82: mol_type = genomic DNA

SEQ ID NO: 73989 - DNA, 46 bp, Homo sapiens; identical to SEQ ID NO: 15700
  misc_feature 1..46: note = chr12:122141060-122141106
  misc_feature 1..46: note = hypo
  source 1..46: mol_type = genomic DNA

SEQ ID NO: 73990 - DNA, 30 bp, Homo sapiens
  misc_feature 1..30: note = chr12:122186181-122186211
  misc_feature 1..30: note = hypo
  source 1..30: mol_type = genomic DNA
cctccctctgagtgacgccccttcccctgt

SEQ ID NO: 73991 - DNA, 30 bp, Homo sapiens
  misc_feature 1..30: note = chr12:122192959-122192989
  misc_feature 1..30: note = hypo
  source 1..30: mol_type = genomic DNA
accggttagcatcaccgttgttttgggcta

SEQ ID NO: 73992 - DNA, 81 bp, Homo sapiens
  misc_feature 1..81: note = chr12:122204974-122205055
  misc_feature 1..81: note = hypo
  source 1..81: mol_type = genomic DNA
gacatgctgtccctacgtctggccattgatgcacctgctcctcctggagctcataaaataaaaaaaggccgtgagctcctg

SEQ ID NO: 73993 - DNA, 200 bp, Homo sapiens
  misc_feature 1..200: note = chr12:122205355-122205555
  misc_feature 1..200: note = hypo
  source 1..200: mol_type = genomic DNA
gcgcccagctgcccctgcaagctttaacttctgtggtgaaatgagcccagagagtgactgcaaatgggtgtaggtttctttctgcaatgataaaaaggttttaaaacagattctggtgacagttgcacaactctgtgaatatactaaaagccactcagttgtgcactttcagtgagtgaattgtacggtatctgaatcac

SEQ ID NO: 73994 - DNA, 66 bp, Homo sapiens
  misc_feature 1..66: note = chr12:122208388-122208454
  misc_feature 1..66: note = hypo
  source 1..66: mol_type = genomic DNA
agcaggcaggcttggcgggttctaggagagcccacattcctggagggcctgcgtgctggggagaag

SEQ ID NO: 73995 - DNA, 30 bp, Homo sapiens
  misc_feature 1..30: note = chr12:122208777-122208807
  misc_feature 1..30: note = hypo
  source 1..30: mol_type = genomic DNA
ctcctgagcactttccgttctctccctctc

SEQ ID NO: 73996 - DNA, 123 bp, Homo sapiens
  misc_feature 1..123: note = chr12:122212425-122212548
  misc_feature 1..123: note = hypo
  source 1..123: mol_type = genomic DNA
tgagggctgaccccccgcatgtgtgactgtccctggctcatcttagggtgactggtgtggctgggggtgggcgtctggtggagctgtgggggcagcggaccccctcagcgggtcctttttctt

SEQ ID NO: 73997 - DNA, 85 bp, Homo sapiens; identical to SEQ ID NO: 43605
  misc_feature 1..85: note = chr12:122213608-122213693
  misc_feature 1..85: note = hypo
  source 1..85: mol_type = genomic DNA

SEQ ID NO: 73998 - DNA, 30 bp, Homo sapiens
  misc_feature 1..30: note = chr12:122219029-122219059
  misc_feature 1..30: note = hypo
  source 1..30: mol_type = genomic DNA
catagcagatgagcacgaggtgggtgttct

SEQ ID NO: 73999 - DNA, 176 bp, Homo sapiens
  misc_feature 1..176: note = chr12:122231347-122231523
  misc_feature 1..176: note = hyper
  source 1..176: mol_type = genomic DNA
gctcagggtaaggggcgtccctcgcccccaccccagccccgctgcgggcctcacctcggggaaggagccctggctgtacaccatgagcagcgaggtcttgccgcagccgccgtcgcccacgatcacgatcttcagctccttcctgcccggaccgggggcggcggtctgggccaggg

SEQ ID NO: 74000 - DNA, 166 bp, Homo sapiens; identical to SEQ ID NO: 43606
  misc_feature 1..166: note = chr12:122281163-122281329
  misc_feature 1..166: note = hypo
  source 1..166: mol_type = genomic DNA

SEQ ID NO: 74001 - DNA, 139 bp, Homo sapiens
  misc_feature 1..139: note = chr12:122284969-122285108
  misc_feature 1..139: note = hypo
  source 1..139: mol_type = genomic DNA
cttcttcttgccaggcgctggctcattgatgggcatcttgatggactcttcatagttggccaccacaatggatcgcagagagctatattccgtgtgcacctgcgtgtcatccacggaccagaagcggtggaactgcagg

SEQ ID NO: 74002 - DNA, 30 bp, Homo sapiens; identical to SEQ ID NO: 15703
  misc_feature 1..30: note = chr12:122292767-122292797
  misc_feature 1..30: note = hypo
  source 1..30: mol_type = genomic DNA

SEQ ID NO: 74003 - DNA, 21 bp, Homo sapiens
  misc_feature 1..21: note = chr12:122301174-122301195
  misc_feature 1..21: note = hypo
  source 1..21: mol_type = genomic DNA
ccactgcgcccagccagctct

SEQ ID NO: 74004 - DNA, 140 bp, Homo sapiens
  misc_feature 1..140: note = chr12:122343727-122343867
  misc_feature 1..140: note = hypo
  source 1..140: mol_type = genomic DNA
gtggcctgccattcccgtgagttttcacaaatgtatgtagtatgtcattgccaccacgatgaaggtcaagagcattccaacaccccataaaattgcctcaggcttctttgtagttaatccctcaccgtcaacttccagaa

SEQ ID NO: 74005 - DNA, 112 bp, Homo sapiens; identical to SEQ ID NO: 43609
  misc_feature 1..112: note = chr12:122439399-122439511
  misc_feature 1..112: note = hypo
  source 1..112: mol_type = genomic DNA

SEQ ID NO: 74006 - DNA, 53 bp, Homo sapiens; identical to SEQ ID NO: 43610
  misc_feature 1..53: note = chr12:122458643-122458696
  misc_feature 1..53: note = hypo
  source 1..53: mol_type = genomic DNA

SEQ ID NO: 74007 - DNA, 30 bp, Homo sapiens
  misc_feature 1..30: note = chr12:122487551-122487581
  misc_feature 1..30: note = hypo
  source 1..30: mol_type = genomic DNA
aactataatacttcccgttcaagtctgtga

SEQ ID NO: 74008 - DNA, 68 bp, Homo sapiens
  misc_feature 1..68: note = chr12:122591572-122591640
  misc_feature 1..68: note = hypo
  source 1..68: mol_type = genomic DNA
ctggcaggggttcaacgtcaccagccctcctccttgtgttctcctctgtctgtcgccctctcccaggt

SEQ ID NO: 74009 - DNA, 23 bp, Homo sapiens
  misc_feature 1..23: note = chr12:122596891-122596914
  misc_feature 1..23: note = hypo
  source 1..23: mol_type = genomic DNA
aatgtatgtacaggccgggcgtg

SEQ ID NO: 74010 - DNA, 86 bp, Homo sapiens
  misc_feature 1..86: note = chr12:122602862-122602948
  misc_feature 1..86: note = hypo
  source 1..86: mol_type = genomic DNA
gggtaaagcacaataccgcagaaaagggaggaatgccgtacattccagtgttatatttcaacaatacaaaacggtgttcagtgaac

SEQ ID NO: 74011 - DNA, 352 bp, Homo sapiens
  misc_feature 1..352: note = chr12:122622033-122622385
  misc_feature 1..352: note = hypo
  source 1..352: mol_type = genomic DNA
cagggcaggcctctccgtgtgcatcggagcagagccccagtcctcaatctccccagaacaactgctcagggaaatccgaccccaaaaatgtggctgcactaaaggtaccgcatgtctcctcttggttcccttgggaggaggggagaggagtgcaggacatcaaggatctgtgtcttgtctggaacggagacctcagacccagccagagctgcccaggcaggggtggatcagaaatgggcttctccttgccccatgccacgaaccagccctgtggggatggtgggccccctggaggcttttgggtgagccccaagcctgggagccaacgctgagtccacgtagtgtgcaggta

SEQ ID NO: 74012 - DNA, 48 bp, Homo sapiens
  misc_feature 1..48: note = chr12:122622594-122622642
  misc_feature 1..48: note = hypo
  source 1..48: mol_type = genomic DNA
gagccttcagcttctcgtcgtgccctcctcccacgtagctctctagcc

SEQ ID NO: 74013 - DNA, 114 bp, Homo sapiens
  misc_feature 1..114: note = chr12:122623990-122624104
  misc_feature 1..114: note = hypo
  source 1..114: mol_type = genomic DNA
gcagcacggctctcacggggagtggttcccgcctggtcactccccaccctgccaccgctctgcctctgagtaaacggtcggcacatgtgttgggttgaccgtggcattggggca

SEQ ID NO: 74014 - DNA, 30 bp, Homo sapiens
  misc_feature 1..30: note = chr12:122643546-122643576
  misc_feature 1..30: note = hypo
  source 1..30: mol_type = genomic DNA
ggccaaatatagagacgacccaagtgtact

SEQ ID NO: 74015 - DNA, 33 bp, Homo sapiens
  misc_feature 1..33: note = chr12:122658513-122658546
  misc_feature 1..33: note = hypo
  source 1..33: mol_type = genomic DNA
cagaaagagcacagacgtcgaggggcctggaga

SEQ ID NO: 74016 - DNA, 163 bp, Homo sapiens
  misc_feature 1..163: note = chr12:122667736-122667899
  misc_feature 1..163: note = hyper
  source 1..163: mol_type = genomic DNA
gggcctgggactcagcggcccgggaccgggaccgtgagcgcggccgtgcgcgagcacttgcggaagctgtgtctgcgcgagttcccgtgcggtgccggcagctgggtgcgggcgccggggccggaactctgggggcctggaccggctgcggggaggcacgggc

SEQ ID NO: 74017 - DNA, 573 bp, Homo sapiens
  misc_feature 1..573: note = chr12:122688648-122689221
  misc_feature 1..573: note = hyper
  source 1..573: mol_type = genomic DNA
cggcccgggggtccccgcagagtgggtctctgctgccgtcagcccttcggagactgtcgcgttgaaagaatgaaccagagttcgccccctgcccgcgccagggcgttttgggtcaccgagtcctgtggggatccgaggcggctgccgcccaaggccgagcgcagcctcaggacccgcgccccaccagacggggtcgtgcgctccgcggcgggtggagagccgggctctggggtctccgcggctcggagggcggcggggcgaggccgtgcggccagcgcctggggacgcccgcggcgggacaggggccacccgggccgcggcgcagcctgggctgaaacctcctgggacggaaccaagccacctgctgtgcgcccttctcggtgaatggcaccgccgcccgcccgggcctctcgtccacagcccgcggtgctcgcacacctgagactcatctcgcttcgaccccgccgccgccgccgcccggcatcctgagcacggagacagtctccagctgccgttcatgcttcctccccagccttccgcagcccaccagggaaggggcggtaggagtggcct

SEQ ID NO: 74018 - DNA, 42 bp, Homo sapiens
  misc_feature 1..42: note = chr12:122691182-122691224
  misc_feature 1..42: note = hypo
  source 1..42: mol_type = genomic DNA
ggtcacgtggagcgacgtgcggctatccgcagcacgtggggc

SEQ ID NO: 74019 - DNA, 30 bp, Homo sapiens
  misc_feature 1..30: note = chr12:122958549-122958579
  misc_feature 1..30: note = hypo
  source 1..30: mol_type = genomic DNA
cgctgtttacgctctcggcctgctcaagag

SEQ ID NO: 74020 - DNA, 180 bp, Homo sapiens
  misc_feature 1..180: note = chr12:123128959-123129139
  misc_feature 1..180: note = hypo
  source 1..180: mol_type = genomic DNA
gtcgggcggcttcttcgcagcccgggctctcctccgactgcccaggccaaactccgcctcattcccccagtcaatggcctgatggcctgtaggcatgccagtgtctgactatgtgctcttccgccagcgtgctaccctcgatgtcctctcgatgtccagccacctgtgtctgcctgctag

SEQ ID NO: 74021 - DNA, 29 bp, Homo sapiens
  misc_feature 1..29: note = chr12:123233817-123233846
  misc_feature 1..29: note = hypo
  source 1..29: mol_type = genomic DNA
tcagccaccgcgcccgccctattactatt

SEQ ID NO: 74022 - DNA, 171 bp, Homo sapiens
  misc_feature 1..171: note = chr12:123333222-123333393
  misc_feature 1..171: note = hypo
  source 1..171: mol_type = genomic DNA
ccctgttcctgtccccgtagctccgggctgttcctcccgcctcgggtggggagtgcgtgtctcagggccctgccacacggtcctggacactcccccactcccgtattccctgcgctgcaggtgctgcatgactgccagcggtaccgcagcaacatccgggagattggagac

SEQ ID NO: 74023 - DNA, 16 bp, Homo sapiens
  misc_feature 1..16: note = chr12:123373979-123373995
  misc_feature 1..16: note = hypo
  source 1..16: mol_type = genomic DNA
cagtttcaggccgggc

SEQ ID NO: 74024 - DNA, 30 bp, Homo sapiens
  misc_feature 1..30: note = chr12:123428902-123428932
  misc_feature 1..30: note = hypo
  source 1..30: mol_type = genomic DNA
ttctctctggatccccggacacactggcct

SEQ ID NO: 74025 - DNA, 216 bp, Homo sapiens
  misc_feature 1..216: note = chr12:123436083-123436299
  misc_feature 1..216: note = hypo
  source 1..216: mol_type = genomic DNA
ttgaatgagatgactcgtccaggccacatggcaatcagtggctgattgacgccaaagttgatttcattcttctcaatgggttcagagtccaaattctggaacctcagaagacgttgctattctggttccaagcaatgctggaaattgccaccccacccctcctggtggggcacttgacaccttgctgggtgctttcttacccgcttgccttactgt

SEQ ID NO: 74026 - DNA, 30 bp, Homo sapiens
  misc_feature 1..30: note = chr12:123636606-123636636
  misc_feature 1..30: note = hypo
  source 1..30: mol_type = genomic DNA
ccctgaccatgaccacgcagaggaggacca

SEQ ID NO: 74027 - DNA, 123 bp, Homo sapiens
  misc_feature 1..123: note = chr12:123753196-123753319
  misc_feature 1..123: note = hyper
  source 1..123: mol_type = genomic DNA
gagcctcagtttccacgcctcccacgtggggatgatgagacacatgcggatgatgagacacgtgcgctataggggcgggttgcttgggagggggacgcacaacgcccacgatatctggcacgt

SEQ ID NO: 74028 - DNA, 38 bp, Homo sapiens; identical to SEQ ID NO: 43619
  misc_feature 1..38: note = chr12:123881693-123881731
  misc_feature 1..38: note = hypo
  source 1..38: mol_type = genomic DNA

SEQ ID NO: 74029 - DNA, 214 bp, Homo sapiens
  misc_feature 1..214: note = chr12:123920513-123920727
  misc_feature 1..214: note = hyper
  source 1..214: mol_type = genomic DNA
aaaagaaaaaagagaaaagagaagagaaaagaaaaggaaggcgtctccctgccagtaggtgccctcctacgccccgcaggcgccgtgggcccggaaccctcgctcccacactcacctccccgctggccggagggctctgtctccgcagcccctccacctccttcctgaggtggtccctctccatcttcagctcctccagcgccaggctgccctc

SEQ ID NO: 74030 - DNA, 34 bp, Homo sapiens
  misc_feature 1..34: note = chr12:123921841-123921875
  misc_feature 1..34: note = hypo
  source 1..34: mol_type = genomic DNA
ggaagcactcacatacgtgactgcaatccttcat

SEQ ID NO: 74031 - DNA, 30 bp, Homo sapiens
  misc_feature 1..30: note = chr12:12397276-12397306
  misc_feature 1..30: note = hypo
  source 1..30: mol_type = genomic DNA
ttagaaacttcaatccgattagtttcagaa

SEQ ID NO: 74032 - DNA, 84 bp, Homo sapiens
  misc_feature 1..84: note = chr12:123998069-123998153
  misc_feature 1..84: note = hypo
  source 1..84: mol_type = genomic DNA
ctcctatcccagcttcggcctcttagttgctttcccttcaggcctcggtgctctcgagaggcctgtgcacgcttcatcgatgtg

SEQ ID NO: 74033 - DNA, 30 bp, Homo sapiens
  misc_feature 1..30: note = chr12:124092980-124093010
  misc_feature 1..30: note = hypo
  source 1..30: mol_type = genomic DNA
agcccaggtttggtccgggagctggagttt

SEQ ID NO: 74034 - DNA, 38 bp, Homo sapiens
  misc_feature 1..38: note = chr12:124117199-124117237
  misc_feature 1..38: note = hypo
  source 1..38: mol_type = genomic DNA
aaagctactggtggccgggcgcggtggctcacgcctgt

SEQ ID NO: 74035 - DNA, 30 bp, Homo sapiens
  misc_feature 1..30: note = chr12:124152701-124152731
  misc_feature 1..30: note = hypo
  source 1..30: mol_type = genomic DNA
ttcaagtgccccgtccgacccttcactggg

SEQ ID NO: 74036 - DNA, 30 bp, Homo sapiens
  misc_feature 1..30: note = chr12:12419446-12419476
  misc_feature 1..30: note = hyper
  source 1..30: mol_type = genomic DNA
cgcagcccctgctcccgggcccctttctct

SEQ ID NO: 74037 - DNA, 78 bp, Homo sapiens
  misc_feature 1..78: note = chr12:124195871-124195949
  misc_feature 1..78: note = hypo
  source 1..78: mol_type = genomic DNA
ctgtggtggccaggccgggcgggaaggggagactgcaactgagcaggaggagtcttgcgaggtcggtgggaaatgttt

SEQ ID NO: 74038 - DNA, 30 bp, Homo sapiens; identical to SEQ ID NO: 43621
  misc_feature 1..30: note = chr12:124284067-124284097
  misc_feature 1..30: note = hypo
  source 1..30: mol_type = genomic DNA

SEQ ID NO: 74039 - DNA, 30 bp, Homo sapiens
  misc_feature 1..30: note = chr12:124285872-124285902
  misc_feature 1..30: note = hypo
  source 1..30: mol_type = genomic DNA
cataggaacgttaaacgatgcggagtctgt

SEQ ID NO: 74040 - DNA, 30 bp, Homo sapiens
  misc_feature 1..30: note = chr12:124323044-124323074
  misc_feature 1..30: note = hypo
  source 1..30: mol_type = genomic DNA
tgtgaagccccaaaccgcctcagtgaccta

SEQ ID NO: 74041 - DNA, 44 bp, Homo sapiens
  misc_feature 1..44: note = chr12:124393560-124393604
  misc_feature 1..44: note = hypo
  source 1..44: mol_type = genomic DNA
ttttaatgctgcccccgcaccattccaggcgcctggtctggaac

SEQ ID NO: 74042 - DNA, 30 bp, Homo sapiens; identical to SEQ ID NO: 43623
  misc_feature 1..30: note = chr12:124397588-124397618
  misc_feature 1..30: note = hypo
  source 1..30: mol_type = genomic DNA

SEQ ID NO: 74043 - DNA, 92 bp, Homo sapiens; identical to SEQ ID NO: 43624
  misc_feature 1..92: note = chr12:124404180-124404272
  misc_feature 1..92: note = hypo
  source 1..92: mol_type = genomic DNA

SEQ ID NO: 74044 - DNA, 30 bp, Homo sapiens
  misc_feature 1..30: note = chr12:124566628-124566658
  misc_feature 1..30: note = hypo
  source 1..30: mol_type = genomic DNA
tatacttggctctgtcgatggaagctttct

SEQ ID NO: 74045 - DNA, 78 bp, Homo sapiens
  misc_feature 1..78: note = chr12:124651773-124651851
  misc_feature 1..78: note = hypo
  source 1..78: mol_type = genomic DNA
gccgcctcccccactcgggtctgtttttcagccgtggctccggcagtgggtctgattttatcccgcaaagtgatgtcc

SEQ ID NO: 74046 - DNA, 207 bp, Homo sapiens; identical to SEQ ID NO: 43626
  misc_feature 1..207: note = chr12:124716795-124717002
  misc_feature 1..207: note = hypo
  source 1..207: mol_type = genomic DNA

SEQ ID NO: 74047 - DNA, 30 bp, Homo sapiens
  misc_feature 1..30: note = chr12:124723968-124723998
  misc_feature 1..30: note = hypo
  source 1..30: mol_type = genomic DNA
tcctaccaaatgttgcgttggaaaatcaaa

SEQ ID NO: 74048 - DNA, 169 bp, Homo sapiens
  misc_feature 1..169: note = chr12:124726523-124726692
  misc_feature 1..169: note = hypo
  source 1..169: mol_type = genomic DNA
tgagagcagcagggacggacggcagggagccgcgactcgatccgccgtaaggggtactgtgagcatacattattttcctctgcctggtcaaaacaaagacaaatgcaaattacaagaacattgcagacaacaaaagaaaaatcccggaatccctcgtctctagaagttt

SEQ ID NO: 74049 - DNA, 283 bp, Homo sapiens
  misc_feature 1..283: note = chr12:124778114-124778397
  misc_feature 1..283: note = hypo
  source 1..283: mol_type = genomic DNA
gaagcaaatggaatccgtagtcccattgtttttttcccagaatgttccaaatattcaaacctctggttagttgggtctgtttgggcagcagacttccagcgttctttcctgggcgacatggaaatgggctgtaaattcacctggtgacaggtgcatgcctgtcaccctgtgggctctcaggaagcggccccaccctctgtcagtgtccggcatgcaccttactcctgctgctgcagggcctgcgccctgctgttccctccacatggtgcgctaattctcactg

SEQ ID NO: 74050 - DNA, 88 bp, Homo sapiens
  misc_feature 1..88: note = chr12:124779505-124779593
  misc_feature 1..88: note = hyper
  source 1..88: mol_type = genomic DNA
cgcagtgcccaggagcgggagggcctcggcggaggcgccgggccggggctgttgcccaccgcgcaggccggggcggggagaggaaggg

SEQ ID NO: 74051 - DNA, 36 bp, Homo sapiens
  misc_feature 1..36: note = chr12:124780202-124780238
  misc_feature 1..36: note = hyper
  source 1..36: mol_type = genomic DNA
ccaaacgggggaccgcgtgggcgggtgggtgagggc

SEQ ID NO: 74052 - DNA, 143 bp, Homo sapiens
  misc_feature 1..143: note = chr12:124780828-124780971
  misc_feature 1..143: note = hyper
  source 1..143: mol_type = genomic DNA
gggaggctggaacctcgggtcaggaaactcaggagtttgtctcctgccagactaagtccagcctgggggtggactccggtggggacccagcttggcgccttgcctgagactgggcaccccccggcaggcggggaagcatatgg

SEQ ID NO: 74053 - DNA, 30 bp, Homo sapiens; identical to SEQ ID NO: 43628
  misc_feature 1..30: note = chr12:124782655-124782685
  misc_feature 1..30: note = hypo
  source 1..30: mol_type = genomic DNA

SEQ ID NO: 74054 - DNA, 223 bp, Homo sapiens; identical to SEQ ID NO: 43629
  misc_feature 1..223: note = chr12:124788775-124788998
  misc_feature 1..223: note = hypo
  source 1..223: mol_type = genomic DNA

SEQ ID NO: 74055 - DNA, 52 bp, Homo sapiens
  misc_feature 1..52: note = chr12:124799068-124799120
  misc_feature 1..52: note = hypo
  source 1..52: mol_type = genomic DNA
tgacggggctggggccggcccggggtgctggaggagccgggagccctgggga

SEQ ID NO: 74056 - DNA, 30 bp, Homo sapiens
  misc_feature 1..30: note = chr12:124832960-124832990
  misc_feature 1..30: note = hypo
  source 1..30: mol_type = genomic DNA
cttccatgctggccccgtcacaaagcctca

SEQ ID NO: 74057 - DNA, 33 bp, Homo sapiens; identical to SEQ ID NO: 43630
  misc_feature 1..33: note = chr12:124843830-124843863
  misc_feature 1..33: note = hypo
  source 1..33: mol_type = genomic DNA

SEQ ID NO: 74058 - DNA, 276 bp, Homo sapiens
  misc_feature 1..276: note = chr12:124869876-124870152
  misc_feature 1..276: note = hypo
  source 1..276: mol_type = genomic DNA
ggcaggggagccactcgctcaggacccatttgcctccgggtcctcattccaacgcgctgacagcccgaattcctggctgagtcagtctggtccaccgcgctccttcccccacaccgtgagacagggctgagggcccccagaggtgtctgtctgagaggagtggggtgcagggtgggggtggagggcagcctggcccggcccgtctccaaggcagggacactcatagcagcattgccgcctgcagccatctcggggtactcccgggcttgaaccccc

SEQ ID NO: 74059 - DNA, 239 bp, Homo sapiens
  misc_feature 1..239: note = chr12:124880121-124880360
  misc_feature 1..239: note = hypo
  source 1..239: mol_type = genomic DNA
acacgggctcctctccgccggtgagtcatccccagccgtcctcccagcctccggatctgcccttccagaaggcaaacagagggcaggcactgtcttcccagttctcaggcaatgggcggtgggggcgggggtggtcaccggtgaggaggtggtagtgacaacacgagacacgagaagggatggagaggcggtgggaccctgggctgaccgtttggggatgtccacgcggagtcctccga

SEQ ID NO: 74060 - DNA, 108 bp, Homo sapiens
  misc_feature 1..108: note = chr12:124890812-124890920
  misc_feature 1..108: note = hypo
  source 1..108: mol_type = genomic DNA
tggcctgtgggctttcgttagagcactctgctccaggccagtgttacccacacctgcaggtgcacacacatcccctgccaattcccactcagtcggtctggggtgggg

SEQ ID NO: 74061 - DNA, 168 bp, Homo sapiens
  misc_feature 1..168: note = chr12:124893402-124893570
  misc_feature 1..168: note = hypo
  source 1..168: mol_type = genomic DNA
cgtggaggtgacttccgccaactccatgcacagggtgagaacaggataagacagcctggtgctaggggcatctttccccagttccaagtcagcggcagcacgttgtcacgtggcactgggcacggtgagaggatttatttacaccatggcaaccggcacatgctacaa

SEQ ID NO: 74062 - DNA, 30 bp, Homo sapiens
  misc_feature 1..30: note = chr12:124985749-124985779
  misc_feature 1..30: note = hypo
  source 1..30: mol_type = genomic DNA
cccagcctggccctgcgaagacaggcaggc

SEQ ID NO: 74063 - DNA, 165 bp, Homo sapiens
  misc_feature 1..165: note = chr12:124989245-124989410
  misc_feature 1..165: note = hypo
  source 1..165: mol_type = genomic DNA
ccacgcaaaggtaagcgctgactcagccacaacgcaggtgagccctgaagacatggcacaaaaggcaaagaagccgctcagaaaggccacgcactgcatgattccattaacttcacaggaggggcagattcccaggacagaacaaaggcccgaggctgccagggg

SEQ ID NO: 74064 - DNA, 30 bp, Homo sapiens
  misc_feature 1..30: note = chr12:125001347-125001377
  misc_feature 1..30: note = hypo
  source 1..30: mol_type = genomic DNA
cctcagaccaggtgccggtattgtcagcat

SEQ ID NO: 74065 - DNA, 54 bp, Homo sapiens; identical to SEQ ID NO: 15714
  misc_feature 1..54: note = chr12:125009346-125009400
  misc_feature 1..54: note = hypo
  source 1..54: mol_type = genomic DNA

SEQ ID NO: 74066 - DNA, 40 bp, Homo sapiens
  misc_feature 1..40: note = chr12:125027278-125027318
  misc_feature 1..40: note = hypo
  source 1..40: mol_type = genomic DNA
cctcccagggccggccggggtccaccggatacatcttccc

SEQ ID NO: 74067 - DNA, 45 bp, Homo sapiens
  misc_feature 1..45: note = chr12:12504479-12504524
  misc_feature 1..45: note = hypo
  source 1..45: mol_type = genomic DNA
tagaaacttcgtattcggtgctttaatacaatgaacctgtttctt

SEQ ID NO: 74068 - DNA, 51 bp, Homo sapiens
  misc_feature 1..51: note = chr12:125062836-125062887
  misc_feature 1..51: note = hypo
  source 1..51: mol_type = genomic DNA
ggaagaaaaattccacgcatgtccccgcgagcccttcgaagctcttcgtgg

SEQ ID NO: 74069 - DNA, 30 bp, Homo sapiens
  misc_feature 1..30: note = chr12:125091024-125091054
  misc_feature 1..30: note = hypo
  source 1..30: mol_type = genomic DNA
taaatccagtatgaccggtgcccttataaa

SEQ ID NO: 74070 - DNA, 84 bp, Homo sapiens
  misc_feature 1..84: note = chr12:125092412-125092496
  misc_feature 1..84: note = hypo
  source 1..84: mol_type = genomic DNA
tactgcagcaaaagccgaaagccaagctccgtgtccatcgcgaaggcactgggcatgtggctatgcagccgtgacaaaggatga

SEQ ID NO: 74071 - DNA, 493 bp, Homo sapiens
  misc_feature 1..493: note = chr12:125102096-125102589
  misc_feature 1..493: note = hypo
  source 1..493: mol_type = genomic DNA
cctctcccaacccagcgctgtcttggggaacagggtgaagctcaggaggagccccccaaccccggcgtgcccccattttgcctcctcagaaggccctgcagctggcctttcctgggaggcgcagagcccacagagcccaactctggtggcagaattagcctgtcctcgggctgcgctggctccagtcccagtgaggtggtgactgtcactctccataggagaggacgcctctcgccatggcaacggggacgtcaccagggacgtgtttgccggagcacaaaagagggtgtcggggaaacacccgcactctggcggcagaaacacagtgcacggcctcactccccatctggggatggctgctgggaggtgaccgagcctccctaggcagccggggccctcctcagccctcgtgcttgccttccaaagagctgtggctgttttctccgctcccctgcggtggagaaggaagagggcacatcgctggaggcatctt

SEQ ID NO: 74072 - DNA, 65 bp, Homo sapiens; identical to SEQ ID NO: 43638
  misc_feature 1..65: note = chr12:125102819-125102884
  misc_feature 1..65: note = hypo
  source 1..65: mol_type = genomic DNA

SEQ ID NO: 74073 - DNA, 58 bp, Homo sapiens; identical to SEQ ID NO: 43639
  misc_feature 1..58: note = chr12:125119323-125119381
  misc_feature 1..58: note = hypo
  source 1..58: mol_type = genomic DNA

SEQ ID NO: 74074 - DNA, 232 bp, Homo sapiens
  misc_feature 1..232: note = chr12:125122425-125122657
  misc_feature 1..232: note = hypo
  source 1..232: mol_type = genomic DNA
gccaccccagggggacgctggcacccgaggtaggctgtggcaggctcactcctgtgcagcaagagctggcctccgggaaaccggggggagtctccggagcatgtacaggagacctgccccgcccagcacacacgctccttcactcccaggtcagcatcctggggcctccgtgtccttgtctggaccatgggtgtaaagaagccacatttcatcacaacgaagccagcaccga

SEQ ID NO: 74075 - DNA, 146 bp, Homo sapiens; identical to SEQ ID NO: 43640
  misc_feature 1..146: note = chr12:125152108-125152254
  misc_feature 1..146: note = hypo
  source 1..146: mol_type = genomic DNA

SEQ ID NO: 74076 - DNA, 85 bp, Homo sapiens
  misc_feature 1..85: note = chr12:125167660-125167745
  misc_feature 1..85: note = hypo
  source 1..85: mol_type = genomic DNA
caattttaacaactgcgtagaactcacaactgcctccaatcctcatgttcatttatttatctacctgccacgtcctgagtgtcta

SEQ ID NO: 74077 - DNA, 30 bp, Homo sapiens
  misc_feature 1..30: note = chr12:125184551-125184581
  misc_feature 1..30: note = hypo
  source 1..30: mol_type = genomic DNA
gtccttttcacttagcgttccacttgtgtc

SEQ ID NO: 74078 - DNA, 30 bp, Homo sapiens; identical to SEQ ID NO: 43642
  misc_feature 1..30: note = chr12:125200849-125200879
  misc_feature 1..30: note = hypo
  source 1..30: mol_type = genomic DNA

SEQ ID NO: 74079 - DNA, 30 bp, Homo sapiens
  misc_feature 1..30: note = chr12:125336074-125336104
  misc_feature 1..30: note = hypo
  source 1..30: mol_type = genomic DNA
aagcagaatggacctcggtctcctgactca

SEQ ID NO: 74080 - DNA, 485 bp, Homo sapiens
  misc_feature 1..485: note = chr12:125533937-125534422
  misc_feature 1..485: note = hyper
  source 1..485: mol_type = genomic DNA
ctaggggctcatctgcgtatttgaatacgcatacggaagaataaacatcccccaggtacttcaggcacaaccctcctttggcagcgcagaagtcaagctagaggtcgtgaccccctggagtctcggtggtttcgggttggggagcagagcgggtggggcaggaccgactcgccggtgccagtcaggatatcaaggtgacagcgcccggcactggccttggtcgaagggtgactccgccccattgctaagctccgattgggcacgcccttttctggttcttcttcaggattggctgggaggtgcggcctatgaaccggaacgcgtcgcgattggttggcgctcaggccgatcttccagacgcggaggcctgggccgatgtggcccaactctctgccagccaatcagcgctcgggctgagtgtggcgcgtgagtgtgtccgggatccctccgccgcccgggcgttggggtcgcgggaagggagggga

SEQ ID NO: 74081 - DNA, 191 bp, Homo sapiens
  misc_feature 1..191: note = chr12:125565948-125566139
  misc_feature 1..191: note = hypo
  source 1..191: mol_type = genomic DNA
aagggcctaagcagccgattattggctcgggggctttaagatcattgtgcttcgttttctgcatgtttttcctgacttgttccttacccagctgggtgcaggtgctcacggagctctgctccatgctcactcaggcgttctcagcaaaactcatctctcctatgggtaatccccgtcgaggccatgcgatg

SEQ ID NO: 74082 - DNA, 159 bp, Homo sapiens
  misc_feature 1..159: note = chr12:125578406-125578565
  misc_feature 1..159: note = hypo
  source 1..159: mol_type = genomic DNA
tggcagggagtctgtcggcatttggtggcttcgtggcaggcattattgggcagcactcctggccgtgtgcacccagcgtgggagggcctgcgtggatgccatgttcatagcgcttggtcccacagacacctggacacccgctgtcggagctgagtaagg

SEQ ID NO: 74083 - DNA, 98 bp, Homo sapiens
  misc_feature 1..98: note = chr12:125609670-125609768
  misc_feature 1..98: note = hypo
  source 1..98: mol_type = genomic DNA
gctgggcagccaatacgcacagtcccttctcatgatctgaggcagtgatgttccacgaagtcactgtgaacacggaacccatacggaacccttgctcc

SEQ ID NO: 74084 - DNA, 159 bp, Homo sapiens; identical to SEQ ID NO: 34733
  misc_feature 1..159: note = chr12:125670102-125670261
  misc_feature 1..159: note = hyper
  source 1..159: mol_type = genomic DNA

SEQ ID NO: 74085 - DNA, 111 bp, Homo sapiens; identical to SEQ ID NO: 34734
  misc_feature 1..111: note = chr12:125670334-125670445
  misc_feature 1..111: note = hyper
  source 1..111: mol_type = genomic DNA

SEQ ID NO: 74086 - DNA, 551 bp, Homo sapiens
  misc_feature 1..551: note = chr12:125671499-125672050
  misc_feature 1..551: note = hyper
  source 1..551: mol_type = genomic DNA
gcagcgcgcatctcccggacttggacagacctggggagaccctgggaacccaggagcccccggcgcgttcccctttgcctagcgcctggggagagcccgcctgccttctcccccaaacccttagcttccttgcggatcctttcgggacgcacgggggccacagaccggggcactcagcctctcgaggcgggtggggacgcgactgcaggaatcgagccccctccccgccctgccttgggccaaatcccccccaggtcccagttcctccaggggttttgctgggcgggggcgtcgacgcagcccttctccagtgtcttgctgcccgcggtcgcacagtggtgcgttcccgggacacctgcgggccccggagatgtctcggccggcgctgtctggcttgtccgcagcccctccccacgccccgcggccctcccctgctttcacactgccctccccaagctacccaccctcgccaaatggcctcctcttggccaaagagcagcccgctgcgcgcctcctgcaaacgcggtctactccagcgccctgaccccaag

SEQ ID NO: 74087 - DNA, 268 bp, Homo sapiens; identical to SEQ ID NO: 34736
  misc_feature 1..268: note = chr12:125672764-125673032
  misc_feature 1..268: note = hyper
  source 1..268: mol_type = genomic DNA

SEQ ID NO: 74088 - DNA, 199 bp, Homo sapiens
  misc_feature 1..199: note = chr12:125812590-125812789
  misc_feature 1..199: note = hypo
  source 1..199: mol_type = genomic DNA
ttggggctgggccatcgcattcatttccctgtcttggcctttcctgcttttagtccattctccgtaatagcagagtgatgtcttaaccgtgttatatcaagtggtgccatgaacctgggacctcagtcactcaggtggcttcccattaccctgggataaagtccaaacacaatgcagtggcctccgccagccctgaagg

SEQ ID NO: 74089 - DNA, 186 bp, Homo sapiens; identical to SEQ ID NO: 43645
  misc_feature 1..186: note = chr12:125813536-125813722
  misc_feature 1..186: note = hypo
  source 1..186: mol_type = genomic DNA

SEQ ID NO: 74090 - DNA, 161 bp, Homo sapiens
  misc_feature 1..161: note = chr12:125977237-125977398
  misc_feature 1..161: note = hypo
  source 1..161: mol_type = genomic DNA
ctgggctcaggagggcgcacccttgggagggtctgtcctgtgaagaaacctgcatgttgtccactcagccactcagccacgcccgcagatctcacttggctccaaaatgggctgggccctgtgtcaggctccagggatagacacagcgccaaccaaaggct

SEQ ID NO: 74091 - skipped

SEQ ID NO: 74092 - DNA, 109 bp, Homo sapiens
  misc_feature 1..109: note = chr12:126018156-126018265
  misc_feature 1..109: note = hyper
  source 1..109: mol_type = genomic DNA
atggtcctggcgcacccgctagatggcgccgcagaccggcttgtacaggccgcgcgccctcccctccccggcggaggctcctggagcccctgcccggcctgactggctg

SEQ ID NO: 74093 - DNA, 246 bp, Homo sapiens
  misc_feature 1..246: note = chr12:126168425-126168671
  misc_feature 1..246: note = hyper
  source 1..246: mol_type = genomic DNA
ctgcacaggtggccccgcgcctctcacacaggttcagctcccgccggtccctgtgcagagcgccccctgccggtccctcttggaggctgggccagcgttgcgagtcttgccagggacgcgcgctctagcgccggaggctgggaacgcaccgcggtgccaccgcgtcctgcaggggcggggcgcgcacctggggatgcacctgtcctagaccccctgcgcctattcctcgcccgccccatccttccc

SEQ ID NO: 74094 - DNA, 29 bp, Homo sapiens
  misc_feature 1..29: note = chr12:126243099-126243128
  misc_feature 1..29: note = hypo
  source 1..29: mol_type = genomic DNA
tgagccaccgcgcccggctgatgattgtg

SEQ ID NO: 74095 - DNA, 45 bp, Homo sapiens
  misc_feature 1..45: note = chr12:126288373-126288418
  misc_feature 1..45: note = hypo
  source 1..45: mol_type = genomic DNA
ttacctgagagtggccgggcgctgtggctcacgcctgtaatccca

SEQ ID NO: 74096 - DNA, 280 bp, Homo sapiens
  misc_feature 1..280: note = chr12:126675639-126675919
  misc_feature 1..280: note = hyper
  source 1..280: mol_type = genomic DNA
aactctccagagctgcgccgcagacggcgaaaaccagaggtggttacagtcaagtttagggactgcaggagcgaattcccgaaggcttgcaggagccgcccggctctgcctccagcctttctctctgggcctagcgggactctcccaggcaggcccctccctgcccgcgggcgcactttccccgcctgcatctgaggcgtggcgcagctgggagcaaagcacaggtgggctgggcgcggtttggggttcgggcgtggcagagtggcggcggggtctgggg

SEQ ID NO: 74097 - DNA, 139 bp, Homo sapiens
  misc_feature 1..139: note = chr12:127051874-127052013
  misc_feature 1..139: note = hypo
  source 1..139: mol_type = genomic DNA
cagtgggctcctgcacggcctgagccttcccgaagggagccgcccctgctccccggcacctgctcccatcatccacccaagggctgaggagtgcaagtaggcagcgtgggactggtaggcagctccgcccacggccctg

SEQ ID NO: 74098 - DNA, 69 bp, Homo sapiens
  misc_feature 1..69: note = chr12:127211316-127211385
  misc_feature 1..69: note = hyper
  source 1..69: mol_type = genomic DNA
cgggcagtggcgggagctggagccgcggtggagacgactcgaggggacgcagcccgcctggcacaaagg

SEQ ID NO: 74099 - DNA, 60 bp, Homo sapiens
  misc_feature 1..60: note = chr12:127212512-127212572
  misc_feature 1..60: note = hyper
  source 1..60: mol_type = genomic DNA
acttaccgtaaggtgcggggtcttcttaggtctctgctctcaatgcggagagctctacct

SEQ ID NO: 74100 - DNA, 30 bp, Homo sapiens
  misc_feature 1..30: note = chr12:127519655-127519685
  misc_feature 1..30: note = hypo
  source 1..30: mol_type = genomic DNA
acaaggtggtgtatacgcactttctcctac

SEQ ID NO: 74101 - DNA, 387 bp, Homo sapiens
  misc_feature 1..387: note = chr12:127765141-127765528
  misc_feature 1..387: note = hyper
  source 1..387: mol_type = genomic DNA
agtgaggtcctgccacgccctgctgagttctacgtgcttgcgcgcttcttcctcgggagagcttccactgatttaattggatatggggatggagagaggaaacagaaacagggaaagaagtgaaaaagggaaggacggggcgcgcgcggcaggggggcaggcggcctggtgcaggtgcatccccaggtgcgcgccacgcccctgcgggacccggcggcaccgcggtgcgttcccagccgccggcgctagagggcgtgtctgcggaaagactcgctgcgctggcccaggctccacgaggggccgacagggggcgctctgcacagggaccggagggagcgggagccgaacttgcgtgagaggcgcggggccacccgtgcaggtgtaggt

SEQ ID NO: 74102 - DNA, 33 bp, Homo sapiens
  misc_feature 1..33: note = chr12:127865670-127865703
  misc_feature 1..33: note = hyper
  source 1..33: mol_type = genomic DNA
ggaaggcctggaaatcgcaggtcctgaggacgc

SEQ ID NO: 74103 - DNA, 158 bp, Homo sapiens
  misc_feature 1..158: note = chr12:127865704-127865862
  misc_feature 1..158: note = hyper
  source 1..158: mol_type = genomic DNA
gcgagttcacggagaggacctgccgggcaggggctctgggagcctccgcggggaggggagggcgcgcggccggcgcggccacaacccggtctgcggcgccatctagcgggcgcgccgggaccgtcgcccactaggcccttttccggaggagaagctga

SEQ ID NO: 74104 - DNA, 165 bp, Homo sapiens
  misc_feature 1..165: note = chr12:127939926-127940091
  misc_feature 1..165: note = hyper
  source 1..165: mol_type = genomic DNA
gtgctgccccccccccgccccgcagggcctcgggagggtgaaggggccgactgggtctctgctccctgggaatctggccggaattccacagggctgcagggcccgccgcccagcgccaagaaagcgggtggccacatcgaagtttctcaacgggaggagcggatt

SEQ ID NO: 74105 - DNA, 37 bp, Homo sapiens
  misc_feature 1..37: note = chr12:127940356-127940393
  misc_feature 1..37: note = hyper
  source 1..37: mol_type = genomic DNA
ccggggccggaaaggcgaggcggggctggggctgggg

SEQ ID NO: 74106 - DNA, 89 bp, Homo sapiens
  misc_feature 1..89: note = chr12:127940454-127940543
  misc_feature 1..89: note = hyper
  source 1..89: mol_type = genomic DNA
cgggcggatcagcggcacccgctgcagacgcggtcggcgaaacgtcgtcccggccccagctcgagcagcggctccgggtggacctcgca

SEQ ID NO: 74107 - DNA, 30 bp, Homo sapiens
  misc_feature 1..30: note = chr12:128142127-128142157
  misc_feature 1..30: note = hypo
  source 1..30: mol_type = genomic DNA
tttgatctgtgttgtcgcccaaatctcatg

SEQ ID NO: 74108 - DNA, 30 bp, Homo sapiens
  misc_feature 1..30: note = chr12:128245440-128245470
  misc_feature 1..30: note = hypo
  source 1..30: mol_type = genomic DNA
tccaactcctcgagacggtctccaggtagc

SEQ ID NO: 74109 - DNA, 81 bp, Homo sapiens
  misc_feature 1..81: note = chr12:128310374-128310455
  misc_feature 1..81: note = hypo
  source 1..81: mol_type = genomic DNA
taaaagggtccaaagcgatctgagttttccccttcctgccaagtgaggaaacagcacggagacaaccggtgaatgaggaag

SEQ ID NO: 74110 - DNA, 28 bp, Homo sapiens
  misc_feature 1..28: note = chr12:128310875-128310903
  misc_feature 1..28: note = hypo
  source 1..28: mol_type = genomic DNA
cttcaggaaggaagccgggaccctcgcg

SEQ ID NO: 74111 - DNA, 28 bp, Homo sapiens
  misc_feature 1..28: note = chr12:128311023-128311051
  misc_feature 1..28: note = hypo
  source 1..28: mol_type = genomic DNA
ccttcgcagtgaacgttacagctcttaa

SEQ ID NO: 74112 - DNA, 215 bp, Homo sapiens
  misc_feature 1..215: note = chr12:12848341-12848556
  misc_feature 1..215: note = hypo
  source 1..215: mol_type = genomic DNA
gccaggaggctccatcggaaggaggcagacacttcaggtgttgggtggtacctttaagatgttgcggggccaaatccaatgccggtgcaggtgtcccatatatcctgagagacaaaaagaggtcagattggtcagatccctcgagacagttcccaaattcctgacttctgttaccgcgactgttcttcgcaattccacctcggcctgtgttcagg

SEQ ID NO: 74113 - DNA, 224 bp, Homo sapiens
  misc_feature 1..224: note = chr12:12869188-12869412
  misc_feature 1..224: note = hyper
  source 1..224: mol_type = genomic DNA
tctggagtttgaccccgaggggagtattttcacccttcagccctctgaaagcattcactagcatctgaatattgttctgagtttgttggagcagtgaaatctggtgagagagaagggtggaggaaggaaggagctgttgtatttggcggctggactcaggtagaggaaactgctacaatcccgggaaagaacagaaaagtagaaagggacgagttcccacacgc

SEQ ID NO: 74114 - DNA, 760 bp, Homo sapiens
  misc_feature 1..760: note = chr12:128751118-128751878
  misc_feature 1..760: note = hyper
  source 1..760: mol_type = genomic DNA
catctgtcttgagcccgcaccccgccttcacgctccgctgcgcgctgcttttccgcgctcagtgatccagttaggagctctccccgcagcagctgcgcgggactttgcattccagatgtccccagccctccaggctaaagcagcggccacctgaagttgaggaatggggcgtgacgaccaccaggtcccgcagtgaccacgggagggtggggagaaggagtccagctccgccttgagcgtcgggtccctgggcaggaccctccgggccacgggccgctgtccgttgggcacccgggcaggagtctgcgaacgctgagtttctctggaaaggcgcggacccccggaggagccgtcccagccgcctggggagacgccccctcctctcccggtcttctttcccgggcacaccctccctagcccgggcgggggggttctccatctgccgcccctcccggcgggcaggcgaactctctcctaccgcaccctcaatctgtccgcggtcgcggggctcggcgggggcggggcccgggcgggggcgggggcggggccgggggcggggcgggccggcggctgcggaggctgcggaggctgcgggagaaaagttgtcccggccggagcgcgagcagcggcggagccggagccgccagagccagagccggagctgcggcggcgtggacccggcaggggcgggcctcggacagcagagacgcagcgggcccggccgaccgggctgcgggagtggccccgggcatggggcggc

SEQ ID NO: 74115 - DNA, 1126 bp, Homo sapiens
  misc_feature 1..1126: note = chr12:128752114-128753240
  misc_feature 1..1126: note = hyper
  source 1..1126: mol_type = genomic DNA
cgaggggtgcggcgggggcctcggcgggggctcggatcccatcaacagcgcctctgcgggtgccgagccgcccctaatccagaagggcgctcccagctgggcgccgggatccgggcaagttaggctggtcccgagtcccgaatctcccaccccggaccccccagacccagagctgccccgcggatgaggagggggcgtggctgagggacacggtgtttgttccccatccctgagttccgtgcggacctgccccagccccagcacagtcaccctgtggaactggcatccaggagaggtgctccgctctgtgcgctccttcctcccggctgtgtgctccctgtccacagctccccatccacagcttcggcactgtggggctggtgctccaggagggaaggcccggttctttgcatcccctttccgcaaccgctagggtctctgtgcgggccctagaggaacgctcactcatcgcgcagctcaccagggaccccagcttggcagaaaccaggggctctctgcgggttctctcaaatgagtcctttgcggtgggggagcgcggatggggaggtgggtgcgtccctcgcgacgggaactacctcaccagcggtcctgtccggggctccttcacctcagtgtcctcttctctacaatgggagtgacggccctgctttgggttggaggaatttaaaggagttaacgtatggcgcccgcagggctcacgaaaggtagccgtgtggtttttccgaccttttttattatgtgcgtgtgcggccgagtggccgcgcggatgcggcggcgggaagggcggggagaggcggtctccagccccaggagccgcggggcaggcggggagcaaggcctaggctctgccagggcagcagctgcccgagtcccggggcgcgcccagggcgtagaaaaaggagagcgtcgctttcctgctccccgcgccctggcgaaggtctcgggttcatttggttaaacggaggtgcgcacatgggtgccctgagccttcgcgcggcgccgcgggtccagtatcggccccaggctctgagcagagaacactcaaagccacccttctcccgcctaatgctctgaggctgagctagaaatgcgttcagagagacaa

SEQ ID NO: 74116 - DNA, 96 bp, Homo sapiens
  misc_feature 1..96: note = chr12:128850534-128850630
  misc_feature 1..96: note = hyper
  source 1..96: mol_type = genomic DNA
aaactcagctggatccgcgggccgtgattaaacacattgcccgctttgttgccgagatggtgtttcggaaggcgctgtgaatgcacttccctttgc

SEQ ID NO: 74117 - DNA, 137 bp, Homo sapiens
  misc_feature 1..137: note = chr12:128850631-128850768
  misc_feature 1..137: note = hyper
  source 1..137: mol_type = genomic DNA
gggctcacacagacaagatgtgtgttgcaaggatgaggcgcctgctcggcctccagcccagggccgggaagggagaaggtgctgtgcgtcgctgcctgtgtcgcccgcggctctcctcccagcgacagactccagac

SEQ ID NO: 74118 - DNA, 166 bp, Homo sapiens; identical to SEQ ID NO: 43651
  misc_feature 1..166: note = chr12:128899701-128899867
  misc_feature 1..166: note = hypo
  source 1..166: mol_type = genomic DNA

SEQ ID NO: 74119 - DNA, 91 bp, Homo sapiens
  misc_feature 1..91: note = chr12:128944040-128944131
  misc_feature 1..91: note = hypo
  source 1..91: mol_type = genomic DNA
agatagagcatgactcggaagtctctctcctggatgatagtggtgtcattggtgaaaataagaaaaacagacagaagaccaagttttgagg

SEQ ID NO: 74120 - DNA, 193 bp, Homo sapiens; identical to SEQ ID NO: 43652
  misc_feature 1..193: note = chr12:128964823-128965016
  misc_feature 1..193: note = hypo
  source 1..193: mol_type = genomic DNA

SEQ ID NO: 74121 - DNA, 30 bp, Homo sapiens; identical to SEQ ID NO: 43653
  misc_feature 1..30: note = chr12:129028675-129028705
  misc_feature 1..30: note = hypo
  source 1..30: mol_type = genomic DNA

SEQ ID NO: 74122 - DNA, 30 bp, Homo sapiens
  misc_feature 1..30: note = chr12:129189879-129189909
  misc_feature 1..30: note = hypo
  source 1..30: mol_type = genomic DNA
tgtgggcgtcggcaacgtcagggtcaagtt

SEQ ID NO: 74123 - DNA, 30 bp, Homo sapiens
  misc_feature 1..30: note = chr12:129190114-129190144
  misc_feature 1..30: note = hypo
  source 1..30: mol_type = genomic DNA
gtggtgaagaacagtcgggcagacgggggc

SEQ ID NO: 74124 - DNA, 105 bp, Homo sapiens
  misc_feature 1..105: note = chr12:129337805-129337910
  misc_feature 1..105: note = hyper
  source 1..105: mol_type = genomic DNA
gatggtcctggtccccgtggaagggactgtggtcaccgctggtcctggtccaggtggaaacagaccgcggctaccctggtgatggaccccacggggcacacccgc

SEQ ID NO: 74125 - DNA, 239 bp, Homo sapiens; identical to SEQ ID NO: 1076
  misc_feature 1..239: note = chr12:129338587-129338826
  misc_feature 1..239: note = hyper
  source 1..239: mol_type = genomic DNA

SEQ ID NO: 74126 - DNA, 68 bp, Homo sapiens
  misc_feature 1..68: note = chr12:129338851-129338919
  misc_feature 1..68: note = hyper
  source 1..68: mol_type = genomic DNA
cgctcggcctgtattagccggataaacatattccttgaggcgaagcctgggaagtgccaggattagag

SEQ ID NO: 74127 - DNA, 30 bp, Homo sapiens; identical to SEQ ID NO: 43654
  misc_feature 1..30: note = chr12:129441934-129441964
  misc_feature 1..30: note = hypo
  source 1..30: mol_type = genomic DNA

SEQ ID NO: 74128 - DNA, 120 bp, Homo sapiens
  misc_feature 1..120: note = chr12:129520236-129520356
  misc_feature 1..120: note = hypo
  source 1..120: mol_type = genomic DNA
aactgtctgtggagctgcattgagtgctgctgggagaggcagtgttcccagattttactctgaaatcgagagtgaaggaaagcacttgcacagtcaaaaaaatggaagtatggccgggcg

SEQ ID NO: 74129 - DNA, 77 bp, Homo sapiens
  misc_feature 1..77: note = chr12:129615016-129615093
  misc_feature 1..77: note = hypo
  source 1..77: mol_type = genomic DNA
cctagtgctaaccaccgtccgcggtctgctgcctgagaggacccacctgccacgttctagaacgttcttgacacttg

SEQ ID NO: 74130 - DNA, 30 bp, Homo sapiens
  misc_feature 1..30: note = chr12:129728999-129729029
  misc_feature 1..30: note = hypo
  source 1..30: mol_type = genomic DNA
aacttcttgctcctacggtgcatagacaat

SEQ ID NO: 74131 - DNA, 170 bp, Homo sapiens
  misc_feature 1..170: note = chr12:129821969-129822139
  misc_feature 1..170: note = hypo
  source 1..170: mol_type = genomic DNA
atatagatacacacacgcacacacacacacacacacacacacacacacataacgattggctattggcagtcaactttgtggtttcgtttctcactgtcctgattcttggctcctccccttttccccacccagcctgggactcagtgcggcgccggcgccttcccctcccc

SEQ ID NO: 74132 - DNA, 194 bp, Homo sapiens
  misc_feature 1..194: note = chr12:130037653-130037847
  misc_feature 1..194: note = hypo
  source 1..194: mol_type = genomic DNA
ccccttttgagactccgagagtgttgcgcgtttgctcccagctgtgtctgagtcactgcttgtggctcatcagtcaggctccctgctggtcgctctcaccactgctgccccgatgcccagctcttcactctgccacagtggcccgtggtccctggctgcgtgagtccatcctggggctacgagactttgcacct

SEQ ID NO: 74133 - DNA, 30 bp, Homo sapiens
  misc_feature 1..30: note = chr12:130184730-130184760
  misc_feature 1..30: note = hypo
  source 1..30: mol_type = genomic DNA
gctccagctcggccacgcacagccccaggt

SEQ ID NO: 74134 - DNA, 34 bp, Homo sapiens
  misc_feature 1..34: note = chr12:130195436-130195470
  misc_feature 1..34: note = hypo
  source 1..34: mol_type = genomic DNA
tgttcagcctcagtgcgcacgctgcctctcccct

SEQ ID NO: 74135 - DNA, 52 bp, Homo sapiens
  misc_feature 1..52: note = chr12:130216130-130216182
  misc_feature 1..52: note = hypo
  source 1..52: mol_type = genomic DNA
gaggggaatgcaacacgttactgaaggtgcagtgggccgatataaggaaatt

SEQ ID NO: 74136 - DNA, 93 bp, Homo sapiens; identical to SEQ ID NO: 43389
  misc_feature 1..93: note = chr12:13025675-13025768
  misc_feature 1..93: note = hypo
  source 1..93: mol_type = genomic DNA

SEQ ID NO: 74137 - DNA, 187 bp, Homo sapiens; identical to SEQ ID NO: 43390
  misc_feature 1..187: note = chr12:13030748-13030935
  misc_feature 1..187: note = hypo
  source 1..187: mol_type = genomic DNA

SEQ ID NO: 74138 - DNA, 30 bp, Homo sapiens; identical to SEQ ID NO: 43658
  misc_feature 1..30: note = chr12:130308451-130308481
  misc_feature 1..30: note = hypo
  source 1..30: mol_type = genomic DNA

SEQ ID NO: 74139 - DNA, 74 bp, Homo sapiens
  misc_feature 1..74: note = chr12:130325114-130325188
  misc_feature 1..74: note = hypo
  source 1..74: mol_type = genomic DNA
tatcttttatgtctccgagaaggcacacacagaaagtaaaaagcccagggcgggggctgcgcagcctgccctca

SEQ ID NO: 74140 - DNA, 42 bp, Homo sapiens
  misc_feature 1..42: note = chr12:13035995-13036037
  misc_feature 1..42: note = hypo
  source 1..42: mol_type = genomic DNA
caacgtgtttaaggccgggcgcggtggctcatgcctgtaatc

SEQ ID NO: 74141 - DNA, 111 bp, Homo sapiens
  misc_feature 1..111: note = chr12:130387439-130387550
  misc_feature 1..111: note = hyper
  source 1..111: mol_type = genomic DNA
tcctcccccgacagccggctcggccctccagaggccacctttcctctcaagggtccccacgccctctccctttacagaaaaggctttcaggaaacagccttcctttccttt

SEQ ID NO: 74142 - DNA, 222 bp, Homo sapiens
  misc_feature 1..222: note = chr12:130387796-130388018
  misc_feature 1..222: note = hyper
  source 1..222: mol_type = genomic DNA
cgtcctcacctttggaaaacagggcggccaggctgatgagtaccggcgaccagtggtgccacagcgtccccatctcagacgggcacatcctggagacccggagcgcagatcctccgctccccggcgccgtccaggcgaacaagagaccgtctcagtcccctagaggcccgcagcggggccggtggcgagggagcgcccggctaggggcccgagcagcccggg

SEQ ID NO: 74143 - DNA, 166 bp, Homo sapiens
  misc_feature 1..166: note = chr12:130388269-130388435
  misc_feature 1..166: note = hyper
  source 1..166: mol_type = genomic DNA
tcccgggctggctagcgggcgctggcgcaggcggcgccggggtggcggggctgcggagcccgggacgcgggcagaggcggctcggagccccccgggcgggtggccgggctcgctgggcggcccggggctccctggcccgcagcccccatcccaggccggccgctgc

SEQ ID NO: 74144 - DNA, 140 bp, Homo sapiens; identical to SEQ ID NO: 3968
  misc_feature 1..140: note = chr12:130389012-130389152
  misc_feature 1..140: note = hyper
  source 1..140: mol_type = genomic DNA

SEQ ID NO: 74145 - DNA, 30 bp, Homo sapiens
  misc_feature 1..30: note = chr12:130414807-130414837
  misc_feature 1..30: note = hypo
  source 1..30: mol_type = genomic DNA
tgcccaccctgaccccgggccacttcatgg

SEQ ID NO: 74146 - DNA, 30 bp, Homo sapiens; identical to SEQ ID NO: 34754
  misc_feature 1..30: note = chr12:130498725-130498755
  misc_feature 1..30: note = hyper
  source 1..30: mol_type = genomic DNA

SEQ ID NO: 74147 - DNA, 30 bp, Homo sapiens
  misc_feature 1..30: note = chr12:130499052-130499082
  misc_feature 1..30: note = hyper
  source 1..30: mol_type = genomic DNA
acacctgggatcccccggcctaagggcaac

SEQ ID NO: 74148 - DNA, 109 bp, Homo sapiens
  misc_feature 1..109: note = chr12:130501672-130501781
  misc_feature 1..109: note = hypo
  source 1..109: mol_type = genomic DNA
tttctgtaaagccttcgccaccgccatcgccatcggggatgatctccactccgtccgccctgtcacagtggtgccagatttcagccgccagcttcggttcttacgagcg

SEQ ID NO: 74149 - DNA, 68 bp, Homo sapiens
  misc_feature 1..68: note = chr12:130526820-130526888
  misc_feature 1..68: note = hyper
  source 1..68: mol_type = genomic DNA
cacacagatgtgggtcgctgccttcccaacaggctcctgcccggttcacctggggaagcgcagggctg

SEQ ID NO: 74150 - DNA, 199 bp, Homo sapiens
  misc_feature 1..199: note = chr12:130526931-130527130
  misc_feature 1..199: note = hyper
  source 1..199: mol_type = genomic DNA
cggcagcttgcagggcccgctgtctccactagggggcggcgtacgcgcgtctctcgaagccgggacccgcgcggggaggctgcactggctggaaacagcgcctgggcgctcccgcggctcccacctcagagatgtccccaggtgccccacgccccccgcgcgagccccgacacgcgagccccaccgcactcctcaaggg

SEQ ID NO: 74151 - DNA, 30 bp, Homo sapiens
  misc_feature 1..30: note = chr12:13054219-13054249
  misc_feature 1..30: note = hypo
  source 1..30: mol_type = genomic DNA
cctgggagccacctgcggccactaagatag

SEQ ID NO: 74152 - DNA, 125 bp, Homo sapiens
  misc_feature 1..125: note = chr12:130589202-130589327
  misc_feature 1..125: note = hyper
  source 1..125: mol_type = genomic DNA
gagaggaaaatgactcggaaaccctgttgtgagaagcacgttgctatcccggatgaagggccatttcagccctaagctcaaagccggagctccgaccagcactctcaggacgcctgggtgctggc

SEQ ID NO: 74153 - DNA, 130 bp, Homo sapiens
  misc_feature 1..130: note = chr12:130604031-130604161
  misc_feature 1..130: note = hypo
  source 1..130: mol_type = genomic DNA
ggagagctgggcacacggctggtgtgtagtagcggctcactgctgggacactgctgtctgctgagggttgctcacttggctgtggttgctgctctcaggcctctcatggagccaccgtgacacacccccc

SEQ ID NO: 74154 - DNA, 620 bp, Homo sapiens
  misc_feature 1..620: note = chr12:130645186-130645806
  misc_feature 1..620: note = hyper
  source 1..620: mol_type = genomic DNA
ccccaagtttcttaccgatgtaaaaattgtagggcttgttttaattaaaagccaatactctccgaggaagtggccccctcctgcacggcgtgcagaaagctggtcagtgaggggggttcctggcgggccccatctccttcccgggcgcttcctagggagaccttgccccgtgcgcagcgtccccaccgcgggggcccgtgcagccgccccccacgccgggtggagcgccgccaacgcgggaagccccagcactgcctccaaagatgtccgcacactccaccctgctccctggaactatcctcaaacgggcagggggcaagcgaggccggtggacgcgggactcgctcctctgacctctccccggccccccgggaggtagcgggagattgcacacgcgatcctgcgagtttccgaactttggaagatcgtgacccggagagaccctgggaggagagggccggccacctcctaggggtgctgtttttttaagggtcaacccaggacgctacgggaagcacctggcgcatccttgggaacagtggggcttggcggtgggcgcccaccgcgaacgccctgggcgggggaagggaatggcggggggacgtcgtgtcctaagtgac

SEQ ID NO: 74155 - DNA, 260 bp, Homo sapiens
  misc_feature 1..260: note = chr12:130646084-130646344
  misc_feature 1..260: note = hyper
  source 1..260: mol_type = genomic DNA
ataaataaactcagccgccaagaaggcatctccagccctgctggcgcgaggccccggctctgcggcttcggagggggcgggggtcaccgcggtacaaaccaagcccgcacttcccgcggggtgggaggcggtgttcaaagtcccgggacgcttcccgcccctcccccttcccgccttcttagaggagacctcggatgagcggccctaaaatccggattctcgagcccctccccctccccttagctcgtctctttgaaatt

SEQ ID NO: 74156 - DNA, 99 bp, Homo sapiens
  misc_feature 1..99: note = chr12:130646555-130646654
  misc_feature 1..99: note = hyper
  source 1..99: mol_type = genomic DNA
ccaaaccccttctcccgccagtccccgaacttcccgtaacctcggcgtcctcggggtgccggggaccatcccggggaccgccgggaaagggggcgccgg

SEQ ID NO: 74157 - DNA, 137 bp, Homo sapiens
  misc_feature 1..137: note = chr12:130646945-130647082
  misc_feature 1..137: note = hyper
  source 1..137: mol_type = genomic DNA
gcggcccgggggcggggcctgtcagcgctcggcttttctgcccccctttgcctttttgcgagtcttctcatcccgggacgcaaacctcgaaacagctgccggctggtcccggccgaggccggcgcagggagggagga

SEQ ID NO: 74158 - DNA, 336 bp, Homo sapiens
  misc_feature 1..336: note = chr12:130647573-130647909
  misc_feature 1..336: note = hyper
  source 1..336: mol_type = genomic DNA
gggcgacggcaaatgccagcccatcgagatcccgatgtgcaaggacatcggctacaacatgactcgtatgcccaacctgatgggccacgagaaccagcgcgaggcagccatccagttgcacgagttcgcgccgctggtggagtacggctgccacggccacctccgcttcttcctgtgctcgctgtacgcgccgatgtgcaccgagcaggtctctacccccatccccgcctgccgggtcatgtgcgagcaggcccggctcaagtgctccccgattatggagcagttcaacttcaagtggcccgactccctggactgccggaaactccccaacaagaa

SEQ ID NO: 74159 - DNA, 120 bp, Homo sapiens; identical to SEQ ID NO: 1078
  misc_feature 1..120: note = chr12:130647950-130648070
  misc_feature 1..120: note = hyper
  source 1..120: mol_type = genomic DNA

SEQ ID NO: 74160 - DNA, 43 bp, Homo sapiens; identical to SEQ ID NO: 34247
  misc_feature 1..43: note = chr12:13069440-13069483
  misc_feature 1..43: note = hyper
  source 1..43: mol_type = genomic DNA

SEQ ID NO: 74161 - DNA, 72 bp, Homo sapiens
  misc_feature 1..72: note = chr12:130726962-130727034
  misc_feature 1..72: note = hypo
  source 1..72: mol_type = genomic DNA
cctggatatagatgacgatagaagtgacagcgatggaaatgcaggtgtggtgtagaccgagttgtagatatg

SEQ ID NO: 74162 - DNA, 388 bp, Homo sapiens
  misc_feature 1..388: note = chr12:13079623-13080011
  misc_feature 1..388: note = hypo
  source 1..388: mol_type = genomic DNA
ccagagcaagtatcccggcgattcttctgcttggacagggttgggacaaggcgtcggccagtcatccacattgtctttttgcagatccactaatcttccatgcaggctccaacagctccttcccggcctgggaacccaaatccgcaggaagaatctcggggtgttgtcttggcttattcattcagagctgtcgtgtgtggttctgcaaacagtactcagatgcgttccctctccccgtagggatcttgctggagatgcccagggttaacagtggaactccatatggagacagaggcatggggggagcttcgctggagatgggacagcctgctccaccgcgaagcctactgaggctctcttcttacgtaccccgcgcaatctcatctcc

SEQ ID NO: 74163 - DNA, 301 bp, Homo sapiens; identical to SEQ ID NO: 5141
  misc_feature 1..301: note = chr12:130821371-130821672
  misc_feature 1..301: note = hypo
  source 1..301: mol_type = genomic DNA

SEQ ID NO: 74164 - DNA, 30 bp, Homo sapiens
  misc_feature 1..30: note = chr12:130889105-130889135
  misc_feature 1..30: note = hypo
  source 1..30: mol_type = genomic DNA
atgagtcaccgtgcccggccgttggatcta

SEQ ID NO: 74165 - DNA, 153 bp, Homo sapiens
  misc_feature 1..153: note = chr12:130909584-130909737
  misc_feature 1..153: note = hypo
  source 1..153: mol_type = genomic DNA
gttacggggctggggcggggtggaggctgaggcagagcacacgcagagccagcgggccgggcaggagccagcgccatgcatccagccaaggagagggcaggtgagatcccggcggcacatcaggccccacagtgcccacggtaccgctgctgt

SEQ ID NO: 74166 - DNA, 30 bp, Homo sapiens
  misc_feature 1..30: note = chr12:130910571-130910601
  misc_feature 1..30: note = hypo
  source 1..30: mol_type = genomic DNA
agcgaataaggacatcgaaaacaaaccatc

SEQ ID NO: 74167 - DNA, 177 bp, Homo sapiens
  misc_feature 1..177: note = chr12:130918507-130918684
  misc_feature 1..177: note = hypo
  source 1..177: mol_type = genomic DNA
catggccggaggagtcgggggacttgttcacctgtggtctgtaaccagccgggacataaacccaggcctgagagatgccagtccccctctccgggtatggggctgttttgctgtgggagtgggttcagaggatactgtgtgatctgataactgcagcgtcttcgagctcccactatt

SEQ ID NO: 74168 - DNA, 188 bp, Homo sapiens
  misc_feature 1..188: note = chr12:130920592-130920780
  misc_feature 1..188: note = hypo
  source 1..188: mol_type = genomic DNA
cacctcaggtggaaacgggctcaacacaacaggagagatgagagcgggttctgggtggggatgcgggcacacgttctggctcccagccccacatctcttcccctagccctgcacggggggcattgctctgcaggtgatttctcaaaaacgcacgtcccgttgtgtgtatcatccggaacatgccctac

SEQ ID NO: 74169 - DNA, 35 bp, Homo sapiens
  misc_feature 1..35: note = chr12:130921348-130921383
  misc_feature 1..35: note = hypo
  source 1..35: mol_type = genomic DNA
ggactgaggagccaccgaggcgggagccccagcct

SEQ ID NO: 74170 - DNA, 30 bp, Homo sapiens
  misc_feature 1..30: note = chr12:130941083-130941113
  misc_feature 1..30: note = hypo
  source 1..30: mol_type = genomic DNA
aggcttgctgggggccgtggagatgtccag

SEQ ID NO: 74171 - DNA, 30 bp, Homo sapiens
  misc_feature 1..30: note = chr12:130947017-130947047
  misc_feature 1..30: note = hypo
  source 1..30: mol_type = genomic DNA
aagggatgggagaaacgggcattcgttggt

SEQ ID NO: 74172 - DNA, 30 bp, Homo sapiens; identical to SEQ ID NO: 43663
  misc_feature 1..30: note = chr12:130947254-130947284
  misc_feature 1..30: note = hypo
  source 1..30: mol_type = genomic DNA

SEQ ID NO: 74173 - DNA, 112 bp, Homo sapiens
  misc_feature 1..112: note = chr12:130956148-130956260
  misc_feature 1..112: note = hypo
  source 1..112: mol_type = genomic DNA
cgccaggggcctggacggcttattgctctgtgccccatctgacccagctagatgcccagcacttcggccacagggaatctgccctcccttctgtgagcgccatccccccaga

SEQ ID NO: 74174 - DNA, 30 bp, Homo sapiens
  misc_feature 1..30: note = chr12:130968660-130968690
  misc_feature 1..30: note = hypo
  source 1..30: mol_type = genomic DNA
tggccggaaggagcccgatgccccccgaag

SEQ ID NO: 74175 - DNA, 251 bp, Homo sapiens
  misc_feature 1..251: note = chr12:131042217-131042468
  misc_feature 1..251: note = hypo
  source 1..251: mol_type = genomic DNA
ttattacacagcaatcggtgacaaataggtcacagctatagatgacaaattcagctacctgcggagattgatttttaaaaacatattttaaaatcctcttttttcctgtacttatctgtagacaagagtgtcaccttgttcgatgccccgccttcatctagagacaccaccacagaccctggggtcaaagcgccttgctccaattcctgccccttcccagtgagcagctgtggcttcggcaagttacttac

SEQ ID NO: 74176 - DNA, 237 bp, Homo sapiens
  misc_feature 1..237: note = chr12:131060814-131061051
  misc_feature 1..237: note = hypo
  source 1..237: mol_type = genomic DNA
aactacaaacaggaacggagagtttcatgaccatagacatgggcatttgcttccaagagcaatggccctgcatgctttgagaatcgctgtgagctgtgcttctagatcctcagcaggttggcgcatgaccctcagagccctaaacacactacccgtgggcagctggcaggtggccagctgcatgccggcatccaagctgtgcgggctaagtatctcctcccgcgggaagcagatggc

SEQ ID NO: 74177 - DNA, 39 bp, Homo sapiens; identical to SEQ ID NO: 43664
  misc_feature 1..39: note = chr12:131077323-131077362
  misc_feature 1..39: note = hypo
  source 1..39: mol_type = genomic DNA

SEQ ID NO: 74178 - DNA, 30 bp, Homo sapiens
  misc_feature 1..30: note = chr12:131088329-131088359
  misc_feature 1..30: note = hypo
  source 1..30: mol_type = genomic DNA
acaaacccactgcaccgccagtcctagaaa

SEQ ID NO: 74179 - DNA, 63 bp, Homo sapiens
  misc_feature 1..63: note = chr12:131098650-131098713
  misc_feature 1..63: note = hypo
  source 1..63: mol_type = genomic DNA
ctacactttatgtttcggtagcacttcagacttggtaacacagttgcacgtatactatgtgac

SEQ ID NO: 74180 - DNA, 85 bp, Homo sapiens
  misc_feature 1..85: note = chr12:131159445-131159530
  misc_feature 1..85: note = hypo
  source 1..85: mol_type = genomic DNA
tccgcaaggttcatccgtgtggtggcgtgtgtcaggcttcattccttttcgcggctgaatcagattccatcgtgtggatggaaca

SEQ ID NO: 74181 - DNA, 30 bp, Homo sapiens; identical to SEQ ID NO: 43665
  misc_feature 1..30: note = chr12:131159790-131159820
  misc_feature 1..30: note = hypo
  source 1..30: mol_type = genomic DNA

SEQ ID NO: 74182 - DNA, 254 bp, Homo sapiens
  misc_feature 1..254: note = chr12:131199288-131199542
  misc_feature 1..254: note = hyper
  source 1..254: mol_type = genomic DNA
cccccagggaacctccggagccggtcagaccctgcccatcccactgggagcttgggatcatgtctcacaggacaagccaagaccccacagcccagcgggggatgagtctgaagctgattcccggacagcccagcaaggctgggagggagccagggaggggccatgtgcgtgggggaggtggtgattttttagagccttcccccactgttccccttagaaaccgggtgagtgagcctgcacgccagctcccctcc

SEQ ID NO: 74183 - DNA, 77 bp, Homo sapiens
  misc_feature 1..77: note = chr12:131199859-131199936
  misc_feature 1..77: note = hyper
  source 1..77: mol_type = genomic DNA
ggccagtgaccaggccgggaggtgaagcagtcctccctccctccggccagccgccaccccgacctcagccagcgtgc

SEQ ID NO: 74184 - DNA, 70 bp, Homo sapiens
  misc_feature 1..70: note = chr12:131199937-131200007
  misc_feature 1..70: note = hyper
  source 1..70: mol_type = genomic DNA
ctccccggggacaggagggaggctgcttccaccgaggcctctgctgacagatgtccgggcccccacctgg

SEQ ID NO: 74185 - DNA, 215 bp, Homo sapiens
  misc_feature 1..215: note = chr12:131200331-131200546
  misc_feature 1..215: note = hyper
  source 1..215: mol_type = genomic DNA
gtccaggccctgagccgctgctgtctgagaagcctggggcgcactccccaggcgagcggggccgtgtccatcgggtgccaaactttgcctggaggggcctttcttaaaagcctggggtgggggccatgacagagccacagcacccctgcagctgacacccggcacccaggaagaagcccgtcagcccttcccttccgagacgatcctgaattcca

SEQ ID NO: 74186 - DNA, 30 bp, Homo sapiens
  misc_feature 1..30: note = chr12:131201356-131201386
  misc_feature 1..30: note = hyper
  source 1..30: mol_type = genomic DNA
ttccctgcaggaggccgggggtctcctgca

SEQ ID NO: 74187 - DNA, 30 bp, Homo sapiens; identical to SEQ ID NO: 43666
  misc_feature 1..30: note = chr12:131229952-131229982
  misc_feature 1..30: note = hypo
  source 1..30: mol_type = genomic DNA

SEQ ID NO: 74188 - DNA, 30 bp, Homo sapiens
  misc_feature 1..30: note = chr12:131261499-131261529
  misc_feature 1..30: note = hypo
  source 1..30: mol_type = genomic DNA
gtaaatagccagagccgaaatattcacgca

SEQ ID NO: 74189 - DNA, 123 bp, Homo sapiens; identical to SEQ ID NO: 43667
  misc_feature 1..123: note = chr12:131268359-131268482
  misc_feature 1..123: note = hypo
  source 1..123: mol_type = genomic DNA

SEQ ID NO: 74190 - DNA, 56 bp, Homo sapiens; identical to SEQ ID NO: 43668
  misc_feature 1..56: note = chr12:131271976-131272032
  misc_feature 1..56: note = hypo
  source 1..56: mol_type = genomic DNA

SEQ ID NO: 74191 - DNA, 37 bp, Homo sapiens
  misc_feature 1..37: note = chr12:131272330-131272367
  misc_feature 1..37: note = hypo
  source 1..37: mol_type = genomic DNA
cattgtcactctccccgcctgacgaccagccttgtac

SEQ ID NO: 74192 - DNA, 245 bp, Homo sapiens
  misc_feature 1..245: note = chr12:131290735-131290980
  misc_feature 1..245: note = hypo
  source 1..245: mol_type = genomic DNA
tctgagggggatgtgcggcgttgggagccgggatgggcctgaggcttcatctgacctgcgagctgacacgctggcctgccagggctccgtgggggccggcagaaggtccaaggccccaggtcagggacaaagggatttcctactcacagcacagcaggcaacctgaggctcatgagcagctgtccacggcccccagtctcatggggagaggcagagcagctgcagtgggacgtcctcacagtggg

SEQ ID NO: 74193 - DNA, 134 bp, Homo sapiens
  misc_feature 1..134: note = chr12:131335189-131335323
  misc_feature 1..134: note = hypo
  source 1..134: mol_type = genomic DNA
gtatgtgccatataccgttctatgctctaggaatatagaattgtatagcatatagaatataaaatccgtgccttcacagagcttctattcaagggtggaagtgtgtgtgtattcatgtgcgtgtgtgtgagaat

SEQ ID NO: 74194 - DNA, 166 bp, Homo sapiens; identical to SEQ ID NO: 43670
  misc_feature 1..166: note = chr12:131383570-131383736
  misc_feature 1..166: note = hypo
  source 1..166: mol_type = genomic DNA

SEQ ID NO: 74195 - DNA, 30 bp, Homo sapiens; identical to SEQ ID NO: 43671
  misc_feature 1..30: note = chr12:131387248-131387278
  misc_feature 1..30: note = hypo
  source 1..30: mol_type = genomic DNA

SEQ ID NO: 74196 - DNA, 44 bp, Homo sapiens
  misc_feature 1..44: note = chr12:131389290-131389334
  misc_feature 1..44: note = hypo
  source 1..44: mol_type = genomic DNA
acgggatctgggagccggccgcctgggcacgggctgatccacat

SEQ ID NO: 74197 - DNA, 103 bp, Homo sapiens
  misc_feature 1..103: note = chr12:131400816-131400919
  misc_feature 1..103: note = hyper
  source 1..103: mol_type = genomic DNA
ccggcacgcaggacccggccgggctgccgcctctcagaatcgctgtgcaattggcgattgcgacattcatggaataaattccccttcgcgacacatggggacg

SEQ ID NO: 74198 - DNA, 76 bp, Homo sapiens
  misc_feature 1..76: note = chr12:131402548-131402624
  misc_feature 1..76: note = hypo
  source 1..76: mol_type = genomic DNA
tggaggtgaggctagcgttggtgggatcctggtaatcccgctaggacaccgggtcatcctccgtcattagatgatg

SEQ ID NO: 74199 - DNA, 179 bp, Homo sapiens
  misc_feature 1..179: note = chr12:131403032-131403211
  misc_feature 1..179: note = hypo
  source 1..179: mol_type = genomic DNA
cacccctccctgacccgcgttgcactcgtcaggaacgtggcacaacctcccagtattaattcccaccgcgccctgtggcggggccctggcagacatgtagatttgccagacggccaacgtgattgcatccttcattagctatgaggtggtgcaggaggagccgtcgactccaggggtgg

SEQ ID NO: 74200 - DNA, 30 bp, Homo sapiens
  misc_feature 1..30: note = chr12:131417941-131417971
  misc_feature 1..30: note = hypo
  source 1..30: mol_type = genomic DNA
tcggggtgcgggaggcggggagattctcac

SEQ ID NO: 74201 - DNA, 42 bp, Homo sapiens
  misc_feature 1..42: note = chr12:131418388-131418430
  misc_feature 1..42: note = hypo
  source 1..42: mol_type = genomic DNA
ccacacggacccgggcgggcaggacctcggatgctgactccc

SEQ ID NO: 74202 - DNA, 310 bp, Homo sapiens
  misc_feature 1..310: note = chr12:131433135-131433445
  misc_feature 1..310: note = hypo
  source 1..310: mol_type = genomic DNA
ggagacaacaaaccccggggatttccccagacaaacgatgctgcttcattgggactaacttacgcgagtgtctcgttcttggttctctgagagcagagcccagtgccaacactcacgtgtgagcagtgctttagagtgtgagtccagggggccaaagtgggggacgggggcaacagacacagaagtggggaagcggcaatgcagggaaatgctaccgtgttgcaaccatgatggttggagggagaaaagcgggtttgtccactggatcctgcacttcatgggctcgagtacctcacgtttctgggtgctt

SEQ ID NO: 74203 - DNA, 30 bp, Homo sapiens
  misc_feature 1..30: note = chr12:131434432-131434462
  misc_feature 1..30: note = hypo
  source 1..30: mol_type = genomic DNA
ctttcacagtgaattcgcccccaggcttct

SEQ ID NO: 74204 - DNA, 30 bp, Homo sapiens
  misc_feature 1..30: note = chr12:131436515-131436545
  misc_feature 1..30: note = hypo
  source 1..30: mol_type = genomic DNA
aataaatgaaataaacgtctaagatatgaa

SEQ ID NO: 74205 - DNA, 30 bp, Homo sapiens
  misc_feature 1..30: note = chr12:131438610-131438640
  misc_feature 1..30: note = hyper
  source 1..30: mol_type = genomic DNA
cctgactgagacaaacggaggctcttgaaa

SEQ ID NO: 74206 - DNA, 66 bp, Homo sapiens
  misc_feature 1..66: note = chr12:131499103-131499169
  misc_feature 1..66: note = hypo
  source 1..66: mol_type = genomic DNA
atgttggggaagaggcgtcgaggtggctctcctagacgtgtggagcgatcacggatcttcctcatt

SEQ ID NO: 74207 - DNA, 53 bp, Homo sapiens; identical to SEQ ID NO: 43675
  misc_feature 1..53: note = chr12:131500873-131500926
  misc_feature 1..53: note = hypo
  source 1..53: mol_type = genomic DNA

SEQ ID NO: 74208 - DNA, 248 bp, Homo sapiens
  misc_feature 1..248: note = chr12:131513257-131513505
  misc_feature 1..248: note = hypo
  source 1..248: mol_type = genomic DNA
tggtgccgcctttgccgtcagtcacgggaggggcgacgtggctgtttctggactctgctctgtccgtcatcccatttgcatgccggtacgattgcaactgccacgtcctatgccaaggcctgagaccggctcgtgtaaaccctccagcttgttattccaggcggcctcggctatttttggtgagacgcatttaaaaatttgatgcgcgtcgtgaaactgcccttcagaaaggtcgtaaccatttatcc

SEQ ID NO: 74209 - DNA, 56 bp, Homo sapiens
  misc_feature 1..56: note = chr12:131518701-131518757
  misc_feature 1..56: note = hypo
  source 1..56: mol_type = genomic DNA
caagtaagatctacacgcccttcttcccctgcccaccctgccgcactctgggccac

SEQ ID NO: 74210 - DNA, 70 bp, Homo sapiens
  misc_feature 1..70: note = chr12:131535487-131535557
  misc_feature 1..70: note = hypo
  source 1..70: mol_type = genomic DNA
tgtgtgctgtgtgcccggttcctaacaggccacgggctggtcccggttcacggcccgggtgttgggaacc

SEQ ID NO: 74211 - DNA, 30 bp, Homo sapiens
  misc_feature 1..30: note = chr12:131544833-131544863
  misc_feature 1..30: note = hypo
  source 1..30: mol_type = genomic DNA
ggccacactttctcccgtggtatttggagt

SEQ ID NO: 74212 - DNA, 269 bp, Homo sapiens
  misc_feature 1..269: note = chr12:13154515-13154784
  misc_feature 1..269: note = hyper
  source 1..269: mol_type = genomic DNA
gcccgacctgagccccgacggtggcgccgaaccggtcgcggtctccgggacgccgcatctgctgagcgggggcccccgaggtgacggccagcccggcgcccacctgggacgcaaccccgggcaatgcctccggccgcggggagcaaatcaagaaagggccgagaaagttgtgatcggctctgtcctgacgctcatctctctgcgatcgcgggcaactgcctggtggtatctccgtgtgcttcgtcaagaagctccgccagccctccaac

SEQ ID NO: 74213 - DNA, 27 bp, Homo sapiens
  misc_feature 1..27: note = chr12:131547329-131547356
  misc_feature 1..27: note = hypo
  source 1..27: mol_type = genomic DNA
atacaagggtcacgtggtaaatatatt

SEQ ID NO: 74214 - DNA, 38 bp, Homo sapiens
  misc_feature 1..38: note = chr12:131556190-131556228
  misc_feature 1..38: note = hypo
  source 1..38: mol_type = genomic DNA
agggcaacttgtgcacgcactggcgggtcctatgtgtc

SEQ ID NO: 74215 - DNA, 115 bp, Homo sapiens
  misc_feature 1..115: note = chr12:131569132-131569247
  misc_feature 1..115: note = hypo
  source 1..115: mol_type = genomic DNA
aaacctcacctactccgtctgccgctgcactcacctcaccaactttgccatcctcatgcaggtggtcccgctggaggtaagagccaggcctcaggggtcgcgggacctgggggac

SEQ ID NO: 74216 - DNA, 30 bp, Homo sapiens
  misc_feature 1..30: note = chr12:131579447-131579477
  misc_feature 1..30: note = hypo
  source 1..30: mol_type = genomic DNA
ctcacccgggggaggcgcaggggcatgcgt

SEQ ID NO: 74217 - DNA, 33 bp, Homo sapiens
  misc_feature 1..33: note = chr12:131588532-131588565
  misc_feature 1..33: note = hypo
  source 1..33: mol_type = genomic DNA
tcagaaccgagggggcgccgtctggattgtgcg

SEQ ID NO: 74218 - DNA, 119 bp, Homo sapiens
  misc_feature 1..119: note = chr12:131615224-131615343
  misc_feature 1..119: note = hypo
  source 1..119: mol_type = genomic DNA
aggggtgcaggtgtgcggaacagcgatgctggcccatcccgtgcgggggaagagcgaggccggcccatcccgtgcggggggagagcgaagctggccatcccgtgcggggccccagtggc

SEQ ID NO: 74219 - DNA, 198 bp, Homo sapiens
  misc_feature 1..198: note = chr12:131619032-131619230
  misc_feature 1..198: note = hypo
  source 1..198: mol_type = genomic DNA
tgatcctttcagatacggtttcccgggacctaaagattgtagctgaataatgcatgatattgttgtttcccagaaacaggtgttttatttttattgcattagcattatgagaacaagctggctgcggcttctctgagagctgaagtgctggaacacttctgggttttacaggcaccggttgcccggagctgtcagtgc

SEQ ID NO: 74220 - DNA, 62 bp, Homo sapiens
  misc_feature 1..62: note = chr12:131620158-131620220
  misc_feature 1..62: note = hypo
  source 1..62: mol_type = genomic DNA
ttgcacccttccaagcgtctcacaggaggcctgggttctggacgctgcgggggatgctctgc

SEQ ID NO: 74221 - DNA, 171 bp, Homo sapiens
  misc_feature 1..171: note = chr12:131621480-131621651
  misc_feature 1..171: note = hypo
  source 1..171: mol_type = genomic DNA
gggctctaatctctgcgtttcttccctttcttcccagggactgttcatattcctctttcattgtctcctgaattcagaggtacgtccgctctgcttgctggcaggtgcaggtgcagctggcttttcctttccgaaaggtcacaggagcaggaacagcgctgccctgtcagg

SEQ ID NO: 74222 - DNA, 73 bp, Homo sapiens
  misc_feature 1..73: note = chr12:131623324-131623397
  misc_feature 1..73: note = hypo
  source 1..73: mol_type = genomic DNA
gctgctctagccccacggctacagctgcgccgggtgtgtggcacgctccatgagtcaccgtggaatgaacgca

SEQ ID NO: 74223 - DNA, 30 bp, Homo sapiens; identical to SEQ ID NO: 43683
  misc_feature 1..30: note = chr12:131624881-131624911
  misc_feature 1..30: note = hypo
  source 1..30: mol_type = genomic DNA

SEQ ID NO: 74224 - DNA, 53 bp, Homo sapiens
  misc_feature 1..53: note = chr12:131649098-131649151
  misc_feature 1..53: note = hypo
  source 1..53: mol_type = genomic DNA
ctcctgagtgaaactcgggaggtcccggaaggagggggcgaggccctcagcag

SEQ ID NO: 74225 - DNA, 42 bp, Homo sapiens; identical to SEQ ID NO: 43684
  misc_feature 1..42: note = chr12:131687270-131687312
  misc_feature 1..42: note = hypo
  source 1..42: mol_type = genomic DNA

SEQ ID NO: 74226 - DNA, 91 bp, Homo sapiens
  misc_feature 1..91: note = chr12:131699434-131699525
  misc_feature 1..91: note = hypo
  source 1..91: mol_type = genomic DNA
tgactttctcactgcatggtgttttgtaaatggttcttcatgacaataaaacaaccctcccaggcctccgcttcagcggctgcacagcatc

SEQ ID NO: 74227 - DNA, 122 bp, Homo sapiens
  misc_feature 1..122: note = chr12:131700501-131700623
  misc_feature 1..122: note = hypo
  source 1..122: mol_type = genomic DNA
cagcctgggaaaattcggagagaaatgagggggccgtggagagccaggttctgaggctgtgcccgctgcacccctcccaccacttaggtgggccgatgtttaggaaacgctacttccatcaa

SEQ ID NO: 74228 - DNA, 87 bp, Homo sapiens; identical to SEQ ID NO: 43685
  misc_feature 1..87: note = chr12:131725445-131725532
  misc_feature 1..87: note = hypo
  source 1..87: mol_type = genomic DNA

SEQ ID NO: 74229 - DNA, 30 bp, Homo sapiens
  misc_feature 1..30: note = chr12:131746673-131746703
  misc_feature 1..30: note = hypo
  source 1..30: mol_type = genomic DNA
aaggctgaacactaccggccgtgttcgggg

SEQ ID NO: 74230 - DNA, 36 bp, Homo sapiens
  misc_feature 1..36: note = chr12:131750463-131750499
  misc_feature 1..36: note = hypo
  source 1..36: mol_type = genomic DNA
tggtggcagtggtttcgtgagcgtacactcatctcc

SEQ ID NO: 74231 - DNA, 33 bp, Homo sapiens; identical to SEQ ID NO: 43686
  misc_feature 1..33: note = chr12:131767017-131767050
  misc_feature 1..33: note = hypo
  source 1..33: mol_type = genomic DNA

SEQ ID NO: 74232 - DNA, 266 bp, Homo sapiens
  misc_feature 1..266: note = chr12:131768368-131768634
  misc_feature 1..266: note = hypo
  source 1..266: mol_type = genomic DNA
cacaacacaccacaacgccatgaccgcagcaccacaacacaacaccccatgtggttctgtcaagggtgccccagcccagacatgctggatgagaaggaactcggttacagacgacaaggacactccggcctcgctggggctgagcgcttccctcctggggctccctccacatcttgtcctgaccccccgtcgcctcctggggcagagcattctcttctcttctctcctctcttctcctctcccctcccctccgctcccctcccctc

SEQ ID NO: 74233 - DNA, 30 bp, Homo sapiens; identical to SEQ ID NO: 43688
  misc_feature 1..30: note = chr12:131769387-131769417
  misc_feature 1..30: note = hypo
  source 1..30: mol_type = genomic DNA

SEQ ID NO: 74234 - DNA, 37 bp, Homo sapiens; identical to SEQ ID NO: 43689
  misc_feature 1..37: note = chr12:131772177-131772214
  misc_feature 1..37: note = hypo
  source 1..37: mol_type = genomic DNA

SEQ ID NO: 74235 - DNA, 71 bp, Homo sapiens
  misc_feature 1..71: note = chr12:131780201-131780272
  misc_feature 1..71: note = hypo
  source 1..71: mol_type = genomic DNA
catctgactgaggaacggactccccacttccaccaacccaactcgtcatggctgctcggaaatctcatatt

SEQ ID NO: 74236 - DNA, 201 bp, Homo sapiens
  misc_feature 1..201: note = chr12:131801478-131801679
  misc_feature 1..201: note = hypo
  source 1..201: mol_type = genomic DNA
ctgtctcctgacccacggcctagggtggcaggataagaaggggacctggtgagtgcagccatgacagacactcaattggacacagtgctccctctgtgctgggttttggacgggtgtccattgtgatttgcccatgttccattccaatgggaaaatgctccagcctgattggctggtgctccgttgcgattggctcatgct

SEQ ID NO: 74237 - DNA, 67 bp, Homo sapiens
  misc_feature 1..67: note = chr12:131834197-131834264
  misc_feature 1..67: note = hypo
  source 1..67: mol_type = genomic DNA
cgtgctcttcgctgccgtcatttccaacatcgtccgagaatttatgaagtgccgagaatccctctta

SEQ ID NO: 74238 - DNA, 30 bp, Homo sapiens
  misc_feature 1..30: note = chr12:131836813-131836843
  misc_feature 1..30: note = hypo
  source 1..30: mol_type = genomic DNA
ctccgcagcaggctgcgggtaccagccatt

SEQ ID NO: 74239 - DNA, 30 bp, Homo sapiens; identical to SEQ ID NO: 43691
  misc_feature 1..30: note = chr12:131850690-131850720
  misc_feature 1..30: note = hypo
  source 1..30: mol_type = genomic DNA

SEQ ID NO: 74240 - DNA, 259 bp, Homo sapiens
  misc_feature 1..259: note = chr12:131852223-131852482
  misc_feature 1..259: note = hypo
  source 1..259: mol_type = genomic DNA
tggggtcgggggagccggatggggcctgcagggcagcgggtcccacccaggcccacctgcagacatcaggggcctcatctgggaatgcggggccaggatgctcttgaacaaatggaagttttggcaactctggactttggggtaataggctgggaccatagagatgtgacccacagctcctgtccatgctggctctcatggccactggtctccctcacttggtctccggcctgccctctgcttccgagtccgccactcc

SEQ ID NO: 74241 - DNA, 30 bp, Homo sapiens
  misc_feature 1..30: note = chr12:131856761-131856791
  misc_feature 1..30: note = hypo
  source 1..30: mol_type = genomic DNA
ggaagttgcccactgcgggtgaccacagat

SEQ ID NO: 74242 - DNA, 34 bp, Homo sapiens
  misc_feature 1..34: note = chr12:131927584-131927618
  misc_feature 1..34: note = hypo
  source 1..34: mol_type = genomic DNA
caagctcaacccacccgatcgggttgtcagggga

SEQ ID NO: 74243 - DNA, 329 bp, Homo sapiens
  misc_feature 1..329: note = chr12:131928780-131929109
  misc_feature 1..329: note = hypo
  source 1..329: mol_type = genomic DNA
cacctgcacccagggcgcccttctgggaacggctcctgaacctgggcctgtgctgaagagtcagggacgctgggctctgagcggttctggccagtcccctccatcagggcccccgagtccctccggctgggccaaggtggagcccacggcgggtgaggcaggaggagcagctctgccttcaaggggagactcactcccaagcacccctgggcccatcttaggccacggtgggaccgaggctggcgggaccaggacctgagggcactggggcagcctgagaagccaggccttggtggatggagaggctgccgccccgggctctgctcaga

SEQ ID NO: 74244 - DNA, 127 bp, Homo sapiens
  misc_feature 1..127: note = chr12:131943696-131943823
  misc_feature 1..127: note = hypo
  source 1..127: mol_type = genomic DNA
cttccacgggtccctcgggtccccaaatccaaactcacgccgggaagtacctcaacgcacttccgccctggcccaggctggacaaagcccaggtgctgctgagctggaaactcgctcttcaatgagg

SEQ ID NO: 74245 - DNA, 30 bp, Homo sapiens
  misc_feature 1..30: note = chr12:131966801-131966831
  misc_feature 1..30: note = hypo
  source 1..30: mol_type = genomic DNA
cttccttcccactcccgctgagtccaccag

SEQ ID NO: 74246 - DNA, 83 bp, Homo sapiens
  misc_feature 1..83: note = chr12:131977760-131977843
  misc_feature 1..83: note = hypo
  source 1..83: mol_type = genomic DNA
cgggcccagaggaggcgcaggacgaggggggccgagccccaccaggaccgtcccggaggcctgaaggccgtgcctggtgcccg

SEQ ID NO: 74247 - DNA, 436 bp, Homo sapiens
  misc_feature 1..436: note = chr12:131978755-131979191
  misc_feature 1..436: note = hypo
  source 1..436: mol_type = genomic DNA
gggccaaccgagcctcgatgccagccccaagcccgtggagcccgctgtccccttgtatgtcggcggcagacagagggacagggtcaggtggggcagagtccacagaaggcccactgcactcgctacctgggcagtaggggagccgcccaagccgggcctccgacgtcccctggttggagggcgagtggttcaggctcactcccgagggtcctgaccagcagaaggaggggcccagggacaggtgaggagatgcagtcctggtcccggcgaggacagcggccggctcttcccgtggcccggagggccctgtcggaaacagcttgaggacccggagttcccaggagtctcctgccagccttcgtctctgcctgcccctctcgccatagtagcgggaagggtggtaggaacacgtgggtattcacgaggccccacgcct

SEQ ID NO: 74248 - DNA, 24 bp, Homo sapiens
  misc_feature 1..24: note = chr12:13199095-13199119
  misc_feature 1..24: note = hypo
  source 1..24: mol_type = genomic DNA
ataccaccctgaacgcgcccgatc

SEQ ID NO: 74249 - DNA, 24 bp, Homo sapiens
  misc_feature 1..24: note = chr12:13199179-13199203
  misc_feature 1..24: note = hypo
  source 1..24: mol_type = genomic DNA
gttcacttgcgtttttccttgtct

SEQ ID NO: 74250 - DNA, 34 bp, Homo sapiens
  misc_feature 1..34: note = chr12:132025011-132025045
  misc_feature 1..34: note = hypo
  source 1..34: mol_type = genomic DNA
atgacggtgatggtgatgacgtggttgaggagga

SEQ ID NO: 74251 - DNA, 286 bp, Homo sapiens
  misc_feature 1..286: note = chr12:132044061-132044347
  misc_feature 1..286: note = hypo
  source 1..286: mol_type = genomic DNA
tctatgaaccagcagcgctgaggtcactggtgctgaggccatgggactcgtggaggtgttctgtccatgggagagaagccctgagcatctgggagccatgaggaggaatctccagagacaaacgggagaattaaccagaggccccgccccattatcataactcggctccactcacatggccccgccctgttcattcacatgaccccacatgaccccactcacatggcccctccccactcacatgaccccaccccacttacatgaccccacccgtcacagggctcct

SEQ ID NO: 74252 - DNA, 211 bp, Homo sapiens
  misc_feature 1..211: note = chr12:132057357-132057568
  misc_feature 1..211: note = hypo
  source 1..211: mol_type = genomic DNA
tgacacggcagacaccggccatcctgatgcgtggtcctgtccccagccacgcgcccaggcgggcacctgggaaactcacatgtgtacacagagacacaccggtgggattatggcagctttgtttatagcagcaaaaataaaaatgaaatatttgaaactagccaaatacctaccaggaagaaaactactcaattaacgtagaaaatacata

SEQ ID NO: 74253 - DNA, 99 bp, Homo sapiens
  misc_feature 1..99: note = chr12:132060675-132060774
  misc_feature 1..99: note = hypo
  source 1..99: mol_type = genomic DNA
gcagtgaattagacccggtgcagtgagtgagacctgctgcagtgagtgagacctgctgcagtgagtgagagccggtgcagtaagacctgctgcagttga

SEQ ID NO: 74254 - DNA, 30 bp, Homo sapiens; identical to SEQ ID NO: 43696
  misc_feature 1..30: note = chr12:132068982-132069012
  misc_feature 1..30: note = hypo
  source 1..30: mol_type = genomic DNA

SEQ ID NO: 74255 - DNA, 30 bp, Homo sapiens
  misc_feature 1..30: note = chr12:132076155-132076185
  misc_feature 1..30: note = hypo
  source 1..30: mol_type = genomic DNA
ggcatttattatgcccgtggtgtctatcgt

SEQ ID NO: 74256 - DNA, 402 bp, Homo sapiens
  misc_feature 1..402: note = chr12:132076426-132076828
  misc_feature 1..402: note = hypo
  source 1..402: mol_type = genomic DNA
gtcactgcaggaggacgcccccgctgggactcggcgtccgctgcgctgagccgctaaggagccggtctacttgctcccgcagcagcccgggggccggagctgccgacaccagggagacgcgttttctgcactgactcctacgctcccgcgtggacatccccagcatgatttctgtctccacccacttcgcacacaccccgccccggccagacacccccaaacccacacagggtgcagggacaccgccctggccttggctgtggctgtcacactcgcctgtcccgccttggccccaagtcctgccagcccggctccgtccccgccccactcccagtggctctgtgcctgcctccctcccgggctctgccagccctgcctctcccgccacgcacagctcaggcg

SEQ ID NO: 74257 - DNA, 66 bp, Homo sapiens
  misc_feature 1..66: note = chr12:132097008-132097074
  misc_feature 1..66: note = hypo
  source 1..66: mol_type = genomic DNA
gcaggctatgggacccgcagggagtgagcatctgggggtggctgcccagcccggcacttgctgcca

SEQ ID NO: 74258 - DNA, 30 bp, Homo sapiens
  misc_feature 1..30: note = chr12:132104755-132104785
  misc_feature 1..30: note = hypo
  source 1..30: mol_type = genomic DNA
atcatggtgaggtgccgtggggctctgatg

SEQ ID NO: 74259 - DNA, 160 bp, Homo sapiens
  misc_feature 1..160: note = chr12:132106063-132106223
  misc_feature 1..160: note = hypo
  source 1..160: mol_type = genomic DNA
atcttcagctctgggcgacgctgccgggctgcttcccaagttccagatccaccacacccccagggggttccagcctgcagcgggggctgagacccacagctctgctgtgtacatgagaacacacacaggcacatgcacacctacgcgcatgtacacacat

SEQ ID NO: 74260 - DNA, 94 bp, Homo sapiens; identical to SEQ ID NO: 15639
  misc_feature 1..94: note = chr12:13215216-13215310
  misc_feature 1..94: note = hypo
  source 1..94: mol_type = genomic DNA

SEQ ID NO: 74261 - DNA, 155 bp, Homo sapiens
  misc_feature 1..155: note = chr12:132168266-132168421
  misc_feature 1..155: note = hypo
  source 1..155: mol_type = genomic DNA
atttctgggtggggccgtgcctggcgctaggaggtgagctgggcccaggcctgggggcagctctgcgtccccaccaccttcgtcccacccatgggctccagagcttctctcctgcaccgatgggtcagcggccgccacctcgatttctacatctc

SEQ ID NO: 74262 - DNA, 103 bp, Homo sapiens
  misc_feature 1..103: note = chr12:132169254-132169357
  misc_feature 1..103: note = hypo
  source 1..103: mol_type = genomic DNA
agaatgggaatcatgcgtgtctgattcctgctctgtagattgagaatcacggcgtctctgtttcctgctctgtagaaaatgggaatcacgtgtgtccgtttcc

SEQ ID NO: 74263 - DNA, 139 bp, Homo sapiens
  misc_feature 1..139: note = chr12:132171649-132171788
  misc_feature 1..139: note = hypo
  source 1..139: mol_type = genomic DNA
gtagaatgggaatcacgcgtgcgtgtttcctgctctatagaatgggaatcaccacgtcatgacttgggtgtgtctttcactcgagtctggcacatatgcatctgatggtcagcggatccctgcacgcccaaaggccctg

SEQ ID NO: 74264 - DNA, 83 bp, Homo sapiens
  misc_feature 1..83: note = chr12:132197162-132197245
  misc_feature 1..83: note = hypo
  source 1..83: mol_type = genomic DNA
tttttccatccctgacgtttccttttggaattagagctcgaaaacgagaactggtgaagggagggccgcggaatcagatcatg

SEQ ID NO: 74265 - DNA, 628 bp, Homo sapiens
  misc_feature 1..628: note = chr12:132221496-132222124
  misc_feature 1..628: note = hypo
  source 1..628: mol_type = genomic DNA
tcagtctaaaacacacgtgcctccaacccaggatgtctgctctcatttactagtatatgggtgaacatagccacatagatactcatcatagtacagttttagtagtagcaaaagactgaggcgacgcacatcctcggtggaggactaatggagtccctctggtgtgctctcgcggtgggctgcagagctctgggggtgggccagggcccgagcgctgcagggccacccaccggaatggctcttcctgagggtggaggcgaggtgactcaaggggagggcagcacgaggcagtctgttcacgtcagaaggggagggaagtgtctgtagtgcttctgtatcggcacctaaaagggcaggtaagaaggaccagtggccagcacagagaggggaactggaaggacgaggtcgcagacaggagtggctgactcacctgcccgtttgcgctgcttgcattttttcagcgtgactcgtcaccctctcaaaacatgcagattgacgtggtacttattttgagactaaactggtatcctgagttaattccttacaactctgtattttaataatacgtgcttttatcattttgtttcatcagctcagtgtgtttttgtttaggcggaagtggcccccg

SEQ ID NO: 74266 - DNA, 161 bp, Homo sapiens
  misc_feature 1..161: note = chr12:132240161-132240322
  misc_feature 1..161: note = hypo
  source 1..161: mol_type = genomic DNA
atactccatctttcacgtcccccttagctctggaacctgatctgttgaaagcatctgcccacgttcacagcattgatgattgtttgtccagcacgttctaaacaaacaaaaaaaatcctgttccttcaactgttcgatgttttggccgtctacagttacta

SEQ ID NO: 74267 - DNA, 30 bp, Homo sapiens
  misc_feature 1..30: note = chr12:132242801-132242831
  misc_feature 1..30: note = hypo
  source 1..30: mol_type = genomic DNA
gctgctgccaaccagcgtgaccttctccac

SEQ ID NO: 74268 - DNA, 21 bp, Homo sapiens
  misc_feature 1..21: note = chr12:132244054-132244075
  misc_feature 1..21: note = hypo
  source 1..21: mol_type = genomic DNA
aaatagtaggccgggcgcggt

SEQ ID NO: 74269 - DNA, 30 bp, Homo sapiens
  misc_feature 1..30: note = chr12:132259853-132259883
  misc_feature 1..30: note = hypo
  source 1..30: mol_type = genomic DNA
ttcctggggaaatcccgggccttgttgaaa

SEQ ID NO: 74270 - DNA, 30 bp, Homo sapiens; identical to SEQ ID NO: 43704
  misc_feature 1..30: note = chr12:132279981-132280011
  misc_feature 1..30: note = hypo
  source 1..30: mol_type = genomic DNA

SEQ ID NO: 74271 - DNA, 173 bp, Homo sapiens
  misc_feature 1..173: note = chr12:132280837-132281010
  misc_feature 1..173: note = hypo
  source 1..173: mol_type = genomic DNA
tggccaagacagccacgtggctcaggtgtggaatgaagctagaccaggtggaagccgaagggtcggcctctccaggcaggagagaaggatgatctaagggcaggtgcaggccagaatgtctggaaagcatttctggtgcgggattgccagtttggtgacgtggactctgggaa

SEQ ID NO: 74272 - DNA, 227 bp, Homo sapiens
  misc_feature 1..227: note = chr12:132284411-132284638
  misc_feature 1..227: note = hypo
  source 1..227: mol_type = genomic DNA
gggcccccagccctccgacagcagccactggactccccttccccgtctccacgcctcctgcggtcaccgcacaccccttcttcccaggccgtcagctccccgtgggcatgtgtccctgccggcacccatgctgcaactgccggacaggccctccctgcggcagtggtgcacagcaggggagcagcccagccccgcctcaccatgctgagcaccgcatgttgccttga

SEQ ID NO: 74273 - DNA, 221 bp, Homo sapiens
  misc_feature 1..221: note = chr12:132286008-132286229
  misc_feature 1..221: note = hypo
  source 1..221: mol_type = genomic DNA
atgtttgccgtggctcgtgtttgccgtggctcgtgtttgccgtggctcgtgtttgccgtggctcgtgtttgccatggcccgtgtttgccgtggcccgtgtttgctgtggctgttcgtgtttgccgtggcccgtgtttgccgtggctcgtgtttgctgtggcctgtgtttgccgtggctgttcatgtttgctgtggctcatgtttgccgtggctcgtctttg

SEQ ID NO: 74274 - DNA, 30 bp, Homo sapiens; identical to SEQ ID NO: 43394
  misc_feature 1..30: note = chr12:13229039-13229069
  misc_feature 1..30: note = hypo
  source 1..30: mol_type = genomic DNA

SEQ ID NO: 74275 - DNA, 30 bp, Homo sapiens
  misc_feature 1..30: note = chr12:132291006-132291036
  misc_feature 1..30: note = hypo
  source 1..30: mol_type = genomic DNA
aggaccacagaagcacgagcaacgagagaa

SEQ ID NO: 74276 - DNA, 272 bp, Homo sapiens
  misc_feature 1..272: note = chr12:132312558-132312830
  misc_feature 1..272: note = hyper
  source 1..272: mol_type = genomic DNA
gcgggctccaccaagcgcccacctgctgcgctgcggcggcggctccggggcctgaacccgggtctgaacccgggcctcggcgccgtggggggtggacccgggagcgcggccggagaggggagtcagggtcagctccccgcaggcgccccgacccccgcctccgcgcccatcccgcgcgtccccgccgccccaagagcgtcctaagacacccggggaaacgccttccctgtgatgccgcggacccagtcccgtcgcggacacggcggggcggg

SEQ ID NO: 74277 - DNA, 803 bp, Homo sapiens
  misc_feature 1..803: note = chr12:132312856-132313659
  misc_feature 1..803: note = hyper
  source 1..803: mol_type = genomic DNA
cgggccctttaaggcggccggcctcgttagcatacatttgcatggccccgccccgccgcttgaggctgccgcgcggggctcagtccggcgggggcgccgcggagagcggagggcgccgggctgcggaacgcgaagcggagggcgcgggaccctgcacgccgcccgcgggcccatgtgagcgccatgcggcgccgcgcagcccggggacccggcccgccgcccccagggcccggactctcgcggctgccgctgccgctgctgctgctgctggcgctggggacccgcgggggctgcgccgcgcccgcacccgcgccgcgcgccgaggacctcagcctgggagtggtgagcgcgcgggcgggacgggcgcggagctcctgggccggagccgggggtctccgcgggccgggtggcggggaccgggaagaccccagcagtgcacgtcggcgtcgcgcgggagccctggcgccctggacccatttcctgggtggggagactgaggcagggacgcgggctgagcgaccgggcgagcgcacgcgagtcctggggaggcgccggctgccgtcccggctccgtgcgctgggagcgcgccgcagccgcaggagcccgtggagttgtgagggggtcgcccacccggagcccgggtcgccggcttgcagcagccccggagcagccgggctgggcgagagcaggcatcgcggccgccccgagctctgcgcgctgcgtgcgttccgggtgggagtggcgggggcaggagcacgcacccacaaagcgaggaagggcaggggctacggagtgggggcacc

SEQ ID NO: 74278 - DNA, 30 bp, Homo sapiens; identical to SEQ ID NO: 34771
  misc_feature 1..30: note = chr12:132314800-132314830
  misc_feature 1..30: note = hyper
  source 1..30: mol_type = genomic DNA

SEQ ID NO: 74279 - DNA, 30 bp, Homo sapiens; identical to SEQ ID NO: 34772
  misc_feature 1..30: note = chr12:132315470-132315500
  misc_feature 1..30: note = hyper
  source 1..30: mol_type = genomic DNA

SEQ ID NO: 74280 - DNA, 47 bp, Homo sapiens
  misc_feature 1..47: note = chr12:132323460-132323507
  misc_feature 1..47: note = hypo
  source 1..47: mol_type = genomic DNA
ggccagggtggggaacggggtctccgtggaggcgggtgcgtggccag

SEQ ID NO: 74281 - DNA, 321 bp, Homo sapiens
  misc_feature 1..321: note = chr12:132325069-132325390
  misc_feature 1..321: note = hypo
  source 1..321: mol_type = genomic DNA
acgtggcctgttctccgtgactcactctgggctgacccctgcctgcagggtccggacgttcccacgggactcaccactggggcacgacacggtgcgtgcactcatgtactacgccctcaaggtctggagcgacattgcgcccctgaacttccacgaggtggcgggcagcgccgccgacatccagatcgacttctccaaggccgaccataacgacggctaccccttcgacggccccggcggcaccgtggcccacgccttcttccccggccaccaccacaccgccggggacacccactttgacgatgacgaggcctggacctt

SEQ ID NO: 74282 - DNA, 511 bp, Homo sapiens
  misc_feature 1..511: note = chr12:132329560-132330071
  misc_feature 1..511: note = hypo
  source 1..511: mol_type = genomic DNA
atgcctgtcccatgccgctcaggtcaggggctctgccgcaggatgccctgtcccgcgctgcccaggccccgcctcccagcccacctggctctctccctgcaggcccaggaaggacgtgccccacagatgcagcactcactttgacgcggtggcccagatccggggtgaagctttcttcttcaaaggtacctccagggttcccgtggcggttggctgagggccatggcccactctgggtgcagaccgtctctgcagcccggccctcccctctgtgcccccaggcaagtacttctggcggctgacgcgggaccggcacctggtgtccctgcagccggcacagatgcaccgcttctggcggggcctgccgctgcacctggacagcgtggacgccgtgtacgagcgcaccagcgaccacaagatcgtcttctttaaaggtgggtgggcctccccgtcgcactccgggcttcccgggccctctgtccgcctcatggagggacggagagggtccagc

SEQ ID NO: 74283 - DNA, 197 bp, Homo sapiens
  misc_feature 1..197: note = chr12:132332952-132333149
  misc_feature 1..197: note = hypo
  source 1..197: mol_type = genomic DNA
tgtgggcgtggtgagcacactttactatttcagccattttgaagccacagctcggtggcatgaagcacgttcacgttgctgtgcagctgtcacctgcgtccacctcccgaagatttccaccttcccaaacggaaacgctgccccgtgaaacacggatgccccgccccgcccctgggcagccccgcccctcccctggg

SEQ ID NO: 74284 - DNA, 32 bp, Homo sapiens
  misc_feature 1..32: note = chr12:132333386-132333418
  misc_feature 1..32: note = hypo
  source 1..32: mol_type = genomic DNA
ggctcctgtgaaggacgctgctatgagcgtga

SEQ ID NO: 74285 - DNA, 211 bp, Homo sapiens
  misc_feature 1..211: note = chr12:132333478-132333689
  misc_feature 1..211: note = hypo
  source 1..211: mol_type = genomic DNA
ggaatgctggatcacgtggtaattctatttttgacgttttggggagcctatgttctgtctcccgcagcggctgcacaatttcatactccctccccggcagcgcccggctctgccgtccccatatcctcccgacacaggtgactttccacgttcttgacagtgggggcgagggggcgtctcattgtggttttgagggcgtttctagtgacgt

SEQ ID NO: 74286 - DNA, 30 bp, Homo sapiens
  misc_feature 1..30: note = chr12:132334483-132334513
  misc_feature 1..30: note = hypo
  source 1..30: mol_type = genomic DNA
gaccagctgtactggcgctacgatgaccac

SEQ ID NO: 74287 - DNA, 224 bp, Homo sapiens
  misc_feature 1..224: note = chr12:132335471-132335695
  misc_feature 1..224: note = hypo
  source 1..224: mol_type = genomic DNA
gcctcctacttcttccgtggccaggagtactggaaagtgctggatggcgagctggaggtggcacccgggtacccacagtccacggcccgggactggctggtgtgtggagactcacaggccgatggatctgtggctgcgggcgtggacgcggcagaggggccccgcgcccctccaggacaacatgaccagagccgctcggaggacggttacgaggtctgctcatg

SEQ ID NO: 74288 - DNA, 393 bp, Homo sapiens
  misc_feature 1..393: note = chr12:132336227-132336620
  misc_feature 1..393: note = hypo
  source 1..393: mol_type = genomic DNA
agccctccccacagacgagccccccacatggtgccgcggcacgtcccccctgtgacgcgttccagaccaacatgacctctccctgctttctagcggctcggctgggctccctggtgctccagggccatgggagtgggtaccctcgggcctcaaggggcttgaccctgaccaggggcccacgcacctgcacttggggtgggggcttcccaggaggtctcggcagtcgcattcctccttgttcatcagcccgtcccgcgctgtctcttccagtcctcgtgccccgaggagtccccacgcccctgtcacagatgggagagttgaggcccagcgggggatgagcctcagtgctacaggcaggggcatcacgggcgggcggggcgccagctggcccag

SEQ ID NO: 74289 - DNA, 35 bp, Homo sapiens
  misc_feature 1..35: note = chr12:132338738-132338773
  misc_feature 1..35: note = hypo
  source 1..35: mol_type = genomic DNA
acctatgagggctgccggcccgtccttctgtggtc

SEQ ID NO: 74290 - DNA, 176 bp, Homo sapiens
  misc_feature 1..176: note = chr12:132348560-132348736
  misc_feature 1..176: note = hypo
  source 1..176: mol_type = genomic DNA
gtgtctgagaagaaacggtgaagaaatccaccctggctgtctgtcgggcagccccggcgaggagttgagtccccttaccgctgcgaatgagctgtcctccaccccacgtcggagacctcagcgcccggggccccggcctgttagcacctgcatgcctttgacggcaacccctggca

SEQ ID NO: 74291 - DNA, 376 bp, Homo sapiens
  misc_feature 1..376: note = chr12:132349603-132349979
  misc_feature 1..376: note = hypo
  source 1..376: mol_type = genomic DNA
aaaaagcaaagctggaaaagatagcttctaggtatacacatgcacatacgcactaagatcgcttctaggtatacacacacatacgtgctaagatagcttctaggtatacacacgcacatatgcactaagatcacttctaggtatacacacacatacgtgctaagatagcttctaggtatacacacgcacatacgcgctaagactgtttagtgagaagcaaggagatgatgcagtgtcagcggggagtctcgcagctgacacagggtgagtcctgtctgactccatttatgtgcagtccggggatgggcacgctaatgtccagaggctgagatcaggacagtgactcactcgtcaggaacgacggggcacctgccag

SEQ ID NO: 74292 - DNA, 49 bp, Homo sapiens
  misc_feature 1..49: note = chr12:132377450-132377499
  misc_feature 1..49: note = hypo
  source 1..49: mol_type = genomic DNA
tcccccacccctaagcgctgggagctcctgcaggcgggtcttgttctca

SEQ ID NO: 74293 - DNA, 129 bp, Homo sapiens
  misc_feature 1..129: note = chr12:132377954-132378083
  misc_feature 1..129: note = hypo
  source 1..129: mol_type = genomic DNA
agcgcgcaacgtgtacggtgaacagcactaacttttccccggtcctctctcccagagcaatcgctgttggctgtgtcttctgtgagtgagcccccgggctcttttggctgccggcggtgtgactttgga

SEQ ID NO: 74294 - DNA, 30 bp, Homo sapiens
  misc_feature 1..30: note = chr12:132406501-132406531
  misc_feature 1..30: note = hypo
  source 1..30: mol_type = genomic DNA
ccgagcaccggaccacgttgctgcccaggt

SEQ ID NO: 74295 - DNA, 37 bp, Homo sapiens; identical to SEQ ID NO: 43716
  misc_feature 1..37: note = chr12:132415173-132415210
  misc_feature 1..37: note = hypo
  source 1..37: mol_type = genomic DNA

SEQ ID NO: 74296 - DNA, 37 bp, Homo sapiens; identical to SEQ ID NO: 43717
  misc_feature 1..37: note = chr12:132415270-132415307
  misc_feature 1..37: note = hypo
  source 1..37: mol_type = genomic DNA

SEQ ID NO: 74297 - DNA, 157 bp, Homo sapiens; identical to SEQ ID NO: 43718
  misc_feature 1..157: note = chr12:132423589-132423746
  misc_feature 1..157: note = hypo
  source 1..157: mol_type = genomic DNA

SEQ ID NO: 74298 - DNA, 30 bp, Homo sapiens
  misc_feature 1..30: note = chr12:132429244-132429274
  misc_feature 1..30: note = hypo
  source 1..30: mol_type = genomic DNA
gcctcagcactgtcccggtgccaggcaggt

SEQ ID NO: 74299 - DNA, 44 bp, Homo sapiens
  misc_feature 1..44: note = chr12:132566992-132567036
  misc_feature 1..44: note = hypo
  source 1..44: mol_type = genomic DNA
tttgtgtggtgggggcggggtgggggtggggacagtctcactca

SEQ ID NO: 74300 - DNA, 249 bp, Homo sapiens
  misc_feature 1..249: note = chr12:132593124-132593373
  misc_feature 1..249: note = hypo
  source 1..249: mol_type = genomic DNA
tgtggccagaaagcacgggcagcctgggactcctgttgccatagcaacccagctaccgccgaggacttctgcggcttttccagcccagcagcagccgctccaggtactttctgatggctccacagtgcagctccccagactttcctcactcggatttgaggactcgatgtgctgaggcaggacccagaggggtcccaagagcctgtcctcttttgttcaaaatacatcttgaaacgtctttgtgaaggc

SEQ ID NO: 74301 - DNA, 38 bp, Homo sapiens
  misc_feature 1..38: note = chr12:132616617-132616655
  misc_feature 1..38: note = hypo
  source 1..38: mol_type = genomic DNA
tgtgtggcattgaggcgaggaggcggggagtggccgcc

SEQ ID NO: 74302 - DNA, 522 bp, Homo sapiens
  misc_feature 1..522: note = chr12:132617183-132617705
  misc_feature 1..522: note = hypo
  source 1..522: mol_type = genomic DNA
cctgggagcaggagccgtggggagggctggactgcagtaaggacgcctcgtgggatgtgccaaaccgctgcgtggagcctgggctgacttctctggatcttggtgcaactggcgtggcccttccaggaagccgggccacctggctcagagacgccagaccctggccggcaatggggctgccaggggcggggacgctggaggagctaggggtgtgggccactgtgctgcctgccccggcctggcggcctctccgtagcagagctgaggctgggacgcaggtgggggagcctggatgcgcctccttcctcagccacgggaggatgaggtccaggagcgcagcggggcccacgggggagcgccttcgggtgcggctcgtcgctgccacccgtacagtggtttctttttatttcccacgcctccccacaatgatgtggacgccatcagtgtcattggcaagggagggccttgtgccaccctccagagacgtggctgccaccctgacctgggcggagtgtgggggtg

SEQ ID NO: 74303 - DNA, 150 bp, Homo sapiens
  misc_feature 1..150: note = chr12:132619054-132619204
  misc_feature 1..150: note = hypo
  source 1..150: mol_type = genomic DNA
agctgctgtccctcccgctcctctcccctctcacatctcgaaactctggggaaggatccaggcccccgtgccactgtggaagggccgggacgggcctgcccaatgcactgcagatgccccggtgcccactcctcctacctccccgagtgt

SEQ ID NO: 74304 - DNA, 70 bp, Homo sapiens
  misc_feature 1..70: note = chr12:132643455-132643525
  misc_feature 1..70: note = hypo
  source 1..70: mol_type = genomic DNA
tgtcctagtcagaggcgtgaagaggagggcggaggccggaactatccatcggctccgagggtggagcagg

SEQ ID NO: 74305 - DNA, 163 bp, Homo sapiens
  misc_feature 1..163: note = chr12:132643845-132644008
  misc_feature 1..163: note = hypo
  source 1..163: mol_type = genomic DNA
ctgaggatggtgcctcgcggagcctccactgcccctgtgtgctccgcaccacgtctgtctcgatggcgcccctcgaagacctcgggaagctccccgttcgctgtggccccccggggtctgtcccctgcagcactgttctctgggggctcgtggtccgagttct

SEQ ID NO: 74306 - DNA, 30 bp, Homo sapiens
  misc_feature 1..30: note = chr12:132644527-132644557
  misc_feature 1..30: note = hypo
  source 1..30: mol_type = genomic DNA
tcttctcgcctctctcggccccttttcctt

SEQ ID NO: 74307 - DNA, 337 bp, Homo sapiens
  misc_feature 1..337: note = chr12:132648196-132648533
  misc_feature 1..337: note = hypo
  source 1..337: mol_type = genomic DNA
gcccttgccaccctgcgtgggctgcccctgccatgtgagctcctctccctgctctacacatattttaaaggacaggtgagtaaccaaaaaccaggtaggtgctgtgcagagccaggatgtgtggcccagccctgaaccacgctcacttgcaggctgcccagggtcccctgggcgcaggtcacccacataatggggcccgcatcggggcgcagagggtgacaccccagcctccaggaaggtgcctcatgggtggctcagccctggttagccccatggctaacaaagccaggaattaccgcagagcctgggcgtgcaggtggcacggcctctggaattt

SEQ ID NO: 74308 - DNA, 30 bp, Homo sapiens
  misc_feature 1..30: note = chr12:132651886-132651916
  misc_feature 1..30: note = hypo
  source 1..30: mol_type = genomic DNA
tcgtttctgcctgtgcgtgctgaggctgtt

SEQ ID NO: 74309 - DNA, 231 bp, Homo sapiens
  misc_feature 1..231: note = chr12:132652953-132653184
  misc_feature 1..231: note = hypo
  source 1..231: mol_type = genomic DNA
gtgaggccggccacacgtcccagcacagtgagcttgtggggaggggggcccactggggtcctctgggggccgatgctgagacggggtctaggccgggataacgggatagtccattgctgggccagggctgctgagcgtgggtggggactgccgactgcagtacagacccagacggcaggagcccggcaaagcctgcccttccgaggagcctcacgtcggaggagctgcctg

SEQ ID NO: 74310 - DNA, 30 bp, Homo sapiens
  misc_feature 1..30: note = chr12:132654109-132654139
  misc_feature 1..30: note = hypo
  source 1..30: mol_type = genomic DNA
ctgagcctgggccaccgccagaatcacgtg

SEQ ID NO: 74311 - DNA, 30 bp, Homo sapiens
  misc_feature 1..30: note = chr12:132656988-132657018
  misc_feature 1..30: note = hypo
  source 1..30: mol_type = genomic DNA
catgagcccggagcccgccattcccgctgc

SEQ ID NO: 74312 - DNA, 30 bp, Homo sapiens
  misc_feature 1..30: note = chr12:132658236-132658266
  misc_feature 1..30: note = hypo
  source 1..30: mol_type = genomic DNA
gcggggctccgacaccggctttctggacac

SEQ ID NO: 74313 - DNA, 125 bp, Homo sapiens
  misc_feature 1..125: note = chr12:132666377-132666502
  misc_feature 1..125: note = hypo
  source 1..125: mol_type = genomic DNA
ctcgtgtgcccgccacgctgtcttcctgccgctggtgaagtctgtctcccccccccccccccccgagtgatggggcgcctccgactgcccggccacggtgcctgcacctccgctcctcctctccc

SEQ ID NO: 74314 - DNA, 30 bp, Homo sapiens
  misc_feature 1..30: note = chr12:132672104-132672134
  misc_feature 1..30: note = hypo
  source 1..30: mol_type = genomic DNA
agcctcctctgcatccgaacccgccaccgg

SEQ ID NO: 74315 - DNA, 30 bp, Homo sapiens
  misc_feature 1..30: note = chr12:132675830-132675860
  misc_feature 1..30: note = hypo
  source 1..30: mol_type = genomic DNA
cagtgagctccagcacggggactggtcacc

SEQ ID NO: 74316 - DNA, 219 bp, Homo sapiens
  misc_feature 1..219: note = chr12:132677480-132677699
  misc_feature 1..219: note = hypo
  source 1..219: mol_type = genomic DNA
gctctgcgtctcggtcgcgtccgtcggactggggaggtgctctgcgtgtctcggtcgcgtccgtcggactggggaggtgctctgcgtgtctcggtcgcgtccgtcggactggggaggtgctctgcgtgtctcggtcgcgtccgtcggactggggaggttctctgcgtgtctcggtcgcgtccgtcggactggggaggtgctctgcgtctgggggttttg

SEQ ID NO: 74317 - DNA, 123 bp, Homo sapiens
  misc_feature 1..123: note = chr12:132682557-132682680
  misc_feature 1..123: note = hypo
  source 1..123: mol_type = genomic DNA
tgagcactgacaggccgtgcgagctgccttgagctgcaaacggggccctgcgcggctgccttggagcctcccaccccggggacgctgttgcgggcgggagaggaccgccgggcagggcccacg

SEQ ID NO: 74318 - DNA, 157 bp, Homo sapiens
  misc_feature 1..157: note = chr12:132683736-132683893
  misc_feature 1..157: note = hypo
  source 1..157: mol_type = genomic DNA
gcaggggtagaggatcgcccggtcgccgtcctccgctccctggtccagacagtaggcactggctttgctgtttctcacctgcaagcagaagccccaggagaaagtccagagtcacccgagggtgcggccccagggagcttcacgcagccagctctgc

SEQ ID NO: 74319 - DNA, 288 bp, Homo sapiens; identical to SEQ ID NO: 43726
  misc_feature 1..288: note = chr12:132687989-132688277
  misc_feature 1..288: note = hypo
  source 1..288: mol_type = genomic DNA

SEQ ID NO: 74320 - DNA, 198 bp, Homo sapiens
  misc_feature 1..198: note = chr12:132691172-132691370
  misc_feature 1..198: note = hypo
  source 1..198: mol_type = genomic DNA
cagagcgagactccgtctcaaaaaaaaaaaaaaaggaccaaaaccacaggcagagaggagccagtgctggtgccgctgagggaggaccgtggacctgaccgtgacccagccggcaactgggaggaggagccgagcccccacacaaggaaatggcaaatgtggagatggcggctgacctgagtgcggcacgccataccc

SEQ ID NO: 74321 - DNA, 232 bp, Homo sapiens
  misc_feature 1..232: note = chr12:132694804-132695036
  misc_feature 1..232: note = hypo
  source 1..232: mol_type = genomic DNA
tacattcaggactgacgttgtctttggcggcgctgtgggcctggcaaagggcctgcgggcgaggccgtcccgtgaagtcggacctgttcttctggtcaaggcaagcaaagcaacagggctcgtagggttctcctggaagcgctggggacatgcggccttcatcgtgaaactgtcatctagaggggaggcaggcgaggctcagacgtcacactcatcacgtgtgggtgcagct

SEQ ID NO: 74322 - DNA, 64 bp, Homo sapiens
  misc_feature 1..64: note = chr12:132699804-132699868
  misc_feature 1..64: note = hypo
  source 1..64: mol_type = genomic DNA
acaaaagtacttcctcgcacaccgagctgcaatttaccagccctcctgtcgggctgtaggcccc

SEQ ID NO: 74323 - DNA, 373 bp, Homo sapiens
  misc_feature 1..373: note = chr12:132983393-132983766
  misc_feature 1..373: note = hypo
  source 1..373: mol_type = genomic DNA
caccttcagctccgccgagaacgcccgacactcagagaccctgctctttgttaaatgggaatgagacatgacacagacgcggggcagcggccactgcagcacgggttgtccactgcccagctctggggccaaaccctcggcgtcgcgcaaaccatacctcccgcgtgacggccgtgtccggcctgctcacctgtgcgaggcagccctgcagagcaggtcaccaggccacaggagcaccagaagagaagccacgtccactgcgagggccatccggtgtcatgtccctgcctccactcagccccaggcccacagctgcagccacgcagccccgcacagcgtcaccgtctccaggatccatcggcagtgggggggg

SEQ ID NO: 74324 - DNA, 48 bp, Homo sapiens; identical to SEQ ID NO: 43730
  misc_feature 1..48: note = chr12:132985665-132985713
  misc_feature 1..48: note = hypo
  source 1..48: mol_type = genomic DNA

SEQ ID NO: 74325 - DNA, 250 bp, Homo sapiens
  misc_feature 1..250: note = chr12:132986451-132986701
  misc_feature 1..250: note = hypo
  source 1..250: mol_type = genomic DNA
acccagagctgccaccgtcctgtgggtgacggcagaacatctggctgccgggtggcctccgtaaccgccacacacctgcctctgctggaatcacctgaggctctggtgcctcacacggattggccaaaacagggagcggagccgggaaggccacggacatctgtgtggtgtcacgaacaaggtccggccacgtgtgtgggagacgcgggcgccgaggcaggcgccaaactaagcccggccaccaagggga

SEQ ID NO: 74326 - DNA, 211 bp, Homo sapiens
  misc_feature 1..211: note = chr12:132987301-132987512
  misc_feature 1..211: note = hypo
  source 1..211: mol_type = genomic DNA
cagcagctctgtccccgtgaagccacgtgtggaggaacgggggtgaggatggcaaaggacctttttgggggatgtgattcaagccgtagagaaaggaaaccccagcaatgactgagttgggatttctcaccacctagagcgtgggatcgagctctagagccgcggaggcagggatgggaaccgaactcttgtccaccgaggagcctgggag

SEQ ID NO: 74327 - DNA, 106 bp, Homo sapiens
  misc_feature 1..106: note = chr12:132988517-132988623
  misc_feature 1..106: note = hypo
  source 1..106: mol_type = genomic DNA
gaggaactgcctcctcggacagggcttggccagtcagttccactgaccagagggtctggggtattggctatgggatctgggggagtccagccgggggtcacagggt

SEQ ID NO: 74328 - DNA, 30 bp, Homo sapiens
  misc_feature 1..30: note = chr12:132993581-132993611
  misc_feature 1..30: note = hypo
  source 1..30: mol_type = genomic DNA
caacacccaggggtccgcatggagcccccc

SEQ ID NO: 74329 - DNA, 30 bp, Homo sapiens
  misc_feature 1..30: note = chr12:133000092-133000122
  misc_feature 1..30: note = hypo
  source 1..30: mol_type = genomic DNA
gggcctgggtggccacgcccctcccctgaa

SEQ ID NO: 74330 - DNA, 583 bp, Homo sapiens
  misc_feature 1..583: note = chr12:133002792-133003375
  misc_feature 1..583: note = hypo
  source 1..583: mol_type = genomic DNA
gagtctacagtcagccggctcttccagctttctgggagtgtcatattttgaaatctccttgttcactttcacgcctgctggcaggatggacaattcctgtctgggtctggctcctcaaaagatctcactggcatgtctgccgacgtgcgattttccagcctttccctagagctgcggtttcgtcaggttcatggtccaacttccaagttgccgagtccagtctgaccgagtgttccacaccgagtgtgctccggcctctgccccgccttctctctgtcctccacgtgagcaggacacgtgctccaggtgccctgtggctgcggcagcacctcatttcttggagctggtttctgcgctgtcaggattgcttggttctgctgctctaacaaacagtccccagactcagtgccttcaatggcgaaggcgtatctctcactcaggcaactgctctcacacgtcctcaggggacctgctgtttgtcctcactcagggatgcaggtggaggaatgatctgtttgacacacctttctgcgaggactcagttggccagaggagatgtggcgaaacgcgctgggcgggggag

SEQ ID NO: 74331 - DNA, 318 bp, Homo sapiens
  misc_feature 1..318: note = chr12:133019701-133020019
  misc_feature 1..318: note = hypo
  source 1..318: mol_type = genomic DNA
aacccacagtgcactgtgaatattttgtttaaacagtcaattaccttcgacggatacttcatccatttgtcaaatctcaggtatctaattcaccacgccgtggctgttccgggggctccgcgtctgtcgtcccacatctgcgctgctcctgccgggaggacacgcccgtgccccacagcgggtccgctcaccactgctctttcaggcattacctccggagacactcgttccacctttgtctctgagagatgttcttgctgacaggtttcttcttacgacgctgcccttgcgtgggttcactcgcgttgctcctcagga

SEQ ID NO: 74332 - DNA, 30 bp, Homo sapiens
  misc_feature 1..30: note = chr12:133035008-133035038
  misc_feature 1..30: note = hypo
  source 1..30: mol_type = genomic DNA
tctttgcagcatccacgagggaggtgctgc

SEQ ID NO: 74333 - DNA, 190 bp, Homo sapiens; identical to SEQ ID NO: 43736
  misc_feature 1..190: note = chr12:133035657-133035847
  misc_feature 1..190: note = hypo
  source 1..190: mol_type = genomic DNA

SEQ ID NO: 74334 - DNA, 30 bp, Homo sapiens
  misc_feature 1..30: note = chr12:133036250-133036280
  misc_feature 1..30: note = hypo
  source 1..30: mol_type = genomic DNA
agcagtggggagggtcgggggggcatccag

SEQ ID NO: 74335 - DNA, 92 bp, Homo sapiens
  misc_feature 1..92: note = chr12:133056788-133056880
  misc_feature 1..92: note = hypo
  source 1..92: mol_type = genomic DNA
gcaccccagaacacacgcccgtatcttggtgcgctccaaagctcacacttgctgaaaaaataaggttccgagtgtggcggcagggggccacc

SEQ ID NO: 74336 - DNA, 30 bp, Homo sapiens
  misc_feature 1..30: note = chr12:133058946-133058976
  misc_feature 1..30: note = hypo
  source 1..30: mol_type = genomic DNA
cagccccctcatgtccggtcccattggcac

SEQ ID NO: 74337 - DNA, 244 bp, Homo sapiens
  misc_feature 1..244: note = chr12:133060744-133060988
  misc_feature 1..244: note = hypo
  source 1..244: mol_type = genomic DNA
agccctgcctgaagccggggcctgtcaggaaccccacggggtacggggtgctgcctgaatccagccctgcctgaagccggggcatgtcgggaaccccagcgggtacggggtgctgcctgaatccagccctgcctgaagccagggcgtgtcgggaaccccagcgggtacggggtgctgcctgaatccagccctgcctgaagccggggcctgtcaggaaccccacggggtacggggtgctgcctga

SEQ ID NO: 74338 - DNA, 179 bp, Homo sapiens
  misc_feature 1..179: note = chr12:133098374-133098553
  misc_feature 1..179: note = hypo
  source 1..179: mol_type = genomic DNA
ccattgcacattccccgggagggcaccttctgctcagtttgcacaagaggacacgggggctggtgtggggcctcttgggtgctccactttgggcggggcctgcgcaggacagtgcgtgcttagagccttggggcgggtctggggagcaggtggggcgatgagtccgtgtgcatggggtg

SEQ ID NO: 74339 - DNA, 80 bp, Homo sapiens
  misc_feature 1..80: note = chr12:133100375-133100455
  misc_feature 1..80: note = hypo
  source 1..80: mol_type = genomic DNA
gcaggctctgggagacgatgatgcattcccgggaccccgcgttgagaaccgctaggagtgggacacgtggcttcctgcag

SEQ ID NO: 74340 - DNA, 264 bp, Homo sapiens
  misc_feature 1..264: note = chr12:133100756-133101020
  misc_feature 1..264: note = hypo
  source 1..264: mol_type = genomic DNA
agtgccaggaagagccgggcagcctggccagggcctgtgagggctactgtgcagctgagcaggtcactagcccaccaccctgcccccggctcccgcccagtaaggctcagactcctcggggctgcatccctgcccggccagggcctcctccagtgtgggtgcctgctactgtgcggcttgatggacctcatgggccgggggcatttgacctcaggggcctgggtgacatcccttaattcgcactggcaccgtctgccttgtgtg

SEQ ID NO: 74341 - DNA, 30 bp, Homo sapiens
  misc_feature 1..30: note = chr12:133101497-133101527
  misc_feature 1..30: note = hypo
  source 1..30: mol_type = genomic DNA
ctctgttttctcatccgtgaaatgtaaagg

SEQ ID NO: 74342 - DNA, 40 bp, Homo sapiens
  misc_feature 1..40: note = chr12:133122176-133122216
  misc_feature 1..40: note = hypo
  source 1..40: mol_type = genomic DNA
cagacctgaaacccacggggagatccgtaaccaggtccgg

SEQ ID NO: 74343 - DNA, 93 bp, Homo sapiens
  misc_feature 1..93: note = chr12:133130872-133130965
  misc_feature 1..93: note = hypo
  source 1..93: mol_type = genomic DNA
gtgccgcccctgcctcggaagcctcgagggcaacctgcaccctcaggaggcccagctgggggcgtcactgcagggcaccggcagaaactgggg

SEQ ID NO: 74344 - DNA, 30 bp, Homo sapiens
  misc_feature 1..30: note = chr12:133161681-133161711
  misc_feature 1..30: note = hypo
  source 1..30: mol_type = genomic DNA
tcagccacatttccacggtggaccctgttt

SEQ ID NO: 74345 - DNA, 30 bp, Homo sapiens; identical to SEQ ID NO: 43741
  misc_feature 1..30: note = chr12:133167902-133167932
  misc_feature 1..30: note = hypo
  source 1..30: mol_type = genomic DNA

SEQ ID NO: 74346 - DNA, 95 bp, Homo sapiens
  misc_feature 1..95: note = chr12:133168198-133168293
  misc_feature 1..95: note = hypo
  source 1..95: mol_type = genomic DNA
ctctttcccctcaaacgttccctgcacgcatcaattacatcagcgcagctgggccttcccctgagcgtgatgtccaggggcgaggccagtggctt

SEQ ID NO: 74347 - DNA, 30 bp, Homo sapiens
  misc_feature 1..30: note = chr12:133168945-133168975
  misc_feature 1..30: note = hypo
  source 1..30: mol_type = genomic DNA
ccggggccgcccacccggcacagcgcctgc

SEQ ID NO: 74348 - DNA, 256 bp, Homo sapiens; identical to SEQ ID NO: 43742
  misc_feature 1..256: note = chr12:133169847-133170103
  misc_feature 1..256: note = hypo
  source 1..256: mol_type = genomic DNA

SEQ ID NO: 74349 - DNA, 30 bp, Homo sapiens
  misc_feature 1..30: note = chr12:133172661-133172691
  misc_feature 1..30: note = hypo
  source 1..30: mol_type = genomic DNA
gcccggagcactcagcgctggcatcatcct

SEQ ID NO: 74350 - DNA, 24 bp, Homo sapiens
  misc_feature 1..24: note = chr12:133174537-133174561
  misc_feature 1..24: note = hyper
  source 1..24: mol_type = genomic DNA
cgcctcctctccgcgcgcccctcc

SEQ ID NO: 74351 - DNA, 87 bp, Homo sapiens
  misc_feature 1..87: note = chr12:133175277-133175364
  misc_feature 1..87: note = hyper
  source 1..87: mol_type = genomic DNA
cagtcaggatgcaggaggtttccaagtttgcatcctcactgttgctcttcctgctctgagaaaccctcctagcgaccaggctgactg

SEQ ID NO: 74352 - DNA, 30 bp, Homo sapiens
  misc_feature 1..30: note = chr12:133178414-133178444
  misc_feature 1..30: note = hypo
  source 1..30: mol_type = genomic DNA
ggaggctgtgtctgtcgcccacacacgccc

SEQ ID NO: 74353 - DNA, 170 bp, Homo sapiens
  misc_feature 1..170: note = chr12:133187664-133187834
  misc_feature 1..170: note = hypo
  source 1..170: mol_type = genomic DNA
gcgtcgttaggggcacgacggaggtgccagggggacaccgcacagcagggatgccagggagacttcacagagacacctgcaggacacctgctgccaggagcacggcccagtggggatgggagagcgaggagagcgccgggcacggggaggaggggcggggcacggcccag

SEQ ID NO: 74354 - DNA, 136 bp, Homo sapiens
  misc_feature 1..136: note = chr12:133188323-133188459
  misc_feature 1..136: note = hypo
  source 1..136: mol_type = genomic DNA
atgacttgtgatggtcgctgtgtctgtgggttgactgtgctcagctgggcggttctcacacgtgttgcttaggcatcagctttcaggtagtttgactgtgctcagctgggcggttctcacacgtgttgcttaggca

SEQ ID NO: 74355 - DNA, 208 bp, Homo sapiens
  misc_feature 1..208: note = chr12:133194853-133195061
  misc_feature 1..208: note = hyper
  source 1..208: mol_type = genomic DNA
ttgcaaagaagaaaacggatcggccgtggatccctctccagctcgagggctggagctgcggcggaggcaggagctggaagcgaggcgtctgctggcaaaggcgggagtgcaggttgcgctcgaagccccggcagccgcggcaggaaccggcctggacggggtggggggcgccgcggaggccggcgggacttcccatgtctttctcctc

SEQ ID NO: 74356 - DNA, 167 bp, Homo sapiens; identical to SEQ ID NO: 34775
  misc_feature 1..167: note = chr12:133195062-133195229
  misc_feature 1..167: note = hyper
  source 1..167: mol_type = genomic DNA

SEQ ID NO: 74357 - DNA, 200 bp, Homo sapiens
  misc_feature 1..200: note = chr12:133195428-133195628
  misc_feature 1..200: note = hyper
  source 1..200: mol_type = genomic DNA
cgccggggcgaccgcccggcgcctggcccggggctgctggtccgccctctgggactacgagacgcccaaggtgatcgtggtgaggaaccggcgcctgggggtcctgtaccgcgccgtgcagctgctcatcctgctctacttcgtgtggtgcgcggggcgcggggtgcggggcgcggggtgcggggcgcaggggaggggct

SEQ ID NO: 74358 - DNA, 62 bp, Homo sapiens
  misc_feature 1..62: note = chr12:133195878-133195940
  misc_feature 1..62: note = hyper
  source 1..62: mol_type = genomic DNA
ggctggggctgggaccgagggcgcggggcaggccccaagagccccgcagagcggacccgggt

SEQ ID NO: 74359 - DNA, 19 bp, Homo sapiens
  misc_feature 1..19: note = chr12:133195965-133195984
  misc_feature 1..19: note = hyper
  source 1..19: mol_type = genomic DNA
cgggcgggactcagccttc

SEQ ID NO: 74360 - DNA, 49 bp, Homo sapiens
  misc_feature 1..49: note = chr12:133199652-133199701
  misc_feature 1..49: note = hypo
  source 1..49: mol_type = genomic DNA
ccaaaggtcaaagagcggagaagggcgggtaagacgaccctggtctgac

SEQ ID NO: 74361 - DNA, 89 bp, Homo sapiens
  misc_feature 1..89: note = chr12:133200001-133200090
  misc_feature 1..89: note = hypo
  source 1..89: mol_type = genomic DNA
acccaggctgactggcgcccacggctgcaccgggcgacccctggtcctgctaggtggccttcctgggggacgagcggctgtcccctggc

SEQ ID NO: 74362 - DNA, 34 bp, Homo sapiens
  misc_feature 1..34: note = chr12:133262748-133262782
  misc_feature 1..34: note = hypo
  source 1..34: mol_type = genomic DNA
caccgcgccgggcctcatccgttttctgcttatg

SEQ ID NO: 74363 - DNA, 30 bp, Homo sapiens
  misc_feature 1..30: note = chr12:133295960-133295990
  misc_feature 1..30: note = hypo
  source 1..30: mol_type = genomic DNA
cagctcccagaaagtcgaggatgtacgggc

SEQ ID NO: 74364 - DNA, 24 bp, Homo sapiens
  misc_feature 1..24: note = chr12:133334005-133334029
  misc_feature 1..24: note = hypo
  source 1..24: mol_type = genomic DNA
cacctgtcaccccagcgcttgggg

SEQ ID NO: 74365 - DNA, 363 bp, Homo sapiens
  misc_feature 1..363: note = chr12:133428083-133428446
  misc_feature 1..363: note = hypo
  source 1..363: mol_type = genomic DNA
atggaaaaaaagaaacggcatccttacttcacaggttaccctaaggccaacaccgctttgaaacctgacccctgaaggacagataggaacccgcctgcgtgcggtggcgcgggcactcacactgctgaggggcgacacgcgggtcctgctcgcgctccgctctccggtcgggcatgggctggaagcagcaggtgcacagggcgtggcttccttgcagagggcacacgtaatcctggactgctgaagcacacgcacattcagccggagcacgtgggacccagggcagaaagacagcaggttagagaggccgccgggaagcacagcgaggagaggtgcacctgagacagccggggaagaagcaga

SEQ ID NO: 74366 - DNA, 40 bp, Homo sapiens
  misc_feature 1..40: note = chr12:133453650-133453690
  misc_feature 1..40: note = hypo
  source 1..40: mol_type = genomic DNA
gattacaggtgtgagccaccgcgcccgggctgataataat

SEQ ID NO: 74367 - DNA, 85 bp, Homo sapiens
  misc_feature 1..85: note = chr12:133463015-133463100
  misc_feature 1..85: note = hypo
  source 1..85: mol_type = genomic DNA
tttagagtataatgtcggagctaattcattaattttcagacaaactaaacatttttgttgacaggaccagcgcatttctctcccc

SEQ ID NO: 74368 - DNA, 402 bp, Homo sapiens
  misc_feature 1..402: note = chr12:133463573-133463975
  misc_feature 1..402: note = hyper
  source 1..402: mol_type = genomic DNA
cttatacagttgtaacgaaggctaaatgatgtgcgtgaatcatgcgcaagaatcggtgggcagaacaccgaataaataccagttcttacatgacatttcactccacggaaaaatctggagcgcacactgcaccgccgcccgtgtggcctgcccgcaacccggtggctctgcccggccccggcccccggccccggcctcagccccgcacctcgtctccgcccgatggtccactcccgcttcctcaggaggacgtgcggctcgccctcctccgcgcccagacgcaggagccgtccccagggctgcggcggcggcgactgcttgccttcctcgggccgctccatcgggattcacatctgcggagaccccggaaacgcccatggagactcccgaccccagaggccg

SEQ ID NO: 74369 - DNA, 152 bp, Homo sapiens
  misc_feature 1..152: note = chr12:133464403-133464555
  misc_feature 1..152: note = hyper
  source 1..152: mol_type = genomic DNA
ttggggcagaagggacggggaacttccggattggaagccccaaggattctgagagccccgctaatctggggatgactcctaggagtagaagacggtccatcttagttgtcacgaggtagtgcacgtggggaccctttcgggtacagttgcac

SEQ ID NO: 74370 - DNA, 147 bp, Homo sapiens
  misc_feature 1..147: note = chr12:133464773-133464920
  misc_feature 1..147: note = hyper
  source 1..147: mol_type = genomic DNA
ctgaaagtgaaaggtcggcgaaagaggagtaaagacggcgagacgcgtccacgcagggggagtctgtgcggtttggaggaacgcgccaatgtctgcactcatgaggagcccccaagggcggttttaagagggtgaagcaggaccggg

SEQ ID NO: 74371 - DNA, 15 bp, Homo sapiens
  misc_feature 1..15: note = chr12:133481368-133481383
  misc_feature 1..15: note = hyper
  source 1..15: mol_type = genomic DNA
gaagcttttcctcac

SEQ ID NO: 74372 - DNA, 31 bp, Homo sapiens; identical to SEQ ID NO: 1080
  misc_feature 1..31: note = chr12:133481489-133481520
  misc_feature 1..31: note = hyper
  source 1..31: mol_type = genomic DNA

SEQ ID NO: 74373 - DNA, 134 bp, Homo sapiens; identical to SEQ ID NO: 1081
  misc_feature 1..134: note = chr12:133481521-133481655
  misc_feature 1..134: note = hyper
  source 1..134: mol_type = genomic DNA

SEQ ID NO: 74374 - DNA, 34 bp, Homo sapiens
  misc_feature 1..34: note = chr12:133483182-133483216
  misc_feature 1..34: note = hypo
  source 1..34: mol_type = genomic DNA
gattgttattattgccgagtgtggtggctcgtgc

SEQ ID NO: 74375 - DNA, 267 bp, Homo sapiens
  misc_feature 1..267: note = chr12:133484586-133484853
  misc_feature 1..267: note = hyper
  source 1..267: mol_type = genomic DNA
cgcccggcctcagacgtttttctctaggtaaagccgcgggatgaaccagcccctgtggaaatttagaagtaacgacgtccgtcaatttctgtatgaaaaatatacagatcgtgtgacacgtcttctgggaatgaaagtctgctaaactcgccgtcacgagtagatgaacacatttaaagtttgtagttaagaggaaaacaacgccaacgacacaaatgccccaagcgctggatgaagcagcgacctaggatggggctggcctggaac

SEQ ID NO: 74376 - DNA, 187 bp, Homo sapiens; identical to SEQ ID NO: 1082
  misc_feature 1..187: note = chr12:133485161-133485348
  misc_feature 1..187: note = hyper
  source 1..187: mol_type = genomic DNA

SEQ ID NO: 74377 - DNA, 251 bp, Homo sapiens; identical to SEQ ID NO: 1083
  misc_feature 1..251: note = chr12:133485439-133485690
  misc_feature 1..251: note = hyper
  source 1..251: mol_type = genomic DNA

SEQ ID NO: 74378 - DNA, 55 bp, Homo sapiens
  misc_feature 1..55: note = chr12:133485815-133485870
  misc_feature 1..55: note = hyper
  source 1..55: mol_type = genomic DNA
cgtcatctggggtcttacgtgtcagtgatgtggggtctgccgggtcagtgagggg

SEQ ID NO: 74379 - DNA, 91 bp, Homo sapiens
  misc_feature 1..91: note = chr12:133705743-133705834
  misc_feature 1..91: note = hypo
  source 1..91: mol_type = genomic DNA
atctaaaacagaatacgaactaaaaaacctaatcaatgagactttttaaaaaattgagtcagggccgggtgcggtggctcacgcttgtaat

SEQ ID NO: 74380 - DNA, 231 bp, Homo sapiens
  misc_feature 1..231: note = chr12:133757970-133758201
  misc_feature 1..231: note = hyper
  source 1..231: mol_type = genomic DNA
ccggtggcccttggccggagccctccggcgcgggagtaactcctcgcagaggcctctgggagttgtagtttttttgcctttgcctctccatgacgcaattcctgtgcgacatacgtagcggccgccattgttccgcgccgatggcgagatccttgttcctcagatagcgttcatcgcccgtcgtggtcaacgggccagccgagtctggagtggttgcgaacccttctggct

SEQ ID NO: 74381 - DNA, 49 bp, Homo sapiens
  misc_feature 1..49: note = chr12:133758523-133758572
  misc_feature 1..49: note = hyper
  source 1..49: mol_type = genomic DNA
tcttctagcatccctcgcgtcctgtcacttccagcgaggcacacaaaac

SEQ ID NO: 74382 - DNA, 30 bp, Homo sapiens
  misc_feature 1..30: note = chr12:133808200-133808230
  misc_feature 1..30: note = hypo
  source 1..30: mol_type = genomic DNA
ctcctggctgcctcccggcacctggcaccc

SEQ ID NO: 74383 - DNA, 128 bp, Homo sapiens
  misc_feature 1..128: note = chr12:13431237-13431365
  misc_feature 1..128: note = hyper
  source 1..128: mol_type = genomic DNA
tcgattttgaagctccgcagagagtgcctccagcggccgccaggggtcgcagtcgagcagctggcgccgcctctgtgcaggggagcaggggccgctggccgggaatcgcaagccggtctcctgtacat

SEQ ID NO: 74384 - DNA, 32 bp, Homo sapiens
  misc_feature 1..32: note = chr12:13519032-13519064
  misc_feature 1..32: note = hypo
  source 1..32: mol_type = genomic DNA
acatcttgtagcggtcgcgggtctgacacaca

SEQ ID NO: 74385 - DNA, 60 bp, Homo sapiens
  misc_feature 1..60: note = chr12:13716048-13716108
  misc_feature 1..60: note = hypo
  source 1..60: mol_type = genomic DNA
tgctgagcatgtacccgccgccggggttgttgtggtggtgatgtccggcagtgggcactg

SEQ ID NO: 74386 - DNA, 114 bp, Homo sapiens
  misc_feature 1..114: note = chr12:13716358-13716472
  misc_feature 1..114: note = hypo
  source 1..114: mol_type = genomic DNA
cgccactggggcagccggctggtccagttcctgcagggagttgtcctcactgatgtcatacaggttgcctgctttcttgcaagcctcacaccggatgcacgcctgcctgcccga

SEQ ID NO: 74387 - DNA, 2142 bp, Homo sapiens
  misc_feature 1..2142: note = chr12:14133113-14135255
  misc_feature 1..2142: note = hyper
  source 1..2142: mol_type = genomic DNA
ccagagtaattattccgtgtgcatgtgaggttagtggctggaatagatttttaacgcttcttctggcaattacggtttttggtttttggagcgttagtggaggaggctctgtgtggagaagctgggggccggctccgtccctcggtggagcatggtcattcccaaagcgtccccttcctaagggggaaaaagaggcggtcagggcttgattcgcgtgtcccccggagggtgagaaaaatgcattccgaaaaagatatcaattcgttttaaggaaaggggggaggaaaccccgcatttcccacagagtgcacacgagaggaattgaaaacagctggtaccggtctataaataattcagaaaaggtctggctataccattcctgggacaggcacggatgagaggtgggaaagccaacctgaatggaagaggagagagggagggagcgagcgaaggagggaagtgggaaggaaggaggaagggggggagaagcggcaccatacagcaacacacactcacacacacgcagaaacacaattcccacttaactcgccagcgagtgcggcccccagccccatctgcattgctgctgacttgtctcgctcgctctccccatcgcctccagcagcagcgccgcctcccaccccgggcttgtgctgaatgggttctgattgtgcacggggtgcacactgggcatttcttggaaggggcacactgacgcgcgcacacacgcccccgacgcgcacgcgccccgcgcgcactcacactcacccccgcgcacactcacccccgcgcacactcacgctgccgccgcgctgaggtgcagcgcacggggcttcacctgcaacgtgtcgattggacggatgggctcggcgcgtgggtccggcccggggcgccgctgccctgcccctctgctaggtgaagggatgaaaccccccaaaagaccagagacagccctacccagtcacagcaccccctcccccacaaaaaaaaaaaacctttaaaaaagccacgtccaaattagcaagtgccgggttctgctggatttcagagctttacctcatgccagattcgttcacgatttcacggcttcgaccctttatctgcctgacacccccaaacccctacattcaaaggagagactccaaagcccatctttacgtaccggctccgagcgcctccgcggttgcagtctgcggagaggggtggccggtggctgggaatggagggttttcctttcctgcaaagcaggattaatgatccgtctcgggggttttgaagttcatgactcttctttgcaaggcaaaaggatatgcattcggacgccagcactactggatggtggtgatcaagaatcacccttgacgagcactctcgatagagcgaagccccgagatttcctagaggtgaagaagccggaggaagtggtttttgaaagggggtggggggaaccttcctttctcaaaaagaggtggggggtggagaggcaggagcccagattccagttggtgaggatcggagccgggggaagggaagcgggcgggggcaggctgtgcaagtcaaccgcgcggcagccggagagggagagcaggaggggaggaggggagcgtcagaaaaatgggtattaatcaccggggacggggggaggcgcggggaacgcaggttgcctggtctggatttgggtctcacactcaaaaacgtgccgcgcacacacacacagacacacacacaccccctacctcgcacaccctgactccggggggaggagaaacccacgaagctggggaagatactgcttctgctcccaggggcgggtgtgagcgcgcgtgtcctctttctccacaccccccaccccaccccacccccaagcccctgcaccccctcactcctcttgctaagactctggcggaggcagcttcccacgtcatgtgctggggaagtggggtggtaaggtggatggaagggggacggaagggggaagaagcttagcccgagtccgtggcgcctcctcccggccgcagcggggaacagcaccgacggagagcggctgaggggcgaggggagctagacagtgccccccgtgggcggcccgcgggctgcggaaagcatctccaaggcggagctgtagttcgaaattgaagaccc

SEQ ID NO: 74388 - DNA, 41 bp, Homo sapiens
  misc_feature 1..41: note = chr12:14720466-14720507
  misc_feature 1..41: note = hyper
  source 1..41: mol_type = genomic DNA
tcctaggagcctccccgggcgccccccgcccagggcgcgct

SEQ ID NO: 74389 - DNA, 36 bp, Homo sapiens; identical to SEQ ID NO: 43396
  misc_feature 1..36: note = chr12:14817857-14817893
  misc_feature 1..36: note = hypo
  source 1..36: mol_type = genomic DNA

SEQ ID NO: 74390 - DNA, 18 bp, Homo sapiens
  misc_feature 1..18: note = chr12:14905519-14905537
  misc_feature 1..18: note = hypo
  source 1..18: mol_type = genomic DNA
aaaaaaaaagctggccgg

SEQ ID NO: 74391 - DNA, 30 bp, Homo sapiens; identical to SEQ ID NO: 43398
  misc_feature 1..30: note = chr12:14926203-14926233
  misc_feature 1..30: note = hypo
  source 1..30: mol_type = genomic DNA

SEQ ID NO: 74392 - DNA, 1175 bp, Homo sapiens
  misc_feature 1..1175: note = chr12:14927036-14928211
  misc_feature 1..1175: note = hyper
  source 1..1175: mol_type = genomic DNA
ttttcttatttcctacgagtttatgtgcttggaagcgagcgtggtcgtggaaaacccgtaaccgctaaattcatctgggtccccaaagactgagccggctggcctcgttatttatgtgagcggctatgtaaatgaggattcggagattgctctattgattggagagagctggaggaggcggtctctcttccagagcgctagttgggagcggagcctgcctgtcattggtcaccagagccaatggaaaggggctgccgcgcggccgtaaagagtttgtagaggcagttcgggtgcggtacgttgcattccggtaccggacgccgagagcggtttgtctccgtctctggagttgtaggcgagaggtgatcatgtccggtcgcgggaaacagggcggcaaagtgcgagcaaaggccaaatcccgctcctcccgcgcgggcctgcagttcccggtgggccgagtgcacagactgctgcgcaaagggaactacgcggagcgagtgggcgccggggcgccggtgtacctggcggcggtgttggagtaccttacggcggagatcctggagctggctggcaacgccgcgcgtgacaacaagaagaccaggataattccccgccacctgcagctcgccatccgcaacgacgaggagttaaacaagctgctgggcaaagtgaccatcgctcagggcggcgtcctgcccaacatccaggccgtgctgctgcccaagaagacggagagtcagaagacgaagagcaaatgaccctgacgccgccctcagggagctggctcccccagcaaaggcccttttcatggtcgtcccgcaatgcttttgaatgtgctggatgtcatggagggccggtgacatctagcggggaggtgggcggcgagggtcccggcgggagccaataaagttggtgaaaatcgtttggtcgagagagctgtgtagtcgcggggacatgtcggatggccccaggggaggggggcgaccgggaaacccctggagcaggcactggtgggtgggcttgagccactctggacggctttagtccgcaggtcaccctcgaggcgtcaggggagggtggcctggaggtgggcagggtggaagccacctcgctgtcagtagggcaaaggggaggcagagtcggtgcggtgaggcctccttcggaattatttttac

SEQ ID NO: 74393 - DNA, 172 bp, Homo sapiens
  misc_feature 1..172: note = chr12:14929885-14930057
  misc_feature 1..172: note = hypo
  source 1..172: mol_type = genomic DNA
aacatagacaagatacgaggcattgtaactgccctgtcgccacccgcctctcccaccactacccaaaggattcttagcatcccctcacatactctgcctgcctcaacgttcagtcagcccctcaccatttttgtttttgagagttttttttttaacccgaatagtttacggg

SEQ ID NO: 74394 - DNA, 30 bp, Homo sapiens
  misc_feature 1..30: note = chr12:14930753-14930783
  misc_feature 1..30: note = hypo
  source 1..30: mol_type = genomic DNA
atgtaaagtgagtagcggtagttgatggga

SEQ ID NO: 74395 - DNA, 107 bp, Homo sapiens
  misc_feature 1..107: note = chr12:15037662-15037769
  misc_feature 1..107: note = hyper
  source 1..107: mol_type = genomic DNA
tttctaagagggttccgaaagcctcttaagaacctgtgttaaattggcagccacagaaaccactagctccagctgacagctcaccctgggcacgatgccagttcaga

SEQ ID NO: 74396 - DNA, 448 bp, Homo sapiens
  misc_feature 1..448: note = chr12:15374143-15374591
  misc_feature 1..448: note = hyper
  source 1..448: mol_type = genomic DNA
aggccaggagagctacggtcctctgcaagttcggaatgggtcccccaagatcgcgaagccctcccacactgcgcagcccaggcttcaggttgcgtttgcgagttgctgggctgcggtcgtgggtgggactcgccgcagaagcaagtgccagtggcccggcgggggtctcctcactcgcgctcgctccgactagcggcggagggactgcggcaggacgcgagctgagcccggccaaggccgctgcgctcagcggccaggatgctgcagtgcggcgcttcggcgccccctactgggggcaggggcaggctcctcccgccgcgctgcctcccaggcttgcgagcttgggtctttaacgtgctgcacccaagacgggcttccctttttcactggttatttccaagcctccaggctcccaccgaagggcggctttcctcggtcaaaaccttgc

SEQ ID NO: 74397 - DNA, 73 bp, Homo sapiens
  misc_feature 1..73: note = chr12:15475263-15475336
  misc_feature 1..73: note = hyper
  source 1..73: mol_type = genomic DNA
tgtcattttatgggtcggcagccagagtgagagtgtccctgctgccagaggactacggcgggctgggcgcggg

SEQ ID NO: 74398 - DNA, 291 bp, Homo sapiens
  misc_feature 1..291: note = chr12:15475751-15476042
  misc_feature 1..291: note = hyper
  source 1..291: mol_type = genomic DNA
acccctttttcccagcggtccgggcggcagccgcgctccggcgccctcgctctgccgttgggagcggcgcgccccagggcacgatggcccagccgcgggaagcgcctgccgtgcagcctgggcgcacgctttgttgtcctcgcgtgtgcgtgttcctggtggtcttgagaggtagggggcggggggaagaataagggaagtttgctccctccggctttcgccctttgtgctcttttatcgctgctgaaatccacatcaaaggtgggcttgttggatcgtgctttctcaggc

SEQ ID NO: 74399 - DNA, 637 bp, Homo sapiens
  misc_feature 1..637: note = chr12:1639018-1639655
  misc_feature 1..637: note = hyper
  source 1..637: mol_type = genomic DNA
ggattcaaaggaggacgcgtagcaagaaagcggaggacataactctcttcccctctcagagcctcgggccccgcagacgccgaggtgggcgctcgtgccaggatcgcggggcgcgggtacgggctccttgggcgccccgagggggctgctggccggggtaagagccgcggtttcttcggaggatcgggtcgagttccaggagaagggggcagcaggcgtgcggcgccgggagaagggggccgggcggcggagactccccgtccgcacccccgcggcgaggcccccgggccgctctgcttaggggccgagggagccgggcgggaggcaggtgcggaggtcgcggtcccagcgcctgggaggagccctcgggagggtgtcgcggcccggctggtgggcaggagcgagccggggccggcgcggctgtcgggggcggggaggaggcgcgggaggcggggcggaggcggcggcgcccccaggatccactcgcccagcgccgggccctgcactccgagccgcggccgccacccgccccgcagccaacttgggccgaaacttccccgggtcccgcgctccggagcagggcgcgcagcccggcgagatcgacggcggcctcccgagcccgcgcctcgggcccagg

SEQ ID NO: 74400 - DNA, 83 bp, Homo sapiens
  misc_feature 1..83: note = chr12:1639894-1639977
  misc_feature 1..83: note = hyper
  source 1..83: mol_type = genomic DNA
gccccgcgccccggccgcggatgaagagtcggaggcggcggcccgagcggcccgcgcgctgagaggagcgggcagggtctgcc

SEQ ID NO: 74401 - DNA, 155 bp, Homo sapiens
  misc_feature 1..155: note = chr12:1640321-1640476
  misc_feature 1..155: note = hyper
  source 1..155: mol_type = genomic DNA
aaagctggggaccgccgggccctcgcgcgggcaggcataggaggctccggggtcggcggcgcaggcggggcggcctctgagcttcgcgctcactctcccgggtctggtcgggcccagccccgaccctccgccgaggtctgcgccggcatcgagga

SEQ ID NO: 74402 - DNA, 103 bp, Homo sapiens
  misc_feature 1..103: note = chr12:16500483-16500586
  misc_feature 1..103: note = hyper
  source 1..103: mol_type = genomic DNA
tggcgaggttggggtcgggctttaaacgtgggagggctaattaacaggagattaactggagaggggcggtgcctgcgtccggcccgcgcggccacagtccctg

SEQ ID NO: 74403 - DNA, 38 bp, Homo sapiens
  misc_feature 1..38: note = chr12:1650724-1650762
  misc_feature 1..38: note = hypo
  source 1..38: mol_type = genomic DNA
gcaacaggtgctggctcaaccctcgccccaaaacctca

SEQ ID NO: 74404 - DNA, 76 bp, Homo sapiens; identical to SEQ ID NO: 43309
  misc_feature 1..76: note = chr12:1651130-1651206
  misc_feature 1..76: note = hypo
  source 1..76: mol_type = genomic DNA

SEQ ID NO: 74405 - DNA, 175 bp, Homo sapiens
  misc_feature 1..175: note = chr12:16757916-16758091
  misc_feature 1..175: note = hyper
  source 1..175: mol_type = genomic DNA
agtgtggacctggtgcgcagcctacaccgccgaggaccgactattgtgaagccactttgggagcgggtcggagtggcggcagggggtgggggaagggatgaggacggccagacaagacagggcgcacacacggagcccctcgcagtgtgcaaaatgatggcgaatgacaaagcca

SEQ ID NO: 74406 - DNA, 30 bp, Homo sapiens; identical to SEQ ID NO: 34260
  misc_feature 1..30: note = chr12:16758398-16758428
  misc_feature 1..30: note = hyper
  source 1..30: mol_type = genomic DNA

SEQ ID NO: 74407 - DNA, 40 bp, Homo sapiens
  misc_feature 1..40: note = chr12:16758692-16758732
  misc_feature 1..40: note = hyper
  source 1..40: mol_type = genomic DNA
gagtcgtacttgagacgttccgcgccgcagccgctctccc

SEQ ID NO: 74408 - DNA, 160 bp, Homo sapiens
  misc_feature 1..160: note = chr12:1716717-1716877
  misc_feature 1..160: note = hypo
  source 1..160: mol_type = genomic DNA
actttctcagggtcacgggaacaattcaggttgaacgcatctctcctccgacatgccgagcgtctttgagtctcctcacccaggcgcacactcaggattgcagtcatctgctattgttgcctttatttattttgagacggagtctcgctcttgtcaccca

SEQ ID NO: 74409 - DNA, 41 bp, Homo sapiens
  misc_feature 1..41: note = chr12:1738826-1738867
  misc_feature 1..41: note = hyper
  source 1..41: mol_type = genomic DNA
ctcgtcctccctactcgggacctggtcgcctcccctccata

SEQ ID NO: 74410 - DNA, 186 bp, Homo sapiens
  misc_feature 1..186: note = chr12:1739589-1739775
  misc_feature 1..186: note = hyper
  source 1..186: mol_type = genomic DNA
caggaggccaagaggcgggaggcccgggagccagcagggaagggctgtggcatctggaagatgcgtcctcagctcaggcatttgatgccagagctgccgcctggcgtcggcagtgtccccggtgcagctgctgggcaaggtactcggtgccgccctcgaggaccacggtgccgggaggggcagggg

SEQ ID NO: 74411 - DNA, 66 bp, Homo sapiens
  misc_feature 1..66: note = chr12:1762161-1762227
  misc_feature 1..66: note = hyper
  source 1..66: mol_type = genomic DNA
gtgaccacacagtgtcgctatcttctcagttctagccgaatagctctggcccgcaccttggttcaa

SEQ ID NO: 74412 - DNA, 82 bp, Homo sapiens; identical to SEQ ID NO: 43400
  misc_feature 1..82: note = chr12:17629461-17629543
  misc_feature 1..82: note = hypo
  source 1..82: mol_type = genomic DNA

SEQ ID NO: 74413 - DNA, 56 bp, Homo sapiens
  misc_feature 1..56: note = chr12:1905770-1905826
  misc_feature 1..56: note = hyper
  source 1..56: mol_type = genomic DNA
acgctgcacagaacccggggtgaaacccgcgcagcacgacgcgcagggagtggggg

SEQ ID NO: 74414 - DNA, 292 bp, Homo sapiens
  misc_feature 1..292: note = chr12:1906030-1906322
  misc_feature 1..292: note = hyper
  source 1..292: mol_type = genomic DNA
tccccggggccagggcgggttataactagcggcttccacacagcaggaagcctgacagaggctgcccgcggggctcccagcgacccgaggacatcgcacacttccggccttctcttctcacactccctctgccttccaagttctccccacgcagctcaggcgcgggcactggcaccgccctgggcaccgcctgagcagggctgggggagacccgccgaagggcccactcgcccagagacgccgtggggtcacggctgcggcctcggcggggtgggctcgacacacagggtca

SEQ ID NO: 74415 - DNA, 30 bp, Homo sapiens
  misc_feature 1..30: note = chr12:1911756-1911786
  misc_feature 1..30: note = hypo
  source 1..30: mol_type = genomic DNA
tttggtgttggatttcgactttaatgtagg

SEQ ID NO: 74416 - DNA, 122 bp, Homo sapiens
  misc_feature 1..122: note = chr12:1914195-1914317
  misc_feature 1..122: note = hypo
  source 1..122: mol_type = genomic DNA
gagccccagaccgcccgtggagtggcacccaaagcatagcacgatgcaggggcctgaccaccccagcccccctttcatgggggacaattcacaaataagcagtggcccgtgggctgcctgaa

SEQ ID NO: 74417 - DNA, 222 bp, Homo sapiens
  misc_feature 1..222: note = chr12:19283203-19283425
  misc_feature 1..222: note = hyper
  source 1..222: mol_type = genomic DNA
caggtagaggggccacggggactccgccgccgggagttctctccagtctcggggcgcctctttctcctcagcctttcatcagcacttggagacggcgccctcttcctgcgccttctccccccatcccagcctagacgaccctcgcgaccctagagtggcgacgctcccctccctgaaacctggagtcctgagtttttcctccgcggccgctactcactcccc

SEQ ID NO: 74418 - DNA, 109 bp, Homo sapiens
  misc_feature 1..109: note = chr12:19283674-19283783
  misc_feature 1..109: note = hyper
  source 1..109: mol_type = genomic DNA
gaacggctcgggaaacgcttggcgcgttccctcctgccacgggaggagcagccggagccggaggaggcgttcgcagcctcagttgctggcgatccggatctaaagtccc

SEQ ID NO: 74419 - DNA, 71 bp, Homo sapiens
  misc_feature 1..71: note = chr12:1937150-1937221
  misc_feature 1..71: note = hypo
  source 1..71: mol_type = genomic DNA
gtgtaaagagacacccgggccctctccctaacccctgggctggaacggggctcccgcgcctgcctgtgctc

SEQ ID NO: 74420 - DNA, 42 bp, Homo sapiens; identical to SEQ ID NO: 43311
  misc_feature 1..42: note = chr12:1948142-1948184
  misc_feature 1..42: note = hypo
  source 1..42: mol_type = genomic DNA

SEQ ID NO: 74421 - DNA, 270 bp, Homo sapiens
  misc_feature 1..270: note = chr12:1948392-1948662
  misc_feature 1..270: note = hypo
  source 1..270: mol_type = genomic DNA
ggtgcctgccagctgcgttcacggagccaggatggctgagctcgaatgcctgttggatcgcgcaacttttcagaacacagctgggtcccaggtactgaagctaaaacaagggtaaggagcgcttcatcgcagggacctgatcgttctcagacagctaggcagagacaccaaggactctgcaggcacgaagaaactgaaagtcaggagaagcttgtgagggtcacagttgctctcatcatgtaagccatggcaaaccgcagcacagggcag

SEQ ID NO: 74422 - DNA, 118 bp, Homo sapiens
  misc_feature 1..118: note = chr12:1951151-1951269
  misc_feature 1..118: note = hypo
  source 1..118: mol_type = genomic DNA
gtgatgtggcagccccgacaatattccctgggtcccacagcccattttctgggacagaccttccgtcgcatttgtaccccagccagcagaggcttgtaggaaacgcagatgtgagcat

SEQ ID NO: 74423 - DNA, 80 bp, Homo sapiens
  misc_feature 1..80: note = chr12:1957154-1957234
  misc_feature 1..80: note = hypo
  source 1..80: mol_type = genomic DNA
gctcacgcatggcaacgggtatctcttatttgtctgtctgtctctctctgtctttattgagatatcgttcaaataccatc

SEQ ID NO: 74424 - DNA, 35 bp, Homo sapiens; identical to SEQ ID NO: 43401
  misc_feature 1..35: note = chr12:19636251-19636286
  misc_feature 1..35: note = hypo
  source 1..35: mol_type = genomic DNA

SEQ ID NO: 74425 - DNA, 97 bp, Homo sapiens
  misc_feature 1..97: note = chr12:19780563-19780660
  misc_feature 1..97: note = hypo
  source 1..97: mol_type = genomic DNA
gcccagagaaaccagcgtgtaaccactagtagaacctgagcgctcagaccgaggagtggggactgtattaagaagtggacatcgtctggcaggagcc

SEQ ID NO: 74426 - DNA, 30 bp, Homo sapiens
  misc_feature 1..30: note = chr12:1987670-1987700
  misc_feature 1..30: note = hypo
  source 1..30: mol_type = genomic DNA
tgttttcaataggaacgtaactgagccagt

SEQ ID NO: 74427 - DNA, 77 bp, Homo sapiens
  misc_feature 1..77: note = chr12:1990410-1990487
  misc_feature 1..77: note = hypo
  source 1..77: mol_type = genomic DNA
gtggaggtaagagagcgtcagaaggtcaggctgtccatagaatgctaaggacatcctagcaccgtctgacatcagtt

SEQ ID NO: 74428 - DNA, 113 bp, Homo sapiens
  misc_feature 1..113: note = chr12:2017761-2017874
  misc_feature 1..113: note = hypo
  source 1..113: mol_type = genomic DNA
caccccccaggactgcgtcacggacatccccacgccaactcccacgccggactgcctcacggacatccccacgccaactcccacgccggactgcgtcacggacatccccacgc

SEQ ID NO: 74429 - DNA, 58 bp, Homo sapiens
  misc_feature 1..58: note = chr12:2018087-2018145
  misc_feature 1..58: note = hypo
  source 1..58: mol_type = genomic DNA
cctgcaccccacacccggctcctcctcacgacactgtggcccgcgctggccttccacg

SEQ ID NO: 74430 - DNA, 35 bp, Homo sapiens
  misc_feature 1..35: note = chr12:20198455-20198490
  misc_feature 1..35: note = hypo
  source 1..35: mol_type = genomic DNA
tagtagagaccgggtttcaccgtgttagccaggat

SEQ ID NO: 74431 - DNA, 30 bp, Homo sapiens
  misc_feature 1..30: note = chr12:2022315-2022345
  misc_feature 1..30: note = hypo
  source 1..30: mol_type = genomic DNA
aaagtgggagagatgcgtgcatgtggtttt

SEQ ID NO: 74432 - DNA, 162 bp, Homo sapiens
  misc_feature 1..162: note = chr12:2028903-2029065
  misc_feature 1..162: note = hypo
  source 1..162: mol_type = genomic DNA
agaatataattacaccgtacattgctttgtgttctgatgagagttacacaaattagaattgatcaaaattcttgtgttgtgagcccaaaccagtagtagtaccacatgggttctccgggggtgaagtcatagattttatgcagtccccgtatcagattattt

SEQ ID NO: 74433 - DNA, 30 bp, Homo sapiens
  misc_feature 1..30: note = chr12:2029674-2029704
  misc_feature 1..30: note = hypo
  source 1..30: mol_type = genomic DNA
ttaaacactagctcccgttccctcctcccc

SEQ ID NO: 74434 - DNA, 30 bp, Homo sapiens
  misc_feature 1..30: note = chr12:2036436-2036466
  misc_feature 1..30: note = hypo
  source 1..30: mol_type = genomic DNA
agtaccaaccaagcacgtgtgcagcacttg

SEQ ID NO: 74435 - DNA, 49 bp, Homo sapiens
  misc_feature 1..49: note = chr12:2038007-2038056
  misc_feature 1..49: note = hypo
  source 1..49: mol_type = genomic DNA
gagaagggccctcctcggtgtcatgccccattcacgaaagagccaggac

SEQ ID NO: 74436 - DNA, 151 bp, Homo sapiens
  misc_feature 1..151: note = chr12:2040511-2040662
  misc_feature 1..151: note = hypo
  source 1..151: mol_type = genomic DNA
ctggtggcagagtggcggatgccgtggtggagcactgcatggagcactgacggatgacacgtgcacatggcgatgaggacgacacctaaacgtggcagtcagtggagggaaagccagaacgggattcatgacacagaaccacagaaattaa

SEQ ID NO: 74437 - DNA, 30 bp, Homo sapiens; identical to SEQ ID NO: 43316
  misc_feature 1..30: note = chr12:2046347-2046377
  misc_feature 1..30: note = hypo
  source 1..30: mol_type = genomic DNA

SEQ ID NO: 74438 - DNA, 697 bp, Homo sapiens
  misc_feature 1..697: note = chr12:20521144-20521841
  misc_feature 1..697: note = hyper
  source 1..697: mol_type = genomic DNA
cagcaaaggagcaatcgagctgagggtagcgcctcctccgcaggagggggcgggagctcggctgagaaagctttcctagggagttgccttaaagaaagaaagcggaattgtcgatcactccagttgccagttttatacaattttaagcagtcgtcgccactcgtttcccctttgcaaaactgcaaatcaccaccaaccttgcatcaaatagaagtggggagggaaaaaaaaagcaaatctccttctcccttctcaccctccctttcttctcaccctcccttcctctcttactcgctccttctccctccctcccttctgcggctgccgctagtctctcggtctggctctctctccgacgggacttagcaacttcttatttctcagccccttgtccatttttttttttccatcctttgccatgaattggattgacagaggcgggggaggctttgctttctgccccagggaatggcgattcgcgtcctggggccgtgccggggagaatcggccgaggagaaagaaagagtgatagaaaaagagctgcaggaaggaggagaagggagacctccatctgccgcgggcccggcgcgctgcagcgcagcgcagcgccgagctgcgcctcggaatggcccggagcccgccctgcgcccccggctcctccagcgtcagcggctcctgcgcgcgggatgcattgggc

SEQ ID NO: 74439 - DNA, 124 bp, Homo sapiens
  misc_feature 1..124: note = chr12:20522108-20522232
  misc_feature 1..124: note = hyper
  source 1..124: mol_type = genomic DNA
ggaagagcgtgcgtgcgtgtgtgtgtgtgtgtgtgtgcgcgcgcgcgcgtgggtcggggcgggggcgtcggggggccactgggaattcagtgaagagggcaccctataccatggcagtgcccgg

SEQ ID NO: 74440 - DNA, 425 bp, Homo sapiens; identical to SEQ ID NO: 34263
  misc_feature 1..425: note = chr12:20522347-20522772
  misc_feature 1..425: note = hyper
  source 1..425: mol_type = genomic DNA

SEQ ID NO: 74441 - DNA, 44 bp, Homo sapiens
  misc_feature 1..44: note = chr12:20523073-20523117
  misc_feature 1..44: note = hyper
  source 1..44: mol_type = genomic DNA
tttaagaggaggaggcggtccagctccgtcgtgtccgccgagat

SEQ ID NO: 74442 - DNA, 19 bp, Homo sapiens
  misc_feature 1..19: note = chr12:20685629-20685648
  misc_feature 1..19: note = hypo
  source 1..19: mol_type = genomic DNA
tttttttttttgagacgga

SEQ ID NO: 74443 - DNA, 81 bp, Homo sapiens
  misc_feature 1..81: note = chr12:2088757-2088838
  misc_feature 1..81: note = hypo
  source 1..81: mol_type = genomic DNA
gtgagccaccgtgcccagcccatttctcttaagtaaataactacgaacggaacttgttggatcatacgctagttatatgtt

SEQ ID NO: 74444 - DNA, 99 bp, Homo sapiens
  misc_feature 1..99: note = chr12:2138539-2138638
  misc_feature 1..99: note = hypo
  source 1..99: mol_type = genomic DNA
ctttttcattagtcccgaaggaaaccctgtacccattaagaagacactccctattcccgcctcacccagggccctggcagccaccgctctgctttctgt

SEQ ID NO: 74445 - DNA, 150 bp, Homo sapiens
  misc_feature 1..150: note = chr12:2144292-2144442
  misc_feature 1..150: note = hyper
  source 1..150: mol_type = genomic DNA
tcccctgcgccggcgcgtgtgcccgggccctccgcggggcgccggcgtctgcgccaaggcacgttctcctgctgctccagaactgccaccttccaagtcctgaaggaggccgttttcctgtcatttgcacctggccggagccattctgga

SEQ ID NO: 74446 - DNA, 594 bp, Homo sapiens
  misc_feature 1..594: note = chr12:2161460-2162054
  misc_feature 1..594: note = hyper
  source 1..594: mol_type = genomic DNA
cctcgctgcccctcccgcttcccctcccctcctctatctgtcacttctacaaccgctctgattataattgatcaaacagaatcacggaatcacggctcatcttgccgttttgttcagtggcccgatccgaaacgagactctggtagtcgggcaaattgtattcctcctccttggaattccgctcacagaggccttcccggcgtggccggcccagcagggacgcgccgccgcagcggaggagagaacgcgggcggggggctgcaggccggcgcggggggcgcgacgccgccggcggggcgcgagggggtgtgtccgcgccgcggccaccgcggccaccgcggctggcgcccgggtgcgccgcgcgccccggcctccccgggggctcctcacgccgcccctcgcccgccggcggccggggcccgctccctttgacgtcatgcgggcggagggctcgctcgggcggcgctgccgcgggcgccgggagggggcccgacttcgggctccagtccgccgccgtgcgccccgcgccgtgcgcccggctccctgcgcgccgccgcagccacatctggaagcgttcagcgcgtctgcctccgg

SEQ ID NO: 74447 - DNA, 1443 bp, Homo sapiens; identical to SEQ ID NO: 34201
  misc_feature 1..1443: note = chr12:2162067-2163510
  misc_feature 1..1443: note = hyper
  source 1..1443: mol_type = genomic DNA

SEQ ID NO: 74448 - DNA, 656 bp, Homo sapiens
  misc_feature 1..656: note = chr12:21680364-21681020
  misc_feature 1..656: note = hyper
  source 1..656: mol_type = genomic DNA
gtccaaatggggactcgggttgcctgggaaatatctcagtaacccgacctccgctccaaagcgcccttgcggcgtccggtcaggcgcggggctttcctccagagctccagggcccctggctcagcccggggttgcgctgggagcgctggaaactcggcagccccgcgcgaccctatcctggagcaacctgccccctccccacgcccggggactgcgctgtgccgggaggagctgaggtttaagcccgggttgtcccgggccaggctgtcgctgagccccaggtctcgtttttgcagagggtcgccgcttcatctccgaccagagccggagaaaggacctctccgaccggccactgccgggtgagtgaccaagggtgcaagggcgctagtcctgcgcttttggaataggatggggcgggcagggcttgctccgcgctggtgccgaaagaaagcgtctcctcaccggaaagacgcggctctgaggcgccctcagatacagtccgcccgagggcagcccgggttggcagcagcagcagctggatgccgagcgccggagctgggagctcgcgcgtccagccccgcgccaatggtggcaagggcggcccaggctggcgctgcggctccccaagccttattggcttgcggctgttcagccag

SEQ ID NO: 74449 - DNA, 501 bp, Homo sapiens
  misc_feature 1..501: note = chr12:21810473-21810974
  misc_feature 1..501: note = hyper
  source 1..501: mol_type = genomic DNA
tgccttctgctcctccgccagggcacggccccccctgcgccccaaactgagcggcaaagtcagggcccgcggccggatgctcagagctaaaggccgcggaggacagatgtgcttcttcctccttcccgcgtctccccatacaagtactaccccgcacgtcccatcaggcttgcctgtgggccaggattcagggtcctgagccgaaacctaccaggagagagaaggctctggagacctctgtaacagtcgtgcggagaagacaaagtcagctgcgtgcgtctcctccggcgccggctctgcaaggagggaggagggggcggggccccacaaccaccgcagcctcttaggtttctccattgtgattggaaatccgagtaccgcctacccctcccctcggctcgctcaatccccttcaaggacaagggctcaagtatgcacactccctcccccaccctccagatgaggaggtctccttccagaggcttccgctctcagctggtc

SEQ ID NO: 74450 - DNA, 27 bp, Homo sapiens
  misc_feature 1..27: note = chr12:21833068-21833095
  misc_feature 1..27: note = hypo
  source 1..27: mol_type = genomic DNA
aattcaagtttgggccgaagtttaaag

SEQ ID NO: 74451 - DNA, 30 bp, Homo sapiens
  misc_feature 1..30: note = chr12:21860015-21860045
  misc_feature 1..30: note = hypo
  source 1..30: mol_type = genomic DNA
tttaactttgaataacgttgattaactttg

SEQ ID NO: 74452 - DNA, 665 bp, Homo sapiens
  misc_feature 1..665: note = chr12:21927174-21927839
  misc_feature 1..665: note = hyper
  source 1..665: mol_type = genomic DNA
gaattattttaaatgcgaaagaagtatgagttgcatctaaaaagagttaaaaaggttcctgtggaaatcataatattataaattgaaaacttttttttttttttttttttacaacgaaggaatcaaatatacaaggtgcgggggggaaaaaacccaagacaacagcctgcgggttgcagtagggagtgtgccccgaaaagtccatccatcactgcaagcctctgcggtgttttgcattttaaatcatttacgggaacacggacagcctcccccctccgctcccccggagcagctttgaaacttacagactccgggtagcgggcgcggcggctggacctccttgcacacgccggcgggccgcgggcaggtccctcgctctcccatgctggcgcgcgggaccaggggccgcccaggccggagggacaaattgggggctgcgtgtcctaaggagaagagttaaaataataaaaggtgcaactgaatctaaacgcagggagggctagaggaagggggatgggtgtagatcttcccctccccctgctcagctcaactcccttggccacttcagtggaaggaggagggactgggggggcgggggcgggggggcgatgctccacaaatcagcctcccagttagggctttgacgcacgccagacctcggaagc

SEQ ID NO: 74453 - DNA, 75 bp, Homo sapiens
  misc_feature 1..75: note = chr12:21927877-21927952
  misc_feature 1..75: note = hyper
  source 1..75: mol_type = genomic DNA
cgagcgcaagtccccgggaggtagggagcaggccagagggagggacgacccgggggagggcgggacctgcagagc

SEQ ID NO: 74454 - DNA, 34 bp, Homo sapiens; identical to SEQ ID NO: 34269
  misc_feature 1..34: note = chr12:21928417-21928451
  misc_feature 1..34: note = hyper
  source 1..34: mol_type = genomic DNA

SEQ ID NO: 74455 - DNA, 296 bp, Homo sapiens
  misc_feature 1..296: note = chr12:22093664-22093960
  misc_feature 1..296: note = hyper
  source 1..296: mol_type = genomic DNA
gcttcaaacccctgccggtgcacttgagctaccttcaaaacaccgacttcctacactgtcttaagatgtaaatttcaaacccggacgcagaactcctaaaaaaaagtaaagagtaacaaaaattaagcagatagaaaactacttcttgaacatacaagaattgtctacaagaaaggcggtaataataactcctaataataataactcctttcactgtttccagttgatttgagtaggagacggcagttttgaagtaaaactggaaacctgatccccaccccttcacttctcgagcc

SEQ ID NO: 74456 - DNA, 308 bp, Homo sapiens; identical to SEQ ID NO: 1025
  misc_feature 1..308: note = chr12:22093961-22094269
  misc_feature 1..308: note = hyper
  source 1..308: mol_type = genomic DNA

SEQ ID NO: 74457 - DNA, 471 bp, Homo sapiens; identical to SEQ ID NO: 1026
  misc_feature 1..471: note = chr12:22094577-22095048
  misc_feature 1..471: note = hyper
  source 1..471: mol_type = genomic DNA

SEQ ID NO: 74458 - DNA, 15 bp, Homo sapiens
  misc_feature 1..15: note = chr12:22095181-22095196
  misc_feature 1..15: note = hyper
  source 1..15: mol_type = genomic DNA
cgactccagccctgc

SEQ ID NO: 74459 - DNA, 40 bp, Homo sapiens; identical to SEQ ID NO: 43318
  misc_feature 1..40: note = chr12:2245461-2245501
  misc_feature 1..40: note = hypo
  source 1..40: mol_type = genomic DNA

SEQ ID NO: 74460 - DNA, 83 bp, Homo sapiens; identical to SEQ ID NO: 1027
  misc_feature 1..83: note = chr12:22486799-22486882
  misc_feature 1..83: note = hyper
  source 1..83: mol_type = genomic DNA

SEQ ID NO: 74461 - DNA, 326 bp, Homo sapiens; identical to SEQ ID NO: 34274
  misc_feature 1..326: note = chr12:22487133-22487459
  misc_feature 1..326: note = hyper
  source 1..326: mol_type = genomic DNA

SEQ ID NO: 74462 - DNA, 802 bp, Homo sapiens
  misc_feature 1..802: note = chr12:22487460-22488262
  misc_feature 1..802: note = hyper
  source 1..802: mol_type = genomic DNA
cagagagcggcggcggcgagtcgctcccgccggttctgcagcatcacggtcgccctcggcgagggtccgggagaaggctcggctccctcctaaacatgtggcccgtggcgtccccttgtcccctccgagcgatgctcctgcgcccttcgccgcctcccgcgctgctgcgccgccaggcaacccccccccccccaccccgccccgagacgcgctctctgcgccgcaccaagtccttggaaatttccacggcggcccgggaccgctatcctgccccgggctcctccgcctcgcccgccgggaccctcgctccccacccctcccggagaagaaaagaactcgctctcatcagttaattcagcggcgcgccgcagccttccgctgcgccccggacttcgcagacaaacgcccggggattggtggaaatcaaggtctccccctccctcccccacccgcaaaattgcctccttcgacccgatccgagccgcgacactcgcccagagcgcgcacccctcactcgtgcccttgttctttggagataacggcagacaataaaaaccaacagccccccgccaatagaaatatatcagtccctgagtgtggcggagactggctaatatcctgatccttcgacaagcggccggtgtgcccaggctgtcaccctgctgccgtcaccctagtctttctctagctggttggatattaacccgcagccaggcgcgaggaggctggcggagatttattccttcctgggcccccacccccattagccggtcccggagccgcggcccgtgtgtgtgcgcgc

SEQ ID NO: 74463 - DNA, 366 bp, Homo sapiens
  misc_feature 1..366: note = chr12:22488339-22488705
  misc_feature 1..366: note = hyper
  source 1..366: mol_type = genomic DNA
cgaggaggtgcgtgcactccggggtcctccgcctcgcctcctccctgaaaggaagtgctgcatccagatgtgcaggcagctggtgcccaaacactagacctcaagatgtcacattgccttggaggcgcgcggccttttagattaaaggaccgttggttcttagacgtccttcttgcccttcttgcttgtgataagcgataagcttatcgcaaccccgaccttggaaaagcaccacccgccttgacccaccgagccgagagagtcgctgttagccatttctgctcgccccggcggccgacgcatagctcgggtacctcctagcggtcgcctattctatttgcttaagcatctcgtcaagcataaagt

SEQ ID NO: 74464 - DNA, 215 bp, Homo sapiens
  misc_feature 1..215: note = chr12:22634363-22634578
  misc_feature 1..215: note = hypo
  source 1..215: mol_type = genomic DNA
gagaatttccataaacgtggttcatcagattccatatgatcaatacactttttgcaggcacctggttctctgagtcctacactacttatagaagcagcactggctttcctcattaacatctttccagtcagaatttatttgctaacaagccaaaatgaacattaagctgagacacagctttttcttgtctcatatttcatcggcacttaagaaac

SEQ ID NO: 74465 - DNA, 95 bp, Homo sapiens
  misc_feature 1..95: note = chr12:22698101-22698196
  misc_feature 1..95: note = hypo
  source 1..95: mol_type = genomic DNA
ttgcagtgagccgagatcactcctctgtctccaaaaaaagaaaaaaaagaaagaaagaaatagagataccaggcacatctcgaatagtgaaataa

SEQ ID NO: 74466 - DNA, 134 bp, Homo sapiens
  misc_feature 1..134: note = chr12:22852676-22852810
  misc_feature 1..134: note = hypo
  source 1..134: mol_type = genomic DNA
gacacctgagagcttcgccctgctaggattagcgtctgtataaagagagacacctgagagcttcgccctgctaggattagcgtctgtataaagagagacacctgagagcttcgcctacacgcttccccactgag

SEQ ID NO: 74467 - DNA, 27 bp, Homo sapiens
  misc_feature 1..27: note = chr12:22987972-22987999
  misc_feature 1..27: note = hypo
  source 1..27: mol_type = genomic DNA
agccaccgcgcccggcctcatttttta

SEQ ID NO: 74468 - DNA, 57 bp, Homo sapiens
  misc_feature 1..57: note = chr12:2300563-2300620
  misc_feature 1..57: note = hypo
  source 1..57: mol_type = genomic DNA
ggccctctgcagtcacgctggctccaggctcaccgggagtcacgttctctggctgtg

SEQ ID NO: 74469 - DNA, 30 bp, Homo sapiens
  misc_feature 1..30: note = chr12:2403723-2403753
  misc_feature 1..30: note = hypo
  source 1..30: mol_type = genomic DNA
aagattcctcttgtgcgtgctgtcgggata

SEQ ID NO: 74470 - DNA, 30 bp, Homo sapiens
  misc_feature 1..30: note = chr12:2412108-2412138
  misc_feature 1..30: note = hypo
  source 1..30: mol_type = genomic DNA
gggctcttgcggccccgggaggggggcctg

SEQ ID NO: 74471 - DNA, 17 bp, Homo sapiens
  misc_feature 1..17: note = chr12:24596179-24596196
  misc_feature 1..17: note = hypo
  source 1..17: mol_type = genomic DNA
cccggccagtttatgga

SEQ ID NO: 74472 - DNA, 196 bp, Homo sapiens
  misc_feature 1..196: note = chr12:24632145-24632341
  misc_feature 1..196: note = hypo
  source 1..196: mol_type = genomic DNA
actccctggtaactccgaccactcctctccacaccccactgctgtcccattagaagtatgcacagtaattaacatcttatctctcttattgtatgtgtcattttctactccgcgtatttgttttatacatgttttatctcctatactagaaaataaggcagcacctattaagtgcttacctcggccaagcactagc

SEQ ID NO: 74473 - DNA, 1030 bp, Homo sapiens
  misc_feature 1..1030: note = chr12:24714475-24715505
  misc_feature 1..1030: note = hyper
  source 1..1030: mol_type = genomic DNA
gccccaaagtgcaagcgagatttcccaaacccgcgcttaaagtgacacaacacgtgagtggtcttcacttggtacactgagtgaggtggggggaaaaagtagttgcaattagaattaaagcttccggtctctgaaatccctagaatcctgaaggatgagacttgtttcagaaattccgggcgggagggagggggagtggtagggagaaggattgcagaaagcgaaacaaaaagacgaaagagtcgggaggtgggggtgactaaggttagggggtgggccaggggtcgctctgatatcctagaagggttaaggggctttgtccaacttttagggtctggccttggacattggccgcgatgcccagcacagcccagggttctccccgcactctcctctcgcatcaaccacctccaccgccaccacttacaaaacaataccagcaacagtacgcaggcttcccaacaaaaatagaaagttatcccgtctccgggtcggggtccaagccggcgctccagggtcccccggccagccgcccccggggatgacagggccactccgcgcctcgggccgcctcccacctctccgccacccccagcccagtccccctccctctgtacttgaggaaactccggcggcggccccctccctcctccgcggctctccagctggagccgggaaggagtgctgagtggcgggcccggcgagcggcagaggggagctctgcgccttggaggtctgcccacaacaacatcgggacgaacaacaaagttaaaacgcagcgattcacgcaccttacccggtctcgttaatgcctcctccggcgtgggatgcaaagtggcacagaggcgggctgggggcccccgggaggagactggagatgggttttggtggctcgcctttttcactctgtgtgtgtgtgtctgtgtgtgtgcgtgtgtgccggtgtgtgtgtgtgtgcgcgcgcgtgtccctctctctccccccgtctctcgctcgcccgctcgctcgcgctccccgtgttgctctcaag

SEQ ID NO: 74474 - DNA, 447 bp, Homo sapiens; identical to SEQ ID NO: 34279
  misc_feature 1..447: note = chr12:24715757-24716204
  misc_feature 1..447: note = hyper
  source 1..447: mol_type = genomic DNA

SEQ ID NO: 74475 - DNA, 212 bp, Homo sapiens; identical to SEQ ID NO: 11164
  misc_feature 1..212: note = chr12:24716205-24716417
  misc_feature 1..212: note = hyper
  source 1..212: mol_type = genomic DNA

SEQ ID NO: 74476 - DNA, 177 bp, Homo sapiens
  misc_feature 1..177: note = chr12:2482588-2482765
  misc_feature 1..177: note = hypo
  source 1..177: mol_type = genomic DNA
tgcaaagtgagtggtcggcagaggtctcctgaggtgacactgaggcccgactgccctgaggagcctgccctgggacaagctagagagagggtgtcccaggcagcatgcagaggccagcatggagcgctctgaactgggcagagcaatggggcaggagtttggcgtggattcaggggc

SEQ ID NO: 74477 - DNA, 161 bp, Homo sapiens
  misc_feature 1..161: note = chr12:25055472-25055633
  misc_feature 1..161: note = hyper
  source 1..161: mol_type = genomic DNA
ggaggcagaaggctgcggtcaaaatattttggggtggcagagtcacgtaggatgtggctgtgggttctggcagcccagagattcagctcccgcctcctccctcagagcgagtccatagctaccctcacgtcccccgtggcggtcctcgccacgctccggag

SEQ ID NO: 74478 - DNA, 301 bp, Homo sapiens
  misc_feature 1..301: note = chr12:25056242-25056543
  misc_feature 1..301: note = hyper
  source 1..301: mol_type = genomic DNA
cgcgagcatccttgtttattaaacaacctctaggtgaatggccgggaagcgcccctcggtcaaggctaaggaaacctcggagaaactacattagggcagcttttccaccgactccaaatccaactgacaaaaagcagtttctgccctcgagagtttgcgggcggggattgacatttgtgcgtctgctcttgtctgccactgaccgctatgtgcaaactgaagggggagaacgtgaatccagcttttagatttccctgcgccacctacccaaaccgaatttgtaactcggggtgttatgggg

SEQ ID NO: 74479 - DNA, 187 bp, Homo sapiens; identical to SEQ ID NO: 43404
  misc_feature 1..187: note = chr12:25059405-25059592
  misc_feature 1..187: note = hypo
  source 1..187: mol_type = genomic DNA

SEQ ID NO: 74480 - DNA, 97 bp, Homo sapiens
  misc_feature 1..97: note = chr12:25081512-25081609
  misc_feature 1..97: note = hypo
  source 1..97: mol_type = genomic DNA
gcagcgagctgtgattgtgccatgccagcctgcaatacagagcgagacagtctcaaaaaaaaaaaaaaaaaaccaagaaaaacgaaaatacaaaccc

SEQ ID NO: 74481 - DNA, 623 bp, Homo sapiens; identical to SEQ ID NO: 34282
  misc_feature 1..623: note = chr12:25101375-25101998
  misc_feature 1..623: note = hyper
  source 1..623: mol_type = genomic DNA

SEQ ID NO: 74482 - DNA, 279 bp, Homo sapiens
  misc_feature 1..279: note = chr12:25102009-25102288
  misc_feature 1..279: note = hyper
  source 1..279: mol_type = genomic DNA
cgagtacacgtggcgggctggattgcagaccggccctctcgcggcggagactcgcgacctagcggattgcatcagcaggaagacactaaggctgctcccccaggccgcccccagatggtggagtctctcccagcccgaagattcggagccagcgcccagacccgagcctcactcactgctcactcccggggtgcagggcagaggtgccagtgttgcaagcaaatgacacggttacccccgaatcagccactgtgggtgcgtatccgagtgtggggatgc

SEQ ID NO: 74483 - DNA, 30 bp, Homo sapiens
  misc_feature 1..30: note = chr12:25154975-25155005
  misc_feature 1..30: note = hypo
  source 1..30: mol_type = genomic DNA
acaggccatcgtgcccggccttaactactg

SEQ ID NO: 74484 - DNA, 25 bp, Homo sapiens
  misc_feature 1..25: note = chr12:25191255-25191280
  misc_feature 1..25: note = hypo
  source 1..25: mol_type = genomic DNA
caaaattgcaaatgacgaactataa

SEQ ID NO: 74485 - DNA, 30 bp, Homo sapiens; identical to SEQ ID NO: 43407
  misc_feature 1..30: note = chr12:25195744-25195774
  misc_feature 1..30: note = hypo
  source 1..30: mol_type = genomic DNA

SEQ ID NO: 74486 - DNA, 120 bp, Homo sapiens
  misc_feature 1..120: note = chr12:25202526-25202646
  misc_feature 1..120: note = hypo
  source 1..120: mol_type = genomic DNA
tcaaacaggtgtacaaacatactcaacataactaatcattaggaaaatgcaagttaagactataattagatattgtatcatacctgttaggatggctattattttaaaagacggccggat

SEQ ID NO: 74487 - DNA, 214 bp, Homo sapiens
  misc_feature 1..214: note = chr12:25256767-25256981
  misc_feature 1..214: note = hypo
  source 1..214: mol_type = genomic DNA
tagccatcttctctacgaagagtgactattgcctctttacccagaaatattggaaatgcaggaatggtaagacaattcctaagtgttcttagtcaaaggtaaattcattttcatatgacagaaaatataaacgtatattttatcatttcttttaacatttgaacttctactaaaggtggctgggatggaaaataatgatcgattcagtagaagg

SEQ ID NO: 74488 - DNA, 32 bp, Homo sapiens
  misc_feature 1..32: note = chr12:25262917-25262949
  misc_feature 1..32: note = hypo
  source 1..32: mol_type = genomic DNA
ttgaaattttaaaattccgtattgaatgttaa

SEQ ID NO: 74489 - DNA, 23 bp, Homo sapiens
  misc_feature 1..23: note = chr12:25273331-25273354
  misc_feature 1..23: note = hypo
  source 1..23: mol_type = genomic DNA
ggaagcaagccaccacgaggtta

SEQ ID NO: 74490 - DNA, 40 bp, Homo sapiens
  misc_feature 1..40: note = chr12:25537400-25537440
  misc_feature 1..40: note = hypo
  source 1..40: mol_type = genomic DNA
tcacctgacaccttccgtgtttaaccgggactaggtttat

SEQ ID NO: 74491 - DNA, 194 bp, Homo sapiens; identical to SEQ ID NO: 5128
  misc_feature 1..194: note = chr12:2566053-2566247
  misc_feature 1..194: note = hypo
  source 1..194: mol_type = genomic DNA

SEQ ID NO: 74492 - DNA, 30 bp, Homo sapiens; identical to SEQ ID NO: 15624
  misc_feature 1..30: note = chr12:2590465-2590495
  misc_feature 1..30: note = hypo
  source 1..30: mol_type = genomic DNA

SEQ ID NO: 74493 - DNA, 193 bp, Homo sapiens
  misc_feature 1..193: note = chr12:25922413-25922606
  misc_feature 1..193: note = hypo
  source 1..193: mol_type = genomic DNA
atcaatcaatatacacgcatttttattttcaaatttattgttaacaatatccctagataatgatccctggggatctttatccccaaatacagatgagggagctgaggatctgataaggcaacttgtccaaggccgcttgaacccagttccgtctgtgcccttagtcaccatgctttcccgaaagaaagtgccc

SEQ ID NO: 74494 - DNA, 130 bp, Homo sapiens
  misc_feature 1..130: note = chr12:25956132-25956262
  misc_feature 1..130: note = hypo
  source 1..130: mol_type = genomic DNA
ctggggttgtcttaccgcagtgagtaccacgcggtactacagagaccggctgcccgtgtgcctggcaggtggagctgcccgcatcagcggcctcggggaatggaagcggagaacgcgggcagctactccc

SEQ ID NO: 74495 - DNA, 30 bp, Homo sapiens
  misc_feature 1..30: note = chr12:26168478-26168508
  misc_feature 1..30: note = hypo
  source 1..30: mol_type = genomic DNA
attaatgtgtgaggccgtggaaaactgctt

SEQ ID NO: 74496 - DNA, 141 bp, Homo sapiens
  misc_feature 1..141: note = chr12:26348161-26348302
  misc_feature 1..141: note = hyper
  source 1..141: mol_type = genomic DNA
ttaattaagctcaaacgatttcaacattcatcaccttgcattgcacttcacagaaagcaaaaccaaaacaatcctggagttttgagtgaggaaaacagacgccccgcactcgcacacgcgcgcactcgcagcctgtctgaa

SEQ ID NO: 74497 - DNA, 168 bp, Homo sapiens
  misc_feature 1..168: note = chr12:26555243-26555411
  misc_feature 1..168: note = hypo
  source 1..168: mol_type = genomic DNA
acttcccatcactaccgtctatctagcgtcacgatctgcattcatttattcattcaggaactacctggtcatgtcacaggtgtttgttaaaggcttagtaaatgctgattaatcagcacataaacgctacaggagagggcttctacctctctccgagaatttagaaat

SEQ ID NO: 74498 - DNA, 37 bp, Homo sapiens; identical to SEQ ID NO: 43411
  misc_feature 1..37: note = chr12:26555819-26555856
  misc_feature 1..37: note = hypo
  source 1..37: mol_type = genomic DNA

SEQ ID NO: 74499 - DNA, 30 bp, Homo sapiens
  misc_feature 1..30: note = chr12:26844976-26845006
  misc_feature 1..30: note = hypo
  source 1..30: mol_type = genomic DNA
taaaacaaggaaattcgggggtcagaatct

SEQ ID NO: 74500 - DNA, 18 bp, Homo sapiens
  misc_feature 1..18: note = chr12:27072768-27072786
  misc_feature 1..18: note = hypo
  source 1..18: mol_type = genomic DNA
ctggaatttaggggccgg

SEQ ID NO: 74501 - DNA, 232 bp, Homo sapiens
  misc_feature 1..232: note = chr12:27426203-27426435
  misc_feature 1..232: note = hypo
  source 1..232: mol_type = genomic DNA
gccgaatggtgcctccgtttctatatgtgtgaccctagacaaggcttgccaaacacctgcccacctacgcatggcttgggagagcagtactgaatagtggaagagtcctaggctaatgagtgttgacaggcttgttttggttttataacatttataacatacacatctctgagcccattttttctgttgcaaaatggcagtaacattatttaccactcgttagggctaatgt

SEQ ID NO: 74502 - DNA, 153 bp, Homo sapiens; identical to SEQ ID NO: 43412
  misc_feature 1..153: note = chr12:27489449-27489602
  misc_feature 1..153: note = hypo
  source 1..153: mol_type = genomic DNA

SEQ ID NO: 74503 - DNA, 44 bp, Homo sapiens
  misc_feature 1..44: note = chr12:2778028-2778072
  misc_feature 1..44: note = hypo
  source 1..44: mol_type = genomic DNA
gccacggtgttctgcggtcccctaagcaccgcctgccatcatca

SEQ ID NO: 74504 - DNA, 123 bp, Homo sapiens
  misc_feature 1..123: note = chr12:2783720-2783843
  misc_feature 1..123: note = hypo
  source 1..123: mol_type = genomic DNA
gccaatgaggagctgcgggcgatcatcaagaagatctggaagcggaccagcatgaagctgctggaccaggtggtgccccctgcaggtggtgagtgctccctggactcccgcaccttggccact

SEQ ID NO: 74505 - DNA, 52 bp, Homo sapiens
  misc_feature 1..52: note = chr12:2788862-2788914
  misc_feature 1..52: note = hypo
  source 1..52: mol_type = genomic DNA
ccggctaccccagcacggtcagcactgtggagggccacgggccccccttgtc

SEQ ID NO: 74506 - DNA, 43 bp, Homo sapiens
  misc_feature 1..43: note = chr12:2797716-2797759
  misc_feature 1..43: note = hypo
  source 1..43: mol_type = genomic DNA
ctggcccccacagcccgtccccaccctgcggcttgagggggtc

SEQ ID NO: 74507 - DNA, 63 bp, Homo sapiens; identical to SEQ ID NO: 34202
  misc_feature 1..63: note = chr12:2800100-2800163
  misc_feature 1..63: note = hyper
  source 1..63: mol_type = genomic DNA

SEQ ID NO: 74508 - DNA, 358 bp, Homo sapiens
  misc_feature 1..358: note = chr12:28122168-28122526
  misc_feature 1..358: note = hyper
  source 1..358: mol_type = genomic DNA
cccgggctcaggccccggcaggtatccgggatggtccctctccctaacccgggcaaggagcatcggtgaccgctgcaagccctcggcagcatcccagcttggcagcccctccccctggcctccccaacccggcgccctggggaggatggggcacttacaggcggcggctgagaccctccaccgagcgcccgcaggagggcaccgcgtagctcagcaggaacaccgcgacgctccactgctgaaccagtctccgctgcatcgtctccgctcgcgctcgggacctgcaacagaagggaatgggacccgagtgtcagtctggactctccatctccccgcactactccgctcccccttttta

SEQ ID NO: 74509 - DNA, 140 bp, Homo sapiens
  misc_feature 1..140: note = chr12:28123065-28123205
  misc_feature 1..140: note = hyper
  source 1..140: mol_type = genomic DNA
gtcgttagtggcagccggagcggcagggaggcggcagccccgcttcacgggcggggagacatgctggccgggcggcgcaggttggaggcgagttgaaaaccgagcggaggaatgttcacacgctccgaggcaaacctgcc

SEQ ID NO: 74510 - DNA, 238 bp, Homo sapiens
  misc_feature 1..238: note = chr12:28123548-28123786
  misc_feature 1..238: note = hyper
  source 1..238: mol_type = genomic DNA
gggagccgagatccccgagggcgtgcggactgccccgggcagccggcggtccccggcgcgccgagctggacgagcgggcgccaagaccaccaggggcggaccgacgaggaggaggccaaggagctgggccggggaccgcgggcaaccgggagcctgcgcggagaggacgcgggctgttggcctgtgaatttaaggagcccgaagctcgcctggcagctcggggcgatgcatgagaacc

SEQ ID NO: 74511 - DNA, 1436 bp, Homo sapiens
  misc_feature 1..1436: note = chr12:28127648-28129084
  misc_feature 1..1436: note = hyper
  source 1..1436: mol_type = genomic DNA
ctgccctggtgtttgcgctcccactgcagcaagggaggcctgagtctcttagggcaggggtccagggtcttgggagaggccttagggcaagggggatgatctttttcagcctcccctcccctcctcccacccagcgtcctcatccccaccgcctgcgatagacttgggtcgcccattaggaagctgatccgcagggacggggcaggcttggctcctggggatcttaggctccatgggaacttcgggggtctcggggcccgtgagcggatctagctactacttcccctaggttctcctcgggcttcagtccctaagagtctggactccggactgccgcacagaatccttcttgcccggagcggtattattgaggtctttgcgttctgccccgccctgtcccgccggcttgggtgcttggtttctaacccgagtatactcggagtctctggtcctgcgcgcccccctcctcccgggagagccccgtatctggctgcgggtaagggaaaacttcgggaaccccgagacccaaggacagggtcggagggagcgcgcgaacttcctctgagcagggctcttcctcccctcccctctccctccaggtcaatttatgactcaaacatgagataagccctaggcagacggtgacgctgacttccccgtgggggcgcggggagagaaggatgaggcagacgtaccccctccctggcctggccctgtccggggccgcgtcggggtgtggaggggcgactcccttcctccgggagccccgactcgctctctcccagcgcgcctcccctgcgcccgtaaagctcggccctgccggagccccgggacccgtctgttttatttcacttaaagcgatctgcaaagtcaaggccgggtgaggtgcggcgcgggagaggagaggatatgaacggacgtggaacgaagttctgtctgccaactccctccgtctgattcttggaatccggtggcatcttaaaggacggaattgagggcaaggagaagattattaatccccgaagcccgctctgtctatatataactgctcagtggttacagttggcgatcgcagggtgggggttgggggtgtagaccgtgggccatggaacacgtggcatctctccagggcataaaaatcaatctagctggtggctcctatggagtttgtaaattgcgcagagctggctgggggaagccagtgagctgtccatggtggttaaggctcgttgatgtgcgtcctcgggctgtcctggtgaggcacagacccccctaccccaggggccgcaacgccccagagccccagcctgccagcgatccagccggtgtgcgcccgacacgaggctggacgtgtgtttgcacaactccaggacgcgctcttgcacagaggccgaattccagagatagacggaaaaatctcccgattccaaattgtg

SEQ ID NO: 74512 - DNA, 500 bp, Homo sapiens
  misc_feature 1..500: note = chr12:2861643-2862143
  misc_feature 1..500: note = hyper
  source 1..500: mol_type = genomic DNA
cacgccacatcaccccggtcctttagactcctgcgcattctatttccccgtttccttctcacacccactttcttccctggctcccaccacagcagtgcccatctgctcctccccgctcactcaggtctcctgctcaggacgcccttgccgagggcgcggggcatttgtactgaagaagggctgcaggagagtcggtgacccctccttctacttgtatgtagcggccccaagtgtcccgggagctggtggggcgcttgggctgtatgagcccggccgccaggaggctggggctgcgtcaggagctgtccgtggtgcttaagcggcgtctgctcgggcgcggggtgtggcgcggcgggtgagcgctgtccctggtcctggagaggttcctggcccccagtggcaacggtgagagcagtggcccagaaggccagtaccgggaacgacgatggcgggcacaagggtgggcttgcagcagctgctgctggtgctcccacaggctg

SEQ ID NO: 74513 - DNA, 324 bp, Homo sapiens; identical to SEQ ID NO: 34204
  misc_feature 1..324: note = chr12:2862267-2862591
  misc_feature 1..324: note = hyper
  source 1..324: mol_type = genomic DNA

SEQ ID NO: 74514 - DNA, 105 bp, Homo sapiens
  misc_feature 1..105: note = chr12:2903684-2903789
  misc_feature 1..105: note = hyper
  source 1..105: mol_type = genomic DNA
cgccgcccgtggtgacggccggtcccggggagggggcgccgccactgccatcccgcagcctgcgctccccacaccccgccgcaggcgcagcggactggtggagtg

SEQ ID NO: 74515 - DNA, 43 bp, Homo sapiens
  misc_feature 1..43: note = chr12:29123308-29123351
  misc_feature 1..43: note = hypo
  source 1..43: mol_type = genomic DNA
agggtttcttttcccatttaatcctccacgtgacccctattct

SEQ ID NO: 74516 - DNA, 145 bp, Homo sapiens
  misc_feature 1..145: note = chr12:2920998-2921143
  misc_feature 1..145: note = hypo
  source 1..145: mol_type = genomic DNA
aagacagagcagatccggaatccaggcaaccttcacttccagcctgaagactctcctacgaactatgatagtaaatgatggagaggccctagggtttgggatcaaacaattctggtttgagcacgcaccccgccccacaatcctt

SEQ ID NO: 74517 - DNA, 30 bp, Homo sapiens
  misc_feature 1..30: note = chr12:29268148-29268178
  misc_feature 1..30: note = hypo
  source 1..30: mol_type = genomic DNA
caagtccccaccggacggagaagcccctct

SEQ ID NO: 74518 - DNA, 33 bp, Homo sapiens
  misc_feature 1..33: note = chr12:29298795-29298828
  misc_feature 1..33: note = hypo
  source 1..33: mol_type = genomic DNA
gaaaagattggattggaacgaggccgacattcc

SEQ ID NO: 74519 - DNA, 32 bp, Homo sapiens
  misc_feature 1..32: note = chr12:29302656-29302688
  misc_feature 1..32: note = hyper
  source 1..32: mol_type = genomic DNA
gttaatgtggggggccgcgccttggggactgg

SEQ ID NO: 74520 - DNA, 120 bp, Homo sapiens
  misc_feature 1..120: note = chr12:29373965-29374085
  misc_feature 1..120: note = hypo
  source 1..120: mol_type = genomic DNA
ggagttgtgcgcatgctcacttgaggcatgaagtgagcgtgcgtacaactccaataactggtaacaacactcccttaccaggggcgtattcctgtaaggtcatatacccgtaaaatcagc

SEQ ID NO: 74521 - DNA, 548 bp, Homo sapiens
  misc_feature 1..548: note = chr12:2964264-2964812
  misc_feature 1..548: note = hypo
  source 1..548: mol_type = genomic DNA
ggggatggggtgctccgtgggggggcatctgtgggcattggagtcggtcagccagcgccagacattgctatcgtagggcctgtcaggctgggtggggaaggtggcaggcagacggcacacatcgagccacgtgtgaaagccccaggtgtgctgggcgccacccttccaagggtggatgagccgctgacgcaccttggacttcatatctgtgcagggcggcagcttcagagccagctggtggtaggcttgccgggtgaagccagggaactcccaggactcgctggggaggaagaactcacgctgagcccacgtttgggagggtgggagggactcgctggcctggaccatctagggagagacaaaagggagcctggggaaggttgtgcagacaggggtgcagaaaggtgggtgaggcactccgctctccttcccaggcacgacctctgccagcccaggattctcatgaggacgcagaagtcctggcagggccgcatctccatccctctccttcccggcggaagttatggctgctgcgtatcatcttcaca

SEQ ID NO: 74522 - DNA, 366 bp, Homo sapiens
  misc_feature 1..366: note = chr12:298173-298539
  misc_feature 1..366: note = hyper
  source 1..366: mol_type = genomic DNA
cagcagagaggatggcgaattggtgcagggcgaaggaatctgaaagagggctgtgcggtccgcagagagcgaggcttgggagcccgacccaaagcgtgccctccagggtgcagcaccgacgggtgccgcggcgtttgcaggcggggagaaggcggcgggaagtactggactagctgcgggcaggggccggctgaggcgcgcgcccgcgtgctaggggccccgggggagggcggcggggacgcggcgctactcccctctgccacccggcggccgcagacagcgctgcgccggcctcgcgtttttcgttttccgccagacccggcctcgtaactgagagcatctggctgaagccgttgctctccttct

SEQ ID NO: 74523 - DNA, 421 bp, Homo sapiens; identical to SEQ ID NO: 34289
  misc_feature 1..421: note = chr12:29935902-29936323
  misc_feature 1..421: note = hyper
  source 1..421: mol_type = genomic DNA

SEQ ID NO: 74524 - DNA, 121 bp, Homo sapiens
  misc_feature 1..121: note = chr12:29936395-29936516
  misc_feature 1..121: note = hyper
  source 1..121: mol_type = genomic DNA
cgcagagcggccggtaggacttgtggctggtgttctcggccatgcccttgccccagaagtcgttggtgaagatgccccagcggagcggggcgccgggccgcacgtcggggttgttcacgat

SEQ ID NO: 74525 - DNA, 101 bp, Homo sapiens
  misc_feature 1..101: note = chr12:29936542-29936643
  misc_feature 1..101: note = hyper
  source 1..101: mol_type = genomic DNA
cgccctgcagggagcggccgtagcacaggcagcttgccccggccagcagcgccgcggccccggccggcgctagcccgcagccccgccgccgggagggtgtg

SEQ ID NO: 74526 - DNA, 15 bp, Homo sapiens
  misc_feature 1..15: note = chr12:29936661-29936676
  misc_feature 1..15: note = hyper
  source 1..15: mol_type = genomic DNA
cgggcagaggtggtc

SEQ ID NO: 74527 - DNA, 367 bp, Homo sapiens
  misc_feature 1..367: note = chr12:29936976-29937343
  misc_feature 1..367: note = hyper
  source 1..367: mol_type = genomic DNA
cggttcccccgcacagcccggcgccctctgcccccggcccgccttgcttgcaggtggaccggggttcgcggcgcgcggctgcccgggagctgcggggaaggacaccccaggttcccacttgcggtgtccggctgtgctcacccccacgcccccgcccccatccttctcccccgaatggggctgggaaggggcacatctggcggacccctcccgggggacccaggagggtttagcaggtgcgcagtctggaacccccacacccaccttccagggagaaaagtgccgctgcttcccgggaagttcccggcttttcagcacccgggacaacagcagcggcgcccggagagacgctctccacccgccccgc

SEQ ID NO: 74528 - DNA, 58 bp, Homo sapiens; identical to SEQ ID NO: 11172
  misc_feature 1..58: note = chr12:29937344-29937402
  misc_feature 1..58: note = hyper
  source 1..58: mol_type = genomic DNA

SEQ ID NO: 74529 - DNA, 46 bp, Homo sapiens
  misc_feature 1..46: note = chr12:29937496-29937542
  misc_feature 1..46: note = hyper
  source 1..46: mol_type = genomic DNA
cgccctgcccgggtgtgttcagaggcgccaccggctctttaacttt

SEQ ID NO: 74530 - DNA, 139 bp, Homo sapiens
  misc_feature 1..139: note = chr12:299633-299772
  misc_feature 1..139: note = hypo
  source 1..139: mol_type = genomic DNA
actgcaagaacagtgcggaactagggcaggagctggagatgccatgagagactcggaggaaactccagactgacggcatgcaaaggcttgcctctgtcgttaagcctaaggaaggatcccctaacggaacctccgatcc

SEQ ID NO: 74531 - DNA, 31 bp, Homo sapiens
  misc_feature 1..31: note = chr12:2999407-2999438
  misc_feature 1..31: note = hypo
  source 1..31: mol_type = genomic DNA
agtctctggattccctcgtgtgctttagggg

SEQ ID NO: 74532 - DNA, 90 bp, Homo sapiens
  misc_feature 1..90: note = chr12:300471-300561
  misc_feature 1..90: note = hypo
  source 1..90: mol_type = genomic DNA
gcacatggccagcaccgcacagtatgagtgagtcaatgaatgaaccgtttgaggtgagaagggaggcagcaataccgtgactacgaatga

SEQ ID NO: 74533 - DNA, 30 bp, Homo sapiens
  misc_feature 1..30: note = chr12:30260329-30260359
  misc_feature 1..30: note = hypo
  source 1..30: mol_type = genomic DNA
tatttttatttataacgacttgcagaaaaa

SEQ ID NO: 74534 - DNA, 175 bp, Homo sapiens
  misc_feature 1..175: note = chr12:30322750-30322925
  misc_feature 1..175: note = hyper
  source 1..175: mol_type = genomic DNA
agtcccacaactccgcgacacgtcccagccaaggcgcggcggggagccttggacaggagtgcacttgaaggtgagggtgcagagtggccggtgggacttgtggctggtgttctcggccatgccctggccccagaagtcgttggtgaagatgccccagcagagcgaggcgctgggc

SEQ ID NO: 74535 - DNA, 426 bp, Homo sapiens; identical to SEQ ID NO: 3863
  misc_feature 1..426: note = chr12:30323014-30323440
  misc_feature 1..426: note = hyper
  source 1..426: mol_type = genomic DNA

SEQ ID NO: 74536 - DNA, 57 bp, Homo sapiens
  misc_feature 1..57: note = chr12:30323502-30323559
  misc_feature 1..57: note = hyper
  source 1..57: mol_type = genomic DNA
cgccagcttcgtgatcttctgcccggactttctctcacccgccgggcgctgcgtcct

SEQ ID NO: 74537 - DNA, 112 bp, Homo sapiens
  misc_feature 1..112: note = chr12:30354005-30354117
  misc_feature 1..112: note = hyper
  source 1..112: mol_type = genomic DNA
cttcccggaaagcagcggcacttttctccctggaaggtgggtgtgggggttccaggcttcgcacctgctaaacctgcctcgtcacctgggaggggtccgccagatgtgcccc

SEQ ID NO: 74538 - DNA, 20 bp, Homo sapiens
  misc_feature 1..20: note = chr12:30859424-30859444
  misc_feature 1..20: note = hypo
  source 1..20: mol_type = genomic DNA
acaagcgtaagccactgtac

SEQ ID NO: 74539 - DNA, 41 bp, Homo sapiens; identical to SEQ ID NO: 43415
  misc_feature 1..41: note = chr12:30947564-30947605
  misc_feature 1..41: note = hypo
  source 1..41: mol_type = genomic DNA

SEQ ID NO: 74540 - DNA, 45 bp, Homo sapiens
  misc_feature 1..45: note = chr12:30948625-30948670
  misc_feature 1..45: note = hyper
  source 1..45: mol_type = genomic DNA
tgaagtcagtcgggccgcccgcttgctgcacggcagccgtgggac

SEQ ID NO: 74541 - DNA, 20 bp, Homo sapiens
  misc_feature 1..20: note = chr12:30959879-30959899
  misc_feature 1..20: note = hypo
  source 1..20: mol_type = genomic DNA
caccgcgcccagcccagaat

SEQ ID NO: 74542 - DNA, 15 bp, Homo sapiens
  misc_feature 1..15: note = chr12:30975310-30975325
  misc_feature 1..15: note = hyper
  source 1..15: mol_type = genomic DNA
cacaaaacaaaagag

SEQ ID NO: 74543 - DNA, 551 bp, Homo sapiens; identical to SEQ ID NO: 34297
  misc_feature 1..551: note = chr12:30975388-30975939
  misc_feature 1..551: note = hyper
  source 1..551: mol_type = genomic DNA

SEQ ID NO: 74544 - DNA, 110 bp, Homo sapiens; identical to SEQ ID NO: 34298
  misc_feature 1..110: note = chr12:31079258-31079368
  misc_feature 1..110: note = hyper
  source 1..110: mol_type = genomic DNA

SEQ ID NO: 74545 - DNA, 247 bp, Homo sapiens; identical to SEQ ID NO: 3867
  misc_feature 1..247: note = chr12:31079417-31079664
  misc_feature 1..247: note = hyper
  source 1..247: mol_type = genomic DNA

SEQ ID NO: 74546 - DNA, 245 bp, Homo sapiens
  misc_feature 1..245: note = chr12:31079693-31079938
  misc_feature 1..245: note = hyper
  source 1..245: mol_type = genomic DNA
cgcagctcccttcgccgcttccggagcccctggcagggtaagtgcagaagcgcgcccgaggagtgggggcgccgcgggagggggctgggggtccaggagaggcgcctccacctccgctgcccgccccgccggcagtcccgagctagactgtcccgagcttcccccgggcgggcagagggaagccggctggggatgaggagtggaggaggcaggaatgcctgggacactcgcggggcatgtgagca

SEQ ID NO: 74547 - DNA, 30 bp, Homo sapiens
  misc_feature 1..30: note = chr12:31134289-31134319
  misc_feature 1..30: note = hypo
  source 1..30: mol_type = genomic DNA
cttcaccactgatggcgccgggctctcttc

SEQ ID NO: 74548 - DNA, 101 bp, Homo sapiens
  misc_feature 1..101: note = chr12:31230802-31230903
  misc_feature 1..101: note = hypo
  source 1..101: mol_type = genomic DNA
acgtgtatgttaacttgcgctatccaaacaacaagctgtgcttatggtcctctgcctgtgcgtcatgattttccaggacttcacaacgggataaagtgaag

SEQ ID NO: 74549 - DNA, 174 bp, Homo sapiens
  misc_feature 1..174: note = chr12:31255181-31255355
  misc_feature 1..174: note = hypo
  source 1..174: mol_type = genomic DNA
ccaggaacctaagagcgcacaccaggtggagcaggtgctgctggcatattccaggtgcatccaggtgcgggcgtcatgctgggcttgggtctgagatcgtgtgggggtggcagctggaaacgttgtgggtgtcatccaagttttggctcagcaactcagcgtctgggtttctcc

SEQ ID NO: 74550 - DNA, 30 bp, Homo sapiens
  misc_feature 1..30: note = chr12:31744505-31744535
  misc_feature 1..30: note = hyper
  source 1..30: mol_type = genomic DNA
ctcccttcccccagccgtcaccccatttac

SEQ ID NO: 74551 - DNA, 105 bp, Homo sapiens
  misc_feature 1..105: note = chr12:3198028-3198133
  misc_feature 1..105: note = hypo
  source 1..105: mol_type = genomic DNA
ttggagcagctcaggcgcgggaggctggtggtgggagccagtgttggtctttgaacagtggaatgacaggatgaaaagggacactataggctgggtgtgatggct

SEQ ID NO: 74552 - DNA, 22 bp, Homo sapiens
  misc_feature 1..22: note = chr12:32086687-32086709
  misc_feature 1..22: note = hypo
  source 1..22: mol_type = genomic DNA
ttttattttgaaattcggggac

SEQ ID NO: 74553 - DNA, 180 bp, Homo sapiens
  misc_feature 1..180: note = chr12:32087009-32087189
  misc_feature 1..180: note = hypo
  source 1..180: mol_type = genomic DNA
agcaaagccagttaccttctcatttctgtgagatgaattcatagtgaaggagtgaaggatgtgccactccaaaatctgctgaattagtatactgattatttaagctaaagacactttagaaactgtagttgcagaaagggcgagctagccaggcatggtggcacacgcctgtgccacagc

SEQ ID NO: 74554 - DNA, 77 bp, Homo sapiens
  misc_feature 1..77: note = chr12:32188978-32189055
  misc_feature 1..77: note = hypo
  source 1..77: mol_type = genomic DNA
tcactctgtgaagtacgcatcccatttagggcaaatgacagcctttttaagttaattttgctctttttttttttttt

SEQ ID NO: 74555 - DNA, 30 bp, Homo sapiens
  misc_feature 1..30: note = chr12:32251556-32251586
  misc_feature 1..30: note = hypo
  source 1..30: mol_type = genomic DNA
agaaatgaaaacatacgtccacaagaaagt

SEQ ID NO: 74556 - DNA, 27 bp, Homo sapiens
  misc_feature 1..27: note = chr12:32340317-32340344
  misc_feature 1..27: note = hypo
  source 1..27: mol_type = genomic DNA
aatctatgggctgggcgcggtggctca

SEQ ID NO: 74557 - DNA, 151 bp, Homo sapiens; identical to SEQ ID NO: 15647
  misc_feature 1..151: note = chr12:32597645-32597796
  misc_feature 1..151: note = hypo
  source 1..151: mol_type = genomic DNA

SEQ ID NO: 74558 - DNA, 40 bp, Homo sapiens; identical to SEQ ID NO: 43420
  misc_feature 1..40: note = chr12:32831140-32831180
  misc_feature 1..40: note = hypo
  source 1..40: mol_type = genomic DNA

SEQ ID NO: 74559 - DNA, 240 bp, Homo sapiens; identical to SEQ ID NO: 43421
  misc_feature 1..240: note = chr12:32831300-32831540
  misc_feature 1..240: note = hypo
  source 1..240: mol_type = genomic DNA

SEQ ID NO: 74560 - DNA, 30 bp, Homo sapiens
  misc_feature 1..30: note = chr12:330158-330188
  misc_feature 1..30: note = hypo
  source 1..30: mol_type = genomic DNA
gggggtggcgggagccgagggtcctgctgg

SEQ ID NO: 74561 - DNA, 30 bp, Homo sapiens
  misc_feature 1..30: note = chr12:33047302-33047332
  misc_feature 1..30: note = hypo
  source 1..30: mol_type = genomic DNA
tcagcacctgcacagcgcccggcatgaaga

SEQ ID NO: 74562 - DNA, 55 bp, Homo sapiens
  misc_feature 1..55: note = chr12:33048730-33048785
  misc_feature 1..55: note = hyper
  source 1..55: mol_type = genomic DNA
atcagacttgcatcacgcccgcactggtgggggtaggaagcgcagctaggcgggc

SEQ ID NO: 74563 - DNA, 64 bp, Homo sapiens; identical to SEQ ID NO: 34302
  misc_feature 1..64: note = chr12:33049326-33049390
  misc_feature 1..64: note = hyper
  source 1..64: mol_type = genomic DNA

SEQ ID NO: 74564 - DNA, 244 bp, Homo sapiens
  misc_feature 1..244: note = chr12:33050001-33050245
  misc_feature 1..244: note = hyper
  source 1..244: mol_type = genomic DNA
ggtcgcgcacgttgtcggagtcccagcggataccgcctgccggggccgcgccccgctctgcccacgccccgcgctggacaggatggatttccgctcgatgcagggaggggctgccctgcaggcaggtgagccctcgagagtcactcctgttcttggactgaggcttgcctccgggatccccgagcgagtagtatgtctggttagtcaggctttgtcgcactgttggaaacgtttcctggttttc

SEQ ID NO: 74565 - DNA, 30 bp, Homo sapiens
  misc_feature 1..30: note = chr12:33139125-33139155
  misc_feature 1..30: note = hypo
  source 1..30: mol_type = genomic DNA
cacgggaaaggggagcgatcaggtccagtt

SEQ ID NO: 74566 - DNA, 345 bp, Homo sapiens
  misc_feature 1..345: note = chr12:33205376-33205721
  misc_feature 1..345: note = hypo
  source 1..345: mol_type = genomic DNA
gccaggcctcctggccgccacgcagaatacctcgaatctggcgggctgtgatcgagcccccctgacctgtcagcctcgagcccaacacccgactcggggccgaggctaggctgcccctccctgtgggctcagggtctcctgccggggaggcagccaagagctctgtccacaaaaccaaatctgggtgtcagaggccaagaccccggggtgggatcagggaccatcccctcacggggcataaggtcatttttcccccagagcctggatccctgtcccccacggggcaagctgggtccctggagccctggagtggagcggcgagtcccggggcggtgcctgtctcag

SEQ ID NO: 74567 - DNA, 30 bp, Homo sapiens
  misc_feature 1..30: note = chr12:33205934-33205964
  misc_feature 1..30: note = hypo
  source 1..30: mol_type = genomic DNA
gggaccccagcccatcgtgggcgtcgtcag

SEQ ID NO: 74568 - DNA, 38 bp, Homo sapiens
  misc_feature 1..38: note = chr12:3340974-3341012
  misc_feature 1..38: note = hypo
  source 1..38: mol_type = genomic DNA
ctctgccttttcacccgctgtcgcgtgcatgcccagcc

SEQ ID NO: 74569 - DNA, 265 bp, Homo sapiens
  misc_feature 1..265: note = chr12:33591748-33592013
  misc_feature 1..265: note = hyper
  source 1..265: mol_type = genomic DNA
aaattgtcaggtgcccgacaggttgcagccgcgggttacctcggaggccaaggcagccacctctgcaagggagttctgcgtccaagcatggcttgtccgtcccgcctggcccccatcaacaaggccgggaccagcggccggtggaacgagcgagagcagccctagtcccacaggtgagccgcccccacaagcagccaagccgcgagccgtcccggcgccgtcaccgcccgcactcacttctccactccgggagggagatgggagg

SEQ ID NO: 74570 - DNA, 35 bp, Homo sapiens
  misc_feature 1..35: note = chr12:33592057-33592092
  misc_feature 1..35: note = hyper
  source 1..35: mol_type = genomic DNA
cggcgccgggaggcgggaagcggaccagagaatgg

SEQ ID NO: 74571 - DNA, 64 bp, Homo sapiens; identical to SEQ ID NO: 34305
  misc_feature 1..64: note = chr12:33592578-33592642
  misc_feature 1..64: note = hyper
  source 1..64: mol_type = genomic DNA

SEQ ID NO: 74572 - DNA, 205 bp, Homo sapiens; identical to SEQ ID NO: 34306
  misc_feature 1..205: note = chr12:33592643-33592848
  misc_feature 1..205: note = hyper
  source 1..205: mol_type = genomic DNA

SEQ ID NO: 74573 - DNA, 102 bp, Homo sapiens; identical to SEQ ID NO: 34307
  misc_feature 1..102: note = chr12:33592932-33593034
  misc_feature 1..102: note = hyper
  source 1..102: mol_type = genomic DNA

SEQ ID NO: 74574 - DNA, 40 bp, Homo sapiens; identical to SEQ ID NO: 11185
  misc_feature 1..40: note = chr12:33593092-33593132
  misc_feature 1..40: note = hyper
  source 1..40: mol_type = genomic DNA

SEQ ID NO: 74575 - DNA, 33 bp, Homo sapiens
  misc_feature 1..33: note = chr12:3414273-3414306
  misc_feature 1..33: note = hypo
  source 1..33: mol_type = genomic DNA
cacttttgtgatcatcgtcgtgtgaatgcaggt

SEQ ID NO: 74576 - DNA, 195 bp, Homo sapiens
  misc_feature 1..195: note = chr12:3419740-3419935
  misc_feature 1..195: note = hypo
  source 1..195: mol_type = genomic DNA
ccgactccctgctgccgcccagaacctagagggagtgaggtgctgcagcgtctgtaactgaacgggagacccaggccgctggcagcagggagggctgcatcctggcatctcaccaccttccttctattaccaccatgggctgggagtcaggcccagaagatagtcctgaagaggtggcagcgtcacgctgctccc

SEQ ID NO: 74577 - DNA, 34 bp, Homo sapiens
  misc_feature 1..34: note = chr12:3421073-3421107
  misc_feature 1..34: note = hypo
  source 1..34: mol_type = genomic DNA
tgattaaggtgtgggcgtgcgctgtcttacaaag

SEQ ID NO: 74578 - DNA, 30 bp, Homo sapiens
  misc_feature 1..30: note = chr12:34261260-34261290
  misc_feature 1..30: note = hyper
  source 1..30: mol_type = genomic DNA
ggctgccacagggaccgctcgagatccgaa

SEQ ID NO: 74579 - DNA, 30 bp, Homo sapiens
  misc_feature 1..30: note = chr12:34358492-34358522
  misc_feature 1..30: note = hypo
  source 1..30: mol_type = genomic DNA
agggggagagcagcccggcagggggcgagt

SEQ ID NO: 74580 - DNA, 43 bp, Homo sapiens; identical to SEQ ID NO: 43423
  misc_feature 1..43: note = chr12:34362659-34362702
  misc_feature 1..43: note = hypo
  source 1..43: mol_type = genomic DNA

SEQ ID NO: 74581 - DNA, 105 bp, Homo sapiens
  misc_feature 1..105: note = chr12:34364426-34364531
  misc_feature 1..105: note = hypo
  source 1..105: mol_type = genomic DNA
cccccccagtctcggcgcagaggctgccgggaaggcactgtggtccgtgggagtaccccggcccaccgctttttccccttgcagcctcaacgtcccctttcaagc

SEQ ID NO: 74582 - DNA, 30 bp, Homo sapiens
  misc_feature 1..30: note = chr12:34463923-34463953
  misc_feature 1..30: note = hypo
  source 1..30: mol_type = genomic DNA
acccatggtgcgtgtcgtgctcacggggac

SEQ ID NO: 74583 - DNA, 90 bp, Homo sapiens
  misc_feature 1..90: note = chr12:34464013-34464103
  misc_feature 1..90: note = hypo
  source 1..90: mol_type = genomic DNA
gctggtgcctctccctccctttcaagccttatcttcccttctgggtcttcttgccactttgggctgcacgccgcgcgtgccacacgctct

SEQ ID NO: 74584 - DNA, 58 bp, Homo sapiens
  misc_feature 1..58: note = chr12:34471693-34471751
  misc_feature 1..58: note = hypo
  source 1..58: mol_type = genomic DNA
ggatccttggggtaccgagctggggctgctgggaaggcactttcgtcagtgggggacc

SEQ ID NO: 74585 - DNA, 30 bp, Homo sapiens
  misc_feature 1..30: note = chr12:34472580-34472610
  misc_feature 1..30: note = hypo
  source 1..30: mol_type = genomic DNA
gaaggcacttttgtccgttgggcgacccag

SEQ ID NO: 74586 - DNA, 115 bp, Homo sapiens
  misc_feature 1..115: note = chr12:34474495-34474610
  misc_feature 1..115: note = hypo
  source 1..115: mol_type = genomic DNA
ttttttccatccacacgtgctccacctcacctttcaagccttatcgtcccttctgaaccctcttgcccctttgcggtaatgccgttgtcgcgacatgcaccgtgggtgtgaacca

SEQ ID NO: 74587 - DNA, 36 bp, Homo sapiens
  misc_feature 1..36: note = chr12:34478137-34478173
  misc_feature 1..36: note = hypo
  source 1..36: mol_type = genomic DNA
acattggggtacacccgtgggcgcgacacacaccgt

SEQ ID NO: 74588 - DNA, 81 bp, Homo sapiens; identical to SEQ ID NO: 43427
  misc_feature 1..81: note = chr12:34494888-34494969
  misc_feature 1..81: note = hypo
  source 1..81: mol_type = genomic DNA

SEQ ID NO: 74589 - DNA, 30 bp, Homo sapiens
  misc_feature 1..30: note = chr12:34501815-34501845
  misc_feature 1..30: note = hypo
  source 1..30: mol_type = genomic DNA
tctccaccggtgcctcgacctcccctttca

SEQ ID NO: 74590 - DNA, 268 bp, Homo sapiens; identical to SEQ ID NO: 43428
  misc_feature 1..268: note = chr12:34502619-34502887
  misc_feature 1..268: note = hypo
  source 1..268: mol_type = genomic DNA

SEQ ID NO: 74591 - DNA, 136 bp, Homo sapiens
  misc_feature 1..136: note = chr12:34519267-34519403
  misc_feature 1..136: note = hypo
  source 1..136: mol_type = genomic DNA
ctggccctggtggaccgtaggcactccgtggccatgagtcagggatgccaagggtcccctgggccccgcgcatgctcagtagagaggcaatgcctcccatgttgggggacctctgcctcgccgtttgtgttttcct

SEQ ID NO: 74592 - DNA, 113 bp, Homo sapiens; identical to SEQ ID NO: 43430
  misc_feature 1..113: note = chr12:34520137-34520250
  misc_feature 1..113: note = hypo
  source 1..113: mol_type = genomic DNA

SEQ ID NO: 74593 - DNA, 65 bp, Homo sapiens
  misc_feature 1..65: note = chr12:34522274-34522339
  misc_feature 1..65: note = hypo
  source 1..65: mol_type = genomic DNA
acatagatgccaacccgggatgcccaaggtttccagggatccacgcattgcggtggggaggcact

SEQ ID NO: 74594 - DNA, 38 bp, Homo sapiens
  misc_feature 1..38: note = chr12:34527377-34527415
  misc_feature 1..38: note = hypo
  source 1..38: mol_type = genomic DNA
tttccctaggccccacgcatgtacggtggggaggcaat

SEQ ID NO: 74595 - DNA, 785 bp, Homo sapiens
  misc_feature 1..785: note = chr12:3474882-3475667
  misc_feature 1..785: note = hyper
  source 1..785: mol_type = genomic DNA
gggacagccatgtcccgggagggcacacggcccccagaggcccagagctcttcccaaggcacaagtgcagaaggcggactcaggcgtgtggttaaggaccccctgctgcgggcccctgcacacaccaacgcgtgctcccacgcgccgcgactcccccgggatgcctgccccacccctatccgcagccagcgtccccctgcccgccggccccgccacggtccatcagggactgcgggcggcggaggtggcggcgccttgccgggacccccagcctccctcccccgcccccggcgccccaccccacgcgggcgcgcttctcccgccgcagccgcccgcgctcacctggcccggacacgggctccgccacgcggtgatggaagctgagcctagagaggcggagagcggcggctcgcagggccacccagcggcacacggcccgcgcctcggcccgccccttccttgccggccgggggagtgtccgcgcgcctccagcccgccccgcgccccgctgcggtgcccagtgcccgccgtcctcacctggccagcgggacgcgcccgggaaccccgcacgcgggcgggccgcctctttgttagcaagtttgcctttctgtgattcagagcacgcggagcgaattaagtggagtgaggggtactgtgcgactgtctgcgggaaacctgcggggagcgcgggaagggatggacttgatgagccgcggcgcagcggctttcaaacctccccgcgctccgcagcccccagcccccgccctacccgccctctcagatcc

SEQ ID NO: 74596 - DNA, 106 bp, Homo sapiens
  misc_feature 1..106: note = chr12:3562914-3563020
  misc_feature 1..106: note = hypo
  source 1..106: mol_type = genomic DNA
tgtcctgacgtggcccgactgtggacccccttgtcctcctgcccgctgtgtctatttctcagctcctgctatgctaggtctgggcttccgacgccggccctgctcc

SEQ ID NO: 74597 - DNA, 256 bp, Homo sapiens; identical to SEQ ID NO: 34207
  misc_feature 1..256: note = chr12:3599973-3600229
  misc_feature 1..256: note = hyper
  source 1..256: mol_type = genomic DNA

SEQ ID NO: 74598 - DNA, 304 bp, Homo sapiens
  misc_feature 1..304: note = chr12:3600230-3600534
  misc_feature 1..304: note = hyper
  source 1..304: mol_type = genomic DNA
gagactaggggagggggcgggcccgggggcgctgggggccctcggtctgcgcccagccgccgccggctccagcgaacctcctaccccgcccccactcacccggctcagcccctaggagagacgcgcaggaagcgtgttgcttcgcccagcggatcggcagaagttgagaggagttggcggctgcctccggccggccggactttgcgagcagcctggagaggatccgcgaccgccgccgccgccgccgcggaggcttcggggctgcttccctcgagcttagcccgcagcgcgggtggagaggggc

SEQ ID NO: 74599 - DNA, 15 bp, Homo sapiens
  misc_feature 1..15: note = chr12:3600768-3600783
  misc_feature 1..15: note = hyper
  source 1..15: mol_type = genomic DNA
tcaccaaacccttgc

SEQ ID NO: 74600 - skipped

SEQ ID NO: 74601 - DNA, 214 bp, Homo sapiens; identical to SEQ ID NO: 34211
  misc_feature 1..214: note = chr12:3601042-3601256
  misc_feature 1..214: note = hyper
  source 1..214: mol_type = genomic DNA

SEQ ID NO: 74602 - DNA, 147 bp, Homo sapiens
  misc_feature 1..147: note = chr12:3601478-3601625
  misc_feature 1..147: note = hyper
  source 1..147: mol_type = genomic DNA
ctcagatatcagagccgcctctgggtagctaaacccggcagggcacacgggccgcggccaccttcagcaccagggacagcgtccgcccctgcagcagccgagcctgcgcggactgtgggggctgcgcgccgccggctgcagtgagaa

SEQ ID NO: 74603 - DNA, 696 bp, Homo sapiens; identical to SEQ ID NO: 34213
  misc_feature 1..696: note = chr12:3602021-3602717
  misc_feature 1..696: note = hyper
  source 1..696: mol_type = genomic DNA

SEQ ID NO: 74604 - DNA, 97 bp, Homo sapiens
  misc_feature 1..97: note = chr12:3602864-3602961
  misc_feature 1..97: note = hyper
  source 1..97: mol_type = genomic DNA
cgctcccccttctcagcagttgcacatgccagctctgctgaaggcatcaatgaaaacagcagtaggggcggccgggctcctgcgaacaacaacaaaa

SEQ ID NO: 74605 - DNA, 37 bp, Homo sapiens
  misc_feature 1..37: note = chr12:3640833-3640870
  misc_feature 1..37: note = hypo
  source 1..37: mol_type = genomic DNA
tgagggcggccttcgcgtcaagcgtctcagtgaccct

SEQ ID NO: 74606 - DNA, 113 bp, Homo sapiens
  misc_feature 1..113: note = chr12:3724027-3724140
  misc_feature 1..113: note = hypo
  source 1..113: mol_type = genomic DNA
gactatccctttggccgccgcagaacaggggccaagaaagattaactaccccggtggcacctgagtgctgtacctttggcctgcaggaagccgcaagtcgagccctgcatagt

SEQ ID NO: 74607 - DNA, 40 bp, Homo sapiens
  misc_feature 1..40: note = chr12:37937804-37937844
  misc_feature 1..40: note = hypo
  source 1..40: mol_type = genomic DNA
ggatgaagaaacccccggcgaagtccgtgggaagcaccac

SEQ ID NO: 74608 - DNA, 148 bp, Homo sapiens
  misc_feature 1..148: note = chr12:38471923-38472071
  misc_feature 1..148: note = hypo
  source 1..148: mol_type = genomic DNA
atgatgtcggcagagcgatatcaacaagagtgattataaagtagctggccttataagtcaagagttatgatctttgatccactgctcaatcaatttcaagatctgatctacattcttttcttttctttcttttttttttctaggctgg

SEQ ID NO: 74609 - DNA, 183 bp, Homo sapiens
  misc_feature 1..183: note = chr12:38543382-38543565
  misc_feature 1..183: note = hypo
  source 1..183: mol_type = genomic DNA
aggcttgacctgagacgcaggggcattgtgcgggtggctggggatgcccttcctggcccagcggcaggccagtgcaggtcctggccatctgaggcatctgctgaattattttccaagtccctggtggagtcagggaccatcctgcactgtcctctggttaccaaggagcggtcacagggccca

SEQ ID NO: 74610 - DNA, 30 bp, Homo sapiens
  misc_feature 1..30: note = chr12:38548005-38548035
  misc_feature 1..30: note = hypo
  source 1..30: mol_type = genomic DNA
ctgcgctggcctcagcgaggtcgtggagtc

SEQ ID NO: 74611 - DNA, 30 bp, Homo sapiens
  misc_feature 1..30: note = chr12:38548938-38548968
  misc_feature 1..30: note = hypo
  source 1..30: mol_type = genomic DNA
gaagttgaggcagcacggggaaaaaagcag

SEQ ID NO: 74612 - DNA, 98 bp, Homo sapiens
  misc_feature 1..98: note = chr12:38549408-38549506
  misc_feature 1..98: note = hypo
  source 1..98: mol_type = genomic DNA
tccctgcagcccctgcgccgggcccgggggagttgtggagtccctgtcttataccagggtaggtttctcgcccatggcgggggcgcatcccaaagcgg

SEQ ID NO: 74613 - DNA, 60 bp, Homo sapiens
  misc_feature 1..60: note = chr12:38550213-38550273
  misc_feature 1..60: note = hypo
  source 1..60: mol_type = genomic DNA
agtacagtggctccccgacaggccctgcgccgggtctagagaggtcgtggaatccctggc

SEQ ID NO: 74614 - DNA, 236 bp, Homo sapiens
  misc_feature 1..236: note = chr12:38550662-38550898
  misc_feature 1..236: note = hypo
  source 1..236: mol_type = genomic DNA
attgcacccagggtgcgtgtcgcccccacggcgggcaccccaaagcgtcaagaatgaccccacgggaaggggaaagcatgtcggtcttaaagagggacgttgaggcagcccggagaaaaaaacagggaggctggggtccttccaccgatgacagtgccttcccggcatcccatgtgccatctccgggcgggtcgtggagtccctggctttcacccagggtgcgtgtatctcccatt

SEQ ID NO: 74615 - DNA, 152 bp, Homo sapiens
  misc_feature 1..152: note = chr12:38551153-38551305
  misc_feature 1..152: note = hypo
  source 1..152: mol_type = genomic DNA
aggcgtgaaaggtgacgttgaggcagcacgagggaaaaagcagcaggcagcgatcgtcacacggacgacagtgccttcccggcagcccctgcgccagactcggggttgtcgtggagttcctgacttgaacccagggtgcgtgtcgcgcccac

SEQ ID NO: 74616 - DNA, 92 bp, Homo sapiens
  misc_feature 1..92: note = chr12:38551365-38551457
  misc_feature 1..92: note = hypo
  source 1..92: mol_type = genomic DNA
aaaggggactttgaagcagtccaggaaaaaacttcccacggaccacggtgccttcccggcagcccctttgccaggcccgagggggttgttgt

SEQ ID NO: 74617 - DNA, 234 bp, Homo sapiens
  misc_feature 1..234: note = chr12:38551828-38552062
  misc_feature 1..234: note = hypo
  source 1..234: mol_type = genomic DNA
cccctgcgtcaggcccggggtggtcgtggagtccctggcttgcaccgagggtgcgggtcgcacccatgggggcaccccaaagtggcaagaaggccgccgggcgaacgccacagaaggccaggctttaatggggatgctgaggcagcacagagagaaaagcggctagtcgggttcctcctacggatgacagtgccttcctggcagtccctgcgctgggcccggggggatcgtgga

SEQ ID NO: 74618 - DNA, 36 bp, Homo sapiens; identical to SEQ ID NO: 43437
  misc_feature 1..36: note = chr12:38553830-38553866
  misc_feature 1..36: note = hypo
  source 1..36: mol_type = genomic DNA

SEQ ID NO: 74619 - DNA, 54 bp, Homo sapiens
  misc_feature 1..54: note = chr12:38554204-38554258
  misc_feature 1..54: note = hypo
  source 1..54: mol_type = genomic DNA
atgacagtgccttcccggaagccgctgcgcagggcccggcgtgtttgtggagtc

SEQ ID NO: 74620 - DNA, 80 bp, Homo sapiens
  misc_feature 1..80: note = chr12:38595481-38595561
  misc_feature 1..80: note = hypo
  source 1..80: mol_type = genomic DNA
tgttggtagcggcagtggtggggctggcgcccctgcgttgcggcccctgggctccctgccagggacgcagtggaactggc

SEQ ID NO: 74621 - DNA, 34 bp, Homo sapiens
  misc_feature 1..34: note = chr12:38836094-38836128
  misc_feature 1..34: note = hypo
  source 1..34: mol_type = genomic DNA
cacacccagtcccatcgaccgcccaagactgagg

SEQ ID NO: 74622 - DNA, 17 bp, Homo sapiens
  misc_feature 1..17: note = chr12:39142109-39142126
  misc_feature 1..17: note = hypo
  source 1..17: mol_type = genomic DNA
aacgcaatactattaat

SEQ ID NO: 74623 - DNA, 131 bp, Homo sapiens
  misc_feature 1..131: note = chr12:39298556-39298687
  misc_feature 1..131: note = hyper
  source 1..131: mol_type = genomic DNA
tgtactgagccactgcgcccggccgagagtcagtttttacaagcactcagatgtgggcccgaaaacaaatcaaaacaaaagtcgtgacttcccagatcttaggtaaggcatagattcgtctgcaaggaggg

SEQ ID NO: 74624 - DNA, 194 bp, Homo sapiens
  misc_feature 1..194: note = chr12:39298908-39299102
  misc_feature 1..194: note = hyper
  source 1..194: mol_type = genomic DNA
cccaaccatccagcccgggtttggggcggaaaaccggcttgtaaagtgggcggcggccggtgttcccacagctgagtcacagcccagccaacttttacagcgtttcccagaaagaaaatacaaagtctcagtcccggagcccaccgcttctaattcccgctcccctgtgtcacctgacccggggtaactccagc

SEQ ID NO: 74625 - DNA, 640 bp, Homo sapiens
  misc_feature 1..640: note = chr12:39299368-39300008
  misc_feature 1..640: note = hyper
  source 1..640: mol_type = genomic DNA
cccacaaccacagctcgggcggactgagggctagctcccgtcaggcggggatgggggttgagggtggaggcagaagaaggaggcggaggcagcgcgcgggatgggggagggaagggaggaggcggacctccgcgcagagccacgagggaaccgctagccagtcctgggtgaaactgacgctgccaggcaagtggcgcgcggggatcccggtttcccagcccccttccggcaggcagcagcccgggcgggggacacactccgtgatcccctcctggctggaggggtcaggcttggtggacccagcaagcagcctgatggagaaggtggcaccagacgcagacccctaccgtccaggaccgcaagccctcgccggctctgcgtgcttttaggttttgtctccacctctgcacacccacactcgcctcctgggccgcgacagcttccttctgtcaatcaggtgtggacgggaaggtctcgaagtttcctcgcctgagttgaaagctggaggtgggggcacctctgcccgttcctaactgccccgttataaggtccccctccccacaattggttctcacctcgccctcggagctcttgggagatccctccgtccctcctactgtgccctcgggcagatgagtct

SEQ ID NO: 74626 - DNA, 75 bp, Homo sapiens
  misc_feature 1..75: note = chr12:39300330-39300405
  misc_feature 1..75: note = hyper
  source 1..75: mol_type = genomic DNA
gtcacaaccatataacgcagctccttcagccgactcccacccgcaagaactgagacctgacggataaaagcagag

SEQ ID NO: 74627 - DNA, 30 bp, Homo sapiens
  misc_feature 1..30: note = chr12:39300876-39300906
  misc_feature 1..30: note = hyper
  source 1..30: mol_type = genomic DNA
gatttccccacccaccgctttttcttcttt

SEQ ID NO: 74628 - DNA, 189 bp, Homo sapiens
  misc_feature 1..189: note = chr12:39539283-39539472
  misc_feature 1..189: note = hyper
  source 1..189: mol_type = genomic DNA
cgccgccccggaaggtcgcgaactcgccgcctccagcgccggcgccttaaccccgccggtcccggcgccaaagtcccgacagtggcggacgccggcaccaggggcgatggagagcaggcgacaccgagggtgtccatccggtccacccaacctggtgcaaggctctgggaagcgcgctgacaggatttc

SEQ ID NO: 74629 - DNA, 33 bp, Homo sapiens
  misc_feature 1..33: note = chr12:39726877-39726910
  misc_feature 1..33: note = hypo
  source 1..33: mol_type = genomic DNA
atgggtcttacttgccgacgaagagccgtaacc

SEQ ID NO: 74630 - DNA, 205 bp, Homo sapiens
  misc_feature 1..205: note = chr12:4018922-4019127
  misc_feature 1..205: note = hypo
  source 1..205: mol_type = genomic DNA
ttaaagagaaatgggcgaaattaaatatttgtatcatttcgacatgtaatcaatacaaaaatgaatgagatgttttatttttttaatactgcatcttcaaaatctgttgtgtgtttttcactcacagcgcagcttaacttggactcaccacctatcaagtgctcgacagccacgtgtgcagtggttcctacgtggagcagcatac

SEQ ID NO: 74631 - DNA, 60 bp, Homo sapiens
  misc_feature 1..60: note = chr12:40501737-40501797
  misc_feature 1..60: note = hypo
  source 1..60: mol_type = genomic DNA
acagttatgtatctgcggtcaggttacattttaaaagaaatgtgacgtgaaaaaaaaggc

SEQ ID NO: 74632 - DNA, 18 bp, Homo sapiens
  misc_feature 1..18: note = chr12:4051745-4051763
  misc_feature 1..18: note = hypo
  source 1..18: mol_type = genomic DNA
aaccgtgtctccaaaaaa

SEQ ID NO: 74633 - DNA, 35 bp, Homo sapiens
  misc_feature 1..35: note = chr12:40540758-40540793
  misc_feature 1..35: note = hypo
  source 1..35: mol_type = genomic DNA
tcctggagagccatgcgtggtggcgcatgcctgta

SEQ ID NO: 74634 - DNA, 34 bp, Homo sapiens
  misc_feature 1..34: note = chr12:40540853-40540887
  misc_feature 1..34: note = hypo
  source 1..34: mol_type = genomic DNA
gggcgacagagtgagaccccgtctctaaaaaaaa

SEQ ID NO: 74635 - DNA, 708 bp, Homo sapiens
  misc_feature 1..708: note = chr12:40618340-40619048
  misc_feature 1..708: note = hyper
  source 1..708: mol_type = genomic DNA
agttcccagaccttccgtggggccgcaggatccccggctggcgggtcgcggagggtggccggccgggctgcgcactgcgcgcctccgctgcggggctccgggcctgtggactcagcggagtccgctgagtcagtttcttcccgcgcgactcccggccgcgccgccgctgcggtggaatctggtcccaggaggcggcgtccgcccggggtccggtctaggcgtgcgtgggggccacggtcacggtcatcccagccaggcccggctccagcagccccacggccgccgccagagttctgcgcggcccgtcgcctcggcggagcctctggcaggcccctgagctcgtttttggggcctgagtgggggaggaggaagccgagcaggagggctccggagagggagggcaacgcggggcggggagctgcctccttcctcataaacaggcgggcgtgggcgccgatggggcccgcggggagcgctggctgcgggcggtgagctgagctcgcccccggggagctgtggccggcgcccctgccggttccctgagcagcggacgttcatgctgggagggcggcgggttggaagcaggtgccaccatggctagtggcagctgtcaggggtgcgaagaggacgaggaaactctgaagaagttgatagtcaggctgaacaatgtccaggaaggaaaacagatagaaacgctggtccaaatcc

SEQ ID NO: 74636 - DNA, 32 bp, Homo sapiens
  misc_feature 1..32: note = chr12:41012036-41012068
  misc_feature 1..32: note = hypo
  source 1..32: mol_type = genomic DNA
ttacaggcctgagccaccgctcccggctgtga

SEQ ID NO: 74637 - DNA, 45 bp, Homo sapiens
  misc_feature 1..45: note = chr12:41086182-41086227
  misc_feature 1..45: note = hyper
  source 1..45: mol_type = genomic DNA
tttccctgtggtccccgccccactttccctgctgccccaataacc

SEQ ID NO: 74638 - DNA, 226 bp, Homo sapiens
  misc_feature 1..226: note = chr12:41086228-41086454
  misc_feature 1..226: note = hyper
  source 1..226: mol_type = genomic DNA
ccctaaaaggccgggcttctgctgtcaagtagccagggtgggctccgccgaggcgaggaggggcgccggtggggagatgcgctcccaggtgtttgcagcggaagtgggaaacctgtagggtatggtccagctgtgccgcaccgaggcgagcaggagcagggaacaggtaggaagctggacttttccttctttgcagataaaataaagaatgcgcatttccatgctg

SEQ ID NO: 74639 - DNA, 393 bp, Homo sapiens
  misc_feature 1..393: note = chr12:41086713-41087106
  misc_feature 1..393: note = hyper
  source 1..393: mol_type = genomic DNA
ccagggatgccatatcgcctcggcaggggaggggtggggaagcagagaggtcggcagcccggggcctgcaggtctttttctcccgacgccggcccgcacctgctcatctttcccatcccacctgggcgcctggctagcgcatcccggaaaacctgggagcggttgcggagaggggaggaagcgacttgtttgtcccctgacccctctgttaagatctagctcccttcaggagatgggggtggggaagaatccctgcaactcgaagggcacgttccgattaattacgtctccgttgagaaggcaccggcccttctccacgatctgcggcaggtgggagggagagaccgcggagccacggccccttccctcctagcctggcgctgtctacgggaa

SEQ ID NO: 74640 - DNA, 349 bp, Homo sapiens
  misc_feature 1..349: note = chr12:4140405-4140754
  misc_feature 1..349: note = hyper
  source 1..349: mol_type = genomic DNA
actgcctgagcctcccgcccgcccgccgcgcccccgcccggggccgggaaacgagcagggacaactccccgcccgcgcctccccgcgcccggcggcccggctagcaacccagaggcgcggcgctgcgattggctgcgcgggggagaaggggcgctgcgctgctccaatcgccggccgcgcccggaggccgcgccgccaggaggccgcggacgcgtgctcgcatgcctgtggtatttgctcagaggggcatgaccacttcgggcaagcctttaaatgtgagtcagctttcggccgatccctgggaaaaattccttcggtgttgtcaggcagggttcgctagctgcagctt

SEQ ID NO: 74641 - DNA, 46 bp, Homo sapiens
  misc_feature 1..46: note = chr12:4154674-4154720
  misc_feature 1..46: note = hypo
  source 1..46: mol_type = genomic DNA
acccccaccacttgccgtgtcagatgctgcgcgggagccgagctca

SEQ ID NO: 74642 - DNA, 979 bp, Homo sapiens
  misc_feature 1..979: note = chr12:41582398-41583377
  misc_feature 1..979: note = hyper
  source 1..979: mol_type = genomic DNA
cggaggcgccggtgcccgctgcagtgccagcccttggcgcccggcgagctgtaccgggtgctgccgctgcgcagcctcatccagaagctgcgagtccagtgcgactaccgcgcccgcggctgcggccactcggtcaggctgcacgagctggaggcgcacgtcgagcactgcgacttcggccctgcccgccggctccgcagccgcgggggctgcgcttcggggctgggcggtggtgaggtgcccgcgcgggggggctgcggtccgacacccagggctggccggggcgggggcgcgcgcggggggccgccgggcggccgctggggccgcgggcggggacccgggcctcgggtcctcgcctggaggcggcgcgagaaggcgctgctggcgcagctctgggcgctgcagggcgaggtgcagctcacggcgcgcaggtaccaggagaagttcacccaatacatggctcacgtccgcaacttcgtcggcgacctcggtggcggccaccgcagggtaagcaaaggggggtgggcaccgcgggcatggtcgattggggtgggaaaaggagcggttctttctgacgcttcaggattcctttggaattgggcatccttcctcactatgcagcaggaaacatccacaccctgatcatactttcctgtcattatcttacgaatggattggcgtcgaagttaaggattgtcccttttctgattatattacgattggaaagagttaaacagattcgattctaactttcccccgggaaagtaggaattgtgaaaactcattttccatccagactctcgttttccatctttcaccctcctgcccaccgtctctgcctattttttgagcacttgtcccgtgcctgaagcaaatccgagaaggaaagacagaaagcgaagactttcccggcccagcctttcctctcccgcggccaccagcatccccgcggccctggcagccgcgcacgcacacctgg

SEQ ID NO: 74643 - DNA, 145 bp, Homo sapiens
  misc_feature 1..145: note = chr12:41583648-41583793
  misc_feature 1..145: note = hyper
  source 1..145: mol_type = genomic DNA
gtcagaccggccctgcgagcccccaggcagcggttgtttcccttctttgtctaagctgctggccccgaactgcgctcctggtcctcccgccggctttcataccgaataaacaagcctctttgcagcatcccgtgtgaagaggctt

SEQ ID NO: 74644 - DNA, 164 bp, Homo sapiens
  misc_feature 1..164: note = chr12:41584085-41584249
  misc_feature 1..164: note = hyper
  source 1..164: mol_type = genomic DNA
tgtgtattaaacgaccggtttcaaggagtatttctctagttcatatatgcatatacatatacgcatatatacaggtaaatttacaaaacgggaggacccggggaaaagcacagatagaagctttgtattaccagtccaggtttcaaggtcgtaggaaaccaatg

SEQ ID NO: 74645 - DNA, 30 bp, Homo sapiens; identical to SEQ ID NO: 43440
  misc_feature 1..30: note = chr12:41925162-41925192
  misc_feature 1..30: note = hypo
  source 1..30: mol_type = genomic DNA

SEQ ID NO: 74646 - DNA, 30 bp, Homo sapiens
  misc_feature 1..30: note = chr12:41934689-41934719
  misc_feature 1..30: note = hypo
  source 1..30: mol_type = genomic DNA
gttgtcccttttcttcgttgttgttgttgt

SEQ ID NO: 74647 - DNA, 196 bp, Homo sapiens; identical to SEQ ID NO: 43325
  misc_feature 1..196: note = chr12:4194712-4194908
  misc_feature 1..196: note = hypo
  source 1..196: mol_type = genomic DNA

SEQ ID NO: 74648 - DNA, 30 bp, Homo sapiens
  misc_feature 1..30: note = chr12:41957024-41957054
  misc_feature 1..30: note = hypo
  source 1..30: mol_type = genomic DNA
ttccattactctgagcgaagaaagatgaac

SEQ ID NO: 74649 - DNA, 30 bp, Homo sapiens
  misc_feature 1..30: note = chr12:42047159-42047189
  misc_feature 1..30: note = hypo
  source 1..30: mol_type = genomic DNA
tcaggtgcattagtccgttttcacactgct

SEQ ID NO: 74650 - DNA, 30 bp, Homo sapiens
  misc_feature 1..30: note = chr12:4206588-4206618
  misc_feature 1..30: note = hypo
  source 1..30: mol_type = genomic DNA
ttggagccaggcctacgtgccagccaccat

SEQ ID NO: 74651 - DNA, 165 bp, Homo sapiens
  misc_feature 1..165: note = chr12:4212424-4212589
  misc_feature 1..165: note = hypo
  source 1..165: mol_type = genomic DNA
atccaaaacaaggaaagtctgagaaactctcacagacaagaaaggctggcaaagaaaagtaatgtggtatccagagccagaaggacagtggggcaaactagtaacatgcaaatcaactgcagagtttagttagtaccagtgcgctggtgccggctccttagttgt

SEQ ID NO: 74652 - DNA, 148 bp, Homo sapiens
  misc_feature 1..148: note = chr12:4214009-4214157
  misc_feature 1..148: note = hypo
  source 1..148: mol_type = genomic DNA
ataaggcttttatctttaattaattcatgcactcatgcatgacattacttgttattagagttagacaaggaatagcatccattctattcatacttttcatttttatagaagtaatgctgggaaaccttgttcacgtaaataagtttgg

SEQ ID NO: 74653 - DNA, 125 bp, Homo sapiens
  misc_feature 1..125: note = chr12:4217500-4217625
  misc_feature 1..125: note = hypo
  source 1..125: mol_type = genomic DNA
cccacaatggaggaccgggtcccctcaggtttgccgaacagaccataaagcttgttaaccttggctgggcgccgaggcaggataatcctaatttcttggcactccctacacggatgcccatggat

SEQ ID NO: 74654 - DNA, 35 bp, Homo sapiens; identical to SEQ ID NO: 34320
  misc_feature 1..35: note = chr12:42326337-42326372
  misc_feature 1..35: note = hyper
  source 1..35: mol_type = genomic DNA

SEQ ID NO: 74655 - DNA, 126 bp, Homo sapiens
  misc_feature 1..126: note = chr12:42326595-42326721
  misc_feature 1..126: note = hyper
  source 1..126: mol_type = genomic DNA
taactacaaccattacgggctccttgccgacagcacgcccacctggcatccctgcactacacctttgcgcgcaccgggcccagccggcccagtccctcaagcatcagtagacggaaaatgctcctg

SEQ ID NO: 74656 - DNA, 23 bp, Homo sapiens
  misc_feature 1..23: note = chr12:42443414-42443437
  misc_feature 1..23: note = hypo
  source 1..23: mol_type = genomic DNA
ttcctattcggccatcttggctc

SEQ ID NO: 74657 - DNA, 24 bp, Homo sapiens
  misc_feature 1..24: note = chr12:42654216-42654240
  misc_feature 1..24: note = hypo
  source 1..24: mol_type = genomic DNA
gataatagtacttgccgggaggcg

SEQ ID NO: 74658 - DNA, 83 bp, Homo sapiens; identical to SEQ ID NO: 43442
  misc_feature 1..83: note = chr12:42654300-42654383
  misc_feature 1..83: note = hypo
  source 1..83: mol_type = genomic DNA

SEQ ID NO: 74659 - DNA, 84 bp, Homo sapiens; identical to SEQ ID NO: 43327
  misc_feature 1..84: note = chr12:4268526-4268610
  misc_feature 1..84: note = hypo
  source 1..84: mol_type = genomic DNA

SEQ ID NO: 74660 - DNA, 17 bp, Homo sapiens
  misc_feature 1..17: note = chr12:4272614-4272631
  misc_feature 1..17: note = hypo
  source 1..17: mol_type = genomic DNA
agcgagactctgtctca

SEQ ID NO: 74661 - DNA, 15 bp, Homo sapiens
  misc_feature 1..15: note = chr12:4273871-4273886
  misc_feature 1..15: note = hyper
  source 1..15: mol_type = genomic DNA
gcggcacccgggcct

SEQ ID NO: 74662 - DNA, 419 bp, Homo sapiens; identical to SEQ ID NO: 34216
  misc_feature 1..419: note = chr12:4274001-4274420
  misc_feature 1..419: note = hyper
  source 1..419: mol_type = genomic DNA

SEQ ID NO: 74663 - DNA, 30 bp, Homo sapiens
  misc_feature 1..30: note = chr12:4274474-4274504
  misc_feature 1..30: note = hyper
  source 1..30: mol_type = genomic DNA
cgcatcccccatacccgtcctaactcactc

SEQ ID NO: 74664 - DNA, 87 bp, Homo sapiens
  misc_feature 1..87: note = chr12:4280838-4280925
  misc_feature 1..87: note = hypo
  source 1..87: mol_type = genomic DNA
gggtaatttttcctccgtcaccccctcccaccctcccaccttttgcagcctccagtgtctgttatgctactctgtacgtccgtgtgt

SEQ ID NO: 74665 - DNA, 30 bp, Homo sapiens
  misc_feature 1..30: note = chr12:4286260-4286290
  misc_feature 1..30: note = hypo
  source 1..30: mol_type = genomic DNA
aggcatgagccaccacgcttggctttatgc

SEQ ID NO: 74666 - DNA, 76 bp, Homo sapiens
  misc_feature 1..76: note = chr12:42970333-42970409
  misc_feature 1..76: note = hypo
  source 1..76: mol_type = genomic DNA
attaccatctgatagcgtttgatctttgagtcatggctgaagtgacccagattcaaactggcgattattaatgtca

SEQ ID NO: 74667 - DNA, 863 bp, Homo sapiens
  misc_feature 1..863: note = chr12:42983011-42983874
  misc_feature 1..863: note = hyper
  source 1..863: mol_type = genomic DNA
caaacaggagccatgcggagagcctctgcggagccctggcgatgctgcagccaatatctgctttccctgtctacacagcccaacaaaccgattatgaccttctccctgatcttctgcgacaccgacccagtctgggtgtcacagactccggcggtgccagcgaaggtgcccggccctacccctgcggcgctcgccccccaccaccgcgccgcagccccctctgcggaatccgccgggatccaggctgccactcacctcgcgcgagggagacgcaactcggctgcactgtcctcggcgccgctgcggggctgctgggctgcggggctgcggggctgaggagctgcggtccgcggcgtcaggggtgggcgagggtgagcagcgcacgaaccatccagagcccagaaagtctccgtgccgaccgcggcgcgtctcggggaagtcagcgcaggctgcgcgaggctggcatgttccgggcgcgctgtcgggcggcggcggccgcgggagacggcgctggcagctgggctgcaggcggagtgcgctcgggctccggagccgcgcgctgcggcgccgccgcgcaccccgccctcggccgcggggcccggcgcgagcgaaaacgcggagcgcggacgccgccgcgggatcgaggccgctgggcgcgcgcccacgcgtaccccggctcggccctgaaagcgaggtcgggcccggctcgggccgcgcccgggggcagggctgcgagcaggcctgggaccggctccacgcgcagccagtggggcagagcagcaggcggattatgcgcagggagaaaaaagttcaccaaccgcggtccagagtcgcaagtgcggctcgctcggagcctctgcccc

SEQ ID NO: 74668 - DNA, 42 bp, Homo sapiens; identical to SEQ ID NO: 34323
  misc_feature 1..42: note = chr12:42984438-42984480
  misc_feature 1..42: note = hyper
  source 1..42: mol_type = genomic DNA

SEQ ID NO: 74669 - DNA, 101 bp, Homo sapiens
  misc_feature 1..101: note = chr12:4301350-4301451
  misc_feature 1..101: note = hypo
  source 1..101: mol_type = genomic DNA
accgcacctggttggttgcagactttgaatatcaccctgcatgccaatacctacaggcgtgtctcacttcatttatatcgctgtgtcgtgttcttgagcat

SEQ ID NO: 74670 - DNA, 30 bp, Homo sapiens
  misc_feature 1..30: note = chr12:4307938-4307968
  misc_feature 1..30: note = hypo
  source 1..30: mol_type = genomic DNA
gacatttagactattcgagggcactggatg

SEQ ID NO: 74671 - DNA, 34 bp, Homo sapiens
  misc_feature 1..34: note = chr12:4309680-4309714
  misc_feature 1..34: note = hypo
  source 1..34: mol_type = genomic DNA
accaagatggagagccgtgcggtgcagcgtggtg

SEQ ID NO: 74672 - DNA, 30 bp, Homo sapiens
  misc_feature 1..30: note = chr12:4315483-4315513
  misc_feature 1..30: note = hypo
  source 1..30: mol_type = genomic DNA
agaaatcttacttcacggtataattacagg

SEQ ID NO: 74673 - DNA, 36 bp, Homo sapiens
  misc_feature 1..36: note = chr12:4322949-4322985
  misc_feature 1..36: note = hypo
  source 1..36: mol_type = genomic DNA
ccaaagtccacctaccgcctgcgaggacatgtattt

SEQ ID NO: 74674 - DNA, 30 bp, Homo sapiens
  misc_feature 1..30: note = chr12:4334601-4334631
  misc_feature 1..30: note = hypo
  source 1..30: mol_type = genomic DNA
catatcgagcggccacgttttcagaggagg

SEQ ID NO: 74675 - DNA, 30 bp, Homo sapiens; identical to SEQ ID NO: 43330
  misc_feature 1..30: note = chr12:4356247-4356277
  misc_feature 1..30: note = hypo
  source 1..30: mol_type = genomic DNA

SEQ ID NO: 74676 - DNA, 30 bp, Homo sapiens
  misc_feature 1..30: note = chr12:4358486-4358516
  misc_feature 1..30: note = hypo
  source 1..30: mol_type = genomic DNA
gactcggaacatggccgggcatggtggatc

SEQ ID NO: 74677 - DNA, 30 bp, Homo sapiens
  misc_feature 1..30: note = chr12:4362436-4362466
  misc_feature 1..30: note = hypo
  source 1..30: mol_type = genomic DNA
cctcacgtaccctgacgaaacgtccttttc

SEQ ID NO: 74678 - DNA, 190 bp, Homo sapiens
  misc_feature 1..190: note = chr12:4373080-4373270
  misc_feature 1..190: note = hypo
  source 1..190: mol_type = genomic DNA
gggtccattccaaaccgtgtctatatgcgctctgatgggggctctgtttgaattgtaggaataagctttaggttagtttaagctttaggttaaactaacctgctaagatttccttaagcaccctggagcagtgttatagtccatatattcttatgctctctatatttttgaagaccgctattctattaac

SEQ ID NO: 74679 - DNA, 664 bp, Homo sapiens
  misc_feature 1..664: note = chr12:4377894-4378558
  misc_feature 1..664: note = hyper
  source 1..664: mol_type = genomic DNA
gagtgggaagggagtcgccctacatgttttcacatcgatttgtaaaactgttttgaaagggtatttctagatccatttgttccaaatgcagcaaaattcatccgatatcgctcacaatgcatgcacgggttatcttacatgtaatagccatcgtattaaccaacccagctgatactgagatggtgaatggggcgggggagcagggaggaatatgtcgcgcatgaaaaactccgggtgtaaaagtcaatgcagaactcactccccgaggaaccgaaaaagacattcacgactctcaagtggagagaggatagaaagtcaagtggcgggggtcgcgaccagtgatcgggatttcagtctgatctcagtacccagcggaacaggaccataacctaaagaaatgagctttttccggagcaaagagcggccccgatttcaaagtagaaaaaataaactgcttgggggtggaagatggcgaggggcggggggcggggagggaggcgggtcgcggcgctggctccggggtccgcggcacggcctcctctgccgcgctgcccagggcccggaccctgcccggcgctgcgcccaccgcgagggtgccagacccgccgcgccgccgccgcgctctcccagccgcggccccctcccccgccgcttcctcttgctc

SEQ ID NO: 74680 - DNA, 1118 bp, Homo sapiens; identical to SEQ ID NO: 34218
  misc_feature 1..1118: note = chr12:4378802-4379920
  misc_feature 1..1118: note = hyper
  source 1..1118: mol_type = genomic DNA

SEQ ID NO: 74681 - DNA, 30 bp, Homo sapiens; identical to SEQ ID NO: 34219
  misc_feature 1..30: note = chr12:4380166-4380196
  misc_feature 1..30: note = hyper
  source 1..30: mol_type = genomic DNA

SEQ ID NO: 74682 - DNA, 553 bp, Homo sapiens
  misc_feature 1..553: note = chr12:4380480-4381033
  misc_feature 1..553: note = hyper
  source 1..553: mol_type = genomic DNA
cttcttcctcgcccccgctgcccccacttcgggagacccagagctctggatgcctttccccggagaagggggggtgtgcggagtcggggtggaagagaccttgctcgcagagctatatcaagtgatgtccagaggctgggagccccggcggcctctgtcccttgcctgtcgggttagatttatactttaaaaatacctcccgccctccctccttctctcgcctctccccgctgcaactttctttgatccgctcaaaggtggcttaggtgaaattggagtaattcccttatgggggtcttaaaatgtaagtgaatgtccttatccggggtgactcaaaagcttaagtcgggaagcccaacgtgactaaaaccaataggtgattgttcggggccgactgtgtgcgggtgtacacggtattcggcccgggtgtcatccgcggcgctggactgtttcattttgagtttgcaacttgggtttttcagcgagctttttttcttcctgaaagctaatggcttccacagcaattagacattttcctcgcccgccccttccc

SEQ ID NO: 74683 - DNA, 637 bp, Homo sapiens
  misc_feature 1..637: note = chr12:4381802-4382439
  misc_feature 1..637: note = hyper
  source 1..637: mol_type = genomic DNA
cgacttcaccgcagtcggctcccagggagaaagcctggcgagtgaggcgcgaaaccggaggggtcggcgaggatgcgggcgaaggaccgagcgtggaggcctcatgcctccggggaaaggaaggggtggtggtgtttgcgcagggggagcgagggggagccggacctaatccctcactcgccccctccccctcccgggccatttcctagaaagctgcatcggtgtggccacgctcagcgcagacacctcgggcggcttgtcagcagatgcaggggcgaggaagcgggtttttcctgcgtggccgctggccgcgggggaaccgctgggagccctgcccccggcctgcggcggccctagacgctgcaccgcgtcgccccacggcgcccgaagagcccccagaaacacgatggtttctgctcgaggatcacattctatccctccagagaagcaccccccttccttcctaatacccacctctccctccctcttcttcctctgcacacactctgcaggggggggcagaagggacgttgttctggtccctttaatcggggctttcgaaacagcttcgaagttatcaggaacacagacttcagggacatgacctttatctctgggtatgcgaggttgctatttt

SEQ ID NO: 74684 - DNA, 851 bp, Homo sapiens
  misc_feature 1..851: note = chr12:4383208-4384059
  misc_feature 1..851: note = hyper
  source 1..851: mol_type = genomic DNA
ggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtaggtcggggggtggcgctcgccaggagccaggacccctccggatgctcgggtccccggccggagccctaaacctgggagagggcaatccccgcgccggcctcccggctcctgtgcgggagtttaccgcgcgccttctggcgagacgcgtggctttatttctgttcctctccagataaactggggaggcagaggggggaggaaaatctgggagaagcgaggctgtcctgggcgggggtaggggagcatcccgcgcgcgtgttcctgcatgtggctgcctcttcttcccacccccctcgcgacctgtcttttgcgaagccgccgcggctgcttgcgctgcggccaggaagagagtcggggcctgaaatcgggaccccgagtagaaaggcaaccccccccaaaaggccagagcaaattcgtcttggcctcaggtccccgcctgtggtcgcgactccgcgctggcacttcaccggggaggtggagggaggagggagaaggagagaaacggggaattcgggagccccggaagtcccattgaagaaacgcgtgtttcaggggaacccaaaagaaccgcttcttgcccctcactccaagtctttgcccagcgagccgtgtgcccacgtatgcacagctctggacctgccgtggtttcgccatg

SEQ ID NO: 74685 - DNA, 220 bp, Homo sapiens
  misc_feature 1..220: note = chr12:4384313-4384533
  misc_feature 1..220: note = hyper
  source 1..220: mol_type = genomic DNA
agggctctctgctcccgtctttcccctcgctcgtcaccgcgttccctagtttctgtccttgtgggccgcagccggacactcccgccgcggcgctcaccccttcaagtttcctcccgggatccaaagccccaggggtcggaatacagacctttctggcacccgaaacctctgtttcgggaagcctggctcttctttggggttttcacgccaaaagggcttt

SEQ ID NO: 74686 - DNA, 30 bp, Homo sapiens
  misc_feature 1..30: note = chr12:4390499-4390529
  misc_feature 1..30: note = hypo
  source 1..30: mol_type = genomic DNA
acaaacaccgaaggccgcttttcttgaagg

SEQ ID NO: 74687 - DNA, 229 bp, Homo sapiens
  misc_feature 1..229: note = chr12:4391671-4391900
  misc_feature 1..229: note = hypo
  source 1..229: mol_type = genomic DNA
tagagtgggagatttcgccttgatgggtgctgggaaggaagaatggaaacccgtctttccatctgcaagtctctgagctacccctgaagccgcgaggtcatgggactgagggggagtcgttagcatgccctgtggggacaagcagccaggcagtgtggtgcttgccatcgctcttccctctggctgtaagatgaatgggtagcaggctgctcatcgccctccaaccagc

SEQ ID NO: 74688 - DNA, 55 bp, Homo sapiens
  misc_feature 1..55: note = chr12:4392892-4392947
  misc_feature 1..55: note = hypo
  source 1..55: mol_type = genomic DNA
gggaggcgggaatgtcgggtgttcctggttatctgggcatcgttccttggctcgg

SEQ ID NO: 74689 - DNA, 93 bp, Homo sapiens
  misc_feature 1..93: note = chr12:43944788-43944881
  misc_feature 1..93: note = hyper
  source 1..93: mol_type = genomic DNA
ggtccgagggccctgcgtcgctctcccaggccccgcgctccggggttcccaagtgcacctcggtgtagccggcggccagaaaggatgcatcgg

SEQ ID NO: 74690 - DNA, 271 bp, Homo sapiens
  misc_feature 1..271: note = chr12:43945109-43945380
  misc_feature 1..271: note = hyper
  source 1..271: mol_type = genomic DNA
cgttcctcattgtccaactctaaacttcttccaccaaacgtccccgctaaaggtcccaggtcccagtacagccaggggcaagacaaatgcacacatgctgatgcgcacgcacacacacacacgtgcactgggacggttagtgctctgctttcccacacccccaacttgccctaccctccccaagcaaagaccctaccactaatggccctaagcaacccacttccttccccagtacctcctaacctccccgcagcccccaactcgttccctc

SEQ ID NO: 74691 - DNA, 365 bp, Homo sapiens; identical to SEQ ID NO: 34326
  misc_feature 1..365: note = chr12:43945416-43945781
  misc_feature 1..365: note = hyper
  source 1..365: mol_type = genomic DNA

SEQ ID NO: 74692 - DNA, 217 bp, Homo sapiens; identical to SEQ ID NO: 11197
  misc_feature 1..217: note = chr12:43946202-43946419
  misc_feature 1..217: note = hyper
  source 1..217: mol_type = genomic DNA

SEQ ID NO: 74693 - DNA, 120 bp, Homo sapiens
  misc_feature 1..120: note = chr12:43957403-43957523
  misc_feature 1..120: note = hypo
  source 1..120: mol_type = genomic DNA
cctcagagggagttttaaaacaactcgagtcaagtagaaaatgcaaacatttatatttgcattgtatccatgtgcatgtttatatgcatattttgaacattgttttagaaaatcatcaat

SEQ ID NO: 74694 - DNA, 55 bp, Homo sapiens
  misc_feature 1..55: note = chr12:4397850-4397905
  misc_feature 1..55: note = hypo
  source 1..55: mol_type = genomic DNA
ccttgtgaaagaactcgagggaggacatgcctgtagggcacggggtcactcgcgc

SEQ ID NO: 74695 - DNA, 30 bp, Homo sapiens
  misc_feature 1..30: note = chr12:4399394-4399424
  misc_feature 1..30: note = hypo
  source 1..30: mol_type = genomic DNA
agctcagagaaatggcgcagggagatgctg

SEQ ID NO: 74696 - DNA, 159 bp, Homo sapiens
  misc_feature 1..159: note = chr12:4405568-4405727
  misc_feature 1..159: note = hypo
  source 1..159: mol_type = genomic DNA
aagggctgtgccatgcgaaaccctctttaaaggaaccgcatcgctacgcctaacgggcatttcttttttaatgtaatggttcagagctattgtctaccacgcctcgtgtgcacacgcacacacacgcaagttccctcagtcagccgagaatcctgccat

SEQ ID NO: 74697 - DNA, 30 bp, Homo sapiens; identical to SEQ ID NO: 43332
  misc_feature 1..30: note = chr12:4411192-4411222
  misc_feature 1..30: note = hypo
  source 1..30: mol_type = genomic DNA

SEQ ID NO: 74698 - DNA, 30 bp, Homo sapiens
  misc_feature 1..30: note = chr12:44319436-44319466
  misc_feature 1..30: note = hypo
  source 1..30: mol_type = genomic DNA
aatgaaggtgaattacgtgaaatccttcct

SEQ ID NO: 74699 - DNA, 465 bp, Homo sapiens
  misc_feature 1..465: note = chr12:45268922-45269387
  misc_feature 1..465: note = hyper
  source 1..465: mol_type = genomic DNA
caaagttaggacaagcggcaagagcaactcctgccggggttatcggaactgaaatcacagtggggatgcagcacgccgggcataccttgaaagagaaaggctttcgtcccattatgcagccccgggacctgacgcactccggtcgtggactccccaagttctaactctgttaagacgtcaatctgtagggaagggtccacaccaagcccccaaactggtgaggggtatgaggtgggagagagaaaaaggaaaagctccatcaaaatgcaagtctcttcctccagggcagcaaagaaccgcgttttcgcgacaatattgggaactgaagatgagaggcgactgcctcctcctccgccgagagccttacctgagatcagcagccaagctttaaatagcggagcacccagtcccgtttccatgacctcctttaaacccttctctctgcaaagttccccctcagccctc

SEQ ID NO: 74700 - DNA, 670 bp, Homo sapiens
  misc_feature 1..670: note = chr12:45269416-45270086
  misc_feature 1..670: note = hyper
  source 1..670: mol_type = genomic DNA
cgcggtctccaaggcaagcacagaaaaaaaaaaaatccatatccaaacccgcccccttactccaagcttcccactccagacctactttgggtccgggaaaagcgaggcttccccagccagcccatgctgccccgaggcgggagccatccctttccccagccccagctctgcggccactcacctgctccgagaccgaagatcaaacagaatgttctcagtaagacccgagactccatggtgcggatcagctcagtccatcgtctccctctttaaaaataaaaataaaaatcgaagaggttcttggaatcaagcgggaaaataacgtttgtctctcctgctgctgcctcggatttactgatcagtaggattaatacgctttggttgcctaagaaagaaaagggaggcctccccaggcgcgtgaagaacttagaccctccaatgcgcacatcattcccacacgcagggccgaggcggcagcgcggcccggagggggcccggagggaggggtcggactcgccccggcgcggctccgtcggggaattagctcccgagccgaataaaagcagccaaagactcgcacacccggtagaaggggggcggccccaagaaagcccgggctggggcggccccgcacccccccgtcttccccgccgcccgaacctgttgtaaa

SEQ ID NO: 74701 - DNA, 535 bp, Homo sapiens
  misc_feature 1..535: note = chr12:45270378-45270913
  misc_feature 1..535: note = hyper
  source 1..535: mol_type = genomic DNA
tttgctctcacccctcgatttcgggcgcgtgtcttgaaagacaggagagaaaaaagaccacccagctgcaggaggcaaggctggagcgagtagcgctcgcctgccctttaagcaaaggagggaagcccatgtgcactcgtgcactgggctccggagcagccccggggtgcagggcactccccctccagggcgtgcggaggaaggccaccaaaacacgctgcactgccgaggtggagctgggcaaagtaggtagagactggtggggacggatggcgagcctgggaagccccgggtgtcctggtggagaggttccctgccgggggcggggcgctggagagcttccccggcgcggagagcttcccgggcgcggagagcgcagagaacttggccaggaggtgctggacagctccggaacccgcgcgccccctgccaaataaagcgtggagacccggactcgggctctctgggaccagcatacagcagaaggcaaggggaactgagccagggcgtctgttcacgccgaaatatctaccta

SEQ ID NO: 74702 - DNA, 825 bp, Homo sapiens
  misc_feature 1..825: note = chr12:45443857-45444682
  misc_feature 1..825: note = hyper
  source 1..825: mol_type = genomic DNA
ctccccaagttgggccgcgcaaagctctccttgtcaagaacttttctgagagctggtgtcgtgcagcccgggaaacaggaccgggcaggttagaaacgttgaacttggtgaaaccccttgagactgatccaggcaggccgtagaaccctcagagtttcccagttaaggccaaaaagttaagcagccctaccacctgttgaaagaagggaacagcaaagaagctggtggaatgggatgggatggggcaaaaaagaatcacagaaagtggtgtgcctccgcctgggccccctactcccgaagtggcatctccactaaagctcgagatgctccaggaagttcccaaaccggctctccctgggcgcagtgcgcaccgccggcgctcccagatccctggaccacccggcctgggggcgcgggcgcggctggggagggaggggagagctggctcacctggcgctgaaggctggaaggtacagtctcggtcccccggagcccggcccggcagcctcgcactgtccgcagagggactgagcacttgaaaagcccaccgcgttccgtagggcgccccggcggggctaacttgttcggctgcggggcacagctttaggggaactgggctagcaggcaggggccggagctgcgcgcccgcggtggccagggcggtcgccgggtcgtggggcgcgggcggctgcagcctgggcgttggggcgcccccgacccgcagcaaattctcgatcaggaaactcttgcccaggttgccaaagccgggcgcagcggggaggttgaggagcgcggaggaagccacaacgtcccagtacgcaccgg

SEQ ID NO: 74703 - DNA, 129 bp, Homo sapiens; identical to SEQ ID NO: 34333
  misc_feature 1..129: note = chr12:45444714-45444843
  misc_feature 1..129: note = hyper
  source 1..129: mol_type = genomic DNA

SEQ ID NO: 74704 - DNA, 256 bp, Homo sapiens
  misc_feature 1..256: note = chr12:45445143-45445399
  misc_feature 1..256: note = hyper
  source 1..256: mol_type = genomic DNA
caaggggaggggactcgtagtgggaggaggtgggcgtggaggcgacgtgaatcgggcgcgctcgccacctccccgctgccgtgcagagccgtggcactctcgctagagcccaagcagtcccccaggcgtggggtctggtggacgctggcctggagcgcccggagggcggggtgggggtgggggggacgcgctgtcgtctggggtgtctccgcgtactcctgttgggcgaaccctggctctccggtgttggttgtca

SEQ ID NO: 74705 - DNA, 136 bp, Homo sapiens
  misc_feature 1..136: note = chr12:4554801-4554937
  misc_feature 1..136: note = hypo
  source 1..136: mol_type = genomic DNA
ctccctccggcatggcggcaggggcttatttttggaaggcagatgaaggctgctgacatgaaaccaaagcctccatcgggcactcgggttgagagcagagggacccaggctgagccgcggccggtagagaccatgg

SEQ ID NO: 74706 - DNA, 29 bp, Homo sapiens
  misc_feature 1..29: note = chr12:46495833-46495862
  misc_feature 1..29: note = hypo
  source 1..29: mol_type = genomic DNA
gagaaacacatcagcggaagaacacacaa

SEQ ID NO: 74707 - DNA, 142 bp, Homo sapiens
  misc_feature 1..142: note = chr12:46767273-46767415
  misc_feature 1..142: note = hyper
  source 1..142: mol_type = genomic DNA
ccccagttttccactcgctgacacgttgcttctcttatcccaccaccgccgccccgggcaaaggcactgccttgtctgaatgcgggtctgaggcgctttctgcggagcctggtcctttcccttcaatggtgatgtgtgtggt

SEQ ID NO: 74708 - DNA, 201 bp, Homo sapiens
  misc_feature 1..201: note = chr12:47224753-47224954
  misc_feature 1..201: note = hyper
  source 1..201: mol_type = genomic DNA
gcacacccgcgaccacgtatccctgagtttcctaacttagttcaccccttttcctccaagtcagcagcccggtgagcattccagggtcagtcctggtgctcaaagtaagggcaatcttccatctctgcctgctggatcacaaagaggagctgggagattcgccgttttcccccacaaccggcacctgccctggcccagagc

SEQ ID NO: 74709 - DNA, 19 bp, Homo sapiens
  misc_feature 1..19: note = chr12:47224955-47224974
  misc_feature 1..19: note = hyper
  source 1..19: mol_type = genomic DNA
cagcgtccacctgtaccac

SEQ ID NO: 74710 - DNA, 276 bp, Homo sapiens; identical to SEQ ID NO: 34336
  misc_feature 1..276: note = chr12:47225027-47225303
  misc_feature 1..276: note = hyper
  source 1..276: mol_type = genomic DNA

SEQ ID NO: 74711 - DNA, 158 bp, Homo sapiens; identical to SEQ ID NO: 34337
  misc_feature 1..158: note = chr12:47225319-47225477
  misc_feature 1..158: note = hyper
  source 1..158: mol_type = genomic DNA

SEQ ID NO: 74712 - DNA, 127 bp, Homo sapiens
  misc_feature 1..127: note = chr12:47225550-47225677
  misc_feature 1..127: note = hyper
  source 1..127: mol_type = genomic DNA
cgggtccagggactcgggtaacaccttgccagcaggatcccgggcggtcgcggagccagctcccgcgggggaagtcgggcctctcagccaggcaggcggcgcggccacggaacgcagtcccaataca

SEQ ID NO: 74713 - DNA, 30 bp, Homo sapiens; identical to SEQ ID NO: 43334
  misc_feature 1..30: note = chr12:4734872-4734902
  misc_feature 1..30: note = hypo
  source 1..30: mol_type = genomic DNA

SEQ ID NO: 74714 - DNA, 132 bp, Homo sapiens
  misc_feature 1..132: note = chr12:47547800-47547932
  misc_feature 1..132: note = hypo
  source 1..132: mol_type = genomic DNA
gtcacatgcatttaacgtattacatcattgatgggagacagttctccagggtctctacacaacttgcaagcaaggcgctgactgccctttgttccaaaccatttgacccaggaaacgcgtatcttctaccag

SEQ ID NO: 74715 - DNA, 86 bp, Homo sapiens; identical to SEQ ID NO: 43444
  misc_feature 1..86: note = chr12:47628723-47628809
  misc_feature 1..86: note = hypo
  source 1..86: mol_type = genomic DNA

SEQ ID NO: 74716 - DNA, 162 bp, Homo sapiens
  misc_feature 1..162: note = chr12:47629046-47629208
  misc_feature 1..162: note = hypo
  source 1..162: mol_type = genomic DNA
gggccacatgcacaacggccttaactaccgtgaggtccgcgagttccgctccgaccaccatctggtacgtttttacttcctcacccgcgtgtactccgattacctccagaccatcttgaaagagctgcagtcgggcgagcacgcccccgacctggtcatcat

SEQ ID NO: 74717 - DNA, 54 bp, Homo sapiens
  misc_feature 1..54: note = chr12:47629490-47629544
  misc_feature 1..54: note = hypo
  source 1..54: mol_type = genomic DNA
tttccacttccgccacgcgagggagaacctgcactgggacggggtgcactggaa

SEQ ID NO: 74718 - DNA, 169 bp, Homo sapiens
  misc_feature 1..169: note = chr12:47659833-47660002
  misc_feature 1..169: note = hypo
  source 1..169: mol_type = genomic DNA
agaaaagggctaaatcggcattttaaaaataaatggtcttagactgctgcaccaaacatggttgtcttctttatgagagctatatgatctgcttagaaattctctaaaacttcattcattccttcgtcactggttactcccatattgggtgccacgcactggtgctcca

SEQ ID NO: 74719 - DNA, 74 bp, Homo sapiens
  misc_feature 1..74: note = chr12:48206723-48206797
  misc_feature 1..74: note = hyper
  source 1..74: mol_type = genomic DNA
ctggaatctggggggcgaggcctgcgctcagcccctcgcccggtgggggtggggtgctgcgccagcacctcctc

SEQ ID NO: 74720 - DNA, 138 bp, Homo sapiens
  misc_feature 1..138: note = chr12:4829055-4829193
  misc_feature 1..138: note = hypo
  source 1..138: mol_type = genomic DNA
actcctcacacctgacgctgctcagggagaagccaggcagctataatagtgttcttggccggagaacatctggcctagcaggcagggtgtcatctatgaagctgggtggagagaaagctgttggggaaaccagcccca

SEQ ID NO: 74721 - DNA, 46 bp, Homo sapiens
  misc_feature 1..46: note = chr12:48299419-48299465
  misc_feature 1..46: note = hyper
  source 1..46: mol_type = genomic DNA
gaccgcggctgaccacgttcccggcctgtcgcgaatctcacccaag

SEQ ID NO: 74722 - DNA, 38 bp, Homo sapiens
  misc_feature 1..38: note = chr12:48348058-48348096
  misc_feature 1..38: note = hypo
  source 1..38: mol_type = genomic DNA
aggctaggactactccgccagggcggtgctggccagcc

SEQ ID NO: 74723 - DNA, 30 bp, Homo sapiens
  misc_feature 1..30: note = chr12:48375679-48375709
  misc_feature 1..30: note = hypo
  source 1..30: mol_type = genomic DNA
aagccaaccttggtgcgtgctcccaccgcc

SEQ ID NO: 74724 - DNA, 266 bp, Homo sapiens
  misc_feature 1..266: note = chr12:48395916-48396182
  misc_feature 1..266: note = hyper
  source 1..266: mol_type = genomic DNA
aataaatacgggcagcgtttcagccccatctggaagccatcgctgccaatctcccaatgcaaacaagcctcacaaaggaggattgagatctctcccctgagccaggggcactttcggaggcgagggctctgaaatgcagatgagggtcaaagacgccgccgccagtaagtttctcaaactcgtggaaagatggagaggaggggtgtggccgagctctaggtgtctgacattcctgacgtccacgcagactgcgcatttccccacgt

SEQ ID NO: 74725 - DNA, 338 bp, Homo sapiens
  misc_feature 1..338: note = chr12:48396748-48397086
  misc_feature 1..338: note = hyper
  source 1..338: mol_type = genomic DNA
gggcccacagagcctcgaaggcagagaacttttattccccccgccgaagagtttccctctgcgattgatttacaatctgtaacatacaaagacagggctggaatcccagccgtcggaaacgtgcccaaacacgtggaaaaaaaaatcctctctacctaatacactttccaggcttcgtttgtcctgaatataatcccagacagtggaccttaccaaaggaggggtagaaaggtgcagtccgaacagcatttggacccgactacaagagccatctctaactataccggttgaaatagttgtagcaaccgtagcaatcgaccagcctgctccccttccct

SEQ ID NO: 74726 - DNA, 1598 bp, Homo sapiens
  misc_feature 1..1598: note = chr12:48397146-48398744
  misc_feature 1..1598: note = hyper
  source 1..1598: mol_type = genomic DNA
agttccagaatttagaaaagtaactcattgtagtacctcggggcggcggggaatggggtaagaccgcggggaagggggcgctattttcgggggcatttgaaaagcacggtctggttggaatgttatcgtctttcagatggcctctcctactggaagtttctgtaccctttatcagaagagaggcgcaggcggacggagggaagtcgagatgagcgctagggctgcaccttgctccagggccagctgggagggggagggtaccctaaagaggcgctgaggtctcagagggcctatcggaagccgttctttgtggcctgggatttcagcccaccagtgtcagagtgttagtcccctttgtctaactctgctttgagcccaccagccaccaagccttggacaggctgtgaagtcaaccctttggcgtttgcttgctccctcgctcgcgctctctctttcctacttcacctaagttcgatgagttgagatctgtttttgctgaactcgaagtgcttcgaagaggcgagctgtgtgcatgtgcgcctaattatcaaagctggtggaaaagagcccatttatatctgtgcgcaaacttctccgagccaacactttgcaagttcagtattctagcgcaacgtagggacctgcaaatacttgcaactgcgatgggcaccgaggaccctgggacagagtccttgattggcagaactcttcttggtgaacttctgcgtgtcctgtgcctaagtcggcgcgctacgaccccgggagccgttttagcccggagccgcgggctccagagctggagcgggccggggagaaggatgctgagggacgcatggaaagcaggcaggcaggcaggggcgggggaagacttacggacatcctggccctgacaccgaaggacagcggcgacgagcagcgtcagcagcaccagcgtctggggagccccgaggcgaatcatggctcaccgcggggcctggctgagccgggcccgggcggagcgcagcgaaacggcaggagcacggcgcgggtccgggtctctaccgcgccctcatgcaggaggcccttggagcaggagggggaagcgggagacccggcagcccagcagcgctctgcgtcttctccccgccgcggcgcccgttatatgcgcccggcccctttcgaggctggcgaactcgcccaaaccgcgggccgccccctgccccccgctgggctgtaacctgaaccgcccgcccccggagcccgcctgggccctgccagtgcccgcacctgcccaagccggacccccctctctgggagtcacgcttcccgccctccacccctagtgcgccgagtggcctgatcgggcggggcgcagagatggcccctgccccccaaacccggggctgcggcgctgcccccctctgaccacaggcgggaagggtggcctccggcccctcccctcggagttctgccggagttggaggggagggggtgtttgcagaggcgcaggccgagagccctagaccaaggacggaaaagacatgggagggaggagggaaagcggtagaaaggagcagcggagggcgagggggcaccgcgtcaggcgtttgggagtgggg

SEQ ID NO: 74727 - DNA, 138 bp, Homo sapiens
  misc_feature 1..138: note = chr12:48398948-48399086
  misc_feature 1..138: note = hyper
  source 1..138: mol_type = genomic DNA
gaagttggcctgagccgacagccaggaaaagagctggtgtgttactgcacagaaggagacctgtgtgaaggtgtggggggcaggggcaggccctgggaaggggactgaaagagccacagaggacggagggagccgaga

SEQ ID NO: 74728 - DNA, 30 bp, Homo sapiens
  misc_feature 1..30: note = chr12:48565607-48565637
  misc_feature 1..30: note = hypo
  source 1..30: mol_type = genomic DNA
gatgcttggaagatacgggatatcatgatc

SEQ ID NO: 74729 - DNA, 188 bp, Homo sapiens; identical to SEQ ID NO: 34342
  misc_feature 1..188: note = chr12:48576788-48576976
  misc_feature 1..188: note = hyper
  source 1..188: mol_type = genomic DNA

SEQ ID NO: 74730 - DNA, 861 bp, Homo sapiens
  misc_feature 1..861: note = chr12:48577469-48578330
  misc_feature 1..861: note = hyper
  source 1..861: mol_type = genomic DNA
ggcctgggggagtcccgagtccgacgcgccgctggcctcagcctggacgcggacccctccgcgagcgcgtctgtgacccacggaaccggcaggcgctctctgcttgtggcgcccagagggcggcgctgacacgggcgcgatccgggaggcgaggcagggcagggcactttcgtcccggggcgatcccaagagacgccggctctgggaccctcgccgggtcctcgtcccgcagcctcttctcggcctcccgcgatcctgcctgcgccctctgcccaggactcgtctctcacgtcggctccccgccagtctcgggagcctccgcttccctcggctcccgctagcccctcccgggacctctccccctccaccccctcccccaccccggaggccgggctggacgcgacccagagcctccgccacccgcttctgccactcaatggaggacggtctgctggagatcatgaccaaggacggcggcgacatgccggcgcccctggaggtgtccaccgtgccggcagtgggggacgtgatctccggggagtacaacggcggcatgaaggaactgatggagcacctgaaagcccagctgcaagccctgtttgaggacgtgagggccatgaggggggccctggacgagcaggcctcgcacatccaggtgctctcggacgacgtgtgcgccaaccagcgagccatcgtctccatgtgccagattatgaccactgcgccccgccagggcggcttgggcgtggtcggcggcaaggggagcttccagagcgacccccaagagccggagactccttcgcctgggatcggggacagcggcttgctgggtcgcgatcccgaggacgaggaggaagagga

SEQ ID NO: 74731 - DNA, 100 bp, Homo sapiens
  misc_feature 1..100: note = chr12:48590813-48590913
  misc_feature 1..100: note = hypo
  source 1..100: mol_type = genomic DNA
taaataaataaaaagaaaagaaaactgaccgcaaaatgggctcttattttgagcatgtacaaaacacaggtaagtctgatggtctcggtacatgcgatac

SEQ ID NO: 74732 - DNA, 22 bp, Homo sapiens
  misc_feature 1..22: note = chr12:48615310-48615332
  misc_feature 1..22: note = hypo
  source 1..22: mol_type = genomic DNA
agtgtaacgttaccacaaattt

SEQ ID NO: 74733 - DNA, 36 bp, Homo sapiens
  misc_feature 1..36: note = chr12:49074244-49074280
  misc_feature 1..36: note = hypo
  source 1..36: mol_type = genomic DNA
gattacaggcatgagccactgcgaccagccagggac

SEQ ID NO: 74734 - DNA, 18 bp, Homo sapiens
  misc_feature 1..18: note = chr12:49108598-49108616
  misc_feature 1..18: note = hypo
  source 1..18: mol_type = genomic DNA
tataaggcggccaggcgc

SEQ ID NO: 74735 - DNA, 36 bp, Homo sapiens
  misc_feature 1..36: note = chr12:49111559-49111595
  misc_feature 1..36: note = hypo
  source 1..36: mol_type = genomic DNA
ggtaatttttaagtacgtttgcgaatgggtgaacta

SEQ ID NO: 74736 - DNA, 25 bp, Homo sapiens
  misc_feature 1..25: note = chr12:49174695-49174720
  misc_feature 1..25: note = hypo
  source 1..25: mol_type = genomic DNA
cattctggccaggtgcggtggctca

SEQ ID NO: 74737 - DNA, 49 bp, Homo sapiens
  misc_feature 1..49: note = chr12:49276337-49276386
  misc_feature 1..49: note = hyper
  source 1..49: mol_type = genomic DNA
tcagtgacctgagctcggaaattccaccccatgacgagtctctggagag

SEQ ID NO: 74738 - DNA, 197 bp, Homo sapiens; identical to SEQ ID NO: 34345
  misc_feature 1..197: note = chr12:49297738-49297935
  misc_feature 1..197: note = hyper
  source 1..197: mol_type = genomic DNA

SEQ ID NO: 74739 - DNA, 501 bp, Homo sapiens
  misc_feature 1..501: note = chr12:49363677-49364178
  misc_feature 1..501: note = hyper
  source 1..501: mol_type = genomic DNA
caggtggaagttaggcgcgcaggggcccagacgagtggccagacctggctcagagcggctccggggggggcggggaattccaggagaggcccctcccggagccgcgaaaccatcccttcccgcctccgcgcgcctcgccctgccgcccaccccctagcctccgcggcagcgccgacccgcccagccaggctcaccgcgcttgaggatggcgctgtggtgcggcaggcggccgccgccctcaagcgcggagcagttccagcgctggtcgcgcagctggtgctgacactcgtggaccgcgatgtgcagaccctgaagcgcggacgccgtcacgtcggggttgcgcaggcacaggcctagctgccgcttgctcaggccggacagcgtcaagcacacggtgttggccgtcagcggcggctcgccaggcaacttcaggcccagaatctcattgcttagagccctgggaaccaagaaggcgtctggggtctgcggtccagacccctc

SEQ ID NO: 74740 - DNA, 164 bp, Homo sapiens
  misc_feature 1..164: note = chr12:49366374-49366538
  misc_feature 1..164: note = hyper
  source 1..164: mol_type = genomic DNA
gagacccagtggcagcgaacgggttaggcgccaccgtgctcccgcctgactcaccctcgaagctctaaccactgtgggctatttttgccagagaggggccccaggctttccagccgccccccgcccctgccagaccgcagcccaaggcacggctggccccacgc

SEQ ID NO: 74741 - DNA, 39 bp, Homo sapiens; identical to SEQ ID NO: 34349
  misc_feature 1..39: note = chr12:49367954-49367993
  misc_feature 1..39: note = hyper
  source 1..39: mol_type = genomic DNA

SEQ ID NO: 74742 - DNA, 95 bp, Homo sapiens
  misc_feature 1..95: note = chr12:49372141-49372236
  misc_feature 1..95: note = hyper
  source 1..95: mol_type = genomic DNA
gtctgcgcccctaaccggtgcgccctggtgccacagtgcggcccggaggggcagcctcctcccgtcacttcagccagcgccgcaactataagagg

SEQ ID NO: 74743 - DNA, 122 bp, Homo sapiens
  misc_feature 1..122: note = chr12:49372537-49372659
  misc_feature 1..122: note = hyper
  source 1..122: mol_type = genomic DNA
gtaagtgagctggtgcggggtcgccacttgtcccgcggcacagagccaggggccaaccctacccagctcccacgctctgggatccgtctgccgacaggctccctccccgctctgacttccct

SEQ ID NO: 74744 - DNA, 30 bp, Homo sapiens
  misc_feature 1..30: note = chr12:49373073-49373103
  misc_feature 1..30: note = hyper
  source 1..30: mol_type = genomic DNA
acacacaagtctggacgcccagttctttca

SEQ ID NO: 74745 - DNA, 1654 bp, Homo sapiens
  misc_feature 1..1654: note = chr12:49373373-49375027
  misc_feature 1..1654: note = hyper
  source 1..1654: mol_type = genomic DNA
ggggatcctgcacagcgtgagtggggggctgcagagtgccgtgcgcgagtgcaagtggcagttccggaatcgccgctggaactgtcccactgctccagggccccacctcttcggcaagatcgtcaaccgaggtgggtgcccaggaaggcgacgcttccgggagcaggggaaacgcggggtcacccccagggcatgggcgggcgagttcagagaaggtgtcccaggcgcctggagggtcacacaatcaaccttgccaagtgcctcgtgcccagcgccagctcggggccagacttctaccaggcgttttccagccgtgcaccctggaaacgaagcttaacttttctgagctactgccccagataaagaaagtttcgggtcgcggacgccggctgaccgccgctttcccccagcctctctcaaaagcgcctgggaagctgctctctgcaggcgtgtgtctggcctctcgcccagcaaggcttgcaccgccaaaatgggccgaaagttttgggctgcgaagaagtcttggggatgtatggttcttccgctcccctctcttcggtttgtctctctggggctgctccacttccgctatcgagccaaaatgcgccctagaatctcccagtaaggtgtgattacgcccgtggacgtggctgcgtgcccacgcacctgctttctctactagccctagagaccagctttccagcactgccggccctggctctcaggactcaaagtgcggagtcgggggtgggattccggtcccaagcccttcatgagggtgctggccgcgccccgcgtaccccctcgctgatccccgctcccttctcccacaggctgtcgagaaacggcgtttatcttcgctatcacctccgccggggtcacccattcggtggcgcgctcctgctcagaaggttccatcgaatcctgcacgtgtgactaccggcggcgcggccccgggggccccgactggcactgggggggctgcagcgacaacattgacttcggccgcctcttcggccgggagttcgtggactccggggagaaggggcgggacctgcgcttcctcatgaaccttcacaacaacgaggcaggccgtacggtgagctttgagaggctccgcaccctaagcggagcggcaggggccaacctcgggctggggaagtgacggtcggtgagataaggcaaggggcaccaggagagggcgtcctgggagagccggaggcttggaacgaagacggagaatagaggagacagtggctgagggcaaaggtatgtctggcccgcggacaggtagaagaggttgcaaatcaagcacagtctcttcgctgtacagattcgaaaaataagcctgagaggccgagactgactcgccgcggcggagcagggttgggcagggtttccaaatctcagcggaacatttcgcgcctcccttcccctgggctcagctaggcctgggcctttgctgaggtccggcccccgtggcgtccgggagagggcagtgtctgggagggtgactctggcccggtgccctgggacactctttcttcccctatccccgcagaccgtattctccgagatgcgccaggagtgcaagtgccacgggatgtccggctcatgcacggtgcgcacgtgctggatgcggctgcccacgctg

SEQ ID NO: 74746 - DNA, 414 bp, Homo sapiens; identical to SEQ ID NO: 34353
  misc_feature 1..414: note = chr12:49375115-49375529
  misc_feature 1..414: note = hyper
  source 1..414: mol_type = genomic DNA

SEQ ID NO: 74747 - DNA, 32 bp, Homo sapiens
  misc_feature 1..32: note = chr12:49375761-49375793
  misc_feature 1..32: note = hyper
  source 1..32: mol_type = genomic DNA
ttctgcctgctccatcgcgccagcgacctctc

SEQ ID NO: 74748 - DNA, 262 bp, Homo sapiens
  misc_feature 1..262: note = chr12:49388709-49388971
  misc_feature 1..262: note = hyper
  source 1..262: mol_type = genomic DNA
ggggtggggggagggcgccagggcagtgggaagagccgacaggggtgggctgggggcaaggaagggagagtcccggctgggggagaaaagaggtgggccaggagctcccaacgaagaaagcagccccctcccctcacacagagcgggaagtagcagaggagtcccgggggagggccactgtggggaaagggtcagtgaaaggaagacgatgccaaggctggataaagggaagcttagatttattgagcgcctactgtgtgcc

SEQ ID NO: 74749 - DNA, 282 bp, Homo sapiens
  misc_feature 1..282: note = chr12:49390823-49391105
  misc_feature 1..282: note = hyper
  source 1..282: mol_type = genomic DNA
cgcagggccccggcgtagggccctggggtccgcgcccagccccggccggcgcgccgctggaccaccgccacttccgacccctcggctctgccctgggctcccgaagctgctgggcctaaggcttggtgctctgggctacctggctgcgtgggggcgtcccgcaggtttacttcgggggccgggagccccaagatgcggaaagtgcgctcctccagtgtggagtcccccggcctcccgccctcagcttcgcccccgcggcccccgccgggctggtgtaaaagg

SEQ ID NO: 74750 - DNA, 1391 bp, Homo sapiens
  misc_feature 1..1391: note = chr12:49391146-49392537
  misc_feature 1..1391: note = hyper
  source 1..1391: mol_type = genomic DNA
cgtggccccttcaccctcctccttgccgggcttcgattggctgggggaatcccccaccacgcgtgtcaccccagagggcaaaagctgcacctgctgggttcggggggttggaacatattgggatcgtatcactacgcacgtggcgtcaatgacaaagacgccttccccacgggacaggccctgggaactgcggggcaaggtgtgggcacggcgggtcgccttccaaccctccagggtctccggtcctgccccctctccaagacccagagattctctccatccggtgcctccgggagcccagggtctggggagtgtctggctatggcggggcggctgctttttaggggagggaatccagcatttgggaaaccagatctgttctccttctttcccttccctcgagcccttgaggtggtgcctggatctgggagcgggatgcggggcacagggagccgcagttgcagaccccgcaggagctatctcggtgcctgcgctccctgtagctttggcttggggatggctgtcgctaccactgttcaggtcagcagcagccagccccaggcttttctccacgacccccttgccgggctctggccttgctctggccgctccacagcctggggatccccccaagagaccttgcccctgtcggagaccccaagccccgaggacgtcccggtagatccgaggatccagcctcttctttgtgcgccctccgtctgtcctggctggagtcgcagctggggctgatgaagtgggcacctgagagttcccggggcctctcttagtccccaaggtcctatgggggccttcgtaagaaggtggagccacgtagggtggcggccggtcccagcggcgtcgtggggcggtcccggcagaacctctcagcagcaggtgagcctcgtagcttgggggcccgggccgccgacctccccagggccccgcccacgccgaccctgggtcgctctgcggctgcgcggatggacggggcgctcgccccacaggcgccaggcgctccggccgcaagggagcagggagccctgccagctgggccacccgaggggcgttgcggggctccgggcggggtcgacccggggggctccgtcgggccccaccagccttgcgcctttttcgctcggtctccttggcctcccgctcctgcgacgccgctttccttttctcttgctcccgagctcggacctcggccaggggccccgcccgccagttggtcgcctcctgcagcaccctggaggcccagggccggcggggcggcggctgtggggatcccgggcgcggcccacacctgggacaatgagcaggaacccaggtgagcagtttgtgggggaagggagccgaggtccggggagctgggagcactggagaccacttgg

SEQ ID NO: 74751 - DNA, 39 bp, Homo sapiens
  misc_feature 1..39: note = chr12:49392597-49392636
  misc_feature 1..39: note = hyper
  source 1..39: mol_type = genomic DNA
gactgaagtcgaagcgggactcctcgccatctctccatg

SEQ ID NO: 74752 - DNA, 71 bp, Homo sapiens
  misc_feature 1..71: note = chr12:49393665-49393736
  misc_feature 1..71: note = hyper
  source 1..71: mol_type = genomic DNA
taaccagctcccatgcggtggagagaggaggcggtggcttttaccaagcttttgtgcgactctgagggaga

SEQ ID NO: 74753 - DNA, 30 bp, Homo sapiens
  misc_feature 1..30: note = chr12:49443844-49443874
  misc_feature 1..30: note = hypo
  source 1..30: mol_type = genomic DNA
ctgtctgcttgcattcggggtagacctcca

SEQ ID NO: 74754 - DNA, 541 bp, Homo sapiens
  misc_feature 1..541: note = chr12:49483686-49484227
  misc_feature 1..541: note = hyper
  source 1..541: mol_type = genomic DNA
ccaatgcatgccagtcggctggacggccccgccggggagcagcgcccctagcgcgtgcagcagtctcaagggggcaaaagcgcggtgcgcccactggtgactctccagaaccgcgtagcaagaggccaggacatcgttcaccagcagcgtcccgtgcgcggtgagcggcgcgaacacgcccacggcttcctcccgcgccacacgggccacgcgcgctggccgaagcgcatccccgccgggcgccagcaccgagtccccagcgcgtagccggcgcgcgaacaccggtgcaaagtcgcctggcgcgggcgccggccctcgagcggcaaacaccaggtgccagggcgtgagcaacagtttgcgtggaggccactcggtctccacagccacaaatgaagcccggcgctgcaagtcccggtccaggaagagcagcaccggcgtgggcaccacccggcctgacgcatcggccgccaaaacccagtctccgcggtgcagttcccgcagccctttccgctcgccgctccacaggcgcacagttgcattt

SEQ ID NO: 74755 - DNA, 198 bp, Homo sapiens
  misc_feature 1..198: note = chr12:49485716-49485914
  misc_feature 1..198: note = hyper
  source 1..198: mol_type = genomic DNA
ccaagaggagctgtgcgggatcaaggctgctggaaaaaggattggggtggcgggggttgcgcgaagtacaatggccattatccgggatgacttaaccgagcgagaatcctgagcccaggccgggaacgcgctgggagaagcggactcagcagctccggccacaaaggcgcttttcagccgccccggctcagggagagg

SEQ ID NO: 74756 - DNA, 92 bp, Homo sapiens
  misc_feature 1..92: note = chr12:49486186-49486278
  misc_feature 1..92: note = hyper
  source 1..92: mol_type = genomic DNA
cacagttatcttggccgctccagcctgggagcgggagaccttggcgcgcaccatagcagggacaccgcgggaggaggcgcagagggacagct

SEQ ID NO: 74757 - DNA, 30 bp, Homo sapiens; identical to SEQ ID NO: 34360
  misc_feature 1..30: note = chr12:49487666-49487696
  misc_feature 1..30: note = hyper
  source 1..30: mol_type = genomic DNA

SEQ ID NO: 74758 - DNA, 34 bp, Homo sapiens
  misc_feature 1..34: note = chr12:49515539-49515573
  misc_feature 1..34: note = hypo
  source 1..34: mol_type = genomic DNA
ttaaaaatttatattcggcagggcgcggtggctc

SEQ ID NO: 74759 - DNA, 30 bp, Homo sapiens; identical to SEQ ID NO: 43336
  misc_feature 1..30: note = chr12:4959461-4959491
  misc_feature 1..30: note = hypo
  source 1..30: mol_type = genomic DNA

SEQ ID NO: 74760 - DNA, 37 bp, Homo sapiens
  misc_feature 1..37: note = chr12:49596183-49596220
  misc_feature 1..37: note = hypo
  source 1..37: mol_type = genomic DNA
aataaatcagacagccgggcgcggtggctcacgcctg

SEQ ID NO: 74761 - DNA, 150 bp, Homo sapiens
  misc_feature 1..150: note = chr12:49657572-49657722
  misc_feature 1..150: note = hypo
  source 1..150: mol_type = genomic DNA
gcacatttagtatgacgcagtacaagttagtgttgaagggtttaattcctcggagctctactttcctcatctgtaaactagggataataattcatagagtttgtcatatggatgaaatgtgatcatgtgatatgaaaagccaactactcg

SEQ ID NO: 74762 - DNA, 17 bp, Homo sapiens
  misc_feature 1..17: note = chr12:49661147-49661164
  misc_feature 1..17: note = hypo
  source 1..17: mol_type = genomic DNA
aggtaaacatgatgccg

SEQ ID NO: 74763 - DNA, 30 bp, Homo sapiens; identical to SEQ ID NO: 34361
  misc_feature 1..30: note = chr12:49688858-49688888
  misc_feature 1..30: note = hyper
  source 1..30: mol_type = genomic DNA

SEQ ID NO: 74764 - DNA, 38 bp, Homo sapiens
  misc_feature 1..38: note = chr12:49690563-49690601
  misc_feature 1..38: note = hyper
  source 1..38: mol_type = genomic DNA
gcgcccacttctgttcgttcaagcgtttcttctctttt

SEQ ID NO: 74765 - DNA, 109 bp, Homo sapiens
  misc_feature 1..109: note = chr12:49690983-49691092
  misc_feature 1..109: note = hyper
  source 1..109: mol_type = genomic DNA
caagcaggagatgaacgagtcccgacgccagatccagagtctaacgtgcgaggtggacgggctgcgcggcacggtgagtacgaagctgcgcgctcgggcccggggagcg

SEQ ID NO: 74766 - DNA, 30 bp, Homo sapiens
  misc_feature 1..30: note = chr12:4970362-4970392
  misc_feature 1..30: note = hypo
  source 1..30: mol_type = genomic DNA
ccctgggtaaggctgcgtgccttgggtggg

SEQ ID NO: 74767 - DNA, 15 bp, Homo sapiens
  misc_feature 1..15: note = chr12:49726844-49726859
  misc_feature 1..15: note = hyper
  source 1..15: mol_type = genomic DNA
ggtagatgatgaagc

SEQ ID NO: 74768 - DNA, 36 bp, Homo sapiens; identical to SEQ ID NO: 34363
  misc_feature 1..36: note = chr12:49727091-49727127
  misc_feature 1..36: note = hyper
  source 1..36: mol_type = genomic DNA

SEQ ID NO: 74769 - DNA, 667 bp, Homo sapiens
  misc_feature 1..667: note = chr12:49729713-49730380
  misc_feature 1..667: note = hyper
  source 1..667: mol_type = genomic DNA
ggcatctcacctgtccgttcttcatgaggtcggcccacatgctggtgccgtcgccgccgcgcatgagcacgtggtaagcgaagaagtagacgcctggcatggggcaagtaaacttgccgctggctgcctcgtaggcgttgcccacgttggtcaccacgtcgtcgaagcgcagcacctcgtaaccctcgtggggccgccgcaggcccgcgtagaaagcaatgcgaggcacgtagccggcagcgggcgccaccccgcccggacctggaccgggagggcccggggggcctggcctgccgggttctcctgggggccctcttggacctggtggtccagggggcccccgcaggcctgctttcccgcgccggcccacctctcccttggcgcctggcgggaaggggggcacggaagcaggcgcgccgtcgggaccagggccacggggcccatgcgggtcgcacaccatgcggcagcgacccagcatctcgtagtgcgctggcccgcgggagctgtgcaccagcagcgggatggccaccagcagcagcagcaccatggccactccgacggccgcgcccgccaccctcttgcggcggctcagccgcgacgctgccagggccagcaaatcttcctcactcttgggcgcaatggctgccggggccggggctctccgcgg

SEQ ID NO: 74770 - DNA, 117 bp, Homo sapiens
  misc_feature 1..117: note = chr12:49735966-49736083
  misc_feature 1..117: note = hyper
  source 1..117: mol_type = genomic DNA
ccgccggcaattaggcggccagacaaagagcagcttcggatggatgagggtcccagcggatcggaaatgtgaagggtcagcgctgccgcccgcggcgcaccccgctcccccttccgc

SEQ ID NO: 74771 - DNA, 36 bp, Homo sapiens; identical to SEQ ID NO: 34366
  misc_feature 1..36: note = chr12:49736792-49736828
  misc_feature 1..36: note = hyper
  source 1..36: mol_type = genomic DNA

SEQ ID NO: 74772 - DNA, 108 bp, Homo sapiens
  misc_feature 1..108: note = chr12:49931485-49931593
  misc_feature 1..108: note = hyper
  source 1..108: mol_type = genomic DNA
caggcttcacaggaccggagaaggaggagcgcgtcctcccttcccaaagcgccagctcatttagatacaggtgcctggggctttggctctcgtcgctgatgaggggta

SEQ ID NO: 74773 - DNA, 30 bp, Homo sapiens
  misc_feature 1..30: note = chr12:49932996-49933026
  misc_feature 1..30: note = hyper
  source 1..30: mol_type = genomic DNA
ccatgctccgggccccgacggcgcggacgc

SEQ ID NO: 74774 - DNA, 67 bp, Homo sapiens
  misc_feature 1..67: note = chr12:49933430-49933497
  misc_feature 1..67: note = hyper
  source 1..67: mol_type = genomic DNA
taggcgctgtttccccgaaggttcgaaggttcggggtcaacactgcttcaggcgaggcaacagggcc

SEQ ID NO: 74775 - DNA, 36 bp, Homo sapiens
  misc_feature 1..36: note = chr12:49944080-49944116
  misc_feature 1..36: note = hypo
  source 1..36: mol_type = genomic DNA
gctcaagggtggcaccgtgctcgccatcctaggttt

SEQ ID NO: 74776 - DNA, 35 bp, Homo sapiens
  misc_feature 1..35: note = chr12:50036399-50036434
  misc_feature 1..35: note = hypo
  source 1..35: mol_type = genomic DNA
agatcaccctggagtcggagcggatccggctcttc

SEQ ID NO: 74777 - DNA, 54 bp, Homo sapiens
  misc_feature 1..54: note = chr12:50052209-50052263
  misc_feature 1..54: note = hypo
  source 1..54: mol_type = genomic DNA
caaaagcacacataccggagcacagactggcgcgcagagcgagcgaggctgttg

SEQ ID NO: 74778 - DNA, 808 bp, Homo sapiens; identical to SEQ ID NO: 1018
  misc_feature 1..808: note = chr12:5017990-5018798
  misc_feature 1..808: note = hyper
  source 1..808: mol_type = genomic DNA

SEQ ID NO: 74779 - DNA, 30 bp, Homo sapiens
  misc_feature 1..30: note = chr12:50186522-50186552
  misc_feature 1..30: note = hypo
  source 1..30: mol_type = genomic DNA
ggcatgctggggtgccgcccactcaccagc

SEQ ID NO: 74780 - skipped

SEQ ID NO: 74781 - DNA, 229 bp, Homo sapiens; identical to SEQ ID NO: 1020
  misc_feature 1..229: note = chr12:5018806-5019035
  misc_feature 1..229: note = hyper
  source 1..229: mol_type = genomic DNA

SEQ ID NO: 74782 - DNA, 659 bp, Homo sapiens; identical to SEQ ID NO: 1021
  misc_feature 1..659: note = chr12:5019084-5019743
  misc_feature 1..659: note = hyper
  source 1..659: mol_type = genomic DNA

SEQ ID NO: 74783 - DNA, 521 bp, Homo sapiens; identical to SEQ ID NO: 34228
  misc_feature 1..521: note = chr12:5019793-5020314
  misc_feature 1..521: note = hyper
  source 1..521: mol_type = genomic DNA

SEQ ID NO: 74784 - DNA, 32 bp, Homo sapiens
  misc_feature 1..32: note = chr12:5020440-5020472
  misc_feature 1..32: note = hyper
  source 1..32: mol_type = genomic DNA
cgctccggtgggggggccgcttgggtcccccc

SEQ ID NO: 74785 - DNA, 30 bp, Homo sapiens
  misc_feature 1..30: note = chr12:5020739-5020769
  misc_feature 1..30: note = hyper
  source 1..30: mol_type = genomic DNA
cctaagaaacgcatgcgctacttcgacccc

SEQ ID NO: 74786 - DNA, 94 bp, Homo sapiens; identical to SEQ ID NO: 1035
  misc_feature 1..94: note = chr12:50297461-50297555
  misc_feature 1..94: note = hyper
  source 1..94: mol_type = genomic DNA

SEQ ID NO: 74787 - DNA, 115 bp, Homo sapiens; identical to SEQ ID NO: 1036
  misc_feature 1..115: note = chr12:50297973-50298088
  misc_feature 1..115: note = hyper
  source 1..115: mol_type = genomic DNA

SEQ ID NO: 74788 - DNA, 199 bp, Homo sapiens
  misc_feature 1..199: note = chr12:50355598-50355797
  misc_feature 1..199: note = hyper
  source 1..199: mol_type = genomic DNA
ggccccgcgcccggccgcccgccccctatatagcgcgccccagcagggcccgcgccaggccgccagcctcggagtgggcgcgggacagtgcgcggcgccccgcagccaggcccccgcccccgccgcatccacctcctccgccgcctgcgacccaacgggcgccccccgccgcggcagctgccgccgggcccccgcggcc

SEQ ID NO: 74789 - DNA, 146 bp, Homo sapiens
  misc_feature 1..146: note = chr12:50426748-50426894
  misc_feature 1..146: note = hyper
  source 1..146: mol_type = genomic DNA
tcacctccccaggggcggccgcctgatccgatgtcccgacaggcgaactgtcatcgacgatccctggacgcgggcgtcgggggcagggaggcttggctaggtccctggctgccaaccgtctggccacagcccgatgcgtgtcttca

SEQ ID NO: 74790 - DNA, 241 bp, Homo sapiens; identical to SEQ ID NO: 34371
  misc_feature 1..241: note = chr12:50444182-50444423
  misc_feature 1..241: note = hyper
  source 1..241: mol_type = genomic DNA

SEQ ID NO: 74791 - DNA, 30 bp, Homo sapiens
  misc_feature 1..30: note = chr12:50444626-50444656
  misc_feature 1..30: note = hyper
  source 1..30: mol_type = genomic DNA
ctgcctgtgatatggcgggctgcattacaa

SEQ ID NO: 74792 - DNA, 41 bp, Homo sapiens
  misc_feature 1..41: note = chr12:50508302-50508343
  misc_feature 1..41: note = hypo
  source 1..41: mol_type = genomic DNA
gggactacaggagtgagccactgcgccgggccttggaattt

SEQ ID NO: 74793 - DNA, 30 bp, Homo sapiens
  misc_feature 1..30: note = chr12:50575698-50575728
  misc_feature 1..30: note = hypo
  source 1..30: mol_type = genomic DNA
ttgcaataggagcaacggaagcagctgatg

SEQ ID NO: 74794 - DNA, 19 bp, Homo sapiens
  misc_feature 1..19: note = chr12:50664625-50664644
  misc_feature 1..19: note = hypo
  source 1..19: mol_type = genomic DNA
agcactttgggaggccgag

SEQ ID NO: 74795 - DNA, 30 bp, Homo sapiens; identical to SEQ ID NO: 43452
  misc_feature 1..30: note = chr12:50790622-50790652
  misc_feature 1..30: note = hypo
  source 1..30: mol_type = genomic DNA

SEQ ID NO: 74796 - DNA, 24 bp, Homo sapiens
  misc_feature 1..24: note = chr12:50897742-50897766
  misc_feature 1..24: note = hypo
  source 1..24: mol_type = genomic DNA
tttcttttctttagacggagtgtt

SEQ ID NO: 74797 - DNA, 30 bp, Homo sapiens
  misc_feature 1..30: note = chr12:50938109-50938139
  misc_feature 1..30: note = hypo
  source 1..30: mol_type = genomic DNA
tctattcagatattccgtcactagggctgg

SEQ ID NO: 74798 - DNA, 30 bp, Homo sapiens
  misc_feature 1..30: note = chr12:51070876-51070906
  misc_feature 1..30: note = hypo
  source 1..30: mol_type = genomic DNA
gtcccttctcccttccgtgcctcttttctc

SEQ ID NO: 74799 - DNA, 30 bp, Homo sapiens
  misc_feature 1..30: note = chr12:51237808-51237838
  misc_feature 1..30: note = hypo
  source 1..30: mol_type = genomic DNA
taaagacgctaggtacgtattcagaacaca

SEQ ID NO: 74800 - DNA, 30 bp, Homo sapiens
  misc_feature 1..30: note = chr12:5141776-5141806
  misc_feature 1..30: note = hypo
  source 1..30: mol_type = genomic DNA
tcaccatcaacaggtcgttgatgttaccgt

SEQ ID NO: 74801 - DNA, 520 bp, Homo sapiens
  misc_feature 1..520: note = chr12:51421126-51421646
  misc_feature 1..520: note = hypo
  source 1..520: mol_type = genomic DNA
aaaaggatagccacctggaaggaacatttcctcgcgcccccagagccacatcatagtatctgctgccccaccaagagcaccccacacctgggaggaaccgagaaacatcagctagtgcagccagtttgaccgccttaggtgtcctcccaagcctccgtagtgaattgttttcctcctcgcccagctgactcgattctccccagacttcatcctacctacccaaaagcaatcccactctatcgccagtttcagcctcacaccgtatcttttgctctgaagatgagactgccaaactggtgaagagggaataaatggcctaacaaattaccgtaattttctgcaatgtcgtttacagccaccaaaaacattagatcctcccgccaccctcactccccgacccctcgcactgcttacagcattaaaggtaattgagcttctttattcacgtaaaaacagctaggagaaaatttcattagtaagagagaccaagaaatgaggaaaggagcgtgaactgcaaaga

SEQ ID NO: 74802 - DNA, 104 bp, Homo sapiens
  misc_feature 1..104: note = chr12:51441353-51441457
  misc_feature 1..104: note = hypo
  source 1..104: mol_type = genomic DNA
cgacagagcaaaactgtcacaaaaacaaaacaacaaaacaaaacaaaacagagtaacatgagaataagtgtgaagtgtgtccttttcgccggcactgcttcaga

SEQ ID NO: 74803 - DNA, 372 bp, Homo sapiens; identical to SEQ ID NO: 34229
  misc_feature 1..372: note = chr12:5152915-5153287
  misc_feature 1..372: note = hyper
  source 1..372: mol_type = genomic DNA

SEQ ID NO: 74804 - DNA, 104 bp, Homo sapiens; identical to SEQ ID NO: 11129
  misc_feature 1..104: note = chr12:5153357-5153461
  misc_feature 1..104: note = hyper
  source 1..104: mol_type = genomic DNA

SEQ ID NO: 74805 - DNA, 69 bp, Homo sapiens
  misc_feature 1..69: note = chr12:5153656-5153725
  misc_feature 1..69: note = hyper
  source 1..69: mol_type = genomic DNA
cgtccctgcaccaccagcgcgtccacatcaacatctccgggctgcgctttgagacgcagctgggcaccc

SEQ ID NO: 74806 - DNA, 32 bp, Homo sapiens
  misc_feature 1..32: note = chr12:51565442-51565474
  misc_feature 1..32: note = hypo
  source 1..32: mol_type = genomic DNA
gagccaccgcacccggccgaaaggagattttt

SEQ ID NO: 74807 - DNA, 41 bp, Homo sapiens
  misc_feature 1..41: note = chr12:51749684-51749725
  misc_feature 1..41: note = hypo
  source 1..41: mol_type = genomic DNA
gacacagctgctttgcgatgttgtggcgaaggtccctctga

SEQ ID NO: 74808 - DNA, 30 bp, Homo sapiens
  misc_feature 1..30: note = chr12:51819149-51819179
  misc_feature 1..30: note = hyper
  source 1..30: mol_type = genomic DNA
gttgtcctgccagaacgtgggcagaaaggg

SEQ ID NO: 74809 - DNA, 86 bp, Homo sapiens
  misc_feature 1..86: note = chr12:51930708-51930794
  misc_feature 1..86: note = hypo
  source 1..86: mol_type = genomic DNA
ctctcaccagcagtgcgtagatggatgtggtgagccactcccaagtttttgctcttaaaaagactgagcatgaagctgggcgctgt

SEQ ID NO: 74810 - DNA, 59 bp, Homo sapiens
  misc_feature 1..59: note = chr12:51985238-51985297
  misc_feature 1..59: note = hyper
  source 1..59: mol_type = genomic DNA
agtcaggggctttgccgcagagtgcgcggcggggctccaggggccgtggagctggggct

SEQ ID NO: 74811 - DNA, 30 bp, Homo sapiens
  misc_feature 1..30: note = chr12:52074429-52074459
  misc_feature 1..30: note = hypo
  source 1..30: mol_type = genomic DNA
cctatatttccatcacgaccaaaccaagag

SEQ ID NO: 74812 - DNA, 84 bp, Homo sapiens
  misc_feature 1..84: note = chr12:52207881-52207965
  misc_feature 1..84: note = hyper
  source 1..84: mol_type = genomic DNA
agccctgcactgtggcgagcgggccggggctgccgggcgacgcccggtcgccgtcgccgccagtgatccatagcgtgagcagga

SEQ ID NO: 74813 - DNA, 403 bp, Homo sapiens
  misc_feature 1..403: note = chr12:52208001-52208404
  misc_feature 1..403: note = hyper
  source 1..403: mol_type = genomic DNA
cggtgaggaggccgagcgccagcggccccgcccaacccatggggctccgctcgtacaggggctgcggcaggcgctccacgatcagctgcagggcgtcccagtccggcgcggggaccgcggcgcgccgggggcgcggggccggggcaaagggcacgcgggcggcggcgccgggccgcggcaggaagcgctgcccgaacttgcgcagctgcagcgtcgcctgctggtggaggttcttgcccagctccctggccacgtccgggcggccgctgcgccgcagggcccgagccaggcggtcccaggacagggacgcggcctggggggccagccaggccgccagcgcctcccggcagccgtcggacacctctccaggcccggctaccctgcccgccgggtcctcggccgc

SEQ ID NO: 74814 - DNA, 85 bp, Homo sapiens; identical to SEQ ID NO: 34372
  misc_feature 1..85: note = chr12:52208668-52208753
  misc_feature 1..85: note = hyper
  source 1..85: mol_type = genomic DNA

SEQ ID NO: 74815 - DNA, 30 bp, Homo sapiens
  misc_feature 1..30: note = chr12:52241437-52241467
  misc_feature 1..30: note = hyper
  source 1..30: mol_type = genomic DNA
ggcctcctcctctggcgggggcagggggac

SEQ ID NO: 74816 - DNA, 128 bp, Homo sapiens
  misc_feature 1..128: note = chr12:52241703-52241831
  misc_feature 1..128: note = hyper
  source 1..128: mol_type = genomic DNA
cccctgactctgagacgcgggctctgttctcccgggccagaggagaagacatgaagagggtgggtgttaggggcgcggggaccctaagtagcctcggcctcctgtcactgccccgtcaccatgctggg

SEQ ID NO: 74817 - DNA, 307 bp, Homo sapiens
  misc_feature 1..307: note = chr12:52242119-52242426
  misc_feature 1..307: note = hyper
  source 1..307: mol_type = genomic DNA
ccgagaagtgaccctcggctcccacgtacccgctagggtctctcgccggccctgccctccgacccccgccgagctgaaccccgcgactagcagcccccgccctctcggccctctccggccccgggccggcggacaaagctccggacaccctgaccgaacggtcacctccccccgccccatcccggcccgcccgcggccccgtacctcggcatcacggccgggtcctaggtgagtgtgcgcggcctgggggcgcgtccggcccggggaccggggcggcggcgcgggccgggggcgacaggcctgggct

SEQ ID NO: 74818 - DNA, 152 bp, Homo sapiens
  misc_feature 1..152: note = chr12:52258092-52258244
  misc_feature 1..152: note = hyper
  source 1..152: mol_type = genomic DNA
cgcagaggctcagtccgcccaatccccggccgcccgccatcctgggcgcccccggcccggggcccggtcccgcccgtaaatcagctccgtcagcgttaatggctcctgactaattgcctggacttgggctccgggctcgggtcgccagcatt

SEQ ID NO: 74819 - DNA, 625 bp, Homo sapiens
  misc_feature 1..625: note = chr12:52262788-52263413
  misc_feature 1..625: note = hyper
  source 1..625: mol_type = genomic DNA
cgtgaactatccacccgtgtgcacgccagccgagcgagtggccgagggacacccccgtgcttcccaaggcctggctccacgaggagcagaaccccagcggtgggattctgtcgcgcaatgctgtgtggctccgactagggcccgccctccagcaaagagatgctggtgggtgctctcggttcacccccgcactcgccccaggggggctcgcgggccacctggagctcccgcccctcggtggccagggctgcgcgtgaaagggggacgttcggacgcgggggcgcggagccagcgcgcgagcctcggagcctcccccaggctgtgggggaagaggagggaggagggagcagatggcagcaattaccgctcggaccctcccccgccgtagcctggggccggaagatcggctcggcagctcgctcctgcgggaggggcggcggcctccccggccgggaaccggcggggagggggtccgggaggggcggctctggccgccggggcgcgggcatcccagcttctaggggagagtgatgtgagggcccggtggagacacctccttctcccgggacgagggctgagagattccctttggaaaggccgagtctccggccgcccccacccccag

SEQ ID NO: 74820 - DNA, 282 bp, Homo sapiens
  misc_feature 1..282: note = chr12:52301024-52301306
  misc_feature 1..282: note = hyper
  source 1..282: mol_type = genomic DNA
gccccctcggggaggcggatgtgggaggcccggcccgggtgcgggccagcgacccgggagctgcgggcggctgggaggggaggccgccctgaggggctgggagcggcgcgggggtgggtcccggtcctgcagccccagcgaggggcgagcggcggccagtcggcgagctgggcaataaggaaacggtttattaggagggagtggtggagctgggccaggcaggaagacgctggaataagaaacatttttgctccagcccccatcccagtcccgggaggctgc

SEQ ID NO: 74821 - DNA, 14 bp, Homo sapiens
  misc_feature 1..14: note = chr12:52301505-52301519
  misc_feature 1..14: note = hyper
  source 1..14: mol_type = genomic DNA
gggtggcgggcggc

SEQ ID NO: 74822 - DNA, 37 bp, Homo sapiens
  misc_feature 1..37: note = chr12:52309137-52309174
  misc_feature 1..37: note = hypo
  source 1..37: mol_type = genomic DNA
ggctagctgtgtccgcggcatgcggcctggcgcacct

SEQ ID NO: 74823 - DNA, 72 bp, Homo sapiens
  misc_feature 1..72: note = chr12:52317378-52317450
  misc_feature 1..72: note = hyper
  source 1..72: mol_type = genomic DNA
ccgagggctgcccagcggccgcctcccatccccacacagggaccgcggggcctttcccggcagggtggggca

SEQ ID NO: 74824 - DNA, 206 bp, Homo sapiens
  misc_feature 1..206: note = chr12:52387854-52388060
  misc_feature 1..206: note = hypo
  source 1..206: mol_type = genomic DNA
cctctcccagctcagcgtgcaggaagacgtgaagatctaactgctccctctctccacacggagctcctggcagcgagaactacgcacagctgccgcgttgagcgtacgatggaggcctacctctcgtttctgcccagccctctgtggccaggagccctggcccgcaagagggacagagcccgggagagactcgctcactcccatgt

SEQ ID NO: 74825 - DNA, 198 bp, Homo sapiens
  misc_feature 1..198: note = chr12:52388300-52388498
  misc_feature 1..198: note = hypo
  source 1..198: mol_type = genomic DNA
cacaccaaggtggcccggaagaaccagaagtgcagcccctctcacaggcagctctgagccgcgctttcccctcctccctgggatggacgctgccgggagactgccagtggagacggaatctgccgctttgtctgtccagccgtgtgtgcatgtgccgaggtgcgtcccccgttgtgcctggttcgtgccatgccctta

SEQ ID NO: 74826 - DNA, 234 bp, Homo sapiens
  misc_feature 1..234: note = chr12:52400255-52400489
  misc_feature 1..234: note = hyper
  source 1..234: mol_type = genomic DNA
ccacccctactcctgcgcagccccgctgccgctctccctgccctggagtctcctgcagccccttggatctccgtgactctccctacctccccgactccccaggcttcttacagtgacctcttaccgtgccccactccatgaatcgccagagctattcgtccctaaatttcaaaccttgcgcaatgtcccttcacagacccctccaggtatcacgcagccccgagccccgagccc

SEQ ID NO: 74827 - DNA, 391 bp, Homo sapiens; identical to SEQ ID NO: 34379
  misc_feature 1..391: note = chr12:52400516-52400907
  misc_feature 1..391: note = hyper
  source 1..391: mol_type = genomic DNA

SEQ ID NO: 74828 - DNA, 629 bp, Homo sapiens; identical to SEQ ID NO: 34380
  misc_feature 1..629: note = chr12:52400908-52401537
  misc_feature 1..629: note = hyper
  source 1..629: mol_type = genomic DNA

SEQ ID NO: 74829 - DNA, 32 bp, Homo sapiens
  misc_feature 1..32: note = chr12:52416953-52416985
  misc_feature 1..32: note = hyper
  source 1..32: mol_type = genomic DNA
ggggttggagccccacgcgctgctcaagaggc

SEQ ID NO: 74830 - DNA, 39 bp, Homo sapiens
  misc_feature 1..39: note = chr12:52467638-52467677
  misc_feature 1..39: note = hypo
  source 1..39: mol_type = genomic DNA
tctgaggaactggatcgtgccctgcgcaaggttgttggg

SEQ ID NO: 74831 - DNA, 53 bp, Homo sapiens
  misc_feature 1..53: note = chr12:52491074-52491127
  misc_feature 1..53: note = hypo
  source 1..53: mol_type = genomic DNA
tattacgatacacatcgcaggggggcgggcgacccccacgatgcggggagaaa

SEQ ID NO: 74832 - DNA, 30 bp, Homo sapiens
  misc_feature 1..30: note = chr12:52514449-52514479
  misc_feature 1..30: note = hypo
  source 1..30: mol_type = genomic DNA
aacaaagacgtggatcgcttggggaggtgt

SEQ ID NO: 74833 - DNA, 37 bp, Homo sapiens
  misc_feature 1..37: note = chr12:5252286-5252323
  misc_feature 1..37: note = hypo
  source 1..37: mol_type = genomic DNA
cacctccacatcatccgtaatccgatcacctccacat

SEQ ID NO: 74834 - DNA, 172 bp, Homo sapiens
  misc_feature 1..172: note = chr12:52524463-52524635
  misc_feature 1..172: note = hypo
  source 1..172: mol_type = genomic DNA
tcatacacacacacacgcacacacacaaaagagagaggctgagaggagttgttcacttctttcgggggaggagggtctctgccatctggcatcccactaggggtcctggaaaggaaggagctgaatctaagtgctgggtttagcccacagccctcggcgtgctgctcacaca

SEQ ID NO: 74835 - DNA, 30 bp, Homo sapiens; identical to SEQ ID NO: 34381
  misc_feature 1..30: note = chr12:52615930-52615960
  misc_feature 1..30: note = hyper
  source 1..30: mol_type = genomic DNA

SEQ ID NO: 74836 - DNA, 217 bp, Homo sapiens
  misc_feature 1..217: note = chr12:52626830-52627047
  misc_feature 1..217: note = hyper
  source 1..217: mol_type = genomic DNA
cgctcctgcctactccggaccatccctgcttggactgaaagcctgggcttcggcggggcgggcgggcagagggcggagggcggccccaggaggggcctggcagcagagaaaggtggcccgcggcagccccgcccctacctgtggaagcccagccgcccgctcccgcggataaaaggcgcggagtgtccccgaggtcagcgagtgcgcgctcctcctc

SEQ ID NO: 74837 - DNA, 14 bp, Homo sapiens
  misc_feature 1..14: note = chr12:52627272-52627286
  misc_feature 1..14: note = hyper
  source 1..14: mol_type = genomic DNA
gaggtcaccattaa

SEQ ID NO: 74838 - DNA, 82 bp, Homo sapiens; identical to SEQ ID NO: 34384
  misc_feature 1..82: note = chr12:52652138-52652220
  misc_feature 1..82: note = hyper
  source 1..82: mol_type = genomic DNA

SEQ ID NO: 74839 - DNA, 56 bp, Homo sapiens
  misc_feature 1..56: note = chr12:52652599-52652655
  misc_feature 1..56: note = hyper
  source 1..56: mol_type = genomic DNA
gagtggaacccctccacctgtccgcccctccgccgggactccgagctttgccttgt

SEQ ID NO: 74840 - DNA, 76 bp, Homo sapiens
  misc_feature 1..76: note = chr12:52701967-52702043
  misc_feature 1..76: note = hyper
  source 1..76: mol_type = genomic DNA
gcccggcgccttttccgcggcactgacctctcgccttctctccctgcaggctgtgcgagggcgtcggctcggtgaa

SEQ ID NO: 74841 - DNA, 211 bp, Homo sapiens; identical to SEQ ID NO: 11234
  misc_feature 1..211: note = chr12:52702362-52702573
  misc_feature 1..211: note = hyper
  source 1..211: mol_type = genomic DNA

SEQ ID NO: 74842 - DNA, 30 bp, Homo sapiens; identical to SEQ ID NO: 43460
  misc_feature 1..30: note = chr12:52913808-52913838
  misc_feature 1..30: note = hypo
  source 1..30: mol_type = genomic DNA

SEQ ID NO: 74843 - DNA, 30 bp, Homo sapiens; identical to SEQ ID NO: 43461
  misc_feature 1..30: note = chr12:52914057-52914087
  misc_feature 1..30: note = hypo
  source 1..30: mol_type = genomic DNA

SEQ ID NO: 74844 - DNA, 41 bp, Homo sapiens
  misc_feature 1..41: note = chr12:53004285-53004326
  misc_feature 1..41: note = hyper
  source 1..41: mol_type = genomic DNA
gtgaagtaaacacatcgccagctcgccgccccctccccccc

SEQ ID NO: 74845 - DNA, 102 bp, Homo sapiens; identical to SEQ ID NO: 43462
  misc_feature 1..102: note = chr12:53069161-53069263
  misc_feature 1..102: note = hypo
  source 1..102: mol_type = genomic DNA

SEQ ID NO: 74846 - DNA, 196 bp, Homo sapiens
  misc_feature 1..196: note = chr12:53084865-53085061
  misc_feature 1..196: note = hyper
  source 1..196: mol_type = genomic DNA
ggggatcaggaagggcgtggaggggaggagtttgaggagagggcggtgaggggcaggcgtgatgtgtggcagaaacgaggcctctactccaagatccgcctgtgggaggtgttggtggaggtctggatgatctgcacgcgcgaggatccgcggccgcttctgccgctccctccgtagctcccgccaccgccgccgc

SEQ ID NO: 74847 - DNA, 30 bp, Homo sapiens
  misc_feature 1..30: note = chr12:53088494-53088524
  misc_feature 1..30: note = hypo
  source 1..30: mol_type = genomic DNA
tccaggtccagggaacggttattgtccatg

SEQ ID NO: 74848 - DNA, 615 bp, Homo sapiens
  misc_feature 1..615: note = chr12:53107999-53108614
  misc_feature 1..615: note = hyper
  source 1..615: mol_type = genomic DNA
acaggtcagaagcagcggagggaaggggccccgcgggggtgcgggggagctcagagcggggcgtgccggagggcgaaggggactggggtccgaggacgcccctggcgcggggttcagaatttgtggcgggaccgccagctctaggaggagctttgttctctctggcggcgctgctgccgccgccgccgccaccccggctgacggcgcaggagtcccggagccagagaagccccccgagcaccgcggagctcccgcccaagccccagccgctgcggccccggctaccgccgcgggcccgggctccgactcctcctcccagggcgcagccgccgccagtgctgctgtggccagtctctgcaaagacggtcggggtcagggagcctggcagtgtccgcccggcacgccagcccctcccacagtcccgagccgcaggtcttcccggggtgacgccccgccgagatccggcaaggcgtggggaggacaggcttcaaggaggggaggggaggttggttcctccaaaacagccaccaacagctcttccagcctgcaggcctgatggcctcgcaccagcgctggcacatggcttgagaaactgcattccgaggcctccagccc

SEQ ID NO: 74849 - DNA, 156 bp, Homo sapiens
  misc_feature 1..156: note = chr12:5315378-5315534
  misc_feature 1..156: note = hypo
  source 1..156: mol_type = genomic DNA
cgtgatctgcggcctcccaaagtgctgggattacaggcgtgacccagaaagttgagtaacttcttaaaggctatgtgaattattttcatttcacatcactattcacttgagcagtgagatttacacacttatcagctcttacgcttgctctttaaa

SEQ ID NO: 74850 - DNA, 210 bp, Homo sapiens; identical to SEQ ID NO: 43463
  misc_feature 1..210: note = chr12:53189513-53189723
  misc_feature 1..210: note = hypo
  source 1..210: mol_type = genomic DNA

SEQ ID NO: 74851 - DNA, 146 bp, Homo sapiens
  misc_feature 1..146: note = chr12:5323880-5324026
  misc_feature 1..146: note = hypo
  source 1..146: mol_type = genomic DNA
gcagggggctagtggcgttctattttcttgtggagtgatggcctggaaaatataatgtacgggagatgtaatggtgacccaccgacctggccgggatgccttgcttccccttcctcccacacctacacacacgtgcacacgttgag

SEQ ID NO: 74852 - DNA, 78 bp, Homo sapiens
  misc_feature 1..78: note = chr12:53241495-53241573
  misc_feature 1..78: note = hypo
  source 1..78: mol_type = genomic DNA
gactgcgggacacctcgtttacctgtagcaggtgggcacctgagagcctggggaatggggacgcggaggggtagaggg

SEQ ID NO: 74853 - DNA, 32 bp, Homo sapiens
  misc_feature 1..32: note = chr12:53342879-53342911
  misc_feature 1..32: note = hyper
  source 1..32: mol_type = genomic DNA
tcgggtcgcgcggctcgcgcaggccgccaccg

SEQ ID NO: 74854 - DNA, 141 bp, Homo sapiens; identical to SEQ ID NO: 43339
  misc_feature 1..141: note = chr12:5335908-5336049
  misc_feature 1..141: note = hypo
  source 1..141: mol_type = genomic DNA

SEQ ID NO: 74855 - DNA, 41 bp, Homo sapiens; identical to SEQ ID NO: 34390
  misc_feature 1..41: note = chr12:53359275-53359316
  misc_feature 1..41: note = hyper
  source 1..41: mol_type = genomic DNA

SEQ ID NO: 74856 - DNA, 210 bp, Homo sapiens; identical to SEQ ID NO: 34391
  misc_feature 1..210: note = chr12:53359385-53359595
  misc_feature 1..210: note = hyper
  source 1..210: mol_type = genomic DNA

SEQ ID NO: 74857 - DNA, 21 bp, Homo sapiens
  misc_feature 1..21: note = chr12:53402530-53402551
  misc_feature 1..21: note = hypo
  source 1..21: mol_type = genomic DNA
ttcttaaaggccgggcgcggt

SEQ ID NO: 74858 - DNA, 223 bp, Homo sapiens
  misc_feature 1..223: note = chr12:53454914-53455137
  misc_feature 1..223: note = hypo
  source 1..223: mol_type = genomic DNA
gaaacgccacctgcccgggccggggcaacagccaggaccctggggcccagagcaggcatcatcgccagccagaggcatcagtcaccatgtcaccttcgcacctctgctctcagataatgtcccccaaaccccaggtataaaggccttgagggggttggtgccaccttgagagaaccctttctcctgggatgtagcatggatggggacccgggtaccctggggt

SEQ ID NO: 74859 - DNA, 30 bp, Homo sapiens; identical to SEQ ID NO: 43464
  misc_feature 1..30: note = chr12:53455806-53455836
  misc_feature 1..30: note = hypo
  source 1..30: mol_type = genomic DNA

SEQ ID NO: 74860 - DNA, 38 bp, Homo sapiens
  misc_feature 1..38: note = chr12:53456042-53456080
  misc_feature 1..38: note = hypo
  source 1..38: mol_type = genomic DNA
gcctggggaaggctacgttgggtcggtttagggagatg

SEQ ID NO: 74861 - DNA, 50 bp, Homo sapiens
  misc_feature 1..50: note = chr12:53509507-53509557
  misc_feature 1..50: note = hypo
  source 1..50: mol_type = genomic DNA
cccccaaagagggggcggggcccacgagagggaggcgctggagaaggcat

SEQ ID NO: 74862 - DNA, 15 bp, Homo sapiens
  misc_feature 1..15: note = chr12:53535782-53535797
  misc_feature 1..15: note = hypo
  source 1..15: mol_type = genomic DNA
cggttggagtgtgtg

SEQ ID NO: 74863 - DNA, 240 bp, Homo sapiens; identical to SEQ ID NO: 43466
  misc_feature 1..240: note = chr12:53662984-53663224
  misc_feature 1..240: note = hypo
  source 1..240: mol_type = genomic DNA

SEQ ID NO: 74864 - DNA, 35 bp, Homo sapiens
  misc_feature 1..35: note = chr12:53668208-53668243
  misc_feature 1..35: note = hypo
  source 1..35: mol_type = genomic DNA
tggaatgcagtggatcggtgcgagaagccaaggat

SEQ ID NO: 74865 - DNA, 87 bp, Homo sapiens
  misc_feature 1..87: note = chr12:5370466-5370553
  misc_feature 1..87: note = hypo
  source 1..87: mol_type = genomic DNA
ggcaagagtgctctccgaaaagagattagggctggagagaatgatctcaacatgcatggagtccttaatacagggagttagtaagac

SEQ ID NO: 74866 - DNA, 330 bp, Homo sapiens
  misc_feature 1..330: note = chr12:53719553-53719883
  misc_feature 1..330: note = hyper
  source 1..330: mol_type = genomic DNA
ttggggggcgggggccgcacaaagccctattgtggctcggggatgctgccacagagtggtttttgttcttcggctaactccgtggcgggcacgactgattgcagacccagggcagggggcgggttacgtgccaggcccagtctgcccgccgggagccgcaccaccgcccgactggggccgcgcaggagtccgcactgcaaccgcggtgcccgcgctcgggtcgcgtcactgccctgaccagggtcagttggtgcagtccagaaagggccagggtagaaaccagtgagtcttcccaactctgcagaaagcactgcacgcccaaaaactgaa

SEQ ID NO: 74867 - DNA, 120 bp, Homo sapiens
  misc_feature 1..120: note = chr12:53763895-53764015
  misc_feature 1..120: note = hypo
  source 1..120: mol_type = genomic DNA
aaaataaataaataaaataataataataatcatttaaatcagaagagaagaaaatgaacctagaacacccatcatctgaacttagcaattattattattattattattattattattatt

SEQ ID NO: 74868 - DNA, 36 bp, Homo sapiens
  misc_feature 1..36: note = chr12:53785467-53785503
  misc_feature 1..36: note = hypo
  source 1..36: mol_type = genomic DNA
aatgatcttgttacccgggtccggtcatgagcatag

SEQ ID NO: 74869 - DNA, 16 bp, Homo sapiens
  misc_feature 1..16: note = chr12:53810619-53810635
  misc_feature 1..16: note = hypo
  source 1..16: mol_type = genomic DNA
aggtgtggtggctcac

SEQ ID NO: 74870 - DNA, 30 bp, Homo sapiens; identical to SEQ ID NO: 43467
  misc_feature 1..30: note = chr12:53813830-53813860
  misc_feature 1..30: note = hypo
  source 1..30: mol_type = genomic DNA

SEQ ID NO: 74871 - DNA, 42 bp, Homo sapiens
  misc_feature 1..42: note = chr12:53832375-53832417
  misc_feature 1..42: note = hypo
  source 1..42: mol_type = genomic DNA
ctggacaacggggccagggcgagactccgtctcaaaaaaaaa

SEQ ID NO: 74872 - DNA, 30 bp, Homo sapiens; identical to SEQ ID NO: 43340
  misc_feature 1..30: note = chr12:5384595-5384625
  misc_feature 1..30: note = hypo
  source 1..30: mol_type = genomic DNA

SEQ ID NO: 74873 - DNA, 120 bp, Homo sapiens; identical to SEQ ID NO: 43468
  misc_feature 1..120: note = chr12:53885488-53885608
  misc_feature 1..120: note = hypo
  source 1..120: mol_type = genomic DNA

SEQ ID NO: 74874 - DNA, 30 bp, Homo sapiens
  misc_feature 1..30: note = chr12:54021415-54021445
  misc_feature 1..30: note = hypo
  source 1..30: mol_type = genomic DNA
tttcttaaaatttaacgaattgtagttgac

SEQ ID NO: 74875 - DNA, 564 bp, Homo sapiens; identical to SEQ ID NO: 34393
  misc_feature 1..564: note = chr12:54089081-54089645
  misc_feature 1..564: note = hyper
  source 1..564: mol_type = genomic DNA

SEQ ID NO: 74876 - DNA, 287 bp, Homo sapiens
  misc_feature 1..287: note = chr12:54132239-54132526
  misc_feature 1..287: note = hyper
  source 1..287: mol_type = genomic DNA
gacataaattacctgcgaggaggaaagacgcagaggctgcgcactttccttcctctcccccagacccgcgcaaggcgctgagggggtcctccctccggcaaaggcggagggacggcctgacaggaacagtgtgcacttgcctctgtcctcccccgagggacagtggcctggggtgaccgagaaacctggccctcccaaggtccccgggctgccaaggaggacccttcggccttagggcggagcctcccccgccgctcaggggaggtggagctcgttgtggtgggcgg

SEQ ID NO: 74877 - DNA, 52 bp, Homo sapiens
  misc_feature 1..52: note = chr12:54133602-54133654
  misc_feature 1..52: note = hyper
  source 1..52: mol_type = genomic DNA
atcgtccatctgatgcgcggggcccagcactccatcgcgaacatttgggccg

SEQ ID NO: 74878 - DNA, 1019 bp, Homo sapiens
  misc_feature 1..1019: note = chr12:54144839-54145858
  misc_feature 1..1019: note = hyper
  source 1..1019: mol_type = genomic DNA
tcacacacacacacacgcacacactcactcctgcgcacacaggctgctccgcggacacgcttcacggagcaggtgtgcccacgcgcaataccctcctggcccacaggcctccgcacgcacaggacacacacacacactctctcctggcctccctcccgccgcccctcctctgagccctgcggcccggccttccgcacctcccaacgcctgcaggggttgggggcgctggggctcggggcgctcactcggacctcggagccaatcgccagagatctaatggctcctttggcagtgggaaggggtgtgcgtgggtgtcctctccttcactctttccccagccctgtcgcctcccaccccccttccggccgcggcagtttccgaaatcgcccggcggccgcgaattcattagtggggggcggatgtaaacgcagcgcggtggaacgttttaattaggcctgaacaataaacaagctaaacgaggcgcgcaggactccctggtgggccctcagcctcctccgcgcggcgcggactcattacggctgcagccaatttcatgccagcgccgagcactggctgggccgggagtggggtcgggggtgcgtgcgggtgcgatccgggcctgcagggtgcggagcgggggcgtcccggggcgagggcagcgggccggttcccgcccgcccggggccgcggcttccgcatttctgcaccatccacctgcctttttcagtgtccttgagatgacgctccctccccacaccagagcggccggctggagagtctagcttgctttttagggtctctctcccgcctcttttcctcccccgctccctctctccttgcggctgactccagctccccctcggtgcccgtaaccctcctttcctctttttgccgcagtctccgtctctcttccacagggtctctccctccccctctccccgtggttgtcagactttctcctggactttctccgccccgcaccgcccgccccggatgccgagcgtggtagactctgcagc

SEQ ID NO: 74879 - DNA, 92 bp, Homo sapiens; identical to SEQ ID NO: 34397
  misc_feature 1..92: note = chr12:54145880-54145972
  misc_feature 1..92: note = hyper
  source 1..92: mol_type = genomic DNA

SEQ ID NO: 74880 - DNA, 964 bp, Homo sapiens
  misc_feature 1..964: note = chr12:54321250-54322214
  misc_feature 1..964: note = hyper
  source 1..964: mol_type = genomic DNA
aaatttctgccctgtcgttccaatgccatgatggagaaggacccctaaaatcgcctttggcgtgtgcagctcgagcgttacaacgatgcaaagtgcggtctttggaggatgcgggagtcggtaacccctcaattcactctcgccgttccttctctccagtctgcgcgaaagccaggtccgagggcttcgaagatctgggggacccgagctgcgcacagtggcgggaaacgagcgggctcagctggccgggccgcgtcccctagccaccgcccgcccgcccgctgctttggcctccggagaagcctggagaggggcctgcgcctcttgaaaaatggcttttgggggcggtaggtctcgggagggcgactggggaaagtgacttgccgcggcttcgagtagagacgttggtgcgggacccaactcctggggaaggcggggagcgctgggcggatgcctggccctagtgcggcgccaacacatacaagttccgctgtgaatgtttgaaagtgtaagtttctctcggattgatttttttttcctttaaatgtatccccttcaaaaaaaaaaaaaaacaaacaaacaaaaaaaaaaaaaacaaagacgtggacaggcaggcgccacccggtctgggagctgaggttcgtgactgctgccgatttcgtttggttcaagttgagaaaataagggtctccccgtcccaggctgggagcgtggggacttccgtctctggactgtgcaaaccgtctggggctgcctcccagactggcatgctctccccgccccctgaaacctagggaaggtttcctggaggcactggactccagatccctgcagggcgggacggagaaaaagccctgaataccactgcccacacccctccaagtcgggagcccccacgcgccagtcgagcctacgcagctgtggggtgggaaggagaagacaagtcctccgccaagaactcccc

SEQ ID NO: 74881 - DNA, 433 bp, Homo sapiens
  misc_feature 1..433: note = chr12:54324532-54324965
  misc_feature 1..433: note = hyper
  source 1..433: mol_type = genomic DNA
aggtagtgtcgcgggcgcttcctagtgcgggcactcatcctgccgctctccggtcggccatttattgtcttgtggggaagggctttcgccaagaaacttggtctgggttagtgaaataaaatactaaacaattactatatgtaaaattttaaaaccagcatattaaaataaactaaggaactctctgtcgtgggagaaatccacaggaaaaggaagagaaggagttagatgctggcgccgagttcctggcggagccaggcggcggtgactcctcaggctgagcggaatcgccatccaggcgccggaaacgacccgaatcccaaaatccgtggaagaaaattgcgctgaaagaacagagccaacgcccccgtcctgccaagtttggcgagacggcaagttggcttcaggagcacaatgccgctaaatgatgcct

SEQ ID NO: 74882 - DNA, 223 bp, Homo sapiens
  misc_feature 1..223: note = chr12:54329256-54329479
  misc_feature 1..223: note = hyper
  source 1..223: mol_type = genomic DNA
gcacgcaagcgcacgcgcacacgcacatacacagacgcttcccgtgaaaaagcatattaaatatctcctttctgtgttggatcatttaaaagaaaacatttcagagttgaacttagccgagagcttggttcatgagctgtagctgagggcagagtggcttctgccgctccgcggttgtagaagtccctttgaaaaagcagccgagagcagagccggggcttcc

SEQ ID NO: 74883 - DNA, 313 bp, Homo sapiens
  misc_feature 1..313: note = chr12:54329604-54329917
  misc_feature 1..313: note = hyper
  source 1..313: mol_type = genomic DNA
cgaaggccggcggggcgcgcccgggtgagcaccgcagccgagggtttcagcgccaggccctggaaaggctttctagggcgagatcgccttggagatgtaattactacgtttctagtggtgcatattctcctggagtgtttaatttgattttacttgtgtctcagcgagatccacatttttttttcgggggagggggaagaaaccaccccaggcttaaagttaattaaccagcaaggctttactttccaccgccctcctgcaggctcttgcctcggcgcctcccttcccgatcccggctcgccccagacttgga

SEQ ID NO: 74884 - DNA, 292 bp, Homo sapiens
  misc_feature 1..292: note = chr12:54330283-54330575
  misc_feature 1..292: note = hyper
  source 1..292: mol_type = genomic DNA
cacccagatccttcacgccgttctggttcccactcccgccattctggttcctactcccaaaggctggggacgtgtctttgagtcctggcccgcggaaaacgggtccggcgttgggcctgaccggggagggagccccaagaatggggtgggcgtttcaggccctttgtttctcctggcagccctgcagaaccctgtccacagcgccccactacttccacctgggagcagcacttcacagaaggggaggccaggatctgggttccacttctactacccgcggctggaaaaaggc

SEQ ID NO: 74885 - DNA, 345 bp, Homo sapiens
  misc_feature 1..345: note = chr12:54330790-54331135
  misc_feature 1..345: note = hyper
  source 1..345: mol_type = genomic DNA
ccctcaatgcacactcgagctggtctccttatgtcttaactctctttctgttgtatttttcctcctaatgccagcccagcccgcagcctgctttctgaactctgagctgacccttctggatgaagatcacgcagataagaattactatcctaactcaccgatgtccgggtgctctcaaccgtcaaacaccaccttctccccacaaagaggagggaggtggcccgaaggggtttctgcagacctgtccatttgctctccacttgaggggtgcagtaggtctggctgagcgaggcgctgctctgtggccatggtctgtgcgctggctgcacacgagcactcagcatt

SEQ ID NO: 74886 - DNA, 42 bp, Homo sapiens
  misc_feature 1..42: note = chr12:54331998-54332040
  misc_feature 1..42: note = hyper
  source 1..42: mol_type = genomic DNA
cgggttctttccagccgcgagcggaggcgagctgccagggcc

SEQ ID NO: 74887 - DNA, 1114 bp, Homo sapiens
  misc_feature 1..1114: note = chr12:54332740-54333854
  misc_feature 1..1114: note = hyper
  source 1..1114: mol_type = genomic DNA
cgtctatgaggacagcgcggcggagagcggcatcggcggcggcggcggaggaggaggcggcggcacgggcggagcggggggtggctgcagcggagcgagccccggcaaagccccgagcatggatggtctgggcagcagctgcccggccagccactgccgcgacctgcttccgcaccccgtgctgggccgcccgccggctcccctgggcgcccctcagggcgccgtctatacggacatcccggccccggaggcggcgcgccagtgtgccccgccgcccgcaccccccacctcgtccagcgccaccctgggctacggctaccccttcgggggcagctactacggctgccgcctgtcgcacaacgtgaacctgcagcagaagccttgcgcctaccacccgggcgataaatacccggagccgtcgggcgccctgcccggtgacgacctgtcctctagggccaaggagttcgccttctaccccagcttcgccagctcctaccaggcgatgcccggctacctggacgtgtcggtggtgcccgggatcagcgggcacccggagccgcgtcacgacgccctcatccccgtcgaaggctaccagcactgggctctctccaatggctgggacagtcaggtgtactgctccaaggagcagtcgcagtccgcccacctctggaagtctcccttcccaggtaaggaagggacccgagcgccgccgccgccggggacccctccccgccctgcctgccccggggctccgcgccccaaccacccccgccgtctggccccggcgcgcccgctcggctgggctgcctatggagccggccgggcgagctgcactgaggaatgcgccggggaagaaatctgctccgacacgttctctgtagctgcccggccgagaatgaagcaatcacaggcgcccgaaagccgggccgccggctctgctctgtccggtagctcgcctccgcctccccttgcaggctccagcctcccgccgggctcttggcccctaaacctgcttccggcaagggatgggggcggggtgggcctatagtgccttggaatccaggacaaaacccccaacccaccgaataactggggagggcggagaataagaacc

SEQ ID NO: 74888 - DNA, 152 bp, Homo sapiens; identical to SEQ ID NO: 34406
  misc_feature 1..152: note = chr12:54338666-54338818
  misc_feature 1..152: note = hyper
  source 1..152: mol_type = genomic DNA

SEQ ID NO: 74889 - DNA, 611 bp, Homo sapiens
  misc_feature 1..611: note = chr12:54338978-54339589
  misc_feature 1..611: note = hyper
  source 1..611: mol_type = genomic DNA
ggcgggtcaaagagaagaaggtggtcagcaaatcgaaagcgcctcatctccactccacctgaccacccacccgctgcttgccccatctatttatgtctccgctttgtaccataaccgaacccacggaaagacgctgcgcgggtgcagaagagtatttaatgttaaggaaagagaagaaccgcgccgcccggaggcagagaggctccatggccgtgctgctgggccatccccaactccctatcccatccccagcctccacccccatccagatgggactcacgtggcttcaacagctttggaaatgggtcccgagtgggccgtgcgaggaaggctgtcgacctctactcctccttgcgctcaccttgccagaaagtctggtggcagcgcagagcccaatcattccaaccaaagcagggttggggaatcccgaatggccccaattcttgcctcatcctatgaccaggcttttagaggaccttccctaagggcgcagcttcggagcaggatctgtccagctcatactttccttcgctgtccctcccgcactccttaggcaagatttcccagtaaagattttctgtgcgtattttaaaagtcgtgttaatactcat

SEQ ID NO: 74890 - DNA, 261 bp, Homo sapiens; identical to SEQ ID NO: 34408
  misc_feature 1..261: note = chr12:54343569-54343830
  misc_feature 1..261: note = hyper
  source 1..261: mol_type = genomic DNA

SEQ ID NO: 74891 - DNA, 196 bp, Homo sapiens
  misc_feature 1..196: note = chr12:54345040-54345236
  misc_feature 1..196: note = hyper
  source 1..196: mol_type = genomic DNA
ggcctaatttgcatacgaggcagaaccgctttctgcaaactagacagtgaccttgaactgggccgctgcggcctctggacagaccaggggtaaggcagcactgcgcggaatcactcccgaccacgggtcggcgggggagccaaaacgcagtcactcacagccgattccccgcggtctaagccgccagcagccacgt

SEQ ID NO: 74892 - DNA, 92 bp, Homo sapiens
  misc_feature 1..92: note = chr12:54345567-54345659
  misc_feature 1..92: note = hyper
  source 1..92: mol_type = genomic DNA
agagttcgcaccaatcgctccacggtttgggtgcctcggcctgaccacctatagttttgcgcatggtcagcgaagtgccggcgggttaagcc

SEQ ID NO: 74893 - DNA, 67 bp, Homo sapiens; identical to SEQ ID NO: 34411
  misc_feature 1..67: note = chr12:54345965-54346032
  misc_feature 1..67: note = hyper
  source 1..67: mol_type = genomic DNA

SEQ ID NO: 74894 - DNA, 342 bp, Homo sapiens
  misc_feature 1..342: note = chr12:54348738-54349080
  misc_feature 1..342: note = hyper
  source 1..342: mol_type = genomic DNA
ccgggtttgtggggccgctggtaaacatccacacgggagacaccttctacttccccaacttccgcgcgtccggggcgcagcttcccgggctgccttcgctgtcctacccacgccgcgacaacgtgtgctccctgtcctggccgtcggcggagccgtgcaatggctacccgcagccctacctcggcagcccagtgtctctcaaccctcccttcggccgcacgtgcgagctggcgcgcgtggaggacggcaagggttactaccgcgagccgtgcgccgagggtggcggcgggggcctgaagcgtgaggagcgcgggcgcgacccgggagccgggcccggggcag

SEQ ID NO: 74895 - DNA, 136 bp, Homo sapiens
  misc_feature 1..136: note = chr12:54349255-54349391
  misc_feature 1..136: note = hyper
  source 1..136: mol_type = genomic DNA
cgccggcgcaggcgaccccggcagcttggtatcgccgttgaaccccggcggcgggctctcggccagcggtaaggaccccggccactcaagcggcggattcaaacccgacctcttaccagggcgggcagaacaggac

SEQ ID NO: 74896 - DNA, 218 bp, Homo sapiens
  misc_feature 1..218: note = chr12:54354476-54354694
  misc_feature 1..218: note = hyper
  source 1..218: mol_type = genomic DNA
tctgctccactctgacgtgcacagacgaaattgagtatttaaagccactaagccgctatcgagccggcaggtgatgggtccggccgtctgggttctgtgggtgctaatgtagccggaaatccggcgcgatcgatggctgagacccagagcagagcagggaccgctggccccggtccgcgaacaaagcaaactccggggacttggggttccggccaggc

SEQ ID NO: 74897 - DNA, 273 bp, Homo sapiens; identical to SEQ ID NO: 34415
  misc_feature 1..273: note = chr12:54354814-54355087
  misc_feature 1..273: note = hyper
  source 1..273: mol_type = genomic DNA

SEQ ID NO: 74898 - DNA, 64 bp, Homo sapiens
  misc_feature 1..64: note = chr12:54359619-54359683
  misc_feature 1..64: note = hyper
  source 1..64: mol_type = genomic DNA
aaagataaaaagaggcgggagggaggcagaagcaagggtcggctgttgctctccctcgcccggg

SEQ ID NO: 74899 - DNA, 342 bp, Homo sapiens; identical to SEQ ID NO: 34417
  misc_feature 1..342: note = chr12:54359742-54360084
  misc_feature 1..342: note = hyper
  source 1..342: mol_type = genomic DNA

SEQ ID NO: 74900 - DNA, 80 bp, Homo sapiens
  misc_feature 1..80: note = chr12:54360569-54360649
  misc_feature 1..80: note = hyper
  source 1..80: mol_type = genomic DNA
gggagacagggagaccgggagcgtaaggcagcgccgcagccggcccggcgagaccgaaagagccccgtatccgccgcgac

SEQ ID NO: 74901 - DNA, 120 bp, Homo sapiens
  misc_feature 1..120: note = chr12:54363641-54363761
  misc_feature 1..120: note = hyper
  source 1..120: mol_type = genomic DNA
ctcctttccctaccacgatctgctctctagaacccagagcagtggaggaggtagacaagctaacaggaggccccaacgctgtgtgcgggagtttgctctgggagccgcccagggtagaat

SEQ ID NO: 74902 - DNA, 526 bp, Homo sapiens
  misc_feature 1..526: note = chr12:54366849-54367375
  misc_feature 1..526: note = hyper
  source 1..526: mol_type = genomic DNA
cccctcctacgtctgcgaagtgctccgaactgatatatgacaatatctactttggatcacgtgctcagagagagagagactaagacggataacgcgtcatctcgccttcccaaattttcccccctcgctagaccgggtccaaaacctccatccggagccggcaggagaggagaacgatgtttaactcggtcaacctgggcaacttctgctctccgtcgcgcaaggagaggggcgcagatttcggcgagcgagggagctgcgcctccaacctctatctgcccagttgcacttactacatgcccgagttctccacggtctcctccttcctgccccaggccccctctcgtcagatctcctatccctactcggcccaagtgcccccggtccgggaggtctcctacggcctggagccatccggcaagtggcaccatcggaacagctactcctcctgctatgcggcggccgacgagcttatgcaccgggagtgcctgcctccttccaccgtcaccgagatcctcatgaaaaa

SEQ ID NO: 74903 - DNA, 201 bp, Homo sapiens
  misc_feature 1..201: note = chr12:54367429-54367630
  misc_feature 1..201: note = hyper
  source 1..201: mol_type = genomic DNA
cggcttctactcctcagtcaacaagaacagcgtcctgcctcaagccttcgaccgtttcttcgacaacgcctactgcggtggcggcgacccgcccgccgagcccccctgctccggcaagggcgaggccaagggggagcccgaggcacccccggcctcgggactggcgtcccgggctgaggcgggtgccgaggcggaggctga

SEQ ID NO: 74904 - DNA, 135 bp, Homo sapiens
  misc_feature 1..135: note = chr12:54368297-54368432
  misc_feature 1..135: note = hyper
  source 1..135: mol_type = genomic DNA
caactctggggtcagcggcgacaggggaatggggcgaggcggcgcaggactccactgcgttccaggcgggggtctgggcgtttctcccgggtccgcggccttagtgcttgcctagaactgcggtgtggaaggcgc

SEQ ID NO: 74905 - DNA, 355 bp, Homo sapiens; identical to SEQ ID NO: 34422
  misc_feature 1..355: note = chr12:54368647-54369002
  misc_feature 1..355: note = hyper
  source 1..355: mol_type = genomic DNA

SEQ ID NO: 74906 - DNA, 44 bp, Homo sapiens
  misc_feature 1..44: note = chr12:54369259-54369303
  misc_feature 1..44: note = hyper
  source 1..44: mol_type = genomic DNA
ttttattttctaactcgtcttctttccgccggtggaaaactgga

SEQ ID NO: 74907 - DNA, 154 bp, Homo sapiens
  misc_feature 1..154: note = chr12:54377085-54377239
  misc_feature 1..154: note = hyper
  source 1..154: mol_type = genomic DNA
cctcgtaaaagggaacggtttcgatcaaactggtggggaaagactaatgcagataatacaaacagagtggccataaagtctcgcccgtttcccgcgggatgggcggtgggacaaatggctccctggattgactgctgcccggactgtcccaagt

SEQ ID NO: 74908 - DNA, 94 bp, Homo sapiens
  misc_feature 1..94: note = chr12:54377853-54377947
  misc_feature 1..94: note = hyper
  source 1..94: mol_type = genomic DNA
tgtgtgctggtttcccgtgtgatacgtgactcctccaaactgaccgaggctccgcaggttccctctttctttcccggaatattccctgttttag

SEQ ID NO: 74909 - DNA, 350 bp, Homo sapiens
  misc_feature 1..350: note = chr12:54377977-54378327
  misc_feature 1..350: note = hyper
  source 1..350: mol_type = genomic DNA
cgccagggcctgaagtaaagcagcagaaccggctccaaggccaaagccttgtgggcccctgagatggtgacccaggagccgcccaccctgccaggcccaggccacagctctcgggtcggggatcgggtgcctctggtctctggcttcctctttcccctaccccgcgtccattcggaacctccttttccgagcagccatgaagtgaccgtgaccccctccctggcccaccctagaggctggagattcccagtcaacccccacaggaaacttgcaactccagcgccgcggcccccaagcttccagccccgagggccaagcccggggaaaagaggaggcgggagagcagaaac

SEQ ID NO: 74910 - DNA, 1211 bp, Homo sapiens
  misc_feature 1..1211: note = chr12:54378720-54379931
  misc_feature 1..1211: note = hyper
  source 1..1211: mol_type = genomic DNA
cgcggggaagggctccggtgcccctaccccgaggcagctgctagatggcgctgttactccactctgcgcgctccgcctgccgacaacttgaccccgctgacgtcacggccgtctgaatcatcaaggccattttcaaatcccattggtctagccgtcacatggtgagaaccgaatgcgcggataattacggagctgatatttccccccctccccttctttttcctccctcccctccaaccgcgccccccctcccggatggggaaaaaaaaagatgtcagctcctccgctgtagtattgctccttaaaaacccctctctctgaaaatgacatgccctcgcaatgtaactccgaactcgtacgcggagcccttggctgcgcccggcggaggagagcgctatagccggagcgcaggcatgtatatgcagtctgggagtgacttcaattgcggggtgatgaggggctgcgggctcgcgccctcgctctccaagagggacgagggcagcagccccagcctcgccctcaacacctatccgtcctacctctcgcagctggactcctggggcgaccccaaagccgcctatcgcctggaacaacctgttggcaggccgctgtcctcctgctcctacccacctagtgtcaaggaggagaatgtctgctgcatgtacagcgcagagaagcgggcgaaaagtggccccgaggcagctctctactcccaccccttgccggagtcctgccttggggagcacgaggtacccgtgcccagctactaccgcgccagcccgagctactccgcgctggacaagacgccccactgttctggggccaacgacttcgaagcccctttcgagcagcgggccagtctcaacccgcgcgccgaacatctggaatcgcctcagctggggggcaaagtgagtttccctgagacccccaagtccgacagccagacccccagccccaatgaaatcaagacggagcagagcctggcgggccctaaagggagcccctcggagagcgaaaaggagagggccaaagctgccgactccagcccagacacctcggataacgaagcgaaaggtaaggccgcctgggccgcgggcgccactgggacgttccggcacttggtcttcgcggccggggaggggggcaggggagagggttgggcccaggaggccccagaccatttcgggaatgcgaccctggctttcgactag

SEQ ID NO: 74911 - DNA, 434 bp, Homo sapiens; identical to SEQ ID NO: 34426
  misc_feature 1..434: note = chr12:54379958-54380392
  misc_feature 1..434: note = hyper
  source 1..434: mol_type = genomic DNA

SEQ ID NO: 74912 - DNA, 89 bp, Homo sapiens
  misc_feature 1..89: note = chr12:54384576-54384665
  misc_feature 1..89: note = hyper
  source 1..89: mol_type = genomic DNA
aggaggaggaggcagcgacaaggtaagagaagcggtttcttgttcttctcttggcggcggagtggggatgagcggtgtccccaggtgtc

SEQ ID NO: 74913 - skipped

SEQ ID NO: 74914 - DNA, 536 bp, Homo sapiens
  misc_feature 1..536: note = chr12:54387818-54388354
  misc_feature 1..536: note = hyper
  source 1..536: mol_type = genomic DNA
aagagctcgccaaggcgagccttggtctctgagatctctcgtcggctgctggggctccggctcagcctggcagatccgctgtggcctctctgggacctcgccccggcccacggcctgacttcggctcggagatgcagcccttcccgagaacaggtgaagaagacggcggcagcggggactgggggcttcgggtgggaacgccagggctcagggctttgtgtgggtcgtgcagggggcgaggttcgaagtcctgggctggaccgcagcacgagtgtggcccggacggctgcgtggccagaaggggtgttcgggcagggtgcgagagcaccggcaaggtggattgtgtatggactttggccgcagacagagcagagcgggctcccgggctgtggccggcggcgaggcgggcaaccgcatgttgagtctatagaaaggaccttgaggtctgctgggtgtttgggctgccctgggggcggcggcccagagtgtggagcaagcggcgcgcggggcgcggcggtcagcgtgggagaggctgc

SEQ ID NO: 74915 - DNA, 251 bp, Homo sapiens
  misc_feature 1..251: note = chr12:54388604-54388855
  misc_feature 1..251: note = hyper
  source 1..251: mol_type = genomic DNA
gggagggaaggagggcgggcggcggcggccgtggtggccggggcttccctccccaggcgggagccgcctgtcctgtatctatggccgtggggagcgaaggaccaggtaacgaaggcgcttccgaagcgggattggaccaaaccagagggacagagtcttctgggtctctctgcctgaggccctggagggagagaaggtagggagatcggcgcccgccgggcctggcaaagaggcctcgggaaatgttgaac

SEQ ID NO: 74916 - DNA, 210 bp, Homo sapiens
  misc_feature 1..210: note = chr12:54389111-54389321
  misc_feature 1..210: note = hyper
  source 1..210: mol_type = genomic DNA
cacgggctgagtttccggctccaggttcgcgtgtcgccctgaggtttgaggccagacagctcgcagtcgggcagggagggcgggggagagacgagcggctctggccccttaattgtacttcgggctcgtattgtctctcctttcgccacctccgcttcctcagtctgggctccaaagtcactgcaaatttccttgcgacacatacatcac

SEQ ID NO: 74917 - DNA, 57 bp, Homo sapiens
  misc_feature 1..57: note = chr12:54391267-54391324
  misc_feature 1..57: note = hyper
  source 1..57: mol_type = genomic DNA
gacagaagtggccgccgcgcccggagccggtcccgcggcaaaggcccggcaagccag

SEQ ID NO: 74918 - DNA, 365 bp, Homo sapiens
  misc_feature 1..365: note = chr12:54391399-54391764
  misc_feature 1..365: note = hyper
  source 1..365: mol_type = genomic DNA
cgcctccctctctgcacgcctgcctttcccggctctcctatctcttttcatcttgccttccttcttttaattctcccccttttttccctttattctaatgctccgcttccttctttcctctcttgggcctgactccatgtttcagttggtctgtcccaggctgtctcgggttcagtctctctcaggctctgtcccctgatgtcctcttggtctcagtctggccccgggccccgctgagggctaaacgtctctgctcatcgctgccagcagccgcccaagtgccgggcccggtcctcagccgccctgggctgggggaggtgctggctgtactggggatttggagaaagcctcggcagggggactgg

SEQ ID NO: 74919 - DNA, 30 bp, Homo sapiens
  misc_feature 1..30: note = chr12:54392718-54392748
  misc_feature 1..30: note = hyper
  source 1..30: mol_type = genomic DNA
tttctcctgttcctccgttgcttttttccc

SEQ ID NO: 74920 - DNA, 101 bp, Homo sapiens
  misc_feature 1..101: note = chr12:54393359-54393460
  misc_feature 1..101: note = hyper
  source 1..101: mol_type = genomic DNA
cacactatttaaaaacgcatttttaaaagccacgttccgaactgacaatcgctgatctcggctcgcgcagagactgcgggagcgtcggggccgacagagac

SEQ ID NO: 74921 - DNA, 263 bp, Homo sapiens; identical to SEQ ID NO: 34433
  misc_feature 1..263: note = chr12:54393461-54393724
  misc_feature 1..263: note = hyper
  source 1..263: mol_type = genomic DNA

SEQ ID NO: 74922 - DNA, 621 bp, Homo sapiens; identical to SEQ ID NO: 11268
  misc_feature 1..621: note = chr12:54393798-54394419
  misc_feature 1..621: note = hyper
  source 1..621: mol_type = genomic DNA

SEQ ID NO: 74923 - DNA, 268 bp, Homo sapiens
  misc_feature 1..268: note = chr12:54394466-54394734
  misc_feature 1..268: note = hyper
  source 1..268: mol_type = genomic DNA
cgccggcagcaagcacaaagaggagaaggccgacctggaccccagtaagttgggagcaattttcctttacaaccggcgcgggaggggaggggaggacgggcgggggcagccgaattacagccctcccgaaccgtgcagggagcgcgggagaggggcgagggggcgaggactcaataaaagcgaattaccttggggagctttcaggggcaggaggtctgagaatggggcccagggagacaggttgggagagggccgaggggagctcctc

SEQ ID NO: 74924 - DNA, 77 bp, Homo sapiens; identical to SEQ ID NO: 34436
  misc_feature 1..77: note = chr12:54398709-54398786
  misc_feature 1..77: note = hyper
  source 1..77: mol_type = genomic DNA

SEQ ID NO: 74925 - DNA, 779 bp, Homo sapiens
  misc_feature 1..779: note = chr12:54398888-54399667
  misc_feature 1..779: note = hyper
  source 1..779: mol_type = genomic DNA
cgcgggcttggaggaccctgaggaaagcatgggatgcagaacaggcccacccggcccggcccactgttcaatcccagcccagcctgcaggtcaggattggaatcattttttattcgctatcatttacgaattaacaacacaacacgcatctggggaaagaaatgaaagctgggggtagagaggggctagcaaacgccctcttcccctaatcttcccctcccacctctcctctgctcctttgtcagaatcacaaaaccctaaagattgttccacttgagaaggcagcggataggtacatttccgcagccccgaaatgccacttttatggcgctgtttgtctccctgttctgggttctcaatggggccgaacaaaacagcagcgcggagctggctagacgtctgggcttaattgttttatggtttaaataaggtggacactttcctttgaaatcggattataggaatgttttgtctatggcccacggagaacaggacctcactggctgagagggagaggtggagagcgcgcgcgcgagagggatgggctacaaaccaggggtcaaacagcctggagaagtccgagtcccaccccaaagtcctgcaggcggcggcggaatagtcggtgcggggccagcatcagggtaagaggagggaggactttagggtgcgcgccgcgggcaagccgtcgtgggagcctcggagcgtgcatccgcgttcgcggagatgttccaagcccagaaatgcgcctgaatggggggagatcgcggcagttgctttgc

SEQ ID NO: 74926 - DNA, 160 bp, Homo sapiens
  misc_feature 1..160: note = chr12:54402652-54402812
  misc_feature 1..160: note = hyper
  source 1..160: mol_type = genomic DNA
tctctctctctctctcgcctgtcttcatgtcgtggattgatgaacgcgaatcgcgtgtaagcgccgccaccgccgggagtctgaggaattcgcctgggctgttagaggaaagagctaagtgagagagcgcgagctctacctaccgacagtgaggagcgcc

SEQ ID NO: 74927 - DNA, 820 bp, Homo sapiens
  misc_feature 1..820: note = chr12:54402872-54403692
  misc_feature 1..820: note = hyper
  source 1..820: mol_type = genomic DNA
ggagctctgctgatccggccgagctcagcaccgaggcgccccccaacctgcccagcccccagcccaccagcccagcccagtcccggggagccagctggcctggggttcggtcccggggggaggggagtttcgggggtactgggcggggtactcgtgagccagaggggagggggccgcgggttttcatgtacccagcatgagctcctacttcgtcaaccccctgttctccaaatacaaagccggcgagtccctggaaccggcctattacgactgccggttccctcagagcgtgggcaggagccatgcgctggtgtacgggcccggcggctcggcgcccggcttccagcacgcttcgcaccacgttcaagacttcttccaccacggcacctccggcatctccaactcaggctaccagcagaacccgtgctcgcttagctgccacggagacgcctccaaattctatggctacgaggcgctccccagacagtccctttatggggctcagcaagaggcgagcgtggtgcaatatcccgactgtaaatcctccgccaacactaacagtagcgaaggacaaggccacttaaatcaaaactcgtctcccagcctcatgtttccatggatgagaccccacggtgagaagccttttctctttcccccttggtctcccgcgctccagggtttccccccctccctcgcctcctttttgtctgccctcgctttttctcctggctttggggtctctcccgccccacccccgtgcctgtgcctgggtggttttctcgaagttgggaaggctccgctggggcggggcagggagggg

SEQ ID NO: 74928 - DNA, 30 bp, Homo sapiens
  misc_feature 1..30: note = chr12:54404826-54404856
  misc_feature 1..30: note = hyper
  source 1..30: mol_type = genomic DNA
aagcccccatccaaacgtaaccagactggg

SEQ ID NO: 74929 - DNA, 476 bp, Homo sapiens
  misc_feature 1..476: note = chr12:54408316-54408792
  misc_feature 1..476: note = hyper
  source 1..476: mol_type = genomic DNA
ggcccagtagcctagcggaatgaacccagcattaaatggctccgaagggcctcgccgccttttccccacaccaaatgtgccatttatcccttgtcctgttcagcaatgtccgtggccccaagcccggcgcgtcggagggcggggtgcgtctggcgcccggctttactcgagatgccaggcatggagagggctaagccgagggagccccagccaccccctcatgcagtacccgctcccccacccctcctgcccaccgcctctgttttctcgtttggaaagaaatggaggtaaaaacccgttttatgggggaacgtaattgtgagcgggatgcgctctctttagaatcgcgtcctcccaaatgctcccgccgtcccattaccggaatggggaccattcggctgctgcagataggactttctctcccattctttacttttttattagccaatcaaagtggcttccgaaagccatttgtg

SEQ ID NO: 74930 - DNA, 78 bp, Homo sapiens
  misc_feature 1..78: note = chr12:54410286-54410364
  misc_feature 1..78: note = hyper
  source 1..78: mol_type = genomic DNA
acaatatttaaaactcggcaagccaggagaggcaaccgaccctcagtgcttgaagctttctttcgcctgggcgtccgc

SEQ ID NO: 74931 - DNA, 30 bp, Homo sapiens
  misc_feature 1..30: note = chr12:54422111-54422141
  misc_feature 1..30: note = hyper
  source 1..30: mol_type = genomic DNA
caacagaagcagaagcgatttttttccccc

SEQ ID NO: 74932 - DNA, 94 bp, Homo sapiens
  misc_feature 1..94: note = chr12:54422431-54422525
  misc_feature 1..94: note = hyper
  source 1..94: mol_type = genomic DNA
gccgttgcccagaaccggatctactcgactcccttttattcgccacaggagaatgtcgtgttcagttccagccgggggccgtatgactatggat

SEQ ID NO: 74933 - DNA, 110 bp, Homo sapiens; identical to SEQ ID NO: 11275
  misc_feature 1..110: note = chr12:54425031-54425141
  misc_feature 1..110: note = hyper
  source 1..110: mol_type = genomic DNA

SEQ ID NO: 74934 - DNA, 14 bp, Homo sapiens
  misc_feature 1..14: note = chr12:54427293-54427307
  misc_feature 1..14: note = hyper
  source 1..14: mol_type = genomic DNA
ggactgagccagcc

SEQ ID NO: 74935 - DNA, 94 bp, Homo sapiens
  misc_feature 1..94: note = chr12:54428267-54428361
  misc_feature 1..94: note = hyper
  source 1..94: mol_type = genomic DNA
gctctttagaggcagcgggggaggcccgcagagcgcgcccctagccggttcctgtccctgcgcctttccttttcgcctttcctctctatatttc

SEQ ID NO: 74936 - DNA, 310 bp, Homo sapiens
  misc_feature 1..310: note = chr12:54440843-54441153
  misc_feature 1..310: note = hyper
  source 1..310: mol_type = genomic DNA
tcttctggtgcttctcgcccgccagcgcagggcccaggtgtttgaggcgaaggggctctagctccccgcaagcctggagccaggcgtcgcgcttcctccgggcttaatccagacctttcaacacacacctcattcgggggaggagaaaagcacaggaccgcggagagcccagctttgaggccaggcctgaagggataacccacacagggaacgttttcctatcagagaataatggagcacaaaataattcagaaagcgaatgggcaggaccacagcctgagagtcccgcgccgcggggccgctgcagagc

SEQ ID NO: 74937 - DNA, 30 bp, Homo sapiens; identical to SEQ ID NO: 34445
  misc_feature 1..30: note = chr12:54446784-54446814
  misc_feature 1..30: note = hyper
  source 1..30: mol_type = genomic DNA

SEQ ID NO: 74938 - DNA, 15 bp, Homo sapiens
  misc_feature 1..15: note = chr12:54447818-54447833
  misc_feature 1..15: note = hyper
  source 1..15: mol_type = genomic DNA
gccggaccagggaat

SEQ ID NO: 74939 - DNA, 143 bp, Homo sapiens
  misc_feature 1..143: note = chr12:54447898-54448041
  misc_feature 1..143: note = hyper
  source 1..143: mol_type = genomic DNA
cgccagtatagctgcaccagtctccaggggcccggcaattcgcgaggccacgggccggcccaggcgggccaccaccaccccgagaaatcacagtcgctctgcgagccggcgcctctctcaggcgcctccgcctccccgtcccc

SEQ ID NO: 74940 - DNA, 30 bp, Homo sapiens
  misc_feature 1..30: note = chr12:54475536-54475566
  misc_feature 1..30: note = hyper
  source 1..30: mol_type = genomic DNA
gagggactgcagacccgggtgcgggagacc

SEQ ID NO: 74941 - DNA, 21 bp, Homo sapiens
  misc_feature 1..21: note = chr12:54484237-54484258
  misc_feature 1..21: note = hyper
  source 1..21: mol_type = genomic DNA
ggagggagggactcccgggct

SEQ ID NO: 74942 - DNA, 155 bp, Homo sapiens
  misc_feature 1..155: note = chr12:54484310-54484465
  misc_feature 1..155: note = hyper
  source 1..155: mol_type = genomic DNA
cgattactgtcaggggaccatccatcagcgccgcccgggacgctgggccagactgcccgccgcccgcccgggtctctccagatcgcattagcgtggggcgagggcgcagtgcggcaccggctgctgagggagaggcgtggcggggaggggggcgg

SEQ ID NO: 74943 - DNA, 102 bp, Homo sapiens
  misc_feature 1..102: note = chr12:54500112-54500214
  misc_feature 1..102: note = hyper
  source 1..102: mol_type = genomic DNA
tccctggggagtcctcggagcgggcagccggacgtcgctccatccttcccgcctgacggatgcgtctgctgcgcaggcacaagctgtcgggccaggccctgc

SEQ ID NO: 74944 - DNA, 264 bp, Homo sapiens
  misc_feature 1..264: note = chr12:54519930-54520194
  misc_feature 1..264: note = hyper
  source 1..264: mol_type = genomic DNA
ttcaccctcccttttcgccatgtgggggccctgagcgccgccccagaagaggtcgagggaatgttgtgggctggggcacaccagcacggcagaaactggagaaagcgagagacgtcgccagggacccagggacctctccctccagttccccgggcccgcccggccctgatggccactcacgctatagcgcccactctgtcctgggccatcccgcgccagcagtgtagcccccagcccgggcgcctgaatgctctccctccggat

SEQ ID NO: 74945 - DNA, 790 bp, Homo sapiens; identical to SEQ ID NO: 34449
  misc_feature 1..790: note = chr12:54520221-54521011
  misc_feature 1..790: note = hyper
  source 1..790: mol_type = genomic DNA

SEQ ID NO: 74946 - DNA, 188 bp, Homo sapiens
  misc_feature 1..188: note = chr12:54567315-54567503
  misc_feature 1..188: note = hyper
  source 1..188: mol_type = genomic DNA
agctccacaaaacgccgcccgcgcggcccgccgccgagcccgctccaatctccagcctcatcgccgcgcgggctggttatgcatttaaatgttatttaattggattgcggaggagctgggggccagagcggccgcccgcccccgccccgcacgctccgcacgcccgggctgctcgcctcctctgcaaa

SEQ ID NO: 74947 - DNA, 30 bp, Homo sapiens
  misc_feature 1..30: note = chr12:54609854-54609884
  misc_feature 1..30: note = hyper
  source 1..30: mol_type = genomic DNA
tgcaacccgaggctacggttcatccaaaca

SEQ ID NO: 74948 - DNA, 94 bp, Homo sapiens
  misc_feature 1..94: note = chr12:54611458-54611552
  misc_feature 1..94: note = hyper
  source 1..94: mol_type = genomic DNA
gcagtgaaggaaggacgctcagaccaacaggggctcaggtattctgggtgtcaggacccttcctcctgcacgcatcttacgcagggtggggctg

SEQ ID NO: 74949 - DNA, 83 bp, Homo sapiens
  misc_feature 1..83: note = chr12:54720220-54720303
  misc_feature 1..83: note = hypo
  source 1..83: mol_type = genomic DNA
gccaggaattcttattgtatgatctaggatgctaatttctccctctctggttacatgagaattgtggtcgctaaagggctgta

SEQ ID NO: 74950 - DNA, 37 bp, Homo sapiens
  misc_feature 1..37: note = chr12:54767860-54767897
  misc_feature 1..37: note = hypo
  source 1..37: mol_type = genomic DNA
tcaatgcctttgactcgtcgggcgtggcgattacctt

SEQ ID NO: 74951 - DNA, 640 bp, Homo sapiens
  misc_feature 1..640: note = chr12:54811982-54812622
  misc_feature 1..640: note = hyper
  source 1..640: mol_type = genomic DNA
gcccaccccccttcacgcgcgcacacacccctcccgacacatcccagcacccgcccttggctgagttcgcccccagccccagggccccagtgccagggtccccgcactcgcccccagttctcggatcccctcgcctgaacagagattgggggcggagggaggagtaggagacagaggagaaaggagagggagccgccgtcctctctcgggtctttccccggtctgagttgaggggggaggggaggatgaggctggcccccatttaaccttccgaccccctcagtctttgactttcctcctactacacgtagctcattcggcttctacccgttctctcgccgcacaatggcccctacggatcccgaggtctcctggagcccccaaaagcccttcccggcctctgcgccccctctgcgcccccacccgccccaggtcccagcagcccacagacttcagccagagaccctcagctctccattcacgcgctctcctctcccttggcccggagacccctgcccagacttctccagctccgtgtcctctccccaccggacacatgtctccccactgatctcaaacgccagggcccctcctcacccgccacggtgccctccctactccagcgcgggcccccaactct

SEQ ID NO: 74952 - DNA, 50 bp, Homo sapiens
  misc_feature 1..50: note = chr12:54812829-54812879
  misc_feature 1..50: note = hyper
  source 1..50: mol_type = genomic DNA
tactgctggggcctccgcgtctaagttgaagcccccgaccctgggtggcg

SEQ ID NO: 74953 - DNA, 164 bp, Homo sapiens
  misc_feature 1..164: note = chr12:54914315-54914479
  misc_feature 1..164: note = hypo
  source 1..164: mol_type = genomic DNA
gagagtggtaaatatcggtaaatgttttttgaaagaatgaatatcctctccgcctcaaagggactagctcttaaactctatttttcttttcctttatttttcactcaccactttactaataaggactaaatcttgatttaaagtcttcccgtttctctgcagct

SEQ ID NO: 74954 - DNA, 94 bp, Homo sapiens
  misc_feature 1..94: note = chr12:54936727-54936821
  misc_feature 1..94: note = hypo
  source 1..94: mol_type = genomic DNA
tgaaaaaaggagtaacgtacaagtatattttctatcttctggtgacttgagcttgagctctgacaggcatgggcctctccgaccttcatcacta

SEQ ID NO: 74955 - DNA, 95 bp, Homo sapiens
  misc_feature 1..95: note = chr12:54942993-54943088
  misc_feature 1..95: note = hyper
  source 1..95: mol_type = genomic DNA
ctcagacatgggacacgcaggcagctaggcacacgtggatacatggaaccacaaccacatacacagaaactcaaaacacacggagagaacccaca

SEQ ID NO: 74956 - DNA, 72 bp, Homo sapiens
  misc_feature 1..72: note = chr12:54943351-54943423
  misc_feature 1..72: note = hyper
  source 1..72: mol_type = genomic DNA
ggaggaggagagaggcgaggaggcggctctggcagcgcgcggcggcggcggcggtagcggcagcagcagcgg

SEQ ID NO: 74957 - DNA, 125 bp, Homo sapiens
  misc_feature 1..125: note = chr12:54982532-54982657
  misc_feature 1..125: note = hyper
  source 1..125: mol_type = genomic DNA
ggctgcgggggtcaccgccccgcgggccgccgagtccgggcgtggcccgggagccgtcgtagtggacagctcaggcagatacctcagtgtcctcggagttttgggcagggcgttggggtggggag

SEQ ID NO: 74958 - DNA, 111 bp, Homo sapiens; identical to SEQ ID NO: 43470
  misc_feature 1..111: note = chr12:55356770-55356881
  misc_feature 1..111: note = hypo
  source 1..111: mol_type = genomic DNA

SEQ ID NO: 74959 - DNA, 30 bp, Homo sapiens
  misc_feature 1..30: note = chr12:55390771-55390801
  misc_feature 1..30: note = hypo
  source 1..30: mol_type = genomic DNA
aagattttctgacaacgggagggatgcgat

SEQ ID NO: 74960 - DNA, 761 bp, Homo sapiens
  misc_feature 1..761: note = chr12:5540932-5541693
  misc_feature 1..761: note = hyper
  source 1..761: mol_type = genomic DNA
acatgtaacctgttacgatacatttaacgtttcgttttttcctggatctctaaaagggaactcaagggtgggggttactgaagaatactacagatttggaagtttttgttgctgttgttgtttggtttggttttgtttttcaagaggggccaggagaaatgaccccttccccgccacgggtcccgaagtgagggcggggggggggctctggggcgcgggcgcgcgcggcgcggcgcgggccggcgggggagggcggcgcggcgcggaaggggttaaggcgctgagcgcggagccatctggccgggttggctggttataaccgcgcagattctgttcacgggactcagagttgaagctcctctcccttccgaacagctccgcgcaccgccccgcgacgcagcccggcgcaactactttcttctctctcctttctttcttcctctcctttttcccctgctgggtagtggctgcggcggggtgggggagactttgaatgaccgagctcgcgtccacctttctcttcatgtcgacgtccctggaaacggccacacggatgccatggttacttttgccacggtaaggggaggcggcgggcaccttgggtgggcaggtttggggatgggggtccacgtggggagggattttccagtggactggtgcggggggccccagatccgcatcccgccccacccccatcgcgccgcgctcactcactttcccgggcttgtgtcttccccaaagtttgcgctgggatctgctca

SEQ ID NO: 74961 - DNA, 30 bp, Homo sapiens
  misc_feature 1..30: note = chr12:55413842-55413872
  misc_feature 1..30: note = hyper
  source 1..30: mol_type = genomic DNA
ctaaactggctgcagcggagagatcagccc

SEQ ID NO: 74962 - DNA, 959 bp, Homo sapiens
  misc_feature 1..959: note = chr12:5542015-5542974
  misc_feature 1..959: note = hyper
  source 1..959: mol_type = genomic DNA
tggcagacagaactccgggcggggaggtgccgcggcagctcccctgcacacgccctgcactctgccggccgctgagcctgattctcagctcgccccagcaccactctggcccgggcgtgggctggggggaggggacgcgcagctcaggacccggaacctcgcgttccagttttgggagttgggactcactgccacgcgccgcgtacctgcgttggagttccccgaaagggttttttcagaaaagacctcgcgccccgggctcctcttggccagcgcccacccggtggccaccccaccctgggcctttgcgcagatgttggagctccgtacgcagcccgcacatctgggacccctccggggagcggcgggcacccgggcccggccatcccaggggatctccttgcggtatcgtccagcctgttctcggactttgagcggtggcgtgggaggccgggagacctgggcacccgcgcagccagccaggtcggagtttaaaggtcccacgacggaccgaactgtcccattgccccagagctttactcagtggtggatgctcctgatgaaatttgggacgcttgggagttgaaggttagggacaggaggggcgagggccgagggcatgggatgggggagtaggattctgcttgttgctctccgcgggagtgggtgcgcgtccaggaggcgctgcttctttgcgggagtttggctgctgcgttcattcgtcgtctgcgcttcagatgcacggcactgagacccttgcgtccgacggtgtcggggctgtggactagaaaggatcccttttgctggaatcgaggctggggtgggattgccggtgggggaaacaccgaaaagatcgtctggcctcggcctctggcggcgggcggcaggttctgagtccgaatggaggttgctcccgggagcgccgggctcagagctagagagctcgggagactgtgcgc

SEQ ID NO: 74963 - DNA, 44 bp, Homo sapiens
  misc_feature 1..44: note = chr12:5561220-5561264
  misc_feature 1..44: note = hypo
  source 1..44: mol_type = genomic DNA
cattattgcattgtacgtatctccccatgtctttttcttttctt

SEQ ID NO: 74964 - DNA, 30 bp, Homo sapiens
  misc_feature 1..30: note = chr12:55632656-55632686
  misc_feature 1..30: note = hypo
  source 1..30: mol_type = genomic DNA
gctctggaatgaagtcgtgaatgtccctca

SEQ ID NO: 74965 - DNA, 86 bp, Homo sapiens
  misc_feature 1..86: note = chr12:55786340-55786426
  misc_feature 1..86: note = hypo
  source 1..86: mol_type = genomic DNA
gccgtgctgagggaccgggcgcctgcctgctccatggagccagagtcccaggtctacagcccgggattaggcgggcacccgggaag

SEQ ID NO: 74966 - DNA, 51 bp, Homo sapiens
  misc_feature 1..51: note = chr12:56031566-56031617
  misc_feature 1..51: note = hypo
  source 1..51: mol_type = genomic DNA
gtgaggagggccctgcgacacttggtgaagaggcagcgcccctcaccctga

SEQ ID NO: 74967 - DNA, 30 bp, Homo sapiens; identical to SEQ ID NO: 43472
  misc_feature 1..30: note = chr12:56094359-56094389
  misc_feature 1..30: note = hypo
  source 1..30: mol_type = genomic DNA

SEQ ID NO: 74968 - DNA, 41 bp, Homo sapiens
  misc_feature 1..41: note = chr12:56441277-56441318
  misc_feature 1..41: note = hypo
  source 1..41: mol_type = genomic DNA
acctgccagataggccgggcgcggtggctcacgcctgtaat

SEQ ID NO: 74969 - DNA, 120 bp, Homo sapiens
  misc_feature 1..120: note = chr12:56881719-56881839
  misc_feature 1..120: note = hyper
  source 1..120: mol_type = genomic DNA
ctgatcctggtgctgcggctggtggctgtgtggcgtctctctgccctgcgccgcggcctcactgaggtggtgccggacgcccccgccaaggagggggctccggctcgggtgaccccagcc

SEQ ID NO: 74970 - DNA, 30 bp, Homo sapiens
  misc_feature 1..30: note = chr12:56882439-56882469
  misc_feature 1..30: note = hyper
  source 1..30: mol_type = genomic DNA
gaatgatggagttgtcgtgtagagaggagg

SEQ ID NO: 74971 - DNA, 243 bp, Homo sapiens
  misc_feature 1..243: note = chr12:569970-570213
  misc_feature 1..243: note = hyper
  source 1..243: mol_type = genomic DNA
cctcggagagcgacccggagagaggctccccgcccgtcccgccgagacgctggcggagaccgggcccctccagccgctccgggcttgcggttcccggggaggaggtccgtggggtccacgcgcgagctagggattcgggtgcgggatgccctcggccgtccacacccaggcgcgcgctccagtccgcgcagcccaaactttgcccaccgccttctgtttggctcactccgtttcctctcctgc

SEQ ID NO: 74972 - DNA, 39 bp, Homo sapiens
  misc_feature 1..39: note = chr12:57054141-57054180
  misc_feature 1..39: note = hypo
  source 1..39: mol_type = genomic DNA
attacaagcgtgagccaccgcacccggccaagcctggca

SEQ ID NO: 74973 - DNA, 30 bp, Homo sapiens
  misc_feature 1..30: note = chr12:57054388-57054418
  misc_feature 1..30: note = hypo
  source 1..30: mol_type = genomic DNA
aaagatatttggtggcgatatacgacgctt

SEQ ID NO: 74974 - DNA, 38 bp, Homo sapiens
  misc_feature 1..38: note = chr12:57120619-57120657
  misc_feature 1..38: note = hypo
  source 1..38: mol_type = genomic DNA
ctgggattacaggcgtgaactaccgcccctggcacttc

SEQ ID NO: 74975 - DNA, 131 bp, Homo sapiens
  misc_feature 1..131: note = chr12:5713307-5713438
  misc_feature 1..131: note = hypo
  source 1..131: mol_type = genomic DNA
aagtggatggtggatcgtacacagaagggaaggacaatgaggaatcagcgatgattctcatggtcttagggcatgtgtgtggttggtggtgccgatggctacgatagagaatacaacgtaagaggcagttt

SEQ ID NO: 74976 - DNA, 21 bp, Homo sapiens
  misc_feature 1..21: note = chr12:5720406-5720427
  misc_feature 1..21: note = hypo
  source 1..21: mol_type = genomic DNA
ttacagcggtgagccaccaca

SEQ ID NO: 74977 - DNA, 30 bp, Homo sapiens
  misc_feature 1..30: note = chr12:57423345-57423375
  misc_feature 1..30: note = hypo
  source 1..30: mol_type = genomic DNA
gtcaggaggagaatccgagaagaagtctag

SEQ ID NO: 74978 - DNA, 152 bp, Homo sapiens
  misc_feature 1..152: note = chr12:57483850-57484002
  misc_feature 1..152: note = hyper
  source 1..152: mol_type = genomic DNA
aaggaaaaggctgaccgaggaagtggggagtgtcactgctaggagaggggccactgaggagcactgggcagcctggaagggtggagaggttctgaggggagagaggaagcgtgcgttaagaatgcttaaccaggccgggcgggcccggtggc

SEQ ID NO: 74979 - DNA, 30 bp, Homo sapiens; identical to SEQ ID NO: 43474
  misc_feature 1..30: note = chr12:57493886-57493916
  misc_feature 1..30: note = hypo
  source 1..30: mol_type = genomic DNA

SEQ ID NO: 74980 - DNA, 285 bp, Homo sapiens
  misc_feature 1..285: note = chr12:57504479-57504764
  misc_feature 1..285: note = hyper
  source 1..285: mol_type = genomic DNA
tctggggcttgctcacgccccagccacacccttgaacaggaacctttagtggagggcaggataggggtttaacaaggatccactgccctctggcatcaaccttccagggaggggcggccacttcccccgactcagggcagaggggcactccttcacctcctttccctgactttccatggccctgggggtgcaggggtgaggctgtgaaaacgtgacccatgggggaggggagtactgaggcctggaccctcccagattcctccaggagttcgaaactgctaaaac

SEQ ID NO: 74981 - DNA, 33 bp, Homo sapiens
  misc_feature 1..33: note = chr12:57522742-57522775
  misc_feature 1..33: note = hyper
  source 1..33: mol_type = genomic DNA
acaccatgctgaccccgccgttgctcctgctgc

SEQ ID NO: 74982 - DNA, 56 bp, Homo sapiens; identical to SEQ ID NO: 43475
  misc_feature 1..56: note = chr12:57559766-57559822
  misc_feature 1..56: note = hypo
  source 1..56: mol_type = genomic DNA

SEQ ID NO: 74983 - DNA, 152 bp, Homo sapiens
  misc_feature 1..152: note = chr12:57570049-57570201
  misc_feature 1..152: note = hypo
  source 1..152: mol_type = genomic DNA
acgccccgtaattatcgtcagcagaactgccagcctgataattaacaaaatgatcagccttacctttgaatggcctggagctctgctccccagatctagaattgcaggcttgaaagaaaaaagccacttaggagtggcgtacctgaacgctg

SEQ ID NO: 74984 - DNA, 78 bp, Homo sapiens
  misc_feature 1..78: note = chr12:57576610-57576688
  misc_feature 1..78: note = hypo
  source 1..78: mol_type = genomic DNA
acaaagaaaaacaaaagaaaagaaaagaaaaagaaatgggataactgggaatgagactggcttcggagtgaccttagg

SEQ ID NO: 74985 - DNA, 146 bp, Homo sapiens
  misc_feature 1..146: note = chr12:57587641-57587787
  misc_feature 1..146: note = hypo
  source 1..146: mol_type = genomic DNA
aaaactctggcctgacgatacggggcgggcactgttctagagacagcctgtggtgtgggcgagttccgctgccgggacgggacctgcatcgggaactccagccgctgcaaccagtttgtggattgtgaggacgcctcagatgagat

SEQ ID NO: 74986 - DNA, 30 bp, Homo sapiens
  misc_feature 1..30: note = chr12:57604796-57604826
  misc_feature 1..30: note = hypo
  source 1..30: mol_type = genomic DNA
ggcccaagctgctggcgcttccccacaaag

SEQ ID NO: 74987 - DNA, 601 bp, Homo sapiens
  misc_feature 1..601: note = chr12:57613840-57614441
  misc_feature 1..601: note = hyper
  source 1..601: mol_type = genomic DNA
aagatgtgtgggatccgtgagggacagggcaacagagagggggcagggtcataggagagggtcccagggctcaggcgcaggaggagtcgcagggcgtggggtgggaagcagctgcccagtggggatggggagcagggagcgctgccttgagcgctggaaattggcgcggctccccctctcccccgcctgcccctcctccacctccaccccgcccactccccctccggctccggcttcgggaaattacatccccgctccgcggctccccccaacccccaccgcgccccggagccggcgcctttataggcacatttattgcaataataaagtgaggcgcggggcggggggcgggggggcagtcgttcccgcggggaccgcgctggctccaggaagcagggaaataaaataaaataaaataaaataaaataaaaattcagataacggtgagccttgcgcggcaggccaagagaagtcaggcaggcaggggtagagggagggggcgtccagcccaagggcagagcctaccccaccccaccagcggtccccgccccctcatgcagtggtagggtctggaaagaggtgtcttcgcttcaacctgcct

SEQ ID NO: 74988 - DNA, 137 bp, Homo sapiens
  misc_feature 1..137: note = chr12:57618574-57618711
  misc_feature 1..137: note = hyper
  source 1..137: mol_type = genomic DNA
gtggaaagggactggcgtcgatagggctctggcaggatggcgggggacaaccccagcgtctctctctcctctttcttcgtgcacaggccgtcagtgcccagataccagagtccggaaggccgcagtacctggggctg

SEQ ID NO: 74989 - DNA, 47 bp, Homo sapiens; identical to SEQ ID NO: 34458
  misc_feature 1..47: note = chr12:57619110-57619157
  misc_feature 1..47: note = hyper
  source 1..47: mol_type = genomic DNA

SEQ ID NO: 74990 - DNA, 30 bp, Homo sapiens
  misc_feature 1..30: note = chr12:57620559-57620589
  misc_feature 1..30: note = hyper
  source 1..30: mol_type = genomic DNA
acagtgtaggcagagcgctgacaacctgct

SEQ ID NO: 74991 - DNA, 88 bp, Homo sapiens
  misc_feature 1..88: note = chr12:57632036-57632124
  misc_feature 1..88: note = hyper
  source 1..88: mol_type = genomic DNA
tctcgctgatacttccgccgccccctactctgacaagcgcggctgtaattaggctgcggggtcccgggctctccgcctcactccggcg

SEQ ID NO: 74992 - DNA, 64 bp, Homo sapiens; identical to SEQ ID NO: 34460
  misc_feature 1..64: note = chr12:57632479-57632543
  misc_feature 1..64: note = hyper
  source 1..64: mol_type = genomic DNA

SEQ ID NO: 74993 - DNA, 103 bp, Homo sapiens
  misc_feature 1..103: note = chr12:57635003-57635106
  misc_feature 1..103: note = hyper
  source 1..103: mol_type = genomic DNA
gactggcccctagggcgggtagcgccgacgttgggctgcccctgagcagcagaccgggcggaccccactgacccaaatcgggcagtttcgtggagggagagcc

SEQ ID NO: 74994 - DNA, 30 bp, Homo sapiens
  misc_feature 1..30: note = chr12:57635463-57635493
  misc_feature 1..30: note = hyper
  source 1..30: mol_type = genomic DNA
cgctgtcacgcctgccgccctctctgggga

SEQ ID NO: 74995 - DNA, 191 bp, Homo sapiens
  misc_feature 1..191: note = chr12:5770987-5771178
  misc_feature 1..191: note = hypo
  source 1..191: mol_type = genomic DNA
taactacccctccctcgctgtttttgctccagggcctgtattcctgtggcttgttcctctgtgaacagattctctgagaggagctcacagggtggaaacaagcttggagacaattccctcatgcatggtgtcaacacaggatccgccatgtcagctgtcaggcagccccgccaactcgccaactggctccc

SEQ ID NO: 74996 - DNA, 30 bp, Homo sapiens
  misc_feature 1..30: note = chr12:57857277-57857307
  misc_feature 1..30: note = hypo
  source 1..30: mol_type = genomic DNA
gtgagccactgtgcccggctcagtgatgct

SEQ ID NO: 74997 - DNA, 30 bp, Homo sapiens
  misc_feature 1..30: note = chr12:57862418-57862448
  misc_feature 1..30: note = hypo
  source 1..30: mol_type = genomic DNA
cttctttttagagatcgagtcttgctatgt

SEQ ID NO: 74998 - DNA, 343 bp, Homo sapiens
  misc_feature 1..343: note = chr12:57869912-57870255
  misc_feature 1..343: note = hyper
  source 1..343: mol_type = genomic DNA
ggtccacgctactttcgggccggctacccgctggtccctgacaatgagggaggaaactgaggccacggtgttgtttccttcactgcttccctctccccggtgggctgtgaggaggtgggaggcttcctcacttctttactttcctctgcaccgccctccccgctgccgcccccacattggcgtgaggcggtaggcagcgcccgcacccatcctgcgcctctcgctcacactcacccagcctgaggagggcgctgtcggcggtggctctcggtagaacaccaggctgttacccgttaacaccacccaagacgggccccagttcttcctgcggggacagagaggg

SEQ ID NO: 74999 - DNA, 341 bp, Homo sapiens
  misc_feature 1..341: note = chr12:57881038-57881379
  misc_feature 1..341: note = hypo
  source 1..341: mol_type = genomic DNA
ataagccaccgcgcccggcctatgtacatttttgttgttgttgttgataggatggatatgtacactaacttccactttgtcactaattccgcacatggtaactccgaactctaaaactctgaccgttaagagcttgcatcgagagccactgcgagtagctgctgttatgacatggccatttcattctccacaacaagagaagcagccgcggcttcagtcaccgccctccagcagcgtaagaggataaaagtgcgacttgccctaaaacctaaacgtctcttctggatctccagaaaaaaagtgctgctctaggccgggcgcagtggctcacgcctgtaatc

SEQ ID NO: 75000 - DNA, 30 bp, Homo sapiens
  misc_feature 1..30: note = chr12:57939956-57939986
  misc_feature 1..30: note = hypo
  source 1..30: mol_type = genomic DNA
agctaacagagaaggcggggtgtgatgtca

SEQ ID NO: 75001 - DNA, 442 bp, Homo sapiens
  misc_feature 1..442: note = chr12:57943746-57944188
  misc_feature 1..442: note = hyper
  source 1..442: mol_type = genomic DNA
agggagccccgcccccgctcctccatcgcggccccgcccaggcccgcagcgcggcgctgcagcgcgaggggcggagaggcagagagcccgaaaggaccagacgcccaggtcgcccgcatcccgctgccgcaggagagagacagcgcgccccggccctgctccccaggcttcgcccgggcgccctcaactctgtccccagagactgagcacctgtcctccgcctcggcctctgctgagagccctctcctctggagcacacaccacccctgcagcccaagaagagtcccagccccacgccggctaccaccatggcggagaccaacaacgaatgtagcatcaaggtgctctgccgattccggcccctgaaccaggctgagattctgcggggagacaagttcatccccattttccaaggggacgacagcgtcgttattggggtgag

SEQ ID NO: 75002 - DNA, 62 bp, Homo sapiens
  misc_feature 1..62: note = chr12:57963777-57963839
  misc_feature 1..62: note = hypo
  source 1..62: mol_type = genomic DNA
gtgcctgagacagagcgcctggctggggaggaggcagccctgggagccgagctctgtgagga

SEQ ID NO: 75003 - DNA, 72 bp, Homo sapiens
  misc_feature 1..72: note = chr12:58004542-58004614
  misc_feature 1..72: note = hyper
  source 1..72: mol_type = genomic DNA
tattagcataaagttcgcatctaatttgcatgagacccatttaatcgcagagacctccactcttcttgcctt

SEQ ID NO: 75004 - DNA, 290 bp, Homo sapiens
  misc_feature 1..290: note = chr12:58004657-58004947
  misc_feature 1..290: note = hyper
  source 1..290: mol_type = genomic DNA
cgcaggcagagtgtccccgcgccccacccctggcccctcgccagcccgggctccaggacttcgccttaattggcgattagtcttagctggagtcccggggcctggaggaaagaagggtcctgagagagggcggcatctgggttgtgttcacccacaaaagactccccatacacgcaccccgtaccagggggcctctgtccactcggccggggacagccccaaacccagaacatcttcgcacaggccaaggccccatccactgagtcctccttcatcgcagaggccaaggg

SEQ ID NO: 75005 - DNA, 447 bp, Homo sapiens
  misc_feature 1..447: note = chr12:58014820-58015267
  misc_feature 1..447: note = hyper
  source 1..447: mol_type = genomic DNA
cgctcaacgggttggggtagccgcggccgtggccttcgggagcggggcgttgatggtgagggaggacccggggaggaacccggggggatccctgctgaggggccagggaaattgggccggggaagagggagggaccagctttcggcttgggttcgggagggcggaggtgcgcggggttggtttgctcctcctctagatggtgacagcgcgtcttctcccccacagctggggatgttcgtgctgcagctcggcgtcttgtccacctttttgtccgagcctgtggtcaaggcgctgaccagcggggccgcgctgcacgtgctcttgtcccagctgccgagcctcttggggttgtccctcccgcgccagatcggctgcttctctctcttcaaggtgggggtggaagaagaaaggagaaggggcttctagaggtcccgtgaatagggaaac

SEQ ID NO: 75006 - DNA, 69 bp, Homo sapiens
  misc_feature 1..69: note = chr12:58015479-58015548
  misc_feature 1..69: note = hyper
  source 1..69: mol_type = genomic DNA
cctccttgctgactgcgctgcctcggagcagtccggccgaactgaccatctccgcgctcagcctggcgc

SEQ ID NO: 75007 - DNA, 166 bp, Homo sapiens; identical to SEQ ID NO: 3900
  misc_feature 1..166: note = chr12:58021293-58021459
  misc_feature 1..166: note = hyper
  source 1..166: mol_type = genomic DNA

SEQ ID NO: 75008 - DNA, 280 bp, Homo sapiens
  misc_feature 1..280: note = chr12:58021713-58021993
  misc_feature 1..280: note = hyper
  source 1..280: mol_type = genomic DNA
ggtgccttcgggggtacccctgccccatcctcttccgcttcacccctgcaggacccagacagttcccaggccccacttcgtggttctctctttgtcctagggctggccgttcctggccgcagcgcccccgctgtggccttagcctgttcaaggcccttctccacccccacatcctgcagcccctgccctaccaggtccagcggcgtccgctccagcacgtccacaagcctctccagccgcgtccgcgccgtgaagacgaagtcgtcgtccacccacagca

SEQ ID NO: 75009 - DNA, 154 bp, Homo sapiens; identical to SEQ ID NO: 34469
  misc_feature 1..154: note = chr12:58025580-58025734
  misc_feature 1..154: note = hyper
  source 1..154: mol_type = genomic DNA

SEQ ID NO: 75010 - DNA, 140 bp, Homo sapiens; identical to SEQ ID NO: 34470
  misc_feature 1..140: note = chr12:58025869-58026009
  misc_feature 1..140: note = hyper
  source 1..140: mol_type = genomic DNA

SEQ ID NO: 75011 - DNA, 250 bp, Homo sapiens
  misc_feature 1..250: note = chr12:58026065-58026315
  misc_feature 1..250: note = hyper
  source 1..250: mol_type = genomic DNA
cgcggttttcccggtacccctcccctcacttcccaggccccagggtctcccggcctcctttcttctcgccctctcctgcatctcggtttcctcacacacccgaggcctggcatcttaatgctgaagacatttggatgccgcggtttcgacgcggccgtgcgtaagcggaaaagccccgctctatcagggcagtggcagtccccaagcccgccgcccgccctggccggcgcgcccccgactcctcagtctg

SEQ ID NO: 75012 - DNA, 160 bp, Homo sapiens
  misc_feature 1..160: note = chr12:58125465-58125625
  misc_feature 1..160: note = hypo
  source 1..160: mol_type = genomic DNA
gatacactgatgtgacgatagggaagatagatgaagaagggcccaacagaggagtctagggactagggaagatgggcaggtcatgggggacaggaggatgggggtcagcatgtccatgtccaataccgcaaaaaggctggtcctgcgcttggctgcccgg

SEQ ID NO: 75013 - DNA, 35 bp, Homo sapiens
  misc_feature 1..35: note = chr12:58144980-58145015
  misc_feature 1..35: note = hypo
  source 1..35: mol_type = genomic DNA
cccactcaccttgatcgtttcggctggcaagcctg

SEQ ID NO: 75014 - DNA, 87 bp, Homo sapiens
  misc_feature 1..87: note = chr12:58158951-58159038
  misc_feature 1..87: note = hyper
  source 1..87: mol_type = genomic DNA
tccaggcagcccaagcgcgagccgagcagaaccgcggcgatgccttgtcgggagggggcgccgtcagggttccgggaggctctggta

SEQ ID NO: 75015 - DNA, 57 bp, Homo sapiens
  misc_feature 1..57: note = chr12:58159289-58159346
  misc_feature 1..57: note = hyper
  source 1..57: mol_type = genomic DNA
gttgaggagagagtgcgcatcgggaaggtggggacggctcgacgggactggctgcag

SEQ ID NO: 75016 - DNA, 97 bp, Homo sapiens; identical to SEQ ID NO: 34472
  misc_feature 1..97: note = chr12:58159773-58159870
  misc_feature 1..97: note = hyper
  source 1..97: mol_type = genomic DNA

SEQ ID NO: 75017 - DNA, 124 bp, Homo sapiens
  misc_feature 1..124: note = chr12:58160215-58160339
  misc_feature 1..124: note = hyper
  source 1..124: mol_type = genomic DNA
cctctctgatcatctcggtcgaggagaaatctctaaaagttccatgtctggactgtccatctcaggacgagtcctcagtgaatgaaaaggaacccatgtagctttaagccgcaagcaggcggag

SEQ ID NO: 75018 - DNA, 24 bp, Homo sapiens
  misc_feature 1..24: note = chr12:58177383-58177407
  misc_feature 1..24: note = hypo
  source 1..24: mol_type = genomic DNA
tttttttttttcagacggagtctt

SEQ ID NO: 75019 - DNA, 120 bp, Homo sapiens
  misc_feature 1..120: note = chr12:58204698-58204818
  misc_feature 1..120: note = hypo
  source 1..120: mol_type = genomic DNA
ctcatttccacctgtcgatgagaggtaaacattgttcaggaggaattcttaggtgccaggtggagaagccccgggcctggggcagagagtgtgcaggactaacctcggtagccctgatgt

SEQ ID NO: 75020 - DNA, 90 bp, Homo sapiens; identical to SEQ ID NO: 43477
  misc_feature 1..90: note = chr12:58241509-58241599
  misc_feature 1..90: note = hypo
  source 1..90: mol_type = genomic DNA

SEQ ID NO: 75021 - DNA, 30 bp, Homo sapiens
  misc_feature 1..30: note = chr12:5840200-5840230
  misc_feature 1..30: note = hypo
  source 1..30: mol_type = genomic DNA
cagtgtacacaattccggttccttggcatt

SEQ ID NO: 75022 - DNA, 30 bp, Homo sapiens
  misc_feature 1..30: note = chr12:58517132-58517162
  misc_feature 1..30: note = hypo
  source 1..30: mol_type = genomic DNA
aggtgagccaaaattcggaccagcagcggg

SEQ ID NO: 75023 - DNA, 281 bp, Homo sapiens
  misc_feature 1..281: note = chr12:59313662-59313943
  misc_feature 1..281: note = hyper
  source 1..281: mol_type = genomic DNA
ccagaaggagctatacggcaaaaaggggactgcacgccgaaccccattccccgccggctcctgttttctcgaatctccagcggcccgggccccctccccccgcgggaagaatacttacagccgagcgacccaggacgggagtggctcgggaagacgcgctagccgcttacgactgcagtccagcaggtccccgaggcagcggcaggtagtggggcatgggcgctcggcggctaccccagagggctgcccgagttccccgcgaccgccgctgtctgaccggc

SEQ ID NO: 75024 - DNA, 72 bp, Homo sapiens
  misc_feature 1..72: note = chr12:59924125-59924197
  misc_feature 1..72: note = hypo
  source 1..72: mol_type = genomic DNA
tatccctccccaaatcgcagtgtgtgtccgcctccctgtgatattgctcataatgtccggtgggggagataa

SEQ ID NO: 75025 - DNA, 46 bp, Homo sapiens
  misc_feature 1..46: note = chr12:59989556-59989602
  misc_feature 1..46: note = hyper
  source 1..46: mol_type = genomic DNA
ggctacagagtacttcggatacagcaagttacgacccatctggaaa

SEQ ID NO: 75026 - DNA, 491 bp, Homo sapiens
  misc_feature 1..491: note = chr12:59990053-59990544
  misc_feature 1..491: note = hyper
  source 1..491: mol_type = genomic DNA
aggaggaggaggtgccggctaagaggagggcgagcctgcgtctgcgacccgagctgcccgcggagccgcacgcgtgtgtgcaaataatggccagcctgtgacaaacgtgccaacgcagagttggccagcgagcccttatatagacaaaaaaatcccgaagcggccgcgggagcagagctcgcgtcagccagtgcgcgccgacagctgcccgggaactgagggggcgcgcggggtcctgggcaaggagcgcctcgcgtgctttcggccaggaggtgctcacgctctcggcttttacaccgagactcagcgtggcgcggtgcaccccagtctccctggctcacgggactccgagggctgcttccagtgcggcgtgtctctagtgcgcgccccgccagcatccggcccccgagccccctagggtggcgtggcttcattgccgcagaaggtggaggcgggggtggagtgtgtggagagaacgtcttctctttgag

SEQ ID NO: 75027 - DNA, 21 bp, Homo sapiens
  misc_feature 1..21: note = chr12:60167632-60167653
  misc_feature 1..21: note = hypo
  source 1..21: mol_type = genomic DNA
cactcccggcctaaatcaatg

SEQ ID NO: 75028 - DNA, 68 bp, Homo sapiens
  misc_feature 1..68: note = chr12:6180311-6180379
  misc_feature 1..68: note = hypo
  source 1..68: mol_type = genomic DNA
ccagagctggggtcacgtggttgcagccaacctgtgcagagagggcaacttctcgctgccttgagttg

SEQ ID NO: 75029 - DNA, 30 bp, Homo sapiens
  misc_feature 1..30: note = chr12:62075123-62075153
  misc_feature 1..30: note = hypo
  source 1..30: mol_type = genomic DNA
agccttcttgtctgccggcatgtaagtcat

SEQ ID NO: 75030 - DNA, 42 bp, Homo sapiens
  misc_feature 1..42: note = chr12:62253491-62253533
  misc_feature 1..42: note = hypo
  source 1..42: mol_type = genomic DNA
ggattacaggcataagccaccacgccccgcccagaaaaagca

SEQ ID NO: 75031 - DNA, 17 bp, Homo sapiens
  misc_feature 1..17: note = chr12:62384406-62384423
  misc_feature 1..17: note = hypo
  source 1..17: mol_type = genomic DNA
cccggcccactgtgcca

SEQ ID NO: 75032 - DNA, 31 bp, Homo sapiens; identical to SEQ ID NO: 43479
  misc_feature 1..31: note = chr12:62539074-62539105
  misc_feature 1..31: note = hypo
  source 1..31: mol_type = genomic DNA

SEQ ID NO: 75033 - DNA, 31 bp, Homo sapiens; identical to SEQ ID NO: 43480
  misc_feature 1..31: note = chr12:62539225-62539256
  misc_feature 1..31: note = hypo
  source 1..31: mol_type = genomic DNA

SEQ ID NO: 75034 - DNA, 42 bp, Homo sapiens; identical to SEQ ID NO: 43481
  misc_feature 1..42: note = chr12:62563338-62563380
  misc_feature 1..42: note = hypo
  source 1..42: mol_type = genomic DNA

SEQ ID NO: 75035 - DNA, 168 bp, Homo sapiens; identical to SEQ ID NO: 43482
  misc_feature 1..168: note = chr12:62580835-62581003
  misc_feature 1..168: note = hypo
  source 1..168: mol_type = genomic DNA

SEQ ID NO: 75036 - DNA, 763 bp, Homo sapiens
  misc_feature 1..763: note = chr12:62584250-62585013
  misc_feature 1..763: note = hyper
  source 1..763: mol_type = genomic DNA
actagtagcaagatccgggagacatctaaccggaaagaaataaaaaaccattagtttcccgaagccattcttattctgaacgctgttcgttaagagaatcatttactaaagctctcttgtagtagcctttacaaaagctttatttcattcagtaagaaagcgccccgtcccaaatctaaataaaccttacatagatgaggctccggaaattatcagcttgattctttatgaagatagttagaggtggataaatcaatagactcgctgaaacacccaccttctgcaaacaggcctgagaattaactaatcagaagtggacaaaaagtagggatttcagaaagatgacctgacacatcccattgatcttccctggaatgcgacccccaactccttattaagagtccaaaatggttaccagccaggatgggtctgggtgaggaatcgaattacaacccacttcaatcctcgacctggtcgtttgctgttattaggagaaatggggcagagagggagggcaccgctcacggagcctcatttcgcatgctccgatcccctctcggcgtccctctactccgcccctaccctgaccgcccgcgagggagacgccggccgatggacccgcatctgccctcacctctcgccttccccgggcgatccctctacagtcccggacccccgagaaaggggaagggagacgtgtgcacacgggggcttccgggaccgcggtcctgcagttgccgctccggtccccagcgctggccgg

SEQ ID NO: 75037 - DNA, 1308 bp, Homo sapiens
  misc_feature 1..1308: note = chr12:62585030-62586338
  misc_feature 1..1308: note = hyper
  source 1..1308: mol_type = genomic DNA
cgcacctacctgcagccccgcttcccggtggcggcaacacctagcgatgctcctgcagcttttgcgggccggcgccagccttatcgctctcgcatcgcttccaagatgccaatccgccgtcaccatccaggggcatagggaaccgaagtctggtgctgtgtgatcgtggagggcggcgtgtgagtgtggccctgagcgtgcgagtgtgcgcgcgcgtgtgtggatgtgtttcctcctccgatggcaaagacggttcaggaatctgacatccaagctggaatccccctgaagcgggtgaaggtgagcctgatccttctccccgcttctttattccacagtgtcaaagtaatcaaaagatttgtttactgaggaaaagccaaagtcccgcagcccttggcagcgcccgcggtcgcctcctgtcctcgccggatgcgcgcggtgcgctcagctccctggactgcaagaatcaaggcggtcttgctgcaattaccgctcttattccatctctgatttgtttgcttttaaggccgactaaagacttttcctctcgcctcacgtcgtctctccctctcacacacacacacactcacacatcctccgttccctctctcccgccctccctcttgttctctggggaaaggcaattggacagaatgattcaccttcaggaaagcagcctcggccacgcacttctcgagttccctggctctcgcaggtaccgggtctccaacgtggcggagttgctgggaagctcgggacaggaaggaggagaggctctgagctcagccgatgtcccccctccagacgcccgcgttcctccgtccaggtgcccctgttcccactgctcgcagataggtccccgctggtgccctcgcggagacttggcgccttccactcgaatccacttagcagcaactcctggccagcttcagcccctcaatcccgcctcgaagtgctgcgggcagagccccacgcagcccacccgctgcccttctaggcatcgtgggctggaaggaagggaaacccgccgatgtccccctggtagcagtgccctggcaccgtcaccaccgaggaggtgcgagttccaacatcgaacacaagcgagcaggtgtcgcctgtgtcactttgctaaaggcgggaggggagaaagaaaggagcggggggagggggccgaggaaacaaatccagatcaccggcggagaaagaagccgtttagcaagcaaagcctcctctccgcgtcccaccccagatgctatactgtcaaaagacactgatgctaatcttttagaaagtcgccataaagggcag

SEQ ID NO: 75038 - DNA, 22 bp, Homo sapiens
  misc_feature 1..22: note = chr12:62603703-62603725
  misc_feature 1..22: note = hypo
  source 1..22: mol_type = genomic DNA
aggcgcaggggctcacgcctgt

SEQ ID NO: 75039 - DNA, 24 bp, Homo sapiens
  misc_feature 1..24: note = chr12:62630991-62631015
  misc_feature 1..24: note = hypo
  source 1..24: mol_type = genomic DNA
atgatccattctgttcgccgggcg

SEQ ID NO: 75040 - DNA, 175 bp, Homo sapiens
  misc_feature 1..175: note = chr12:62829159-62829334
  misc_feature 1..175: note = hyper
  source 1..175: mol_type = genomic DNA
gtctgcatccctaagcgaactgctgcgatcctaagcgcggggagctcccccacccagaggtacccaggcggtgcttgggcggtagtttggagaccctgagagggcaatgcaccagacaggaaactcgccctgggtctctcaccacaccccacctgagctgcggcaggtgccattg

SEQ ID NO: 75041 - DNA, 30 bp, Homo sapiens
  misc_feature 1..30: note = chr12:62862175-62862205
  misc_feature 1..30: note = hypo
  source 1..30: mol_type = genomic DNA
gccctaaaaattcaccgagggatttcatat

SEQ ID NO: 75042 - DNA, 565 bp, Homo sapiens
  misc_feature 1..565: note = chr12:63025691-63026256
  misc_feature 1..565: note = hyper
  source 1..565: mol_type = genomic DNA
cgggggtgtaggccccgagtgatttcctgccacagtgccggagcgggactggcgctgcctcccgggtccaggttccagccgctcccagctgttggcggcgctgctgagatgatggcctggatcccccaggttccgggactccccaggtggctccccgaggctatttacagctgaggttcggccggtgattgctgggacggaaaactcatttctcagcctggcttttatttacactcttattaaggaggctttcattcgtgttggaatggcagcgagaggctgcgggccaggcggccgaatgggtcgtgcccgagcgacagcggccgcctgcgccgcgaccttgagggcagaggagcgtgggcggcgtgcggggacaaaggcgcgcggggagcctgggtcacggctctgcagcagacacgggacctccacgtttctaccaccccggaaagttgagcgccttgggggctgcatttctccctttattggtagctggttcggctcgcccctttgcccgaccacacgctctttgtaaatacagaataggacaaaacggaaagagtgatgt

SEQ ID NO: 75043 - DNA, 40 bp, Homo sapiens
  misc_feature 1..40: note = chr12:63033701-63033741
  misc_feature 1..40: note = hypo
  source 1..40: mol_type = genomic DNA
cgtgcccggccaggccacattcttacgagttaattcttct

SEQ ID NO: 75044 - DNA, 48 bp, Homo sapiens
  misc_feature 1..48: note = chr12:6310255-6310303
  misc_feature 1..48: note = hyper
  source 1..48: mol_type = genomic DNA
gcggcaggggtgcctcggccgcgggtccggccccgggacccagtccct

SEQ ID NO: 75045 - DNA, 155 bp, Homo sapiens
  misc_feature 1..155: note = chr12:6316943-6317098
  misc_feature 1..155: note = hypo
  source 1..155: mol_type = genomic DNA
ttccagaggaggtcccggtagagagaagtttggggactactgacttggagaaaaatcagaaacccgggtcttaagagcccttcctcttcaatccttaagccaggcattgtgcctgagggaagaaatagtggctcttatgagctctgctagaaaag

SEQ ID NO: 75046 - DNA, 78 bp, Homo sapiens
  misc_feature 1..78: note = chr12:63195735-63195813
  misc_feature 1..78: note = hypo
  source 1..78: mol_type = genomic DNA
gagtccggctgttggcgggcgtgttctcaggctcctcccccaggcaggtagggggcaggacggcggagttcttcagga

SEQ ID NO: 75047 - DNA, 139 bp, Homo sapiens
  misc_feature 1..139: note = chr12:63327187-63327326
  misc_feature 1..139: note = hyper
  source 1..139: mol_type = genomic DNA
gagctgattggttcccggacgaaccaatcaaccagcgaggccgtgcacggataggggagggccaaaactaccgaggggatggggttaaaggaaaaggcgcaggtgtgccagccaccaggttttgcgtgcacttttgcac

SEQ ID NO: 75048 - DNA, 649 bp, Homo sapiens
  misc_feature 1..649: note = chr12:63543753-63544402
  misc_feature 1..649: note = hyper
  source 1..649: mol_type = genomic DNA
cggatcttggcccgggaaatggacttcacgctgctgacacagggtgcgagcaggaaccccttttggaaggccacacccgcttgctctgcacccttgctctggcgcgacgccgtcttcccgcggacgttgcaccagatgttgtagcagatgaagccgtagcaggtacccaagatgaccacgggcgccacaaagatgccgcccgtcatccaggtcacgtaggcacgagaaccccagggctggatgaaggtggcccagcagtcgcgggccttggtgacattgttcacctcgatcatggagaagacgaagtactgcggcgtgctcagcacgaagctcagcacccaggcggccgcgatcatgaggcgcgagcggcgcgcgggctgttgcagagtcttgagcgggtggcacaccgcgatgtagcggtcggctgtcatgactaccagcatgtaggccgacgcaaacatgccgaacacctgcaggtgcttcaccacgcggcacagccagtcggggccgcggaagcggtaggtgatgtcccagcacatttgcggcagcacctggaagaatgccacggccaggtcggccaggctgaggtgtcggatgaagaggtgcatgcgggacgtcttgcgcggcgtccggtgcagagccagcagta

SEQ ID NO: 75049 - DNA, 102 bp, Homo sapiens; identical to SEQ ID NO: 34483
  misc_feature 1..102: note = chr12:63544498-63544600
  misc_feature 1..102: note = hyper
  source 1..102: mol_type = genomic DNA

SEQ ID NO: 75050 - DNA, 278 bp, Homo sapiens
  misc_feature 1..278: note = chr12:63544728-63545006
  misc_feature 1..278: note = hyper
  source 1..278: mol_type = genomic DNA
cgctcgcagcttgccgggctctgcgatccctccagtgggcgtctcccggagcagcgtcccgcctgcccactgagcagctctcagcagggtgagctggcccctctccctgctctgccttttttcaacttcggcgaggtcgggaaggtgagctccgagcttccggaagcactgggttcccaactcaagtatttatgcggtgcttgtttccttgggacgcgctccctcccgccctattgccggaagactgctggttgcctactccccgctccctggagttt

SEQ ID NO: 75051 - DNA, 256 bp, Homo sapiens
  misc_feature 1..256: note = chr12:63545267-63545523
  misc_feature 1..256: note = hyper
  source 1..256: mol_type = genomic DNA
gaaacctccagtccacgcaccggcgtccacgcatctagctcctgcacctgaacctggctctcgacctcacctcctccagtccgggtttcttccttctcaccgagctcacccgtgcagcagtctggcaaattttattccccaggcaaattttcccggggcaaacatttctccccgctcgtgacttaaagagctatctcttcctagtaacgtctttgatgcatgctatttattaccctatgtttgcgacgggaagaac

SEQ ID NO: 75052 - DNA, 62 bp, Homo sapiens
  misc_feature 1..62: note = chr12:63545524-63545586
  misc_feature 1..62: note = hyper
  source 1..62: mol_type = genomic DNA
cactcatcactttgcagccccagtggctgctgtgcctgtattcacagcggggtttgggggga

SEQ ID NO: 75053 - DNA, 30 bp, Homo sapiens; identical to SEQ ID NO: 43485
  misc_feature 1..30: note = chr12:63788043-63788073
  misc_feature 1..30: note = hypo
  source 1..30: mol_type = genomic DNA

SEQ ID NO: 75054 - DNA, 720 bp, Homo sapiens; identical to SEQ ID NO: 34486
  misc_feature 1..720: note = chr12:64061778-64062498
  misc_feature 1..720: note = hyper
  source 1..720: mol_type = genomic DNA

SEQ ID NO: 75055 - DNA, 27 bp, Homo sapiens
  misc_feature 1..27: note = chr12:64062499-64062526
  misc_feature 1..27: note = hyper
  source 1..27: mol_type = genomic DNA
gtgcgcgcaggccccaagcccacatgc

SEQ ID NO: 75056 - DNA, 624 bp, Homo sapiens; identical to SEQ ID NO: 11301
  misc_feature 1..624: note = chr12:64062527-64063151
  misc_feature 1..624: note = hyper
  source 1..624: mol_type = genomic DNA

SEQ ID NO: 75057 - DNA, 30 bp, Homo sapiens
  misc_feature 1..30: note = chr12:6420362-6420392
  misc_feature 1..30: note = hypo
  source 1..30: mol_type = genomic DNA
caggccctgcccactcgagggcgggccctc

SEQ ID NO: 75058 - DNA, 116 bp, Homo sapiens; identical to SEQ ID NO: 34234
  misc_feature 1..116: note = chr12:6444922-6445038
  misc_feature 1..116: note = hyper
  source 1..116: mol_type = genomic DNA

SEQ ID NO: 75059 - DNA, 30 bp, Homo sapiens
  misc_feature 1..30: note = chr12:6449974-6450004
  misc_feature 1..30: note = hyper
  source 1..30: mol_type = genomic DNA
gaacaggatgattcccggaccaagacgtgg

SEQ ID NO: 75060 - DNA, 30 bp, Homo sapiens
  misc_feature 1..30: note = chr12:6450274-6450304
  misc_feature 1..30: note = hyper
  source 1..30: mol_type = genomic DNA
ccccaggtgagaggccggggcttggccagg

SEQ ID NO: 75061 - DNA, 30 bp, Homo sapiens; identical to SEQ ID NO: 34235
  misc_feature 1..30: note = chr12:6450544-6450574
  misc_feature 1..30: note = hyper
  source 1..30: mol_type = genomic DNA

SEQ ID NO: 75062 - DNA, 152 bp, Homo sapiens
  misc_feature 1..152: note = chr12:6472461-6472613
  misc_feature 1..152: note = hyper
  source 1..152: mol_type = genomic DNA
acttttttttttgcccgcgagcccacgaggccccgcgtggtgtcactgggctgcgcgggcgggtcaggaaaggagcggagcccatgggtgggcggggccaggggccggcgaggggcggggcgggcccctcggcgctgcgggcctcaccagct

SEQ ID NO: 75063 - DNA, 46 bp, Homo sapiens; identical to SEQ ID NO: 34237
  misc_feature 1..46: note = chr12:6472854-6472900
  misc_feature 1..46: note = hyper
  source 1..46: mol_type = genomic DNA

SEQ ID NO: 75064 - DNA, 44 bp, Homo sapiens
  misc_feature 1..44: note = chr12:6473627-6473671
  misc_feature 1..44: note = hypo
  source 1..44: mol_type = genomic DNA
taattgcatttaggccgggtgtggtggctcacgcctgtaatccc

SEQ ID NO: 75065 - DNA, 137 bp, Homo sapiens
  misc_feature 1..137: note = chr12:64783185-64783322
  misc_feature 1..137: note = hypo
  source 1..137: mol_type = genomic DNA
ttggatcaagtgagccgcctgagattgccaagcgtcctgtgcgcatctcattaacgcatctgcttattcatgcatttattcttttgctggggagggggtggaggggaacggtgtctcactcattctgtagctcaggc

SEQ ID NO: 75066 - DNA, 17 bp, Homo sapiens
  misc_feature 1..17: note = chr12:64783562-64783579
  misc_feature 1..17: note = hypo
  source 1..17: mol_type = genomic DNA
cacggcacccggcctta

SEQ ID NO: 75067 - DNA, 593 bp, Homo sapiens
  misc_feature 1..593: note = chr12:64784107-64784700
  misc_feature 1..593: note = hyper
  source 1..593: mol_type = genomic DNA
cgacgtcccgcagagccactacccgccggatggacttgggcgggttctcggttaggtagacgagccggtcgcttagcaccacatacttgaggatgtggttctcagagttggacaccacgatgcatggctcgtaggcgcggaccgcgtcgtagacctcgggcggcagatgccgccgcaggaacacatccaggcggctgttcctgcgcgcggggaagccggacggcaaggggctggccatgcccggcgcccgcagcgtggcggagtgctgggactcgaggccctcagctcgccctctccccgcccccgcgctggaacccgcgcgccacaaagccgccggccacgcgtcgcctcctctccaggcgcggggacccgggccgcaactgcaggaatcgacgctaggtcggcttccctggagcgccctccccagccctgtccagcctctcgatctttgtcctaacctcagacggcgatgggcggggcaagacgctggtccttcaggcccgagttgatgggcacctcgggctcatcaccgtgaagtcccctgcggccgaagggcggtggatttttagggtctctcccgcccacccctaatg

SEQ ID NO: 75068 - DNA, 30 bp, Homo sapiens
  misc_feature 1..30: note = chr12:64797450-64797480
  misc_feature 1..30: note = hypo
  source 1..30: mol_type = genomic DNA
aaataaattttggaccggacaccgtggctc

SEQ ID NO: 75069 - DNA, 20 bp, Homo sapiens
  misc_feature 1..20: note = chr12:64799707-64799727
  misc_feature 1..20: note = hypo
  source 1..20: mol_type = genomic DNA
ttgatcgtccaaatgccttc

SEQ ID NO: 75070 - DNA, 462 bp, Homo sapiens
  misc_feature 1..462: note = chr12:6483568-6484030
  misc_feature 1..462: note = hypo
  source 1..462: mol_type = genomic DNA
gaagacgagcttgtccgagttgaggttgatgttgaggctgacggggtagctgaagtactctccgaaaagcaggccgaattgccagtacatcatgccaaaggtgcagagccacagcactgcccagaaggccgtcttcatgcggttgtgctgggagcacaccaggcggatggcgccgtggatggtggtgttgttgcagaagaactcgaagagctctcggtaggagcggtggaactcgatcagggcctcctcctccgccgtgggctgctggggcgccgcaggttcggggcccagcccctgctcctcacgcttgttccccttcatgagccctggagtggactgtggagggctagagtcctgctcctccagcttgttcccctccatgagacctggtatgggctgcagaggtctagggtcctgctcctccagcttgttccccttcatgagccccggagtggattgggg

SEQ ID NO: 75071 - DNA, 63 bp, Homo sapiens
  misc_feature 1..63: note = chr12:6493353-6493416
  misc_feature 1..63: note = hyper
  source 1..63: mol_type = genomic DNA
ggagccctggaggcccggcctggccgctcccggccctggggtgcacatcggccctgagtcccg

SEQ ID NO: 75072 - DNA, 78 bp, Homo sapiens
  misc_feature 1..78: note = chr12:6495108-6495186
  misc_feature 1..78: note = hypo
  source 1..78: mol_type = genomic DNA
gaaaggtgagagctacgcaatggggtggatgggcatcctgaggcttaaaggaaactcacaggccggcaaagggcccct

SEQ ID NO: 75073 - DNA, 24 bp, Homo sapiens
  misc_feature 1..24: note = chr12:65152388-65152412
  misc_feature 1..24: note = hypo
  source 1..24: mol_type = genomic DNA
caccgcgcccggcccaggcttatt

SEQ ID NO: 75074 - DNA, 232 bp, Homo sapiens; identical to SEQ ID NO: 1051
  misc_feature 1..232: note = chr12:65218319-65218551
  misc_feature 1..232: note = hyper
  source 1..232: mol_type = genomic DNA

SEQ ID NO: 75075 - DNA, 628 bp, Homo sapiens
  misc_feature 1..628: note = chr12:65218900-65219528
  misc_feature 1..628: note = hyper
  source 1..628: mol_type = genomic DNA
ggggagctctggggaaagtccgcgtgccacctggtgcggggcaccgcgttggcacctgcagggagcgattggtctggaagggtagagggcagacgggggcctgggtggggcagcggccaccccaggcgcggagaacccgctgcttccaccctctccccgcggacccccaccctgcggcctgtgtgctcggctttctccgcgtggcggggaagtgcgggtggctgcccgggccctcagaggccgcaccacctattgtgttccaggctcgcaggaagccagaccttgcgagaggtgtgtgggggcggagagtggcacaggtttgacactgcaggtcggaggaggaagacagtggctgcaaaggcaaaatcgggtgttattttcccaagagtcccttcagcgtgagtgccggggtcagctcgaactggagcctgtaatttgtgagtgcgagtggggagcagcaggagatccttttcataggtgaggtccaggaacgagcctggtcgtgctaggcaaggcccttcccactgtcagcctgtgtttacccatccctgcttctccagactgcataactccgtgtcggctccatcacccggcatccctccccgggattttaagagcctggccctag

SEQ ID NO: 75076 - DNA, 288 bp, Homo sapiens; identical to SEQ ID NO: 34493
  misc_feature 1..288: note = chr12:65219605-65219893
  misc_feature 1..288: note = hyper
  source 1..288: mol_type = genomic DNA

SEQ ID NO: 75077 - DNA, 327 bp, Homo sapiens; identical to SEQ ID NO: 3911
  misc_feature 1..327: note = chr12:65220112-65220439
  misc_feature 1..327: note = hyper
  source 1..327: mol_type = genomic DNA

SEQ ID NO: 75078 - DNA, 761 bp, Homo sapiens
  misc_feature 1..761: note = chr12:65514835-65515596
  misc_feature 1..761: note = hyper
  source 1..761: mol_type = genomic DNA
ttgcctggtgagcatcgatccataggtacaggctctcctcctgcggcggcccggcctccgcccgcagtgccagcaggcacaggaggatgctccagagccagagcgcggcggcagggaaggcgctcctccgggccatgctgctcaggacctcctcgctgccgggaaaactcctcgtgccgcacctacgcaacctggcgccgtcagatactctgctgcgctgcagctccctcagccagggctgttcccgtttagacggctgggcgcgtcgcctcccggcctgggtgccaaggagcctgcgagagcaggaggagggggcaggcaggacgcgggaggaggagggggggaccagcgggcgcgagtcgcgcaagaagatggggcgcgggcgggagtgggggcggcagagacgtaagactggcaaagctggcgaggccagcagtcagcggggcaaatagagcgagaacagaagagcgggaagggctggcgcgagcgaggtgcgagcgaggagtggggcccgcgaggcctgggcggccgccacttgggggcgctgtggggcccccccgggggcggggccgcgagggacccccgaggctgcattcacagtgcggtgcgcccagtggagcgcccgcgaagtgggcgtgtagggctggcggacccggagaagggcactcagagacccctgggacatcactcgccacctcctcgggccaagggaggcttcgggggagggaaatggggagagcagacaacgctgggcttgactg

SEQ ID NO: 75079 - DNA, 209 bp, Homo sapiens
  misc_feature 1..209: note = chr12:65516338-65516547
  misc_feature 1..209: note = hypo
  source 1..209: mol_type = genomic DNA
tataaataaataaataaaataattttttaaaagttgccgaattcacaggtgcgtgggggcaaaaccaaggctctggcctcgtctgtgagaagcatgcttggccggcagtgggctgcagcataacctatccacctggcccagcagaaagaactgatttttgcctcctgcctaattcctcggatgcacaaagaaaacggaagcaaaagggt

SEQ ID NO: 75080 - DNA, 29 bp, Homo sapiens
  misc_feature 1..29: note = chr12:65530856-65530885
  misc_feature 1..29: note = hypo
  source 1..29: mol_type = genomic DNA
ctagaaaaggccaggcgtggtggcctttt

SEQ ID NO: 75081 - DNA, 22 bp, Homo sapiens
  misc_feature 1..22: note = chr12:65557212-65557234
  misc_feature 1..22: note = hypo
  source 1..22: mol_type = genomic DNA
gagaagtgatagcatcggccgg

SEQ ID NO: 75082 - DNA, 23 bp, Homo sapiens
  misc_feature 1..23: note = chr12:65562063-65562086
  misc_feature 1..23: note = hypo
  source 1..23: mol_type = genomic DNA
ttgactaacgtttttctgtacag

SEQ ID NO: 75083 - DNA, 99 bp, Homo sapiens
  misc_feature 1..99: note = chr12:65672426-65672525
  misc_feature 1..99: note = hyper
  source 1..99: mol_type = genomic DNA
ttggactcggctgcccgtgcccaggaatttcccgtcatgcctcccgccgccccgtccgtcgcccggagccggggagggagggagcgaggttcggacacc

SEQ ID NO: 75084 - DNA, 524 bp, Homo sapiens
  misc_feature 1..524: note = chr12:65672776-65673300
  misc_feature 1..524: note = hyper
  source 1..524: mol_type = genomic DNA
agcccctgcctcagccgagaaggggagcagaagggttgcgccccgcgccagcggtgaggggccgaacggaaggaggtcagggctggtttccccccacccgccgaagggaggcgtctggcagcctcactgacaccttatcctgtcccgggagcgaacctgaacccgcgggagcctctcgccccgcgcgggcccaggagagagggatctggcggggcagcccgcgggaggcaggggaggggtccatcccggagccctctgctctgtgcgtcgaccctgccggggttgccgctcagataacgggcccgaggcgtgggaaccggcccgccaggcctgcgcttttcgccgcgcgcctcggagaggacgggggtgcggggcggcgggcaggcggcagggaggggcgcacccgggagcgcacccgccgcccgccctccctgcgctgctgccccgctgctgggccagactccagcgggcccgcctggcatttcacaggccaaaatcgaacagaaccccgagtttgccaggta

SEQ ID NO: 75085 - DNA, 30 bp, Homo sapiens; identical to SEQ ID NO: 43493
  misc_feature 1..30: note = chr12:65787081-65787111
  misc_feature 1..30: note = hypo
  source 1..30: mol_type = genomic DNA

SEQ ID NO: 75086 - DNA, 151 bp, Homo sapiens; identical to SEQ ID NO: 11310
  misc_feature 1..151: note = chr12:66122419-66122570
  misc_feature 1..151: note = hyper
  source 1..151: mol_type = genomic DNA

SEQ ID NO: 75087 - DNA, 223 bp, Homo sapiens
  misc_feature 1..223: note = chr12:66122773-66122996
  misc_feature 1..223: note = hyper
  source 1..223: mol_type = genomic DNA
ccaatctcccttcctcgagaggtgtctgggcgcaatactctccggcccgaagcaaggggacgtttgcgaggagggagaaatttaaacccccttcgctccgcgccacctgggagcactttggcgccgcagactcaggagccgacgccatctccaggacggcctcggtggcctcggcaggaggcaccttcggggagcggtcccgcactcctccttcctcagtccc

SEQ ID NO: 75088 - DNA, 186 bp, Homo sapiens
  misc_feature 1..186: note = chr12:66123380-66123566
  misc_feature 1..186: note = hyper
  source 1..186: mol_type = genomic DNA
gggaggtggagcacgaaacacaaaagctgtttgaaccacaaacgccaggctggacacccaacgaatattaatgacctgcagcctccacccacccgcaaacataatattatgtgtacgtgcttaccggttagcttaacagacttgccatcataaattcctttttcactgcagcgccactagatttgt

SEQ ID NO: 75089 - DNA, 22 bp, Homo sapiens
  misc_feature 1..22: note = chr12:66133735-66133757
  misc_feature 1..22: note = hypo
  source 1..22: mol_type = genomic DNA
aaagatgttcttggccgggcac

SEQ ID NO: 75090 - DNA, 1179 bp, Homo sapiens
  misc_feature 1..1179: note = chr12:66135064-66136243
  misc_feature 1..1179: note = hyper
  source 1..1179: mol_type = genomic DNA
aacctcctgggtgtccgggaccaccggccttagccttctccaagcccagggcagggcgagaagaacatggcccggttcccctcggggtctctggcccagctgcggagggggaaaggtgatcgatcttgctgggggccaccgctagcccaccgcttcctgccgcgacctgccgcggcggccggagcccgggagcttcccattggctcacgggccgacgccatgcagtctgggggggcgtggccgggcggcggggcgtggccaggcggtgcggggaactgcggagagaggagaggagaggagaggaggggaggggaggggagaggagtggagaggagaggaggggaggggagggcaggggcggggcggggccgggcggcgggggcgcacaccccaatctccctagcgctgtgggggtggctgcagctccccgcgcgctccctcctttgggggggtttctgggctcgtgacttttttttaaataaagaatgagcggatgcccgtgacaagttaatagctctcgccgcgctctaaagttaagttgtatctccttcccgccgcgagtctccttccacagacccgccggagctgccgggacgggcgctgcgcgggactgggcgttaggtgctcccggctggttccggcgagcagcccccacccctcgcccacgctcggggttagagaccccagcaccccacgcagacggcccgggcttagacctctccacgtcgctgtggcgcgcgccccgccaacacccccaccccacgcgcagcccgtgtcttctttacccccgcgcacttaacgcagggcgcacgcacgcatcccggccccctcacactcacactgcgtcttctgtcacaccccctgtcgcacacacactgttctctgactcccaccatctcctgtctcacacccactccagtttcgtgttgagcggccgccagttctccctcggtcgcgccggcgcacgctcgtccccttctgccccggagcccgcccgcgccgcacggtggccccttgcgctggcctgatcgtgggaaccaggcggggccccagcgtccctgcccctgcccggtcatccatctccctcccggtcggccagccgagacttcaaaggcgcctcctccggccgggcctgccaaaccccgacgcagcctggatgtgggccgggggcgctccccg

SEQ ID NO: 75091 - DNA, 30 bp, Homo sapiens
  misc_feature 1..30: note = chr12:66188703-66188733
  misc_feature 1..30: note = hypo
  source 1..30: mol_type = genomic DNA
gatttgtgattttaccgagtaagatctata

SEQ ID NO: 75092 - DNA, 33 bp, Homo sapiens
  misc_feature 1..33: note = chr12:66208320-66208353
  misc_feature 1..33: note = hypo
  source 1..33: mol_type = genomic DNA
aatagacagataggccgggcgccgtggctcacg

SEQ ID NO: 75093 - DNA, 30 bp, Homo sapiens; identical to SEQ ID NO: 43495
  misc_feature 1..30: note = chr12:66211140-66211170
  misc_feature 1..30: note = hypo
  source 1..30: mol_type = genomic DNA

SEQ ID NO: 75094 - DNA, 60 bp, Homo sapiens
  misc_feature 1..60: note = chr12:66216864-66216924
  misc_feature 1..60: note = hyper
  source 1..60: mol_type = genomic DNA
acgcggaccaatcagcgctgccgcgccaaagcagacatttacacgcgcctcctccacatg

SEQ ID NO: 75095 - DNA, 148 bp, Homo sapiens
  misc_feature 1..148: note = chr12:66217502-66217650
  misc_feature 1..148: note = hyper
  source 1..148: mol_type = genomic DNA
gtgtgtgtgtaaatgcgggtgtttaccagcgcatgaatgcccccgtgtccacgtgtatctgcgtgcatgtgcttacacgcgtgttcgtgtgtatctgcatgcatgtctccgtgtatgtgcgcgctcgcccgcccgcaggctctgtggt

SEQ ID NO: 75096 - DNA, 33 bp, Homo sapiens
  misc_feature 1..33: note = chr12:66217887-66217920
  misc_feature 1..33: note = hyper
  source 1..33: mol_type = genomic DNA
gtggagctaggcccacggcgagccagcccggga

SEQ ID NO: 75097 - DNA, 544 bp, Homo sapiens
  misc_feature 1..544: note = chr12:66218783-66219327
  misc_feature 1..544: note = hyper
  source 1..544: mol_type = genomic DNA
cccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagtcagtacgagggcgcggtgggggcaccagcccaccccgtccccactgccggggcccagacacgcgcggggcggccggagtgcgggagcccagtcgccgcggccgtcgcacactgcccgccggccggccggggggagcggcgcagaccccacgagtgcgccgcgcg

SEQ ID NO: 75098 - DNA, 506 bp, Homo sapiens
  misc_feature 1..506: note = chr12:66219688-66220194
  misc_feature 1..506: note = hyper
  source 1..506: mol_type = genomic DNA
cctcctccaagctctcggtggcccaagactcgcgccctcccgacaaagaacgcatggagacccggctgcctggtcctttttgggctctttaaatatgcggcggccgccggagggagcccggggcaggggctacggggagcctggttccccgcaggacggggttaactcgcccagctaagggcgcgttgaaaggagtgtccaagagagtgcagggtagccagggtcgcttccttgtcaggggcccggtcccccttttgcccctggatctcgcgcctcagagctgcagccattaaatgctcttctccaaggccagtggccgggggttgagtaggggacgatcgaggggcgcccgggaccctgcggagtggagggttttgtctgcggatgcaaccaattaagcgtgcagccggcgcttgcagagctgcgctcagcgcgcagggctgggggttttgttcgctgtaatttccaagccgcggcgggcagagttggagcgggatatgtctatt

SEQ ID NO: 75099 - DNA, 111 bp, Homo sapiens
  misc_feature 1..111: note = chr12:6623485-6623596
  misc_feature 1..111: note = hypo
  source 1..111: mol_type = genomic DNA
aagaaccgccccactcgggaagccataacacacctgcttggtgtagccttgacccgttataaccatatgctcagtaagttaccagtcgctttgccccgccttttttgtatt

SEQ ID NO: 75100 - DNA, 22 bp, Homo sapiens
  misc_feature 1..22: note = chr12:66242342-66242364
  misc_feature 1..22: note = hypo
  source 1..22: mol_type = genomic DNA
ttaaaagtttaaggccgggtgc

SEQ ID NO: 75101 - DNA, 28 bp, Homo sapiens
  misc_feature 1..28: note = chr12:66255902-66255930
  misc_feature 1..28: note = hypo
  source 1..28: mol_type = genomic DNA
gtgtgagccaccacgcctggctgtgcaa

SEQ ID NO: 75102 - DNA, 76 bp, Homo sapiens
  misc_feature 1..76: note = chr12:66282638-66282714
  misc_feature 1..76: note = hypo
  source 1..76: mol_type = genomic DNA
ggccccgtggtgtgctaactcttatgacaatgatgacatagggacccagggaccaccctcccgttagagatgcacc

SEQ ID NO: 75103 - DNA, 30 bp, Homo sapiens
  misc_feature 1..30: note = chr12:66317501-66317531
  misc_feature 1..30: note = hypo
  source 1..30: mol_type = genomic DNA
cattctcgccgggtgcggcagctcatgcct

SEQ ID NO: 75104 - DNA, 22 bp, Homo sapiens
  misc_feature 1..22: note = chr12:66340919-66340941
  misc_feature 1..22: note = hypo
  source 1..22: mol_type = genomic DNA
ggcagagtcttgctccgtcacc

SEQ ID NO: 75105 - DNA, 22 bp, Homo sapiens
  misc_feature 1..22: note = chr12:66341181-66341203
  misc_feature 1..22: note = hypo
  source 1..22: mol_type = genomic DNA
acagtttcgttttaacatctgt

SEQ ID NO: 75106 - DNA, 30 bp, Homo sapiens
  misc_feature 1..30: note = chr12:66343834-66343864
  misc_feature 1..30: note = hypo
  source 1..30: mol_type = genomic DNA
gcattggcatgtatacggagcaattggaac

SEQ ID NO: 75107 - DNA, 37 bp, Homo sapiens
  misc_feature 1..37: note = chr12:66523437-66523474
  misc_feature 1..37: note = hypo
  source 1..37: mol_type = genomic DNA
tacaggcttgagccaccgcgcccggctgaatttcttt

SEQ ID NO: 75108 - DNA, 327 bp, Homo sapiens
  misc_feature 1..327: note = chr12:66582721-66583048
  misc_feature 1..327: note = hyper
  source 1..327: mol_type = genomic DNA
cctagccgtggggcacggtgggctcctgggagctctgagctctgggctttctccagttcgcactctgcttgtctcggcagctccgtccccaccgcagaggtgtgaaggggcgcaaagccagcgaagggagaacccgggtcgggtaacccccaggcctggccaggcggacgcaggggcatctcgggcgaggcgcgccttgcgtcacgtgggcaccgcccctgcagtgaccggagaacggcgtgttcctagggctctgctgccgtcgtggaagcaggatttccgcggttgtgtaacggcctgtcgcaggcgtgcagggacctggactcc

SEQ ID NO: 75109 - DNA, 396 bp, Homo sapiens
  misc_feature 1..396: note = chr12:66583049-66583445
  misc_feature 1..396: note = hyper
  source 1..396: mol_type = genomic DNA
cctcgtccccggggctcgggcagccgagccatggcggggaactgtggggcccgcggcgcgctgtcggcgcacacgctgctgttcgacctgccgcccgcgctgctcggagagctctgcgctgttctggacagctgcgacggcgcgctgggctggcgcggcctgggtgagtcggcggggaccggccgggggcggcgggggagcccagcgcgccgcggggcccgctcggcgtcgccctgcatggctggggtccctcgcggggctggcgcggcctccgggaagttcccgccagggagccggccccctcctttcctgggttggatgcagagactccctgggacccagatgccttccctcccttctctttcaaagaattttgggtatcgctgcaaagtcaag

SEQ ID NO: 75110 - DNA, 71 bp, Homo sapiens
  misc_feature 1..71: note = chr12:665830-665901
  misc_feature 1..71: note = hypo
  source 1..71: mol_type = genomic DNA
gagtatgtgtctgcacgaggctggcagggcatcgatccagctggtggggaggaggtcgaggcccggaacct

SEQ ID NO: 75111 - DNA, 427 bp, Homo sapiens
  misc_feature 1..427: note = chr12:66628990-66629417
  misc_feature 1..427: note = hyper
  source 1..427: mol_type = genomic DNA
agagactgctgcttgcgatagggcgtccggcagttgctgctgcccccggggttgccgctgctgctggggaagatcatcgctgcgggccgcggcggcgggcgcgggcgcggggcagcctgggcgcggggcagcctcgccgcgagggggaggacgcaaggagggggccggccgggccccgggccgaggcagctttgggaactccctctcgccgcgcggcggcggccggcgggggctgcagctccgcgctgacttcccctccgcactcgtctaaaagtgcggcgcggcgcggggcgagactcgagcagctcgggcagccgccgctctgcgtgccatggacgggagttcgcgcgcggagctggcggcgtcgccgactctcccggcggcagcggaggagcagcgccgccgcgtcctccgatattattaagtt

SEQ ID NO: 75112 - DNA, 181 bp, Homo sapiens
  misc_feature 1..181: note = chr12:6664165-6664346
  misc_feature 1..181: note = hyper
  source 1..181: mol_type = genomic DNA
atggcagagacaagccggaaaagtaggaatccccccgtgttccgctcccagcgtccttcttcctgtcacgagcagggcttctgcattctctgcggattctagtctccctgcatccaattgcttccaagctcctcattacacagcacaaactttactctcattcttttcacccctgattctt

SEQ ID NO: 75113 - DNA, 153 bp, Homo sapiens; identical to SEQ ID NO: 3849
  misc_feature 1..153: note = chr12:6664370-6664523
  misc_feature 1..153: note = hyper
  source 1..153: mol_type = genomic DNA

SEQ ID NO: 75114 - DNA, 178 bp, Homo sapiens
  misc_feature 1..178: note = chr12:6803722-6803900
  misc_feature 1..178: note = hypo
  source 1..178: mol_type = genomic DNA
agagagtgagcacgccgcacaccaccacaacatcaggccgggaaacgcacatgagaggtaaagtgtgcaggaaacgctgaccactgagtgagctgagcacagaatgtgggaaggagagagtgcaaatgtgagacgagagaacatgagagtcagctgagcggagcggtatggacgggga

SEQ ID NO: 75115 - DNA, 70 bp, Homo sapiens
  misc_feature 1..70: note = chr12:6804640-6804710
  misc_feature 1..70: note = hypo
  source 1..70: mol_type = genomic DNA
ggccggggtccccctcggggctcctcatggtcaggggtgggggtaggtgagtccccgaaggcccccagca

SEQ ID NO: 75116 - DNA, 493 bp, Homo sapiens
  misc_feature 1..493: note = chr12:6809199-6809692
  misc_feature 1..493: note = hyper
  source 1..493: mol_type = genomic DNA
ccagtccctgggccccgcacagcttcagccgccccctccaggaagcccgcagtccccgggctggcgcgccacccccacccctctcccagcttctcaccgacctgttgtgcgcaggagacgagctgggggtggggcaggagcctcggggtgcgggagccgggccccagccccagcgtggcccccatcccacccatcccgcaggcccgcactccccgcacagggctggagagcggcgagagtggggggagacgaggaaaaggaggtcggcgaagggaccccgaggcagggagtgccgagagcggactggggacccgaagcaggagactgcgcggagccgcccgccgagccgaggcgggatggaggcagccgcggggacggggacggctgcgccagggagggcgggagcgagccaggaccgcggagggatggagagcccttcggggaaggggcgctgggaggctggaggccttgtcccgggcgagggaccgcgtcg

SEQ ID NO: 75117 - DNA, 76 bp, Homo sapiens
  misc_feature 1..76: note = chr12:6809993-6810069
  misc_feature 1..76: note = hyper
  source 1..76: mol_type = genomic DNA
cgcggcggctgggaccgctccgtctccgtctccgcctcccccccgcgccggaggccacgcacggtttaaccctcct

SEQ ID NO: 75118 - DNA, 30 bp, Homo sapiens
  misc_feature 1..30: note = chr12:6812993-6813023
  misc_feature 1..30: note = hyper
  source 1..30: mol_type = genomic DNA
ctgccctcttgcttgcgtgtccctgacagc

SEQ ID NO: 75119 - DNA, 91 bp, Homo sapiens
  misc_feature 1..91: note = chr12:6861239-6861330
  misc_feature 1..91: note = hypo
  source 1..91: mol_type = genomic DNA
tatggatggcagaagcgccaaactgtcaatccctccaccaccctgcaaaaaaatacgcacagagcaacagtggcaccgatgcctacttcct

SEQ ID NO: 75120 - DNA, 78 bp, Homo sapiens
  misc_feature 1..78: note = chr12:68759053-68759131
  misc_feature 1..78: note = hyper
  source 1..78: mol_type = genomic DNA
tgctgaattgggcaacgtgggctgcggttcacagggcaacagagacttcaccacctaacacatcggggctggtgcagc

SEQ ID NO: 75121 - DNA, 78 bp, Homo sapiens
  misc_feature 1..78: note = chr12:68978219-68978297
  misc_feature 1..78: note = hypo
  source 1..78: mol_type = genomic DNA
aaatctcatagtctccgaggtcactaagagctttatttccttgccaggagcggtggctcacacctgtaatcccagcac

SEQ ID NO: 75122 - DNA, 78 bp, Homo sapiens
  misc_feature 1..78: note = chr12:68978597-68978675
  misc_feature 1..78: note = hypo
  source 1..78: mol_type = genomic DNA
ctttttttccgttttcactagaaatgatcagcacagggatttactatttactcagatttgcttcgagcatgatgtcag

SEQ ID NO: 75123 - DNA, 30 bp, Homo sapiens
  misc_feature 1..30: note = chr12:69128689-69128719
  misc_feature 1..30: note = hypo
  source 1..30: mol_type = genomic DNA
tcagcaactatctttcgatcataacaggta

SEQ ID NO: 75124 - DNA, 39 bp, Homo sapiens
  misc_feature 1..39: note = chr12:69203803-69203842
  misc_feature 1..39: note = hypo
  source 1..39: mol_type = genomic DNA
attataggctggcctcggtggctcacccctgtaatccca

SEQ ID NO: 75125 - DNA, 95 bp, Homo sapiens
  misc_feature 1..95: note = chr12:69225853-69225948
  misc_feature 1..95: note = hypo
  source 1..95: mol_type = genomic DNA
caacaacaacaaaatctcgtttttcaggttaagtccctagttgtgaaagcttttggtagggccagtttttttttcttcttcgttttaatttccct

SEQ ID NO: 75126 - DNA, 30 bp, Homo sapiens
  misc_feature 1..30: note = chr12:69326349-69326379
  misc_feature 1..30: note = hyper
  source 1..30: mol_type = genomic DNA
cactcagagtaggtgcgtggaagagcagac

SEQ ID NO: 75127 - DNA, 868 bp, Homo sapiens
  misc_feature 1..868: note = chr12:69326653-69327521
  misc_feature 1..868: note = hyper
  source 1..868: mol_type = genomic DNA
acacatgagggcaggcgggggcatcaccagctacgtctcggtactccggtctcagggtctcccgacactgacgctccctgcctcctaaggaggcaaaagctggaagcaacaccttcgggagtgagccgtgcaaccagagaccgggagcacgggcagcctcggtgccctcgacccagccgcccgcgcctccctctcctcctcctcctggcgcctccgccgtccggcagctgccacagctgcgcccggccccgcgcacccccagcctcaccaggtcccaggcgcgcacctctacccacccgcggccgcccggcggggccgggtgttatagcccggtcagagggcgggcgcgcccgggccccgcccccggacgtccctccggcccactccggagccgcgcgggtgcctcccgggcggggcctcagccgccttcgcacctaggagagacggcgcccgcgcggtgcgccctttcgtggcgcggctgctggtgcccgcggccgggcggctgagctgggcggagggctgcgggcatggagtcgccgctcgcggacagtctttgctggagccccaggtcagaagtgtgtcctcgcctcggccacggctgtagcctgggcagccacagggcgctccaccgagggacactctctgtcgcagactgcagccgcttgggagacgtttagggctcggcgggtttcctgcggttggcggtgccggggcccacctggagccgggacgcatgcggagtcctgagtgccctgagccccgcgcgggctcctgcgggacgggcggcgtcggccccggcagggcgagccaagctcccagcagtgccaagctgcccagcgaggctaagcaatcacggggcttcgagaaa

SEQ ID NO: 75128 - DNA, 46 bp, Homo sapiens
  misc_feature 1..46: note = chr12:69551179-69551225
  misc_feature 1..46: note = hyper
  source 1..46: mol_type = genomic DNA
attctcaaactctgacgtgcttatcagtcaccgggaatgtgagaca

SEQ ID NO: 75129 - DNA, 22 bp, Homo sapiens
  misc_feature 1..22: note = chr12:69751028-69751050
  misc_feature 1..22: note = hypo
  source 1..22: mol_type = genomic DNA
tttttgtttttgagacggagtc

SEQ ID NO: 75130 - DNA, 102 bp, Homo sapiens
  misc_feature 1..102: note = chr12:69754377-69754479
  misc_feature 1..102: note = hypo
  source 1..102: mol_type = genomic DNA
taccatagaccctagcgtaatgtttgacattgtaatatttatttccctcacacagcccctggcacgttaatttttttttttttttgagacgaagtgtctgtc

SEQ ID NO: 75131 - DNA, 120 bp, Homo sapiens
  misc_feature 1..120: note = chr12:69754599-69754719
  misc_feature 1..120: note = hypo
  source 1..120: mol_type = genomic DNA
aaaatttcctttcctttataaataaaaatcagaaggggtacaaatagttgtttttatcaggagccagtgggtcctgccttaaaaattaacgtgcagggccgggcaaggtggctcacgcct

SEQ ID NO: 75132 - DNA, 30 bp, Homo sapiens
  misc_feature 1..30: note = chr12:69799375-69799405
  misc_feature 1..30: note = hypo
  source 1..30: mol_type = genomic DNA
agcactgtgatactacgacagtgaatttga

SEQ ID NO: 75133 - DNA, 30 bp, Homo sapiens
  misc_feature 1..30: note = chr12:69810460-69810490
  misc_feature 1..30: note = hypo
  source 1..30: mol_type = genomic DNA
tatgacaggctacttcgctcagatcaatgt

SEQ ID NO: 75134 - DNA, 239 bp, Homo sapiens
  misc_feature 1..239: note = chr12:69964051-69964290
  misc_feature 1..239: note = hypo
  source 1..239: mol_type = genomic DNA
aatgcattttcctgacgaattggtgacatatttgcatgactgtcaccttctttttttaggtcattaatgtggatgatgatgggaatgagttaggttctggcataatggaacttacagacacagaactgattttatacacccgcaaacgtgactcagtaaaatggcactacctctgcctgcgacgctatggctatgactcgaatctcttttcttttgaaagtggtcgaaggtgtcaaact

SEQ ID NO: 75135 - DNA, 43 bp, Homo sapiens
  misc_feature 1..43: note = chr12:69999350-69999393
  misc_feature 1..43: note = hypo
  source 1..43: mol_type = genomic DNA
atcacaattactggccgggcgcggtggctcacgcctgtaatcc

SEQ ID NO: 75136 - DNA, 30 bp, Homo sapiens; identical to SEQ ID NO: 43504
  misc_feature 1..30: note = chr12:70024017-70024047
  misc_feature 1..30: note = hypo
  source 1..30: mol_type = genomic DNA

SEQ ID NO: 75137 - DNA, 22 bp, Homo sapiens
  misc_feature 1..22: note = chr12:70030627-70030649
  misc_feature 1..22: note = hypo
  source 1..22: mol_type = genomic DNA
ccgcgcccggccccctcagact

SEQ ID NO: 75138 - DNA, 254 bp, Homo sapiens; identical to SEQ ID NO: 43505
  misc_feature 1..254: note = chr12:70087493-70087747
  misc_feature 1..254: note = hypo
  source 1..254: mol_type = genomic DNA

SEQ ID NO: 75139 - DNA, 41 bp, Homo sapiens
  misc_feature 1..41: note = chr12:70173234-70173275
  misc_feature 1..41: note = hypo
  source 1..41: mol_type = genomic DNA
ttattccctcttgaactccaattactcgaacattttctctt

SEQ ID NO: 75140 - DNA, 16 bp, Homo sapiens
  misc_feature 1..16: note = chr12:70651436-70651452
  misc_feature 1..16: note = hypo
  source 1..16: mol_type = genomic DNA
gcgcccggccccaact

SEQ ID NO: 75141 - DNA, 173 bp, Homo sapiens
  misc_feature 1..173: note = chr12:70760956-70761129
  misc_feature 1..173: note = hyper
  source 1..173: mol_type = genomic DNA
gaggagaccaggtggcgcaggctgtgctcaaaccaggaatgactacatcagggagccccagggctccggtcttttcaggtgggtttacgcgcggcgaccagtggtgcccagaggcttactttaaaacctgtcttgcctggtctcagattttgaggcctcgacccagtccgggt

SEQ ID NO: 75142 - DNA, 35 bp, Homo sapiens; identical to SEQ ID NO: 43307
  misc_feature 1..35: note = chr12:709027-709062
  misc_feature 1..35: note = hypo
  source 1..35: mol_type = genomic DNA

SEQ ID NO: 75143 - DNA, 87 bp, Homo sapiens
  misc_feature 1..87: note = chr12:70931093-70931180
  misc_feature 1..87: note = hypo
  source 1..87: mol_type = genomic DNA
aaatacagattcccaggccctgcctcagccctgatggatcagaatctgccttttcacaagatcctcagatggcgcagacatctttca

SEQ ID NO: 75144 - DNA, 568 bp, Homo sapiens
  misc_feature 1..568: note = chr12:71003477-71004045
  misc_feature 1..568: note = hyper
  source 1..568: mol_type = genomic DNA
tgggaatttggttttcggcggggagggggcgcatcagctctgaccccttctcgggccactcacctgcagcaggctcagtgtgatccacaaggccaacccggctccatggctcagcattgcgctcagtagttaagatccagaggagaccgagggggctggacgtgggacggcccgagggccggggcagggggtcacctgttgcgcgcgctcagcgcgccccgtgggcgcagcgcgcttccctcggggctggcgacgcgcaggggccactgcggccaccgctgctgctgctgctcctgccgccccgggcgggctgcggacgcgagaggcggcggggacaggcagcgcgccgcccttcccacgctgccattctgacccgcgctgcctcgccccagccccgtccgctgacttccgcaatcaaaaggcaatttcctcgtctcccggcaaaggaacaatgcgccggcgagggagggagccccgaggagccaacgcctgagcctgccaaggggcccgatgtgggccaagctgcccccgctgccccgcgccgataccttcccggccaggggtccgg

SEQ ID NO: 75145 - DNA, 244 bp, Homo sapiens
  misc_feature 1..244: note = chr12:71314368-71314612
  misc_feature 1..244: note = hyper
  source 1..244: mol_type = genomic DNA
agcagtaggaggttgcgggtaaggggaacagaagcgctcagaggcggcaaatgcctggccttctggacgcccagaagccaaggcggagacggcagggtggactccgcgccagcccagcagcccagcagcagcgccgcggctactgagcatgcccagcgccggccctcacgaggcaagggaatttcaaagtgaaattccgcttctccgggtcttagcggcggcttggagcagagtaggctccatc

SEQ ID NO: 75146 - DNA, 63 bp, Homo sapiens; identical to SEQ ID NO: 11324
  misc_feature 1..63: note = chr12:71314613-71314676
  misc_feature 1..63: note = hyper
  source 1..63: mol_type = genomic DNA

SEQ ID NO: 75147 - DNA, 171 bp, Homo sapiens
  misc_feature 1..171: note = chr12:71403294-71403465
  misc_feature 1..171: note = hyper
  source 1..171: mol_type = genomic DNA
cggagagaaagtgaccgtgaacaataaatgattagatagataggtaggtaggtagagaacaaaacgaggaaaaagaggaacagagggggagttgcgggggagagatgttatcagaggaaacagataagactaatgttttctctagaccttccaaaacgcagtcaagaagaa

SEQ ID NO: 75148 - DNA, 137 bp, Homo sapiens; identical to SEQ ID NO: 43507
  misc_feature 1..137: note = chr12:71626492-71626629
  misc_feature 1..137: note = hypo
  source 1..137: mol_type = genomic DNA

SEQ ID NO: 75149 - DNA, 30 bp, Homo sapiens; identical to SEQ ID NO: 34516
  misc_feature 1..30: note = chr12:71832897-71832927
  misc_feature 1..30: note = hyper
  source 1..30: mol_type = genomic DNA

SEQ ID NO: 75150 - DNA, 617 bp, Homo sapiens
  misc_feature 1..617: note = chr12:71833313-71833930
  misc_feature 1..617: note = hyper
  source 1..617: mol_type = genomic DNA
gggggtcccctattccggcgcgcggcgttgagcactgaatcttccaggcggaggctcagtgggagcgccgagaactcgccagtaccgcgcgctgcctgctgcctgctgcctcccagcccaggacttgggaaaggagggaggggacaagtggagggaaagtggggccgggcggggggtgcctgggaagccaggctgcgctgacgtcactgggcgcgcaattcgggctggagcgctttaaaaaacgagcgtgcaagcagagatgctgctccacaccgctcaggccgcgagcagcagcaaggcgcaccgccactgtcgccgctgcagccagggctgctccgaaggccggcgtggcggcaaccggcacctctgtccccgccgcgcttctcctcgccgcccacgccgtggggtcaggaacgcggcgtctggcgctgcagacgcccgctgagttgcagaagcccacggagcggcgcccggcgcgccacggcccgtagcagtccggtgctgctctccgcccgcgtccggctcgtggccccctacttcgggcaccatggacacctcccggctcggtgtgctcctgtccttgcctgtgctgctgcagctggcgaccgggggcagct

SEQ ID NO: 75151 - DNA, 152 bp, Homo sapiens
  misc_feature 1..152: note = chr12:71834137-71834289
  misc_feature 1..152: note = hyper
  source 1..152: mol_type = genomic DNA
aggctggaggctcctcggcgcccgcctgctcgtgggggaggggggcgagtttgtcaagggcatcctggccaggcctgttagggcccccagagaaatgcacgtgtctcggggagtagcgtgccggcactttctggacccgcagagaaatggct

SEQ ID NO: 75152 - DNA, 301 bp, Homo sapiens
  misc_feature 1..301: note = chr12:71834789-71835090
  misc_feature 1..301: note = hyper
  source 1..301: mol_type = genomic DNA
aaccatctcttcccccggggaggaaaggggaagtgggctgaaggctgttgggctggtaaacagcggcaccgacacccaaagggagacctgaagctctctatcatccctgggggattctcccaccccttctctccccactgcaacttccaaagccctgaggcggcggctcattgcgtaattttttctgtggaaaacccaggcccgaaggtaacaggtagttgggtgaacgcggtgacccaggaggaaccctattctcggagaccaaggcgactactctctccacccccgtgcaaagcatctg

SEQ ID NO: 75153 - DNA, 37 bp, Homo sapiens; identical to SEQ ID NO: 43508
  misc_feature 1..37: note = chr12:72054795-72054832
  misc_feature 1..37: note = hypo
  source 1..37: mol_type = genomic DNA

SEQ ID NO: 75154 - DNA, 18 bp, Homo sapiens
  misc_feature 1..18: note = chr12:72077594-72077612
  misc_feature 1..18: note = hypo
  source 1..18: mol_type = genomic DNA
gatatgctagataaacgg

SEQ ID NO: 75155 - DNA, 30 bp, Homo sapiens
  misc_feature 1..30: note = chr12:72165406-72165436
  misc_feature 1..30: note = hypo
  source 1..30: mol_type = genomic DNA
gttatctccctctcgcgttttgcatgaaaa

SEQ ID NO: 75156 - DNA, 30 bp, Homo sapiens
  misc_feature 1..30: note = chr12:72232195-72232225
  misc_feature 1..30: note = hypo
  source 1..30: mol_type = genomic DNA
actctccttttctgtcgttcagctagttgc

SEQ ID NO: 75157 - DNA, 55 bp, Homo sapiens; identical to SEQ ID NO: 34519
  misc_feature 1..55: note = chr12:72332641-72332696
  misc_feature 1..55: note = hyper
  source 1..55: mol_type = genomic DNA

SEQ ID NO: 75158 - DNA, 90 bp, Homo sapiens
  misc_feature 1..90: note = chr12:7249312-7249402
  misc_feature 1..90: note = hypo
  source 1..90: mol_type = genomic DNA
tgccaaacccactgacgtagcccaacaagccgctgcggtagagggtctcattatcgggcagacagaccgggaggacgttggggcccaggg

SEQ ID NO: 75159 - DNA, 87 bp, Homo sapiens
  misc_feature 1..87: note = chr12:72634614-72634701
  misc_feature 1..87: note = hypo
  source 1..87: mol_type = genomic DNA
gtgctgggattacaggcatgagccaccgcgcctggcctctccaatcaattttaaaaaataaacaaatttatccgggcattatttttt

SEQ ID NO: 75160 - DNA, 160 bp, Homo sapiens; identical to SEQ ID NO: 34520
  misc_feature 1..160: note = chr12:72665266-72665426
  misc_feature 1..160: note = hyper
  source 1..160: mol_type = genomic DNA

SEQ ID NO: 75161 - DNA, 103 bp, Homo sapiens
  misc_feature 1..103: note = chr12:72665668-72665771
  misc_feature 1..103: note = hyper
  source 1..103: mol_type = genomic DNA
ggaatgagggagtctcgctgtcgggtctgcaacctcctgccgtttgccgccaccgccgcttaaagtgcccagggtggagaaggcttttccaggacggatctcc

SEQ ID NO: 75162 - DNA, 260 bp, Homo sapiens
  misc_feature 1..260: note = chr12:72665772-72666032
  misc_feature 1..260: note = hyper
  source 1..260: mol_type = genomic DNA
tcgtagcttcgcggccctgggacttcctcctgctggttcactctagtctctcccacctcggccatccttttctctccagctgcagggtgtatggctcgggtgcctcccgtgctgtggccgccgtcactgctgctgcgagcacattccacccagaggaccgaacgccgccgctggagtggggggagaaagcgaaagccctaacttccctctctacaccctcgctcttcccaccgctcccgtccttctccctagccgagaac

SEQ ID NO: 75163 - DNA, 123 bp, Homo sapiens
  misc_feature 1..123: note = chr12:72666342-72666465
  misc_feature 1..123: note = hyper
  source 1..123: mol_type = genomic DNA
gatgcctgctctggctgtggcccgggtggcccgcccgcggggggtgccagagggggcgggggaggaggaggaggcggtgtgatggccctggacggcgagctgggggagcaagaggaggagaag

SEQ ID NO: 75164 - DNA, 283 bp, Homo sapiens
  misc_feature 1..283: note = chr12:72666525-72666808
  misc_feature 1..283: note = hyper
  source 1..283: mol_type = genomic DNA
gccgagaagagcagctcacccttcgcagccgcgatgggggaagacgacgccgcgcttcgggctggcagcagggggctctccgacccgtgggcagactcagtgggagtgcgaccccgcaccacggagcgccacatcgccgtacacaagcggcttgtgctggccttcgctgtgtccctcgtggcattgctcgcggtcacaatgctcgctgtgctgctcagcctgcgcttcgacgagtgcggggcgagtgccacgccaggcgccgacggtggcccctcaggctttc

SEQ ID NO: 75165 - DNA, 389 bp, Homo sapiens; identical to SEQ ID NO: 3915
  misc_feature 1..389: note = chr12:72666997-72667386
  misc_feature 1..389: note = hyper
  source 1..389: mol_type = genomic DNA

SEQ ID NO: 75166 - DNA, 295 bp, Homo sapiens
  misc_feature 1..295: note = chr12:72667387-72667682
  misc_feature 1..295: note = hyper
  source 1..295: mol_type = genomic DNA
aacctctgggcggcctgcgaccccggggacccagctggcttccaatacccgggaagccaggggtggggggaaggaaacgaaagcggagtagggcagtcagaactccggggtctcccagatgcctcggggtctcgctgccgccaacttcgcaaactgactcaccggtgccaaaagatgaatgctgccccctcctctagtcgggacctctcctcttcctgtcagagttccttagccatcgaaacgcagggctctttttctgaagggtagctgataatctgagcgatgccagagtgac

SEQ ID NO: 75167 - DNA, 23 bp, Homo sapiens
  misc_feature 1..23: note = chr12:73732465-73732488
  misc_feature 1..23: note = hypo
  source 1..23: mol_type = genomic DNA
actgcgcccggccatttactggt

SEQ ID NO: 75168 - DNA, 30 bp, Homo sapiens; identical to SEQ ID NO: 43512
  misc_feature 1..30: note = chr12:74092079-74092109
  misc_feature 1..30: note = hypo
  source 1..30: mol_type = genomic DNA

SEQ ID NO: 75169 - DNA, 16 bp, Homo sapiens
  misc_feature 1..16: note = chr12:7462672-7462688
  misc_feature 1..16: note = hypo
  source 1..16: mol_type = genomic DNA
gcgcctggcaggagac

SEQ ID NO: 75170 - DNA, 36 bp, Homo sapiens
  misc_feature 1..36: note = chr12:74930406-74930442
  misc_feature 1..36: note = hypo
  source 1..36: mol_type = genomic DNA
catgtaaggcactgtcgcaagatttttaaaaatata

SEQ ID NO: 75171 - DNA, 95 bp, Homo sapiens
  misc_feature 1..95: note = chr12:752339-752434
  misc_feature 1..95: note = hyper
  source 1..95: mol_type = genomic DNA
tccagcaggggccaccgagggctccaggagcaccccaggcccgttcttctggcccacagcgcccctcctgtgaccctcagcgaccctcctgtcct

SEQ ID NO: 75172 - DNA, 30 bp, Homo sapiens
  misc_feature 1..30: note = chr12:75518961-75518991
  misc_feature 1..30: note = hypo
  source 1..30: mol_type = genomic DNA
tgacacatgttctaccgtgactgggaataa

SEQ ID NO: 75173 - DNA, 201 bp, Homo sapiens
  misc_feature 1..201: note = chr12:7559133-7559334
  misc_feature 1..201: note = hypo
  source 1..201: mol_type = genomic DNA
agatcacagacacatcgttttgatgaagacagtcaaaattgacggttccggaatgtctgcagtcccaaagaaaagattcattaccggagcaggagacaccatcaagccatacaacatcagaccctgactgcaaatgaggcaagccagcgaagtgaagtgcggttccacatcccaactgcttgcatacgacatcagctgcag

SEQ ID NO: 75174 - DNA, 60 bp, Homo sapiens
  misc_feature 1..60: note = chr12:75601171-75601231
  misc_feature 1..60: note = hyper
  source 1..60: mol_type = genomic DNA
gccccgccgcgtcctcgatgcccagcctcttggccgccaggtcctcgtcgtcgccggggt

SEQ ID NO: 75175 - DNA, 122 bp, Homo sapiens; identical to SEQ ID NO: 34528
  misc_feature 1..122: note = chr12:75601378-75601500
  misc_feature 1..122: note = hyper
  source 1..122: mol_type = genomic DNA

SEQ ID NO: 75176 - DNA, 361 bp, Homo sapiens
  misc_feature 1..361: note = chr12:75601695-75602056
  misc_feature 1..361: note = hyper
  source 1..361: mol_type = genomic DNA
cggtaggtttcgtgccgggtgcccccgacattgaggatcaccctctcgttgttctcgatcttgcccatctctgtgactcagacatgactagggggaggcaaacacagcgccgagttaaagatcttagccgtcaaagacacaccatgacccccaccaccaacccagagcgagtccagggatgcagagttggcagacaggcacggggcaaagaccctccccgggaggggatcagcgtccagcgctgtccccgcctcttgcatcaaacctttcccaggtttccagagaactacagagatagcagtcctagtctttcttgacctttcatgacaccgttttccctgcctcccgctttcctttcttt

SEQ ID NO: 75177 - DNA, 619 bp, Homo sapiens; identical to SEQ ID NO: 34530
  misc_feature 1..619: note = chr12:75602875-75603494
  misc_feature 1..619: note = hyper
  source 1..619: mol_type = genomic DNA

SEQ ID NO: 75178 - DNA, 426 bp, Homo sapiens
  misc_feature 1..426: note = chr12:75728077-75728503
  misc_feature 1..426: note = hyper
  source 1..426: mol_type = genomic DNA
tatacacggaagctgcgtctaagaaacgaatatatagtgctttgcactcgactggcccattgtcagcatcccgcacttgttctttacctaacttgtgtggcttgcatattgcaatctgtattacaatccagacgcgctctgcagattacagattggatccacagaaagcagtttggatggttgaaattccctccaccagagggcgactcagagctttcccctgtagctcagagctttgtggaaggggaaccctgctgcctgttcttccccacagcgacactgacaagttgatccagccgcgctgggctcgagcctgtgcggcaggatggagccaagggagagcgtggtgcgggggcgtggggaaatcgggttgccccagccgttactggtccgcgcagtcagggcatcctccgcatcctccacatc

SEQ ID NO: 75179 - DNA, 60 bp, Homo sapiens
  misc_feature 1..60: note = chr12:76742449-76742509
  misc_feature 1..60: note = hyper
  source 1..60: mol_type = genomic DNA
atctccctccagtggcgtccgctgcccccaaatcccttagtctcccgagaaactttcttc

SEQ ID NO: 75180 - DNA, 53 bp, Homo sapiens
  misc_feature 1..53: note = chr12:76807087-76807140
  misc_feature 1..53: note = hypo
  source 1..53: mol_type = genomic DNA
ataattatttactagcgtgtcacagcaggtacttcattcgttttcactgctga

SEQ ID NO: 75181 - DNA, 29 bp, Homo sapiens
  misc_feature 1..29: note = chr12:76848726-76848755
  misc_feature 1..29: note = hypo
  source 1..29: mol_type = genomic DNA
agcagaggccgggcgcggtggctcaagcc

SEQ ID NO: 75182 - DNA, 94 bp, Homo sapiens
  misc_feature 1..94: note = chr12:77085821-77085915
  misc_feature 1..94: note = hypo
  source 1..94: mol_type = genomic DNA
aggcatgtaaataaacgaccactgggtgaggcagaaaaagtgtactgagtgtgtaacgccaaaggttcttttgtttgtttgttttttgtttttt

SEQ ID NO: 75183 - DNA, 30 bp, Homo sapiens; identical to SEQ ID NO: 15677
  misc_feature 1..30: note = chr12:77150018-77150048
  misc_feature 1..30: note = hypo
  source 1..30: mol_type = genomic DNA

SEQ ID NO: 75184 - DNA, 36 bp, Homo sapiens
  misc_feature 1..36: note = chr12:77436981-77437017
  misc_feature 1..36: note = hypo
  source 1..36: mol_type = genomic DNA
tgaagatataaaacacgattacggtcatgctgcctg

SEQ ID NO: 75185 - DNA, 81 bp, Homo sapiens; identical to SEQ ID NO: 43352
  misc_feature 1..81: note = chr12:7767211-7767292
  misc_feature 1..81: note = hypo
  source 1..81: mol_type = genomic DNA

SEQ ID NO: 75186 - DNA, 36 bp, Homo sapiens
  misc_feature 1..36: note = chr12:77718450-77718486
  misc_feature 1..36: note = hyper
  source 1..36: mol_type = genomic DNA
aggcgctcctcccgccgttcccgcaggaaacttttc

SEQ ID NO: 75187 - DNA, 342 bp, Homo sapiens
  misc_feature 1..342: note = chr12:77719271-77719613
  misc_feature 1..342: note = hyper
  source 1..342: mol_type = genomic DNA
gggggtgcggggggacgtcggggatgggggtggccagcgcggtcctgggagtggcgggttcggatgggctggctgcggtgggccactttgggcatctcggcgtggcctgcgccggggtcacggggagggctgtcagcgccagggcggcggaacccgaggtctccagacgagtgagggagggatgcaggcttgggggtgatggagcgcttggctggtggctggtgagcgtccatacatcatagctctccttcccactcccccgcccctcttcgggattctctctttctctttccccgtcctcatttctttcttcctttactcaccactcgcttcattctcttc

SEQ ID NO: 75188 - DNA, 24 bp, Homo sapiens
  misc_feature 1..24: note = chr12:7840950-7840974
  misc_feature 1..24: note = hypo
  source 1..24: mol_type = genomic DNA
ctaactagggctaggcgcagtggc

SEQ ID NO: 75189 - DNA, 21 bp, Homo sapiens
  misc_feature 1..21: note = chr12:7844734-7844755
  misc_feature 1..21: note = hypo
  source 1..21: mol_type = genomic DNA
gtcaatagactgggccgggac

SEQ ID NO: 75190 - DNA, 30 bp, Homo sapiens
  misc_feature 1..30: note = chr12:7854770-7854800
  misc_feature 1..30: note = hypo
  source 1..30: mol_type = genomic DNA
ttgaatagaatttgccgagggtacatacaa

SEQ ID NO: 75191 - DNA, 105 bp, Homo sapiens
  misc_feature 1..105: note = chr12:7864790-7864895
  misc_feature 1..105: note = hypo
  source 1..105: mol_type = genomic DNA
ttgagccactgcgcccggccagtacttcagatttctaagaccagtttctggggataaataattggaatcacagaacgcggctcgtagcgtcgttgcatcagtatc

SEQ ID NO: 75192 - DNA, 17 bp, Homo sapiens
  misc_feature 1..17: note = chr12:7896250-7896267
  misc_feature 1..17: note = hypo
  source 1..17: mol_type = genomic DNA
cccggccttaattcttt

SEQ ID NO: 75193 - DNA, 120 bp, Homo sapiens
  misc_feature 1..120: note = chr12:7919057-7919177
  misc_feature 1..120: note = hypo
  source 1..120: mol_type = genomic DNA
gactccgtctcaacaaaacaaaacagcaaacaaacaaaacaaaacaaacccactatctcaccaccacgatacccttaaaagaaaatggggatgggaaattggccatttgatttcttttct

SEQ ID NO: 75194 - DNA, 34 bp, Homo sapiens
  misc_feature 1..34: note = chr12:79198065-79198099
  misc_feature 1..34: note = hypo
  source 1..34: mol_type = genomic DNA
gggttacccatagcacgtccgggttacccataga

SEQ ID NO: 75195 - DNA, 205 bp, Homo sapiens
  misc_feature 1..205: note = chr12:7921501-7921706
  misc_feature 1..205: note = hypo
  source 1..205: mol_type = genomic DNA
ataggcatgagccaccacgccgggccttgttactggcatttttagatgtaattaaaatccatattaatcgtcttcaagtaaaagggattataatctgagaaagcctaatccaatcagttaaggctttaagaggaaattctgcctagggagagcagctccatcgcacactgaagggttccagccatcctttcggacttgccaagac

SEQ ID NO: 75196 - DNA, 288 bp, Homo sapiens
  misc_feature 1..288: note = chr12:79257222-79257510
  misc_feature 1..288: note = hyper
  source 1..288: mol_type = genomic DNA
tcaaaggcctttaaacgaggttgagggagggagaaagggaaatagttctctccgttttgaaatcctttcacctgtggagcagataatggacgggcccctctcccagctgggctccgctcccgcccctagcctggcgcgcggtcccttcccccacccgctgagccttcctgttcggtatttcggtattaccaagctataaattgcctgagagcttagagacaatcaggtcaccaccgccctcacaagagaaaagcttcttacttccgagcagaacggttcagctgggaa

SEQ ID NO: 75197 - DNA, 383 bp, Homo sapiens
  misc_feature 1..383: note = chr12:79257714-79258097
  misc_feature 1..383: note = hyper
  source 1..383: mol_type = genomic DNA
gctgatgggtggagtcgcgctcccggccccacctatgggacggagctgcttctcccgcatctcggctccaccgcacccttcgcgggaagtccccaggcttccagcaaagctcagcttatcccgcccccgcttccaacccggaaccccagaagaacagcatgatgagcctccggcagccaggtgggccacctccccgcggctcagtttgaggacacttgtgcggaaccctttcacatccccaccctacccagctttcacaactccgccgggttaaatggccaaagacaaacttctacctctcctgtccccggtcccagcttttcaaaaacccacagctggcgaacccacacacatcgaaactcctaggtcgctgttgcagtctg

SEQ ID NO: 75198 - DNA, 141 bp, Homo sapiens; identical to SEQ ID NO: 34535
  misc_feature 1..141: note = chr12:79258297-79258438
  misc_feature 1..141: note = hyper
  source 1..141: mol_type = genomic DNA

SEQ ID NO: 75199 - DNA, 440 bp, Homo sapiens
  misc_feature 1..440: note = chr12:79258439-79258879
  misc_feature 1..440: note = hyper
  source 1..440: mol_type = genomic DNA
aggtggagccaatcaggatgctggggctcggagatgatgggcggccgcctcctcactggagggattcctggagaagctgcagtgtggggatgctctagaccgagtactgcccccagtgtctttccacctcctcctgcagcagcggcagcggcagcagcagttagcagcggcaacttgaggctgcaccccgggcaagtccccagggtggtgctcagccgagaggggggcttggcgccccgaaggggtgtgtgtagggtgggggcgaccacgtgggaccagctggtggccctggaaaacctcccacacacccacacccacacaccccttttgtgttgcaggctgcccctccaagagcggaggcagcgagagtacgcgtgtgcctcgcgccggtccacgcggggagagcactggggaccgagacccggcaccacctcccggtc

SEQ ID NO: 75200 - DNA, 134 bp, Homo sapiens
  misc_feature 1..134: note = chr12:79258965-79259099
  misc_feature 1..134: note = hyper
  source 1..134: mol_type = genomic DNA
cgatacacttgggttttagtggtgggagtctgagacctagggagggatccccgggtggcctattgtgagaaatatgagactacatgtgcatctcctggaaaagcactttgcacagcgcccgtgatttagagcct

SEQ ID NO: 75201 - DNA, 43 bp, Homo sapiens; identical to SEQ ID NO: 43355
  misc_feature 1..43: note = chr12:7960433-7960476
  misc_feature 1..43: note = hypo
  source 1..43: mol_type = genomic DNA

SEQ ID NO: 75202 - DNA, 94 bp, Homo sapiens
  misc_feature 1..94: note = chr12:7963239-7963333
  misc_feature 1..94: note = hypo
  source 1..94: mol_type = genomic DNA
tcaggaggctgaagccggacagttgcttgagcccaggagaatagcccgggcaatacagtgatatcctgttcccctcctccgataaaaaacaatt

SEQ ID NO: 75203 - DNA, 80 bp, Homo sapiens
  misc_feature 1..80: note = chr12:7963796-7963876
  misc_feature 1..80: note = hypo
  source 1..80: mol_type = genomic DNA
gggattacaggtgtgagccactgcgcccggccgaaggattttaagtaggatagtgatatacagtccgacttctgtatctg

SEQ ID NO: 75204 - DNA, 18 bp, Homo sapiens
  misc_feature 1..18: note = chr12:7973388-7973406
  misc_feature 1..18: note = hypo
  source 1..18: mol_type = genomic DNA
aattaaacaacagtccgg

SEQ ID NO: 75205 - DNA, 30 bp, Homo sapiens; identical to SEQ ID NO: 43358
  misc_feature 1..30: note = chr12:7980007-7980037
  misc_feature 1..30: note = hypo
  source 1..30: mol_type = genomic DNA

SEQ ID NO: 75206 - DNA, 85 bp, Homo sapiens
  misc_feature 1..85: note = chr12:7981128-7981213
  misc_feature 1..85: note = hypo
  source 1..85: mol_type = genomic DNA
catgagattctgtctcaaaaaaagaaaaaacaaagtagagtaatcagaaccatcttcacttggattctgacgggcagggaaaggg

SEQ ID NO: 75207 - DNA, 30 bp, Homo sapiens
  misc_feature 1..30: note = chr12:7984193-7984223
  misc_feature 1..30: note = hypo
  source 1..30: mol_type = genomic DNA
caatacctgccaaagcggttaacaaagagt

SEQ ID NO: 75208 - DNA, 30 bp, Homo sapiens; identical to SEQ ID NO: 43516
  misc_feature 1..30: note = chr12:79842607-79842637
  misc_feature 1..30: note = hypo
  source 1..30: mol_type = genomic DNA

SEQ ID NO: 75209 - DNA, 30 bp, Homo sapiens; identical to SEQ ID NO: 43359
  misc_feature 1..30: note = chr12:7986413-7986443
  misc_feature 1..30: note = hypo
  source 1..30: mol_type = genomic DNA

SEQ ID NO: 75210 - DNA, 30 bp, Homo sapiens
  misc_feature 1..30: note = chr12:7998024-7998054
  misc_feature 1..30: note = hypo
  source 1..30: mol_type = genomic DNA
actcaaattgtggtccggggaccagcaaca

SEQ ID NO: 75211 - DNA, 38 bp, Homo sapiens
  misc_feature 1..38: note = chr12:8001679-8001717
  misc_feature 1..38: note = hypo
  source 1..38: mol_type = genomic DNA
cctcagggtagtcagcccacctccgtctcccaaagtgc

SEQ ID NO: 75212 - DNA, 38 bp, Homo sapiens
  misc_feature 1..38: note = chr12:8009448-8009486
  misc_feature 1..38: note = hypo
  source 1..38: mol_type = genomic DNA
tttgagacagagtctcgccctgtcgctcaggttggaat

SEQ ID NO: 75213 - DNA, 275 bp, Homo sapiens
  misc_feature 1..275: note = chr12:8023505-8023780
  misc_feature 1..275: note = hypo
  source 1..275: mol_type = genomic DNA
cacatccaatgtcttcgtgatgttcgaccagttccacatccaggagtttaaggaggctttcaacatgattgaccagaaccatgatggcttcaatgacaagggggacagcacgacaagctggcttcaccgcggaagaaccccatggatgaatacctgcagggcatgatgagcgaggccccagggcccatcaacttcaccacttccctcaccatgtttggggagaagctgaatggaacagacccccaggatgtgatccaaaacgccttcacctgctt

SEQ ID NO: 75214 - DNA, 96 bp, Homo sapiens; identical to SEQ ID NO: 43517
  misc_feature 1..96: note = chr12:80488160-80488256
  misc_feature 1..96: note = hypo
  source 1..96: mol_type = genomic DNA

SEQ ID NO: 75215 - DNA, 30 bp, Homo sapiens
  misc_feature 1..30: note = chr12:8050118-8050148
  misc_feature 1..30: note = hypo
  source 1..30: mol_type = genomic DNA
gcccttattttgtatcgaaaatgttcattt

SEQ ID NO: 75216 - DNA, 30 bp, Homo sapiens
  misc_feature 1..30: note = chr12:8063011-8063041
  misc_feature 1..30: note = hypo
  source 1..30: mol_type = genomic DNA
gataaacaggctgggcgcggtggctcacgc

SEQ ID NO: 75217 - DNA, 20 bp, Homo sapiens
  misc_feature 1..20: note = chr12:8074494-8074514
  misc_feature 1..20: note = hypo
  source 1..20: mol_type = genomic DNA
tctgtgtttctgggccgagt

SEQ ID NO: 75218 - DNA, 226 bp, Homo sapiens
  misc_feature 1..226: note = chr12:8088725-8088951
  misc_feature 1..226: note = hyper
  source 1..226: mol_type = genomic DNA
agcaagttttctccacgtcctcaggaaggatccaaagtcttaccattacagcatctctgggtctcgctgggatcatgactatttataatctccgcaaagggtggagcctgaaagggcgacaagcccccagccccaccccaccccaccccacccccctgaagcaatcttgtgatctctcggaattctgtgttatcagaactacccccgcccccgccccacagacaat

SEQ ID NO: 75219 - DNA, 297 bp, Homo sapiens
  misc_feature 1..297: note = chr12:81102159-81102456
  misc_feature 1..297: note = hyper
  source 1..297: mol_type = genomic DNA
gtgacccaagaagaccgggtgcttgcaataggcaggaaatgcgtacccggcccgaggaagcaggaaagccgccccccaccccaccccaaccccggaaccgatgtttctttcctaatctgccgctgccttggttttccctccagcttgagggtgcggatttcctgcgcacctgcagctcccagtggccaagtgtttccgatcattccagggggctcgtgataacggctaaggaaggtaaagtaaaagggctctgggccgcaccagagaaaatccgggaggtggataggatgcttgggc

SEQ ID NO: 75220 - DNA, 29 bp, Homo sapiens
  misc_feature 1..29: note = chr12:81107996-81108025
  misc_feature 1..29: note = hyper
  source 1..29: mol_type = genomic DNA
cgcttgtgttttctcggcttctttagttc

SEQ ID NO: 75221 - DNA, 96 bp, Homo sapiens; identical to SEQ ID NO: 43361
  misc_feature 1..96: note = chr12:8117682-8117778
  misc_feature 1..96: note = hypo
  source 1..96: mol_type = genomic DNA

SEQ ID NO: 75222 - DNA, 18 bp, Homo sapiens
  misc_feature 1..18: note = chr12:8122686-8122704
  misc_feature 1..18: note = hypo
  source 1..18: mol_type = genomic DNA
gcccgaactacaattctt

SEQ ID NO: 75223 - DNA, 375 bp, Homo sapiens
  misc_feature 1..375: note = chr12:8123153-8123528
  misc_feature 1..375: note = hyper
  source 1..375: mol_type = genomic DNA
ctttcttgcactcgtctttatcttctaagccctccacatgcttttaaactgtcagtcttttcatttttatttcttcctcttggacgcatttacccaaattggcccgagggaggctgagacagcagatacgaaagaaaaatgtgtgtatgcgtgagtctttgggtggcgaagaaggaggaggaggaatgtagctcggggctcggcccccgtgctgggattccgagggcgggggacaggatgcgcgcgcggcgggtagcgtgccacacggcacgtcccggccgctgcaggaaggcggggctcaggtcccgccgactcccacatgctgggggacaccgggagcgcctcccactcccagcccgccggagagccttgcaa

SEQ ID NO: 75224 - DNA, 22 bp, Homo sapiens
  misc_feature 1..22: note = chr12:8127118-8127140
  misc_feature 1..22: note = hypo
  source 1..22: mol_type = genomic DNA
ccgtgcccggccaaggtcataa

SEQ ID NO: 75225 - DNA, 134 bp, Homo sapiens
  misc_feature 1..134: note = chr12:81330218-81330352
  misc_feature 1..134: note = hyper
  source 1..134: mol_type = genomic DNA
ttttgccttgcccatcgttcagtttaatcctctagaaagaaaatttttagaggtacatcggactaaatcattttcttctgagtacaccatttccaaatggccgcccagggtcctaaatccggcggctgcggaga

SEQ ID NO: 75226 - DNA, 582 bp, Homo sapiens
  misc_feature 1..582: note = chr12:81330737-81331319
  misc_feature 1..582: note = hyper
  source 1..582: mol_type = genomic DNA
agcagacgcgaccctcgccgctttcgatctcgaagccgcggagagccgatctcggctgctggggctcggctccccgcgctctgccttgccctttcggcagagggcagctccctgcctgctgcagccccgccactgtgcgcccggcagcccaggggtgcgcccagcccgccccccgagtggccgccgggactccagcagttggaccgaccctcgccctccggcgcctggacaaacttccttcctcccgggcccctgcgccaagcaagctgacaggcggctccctcgccggtctcctctgggctctggccgggcgagcttgctctctgcccctctccaaccccgagcccctggcgcctatagccgtccccgcgcagcggctccaacaaagccagaggaccggagacgacccggcgaggggctgggagtggcagcggggaccccagagccagaaggaggcgtcccctcggcggggcgagtacagtgggaaggggcagcgggaacgtagcggggagagaaaggggaagaaagtgttctgttctcggcgcgaacgccttcctggctcgtcctcgttccccttctcct

SEQ ID NO: 75227 - DNA, 246 bp, Homo sapiens
  misc_feature 1..246: note = chr12:81331631-81331877
  misc_feature 1..246: note = hyper
  source 1..246: mol_type = genomic DNA
gtagccagatggagacgcaactgttccgcggcggcagatcttcagttgcggtgcggagctgagcaggtatccgagagcgactgcatcgccgggctctgggagggaaggctctgccctagaactttgctattccacccccaggagcgctgggtgggtgtagctggcgggttgcttcctttcaactttccactctaataaaatggtcagaatatacgtgtgtgcatgcgggtgcgtgtgtgtataagg

SEQ ID NO: 75228 - DNA, 160 bp, Homo sapiens; identical to SEQ ID NO: 34541
  misc_feature 1..160: note = chr12:81471455-81471615
  misc_feature 1..160: note = hyper
  source 1..160: mol_type = genomic DNA

SEQ ID NO: 75229 - DNA, 379 bp, Homo sapiens
  misc_feature 1..379: note = chr12:81471753-81472132
  misc_feature 1..379: note = hyper
  source 1..379: mol_type = genomic DNA
cggcgactctagtgtggcttccaaacttctgggctctgggctcacttcggaatttgcccccgccccctactcccttccctcaggccccaggaagttgcaagagtaccatttgtcgcacactcggggaccgcgggtggccggaggagatgaaaccgtcttggctgcagtgtcgtaaagtcaccagcgccggggggctcggagggcccttgcctgggtcctctccggcccggggagccggtgcggccctcagggctttagtggtcccgggcccgcggggcggtctcgggggccggggatgcagggcactgtcctccggcagtggcagcgagtacaagacccacttcgcagcctcggtgaccgaccccgagaggttctgggg

SEQ ID NO: 75230 - DNA, 24 bp, Homo sapiens
  misc_feature 1..24: note = chr12:8148633-8148657
  misc_feature 1..24: note = hypo
  source 1..24: mol_type = genomic DNA
tataataaatgggctcggctgggt

SEQ ID NO: 75231 - DNA, 90 bp, Homo sapiens
  misc_feature 1..90: note = chr12:8165031-8165121
  misc_feature 1..90: note = hypo
  source 1..90: mol_type = genomic DNA
cagaacaaaacacacaaacaaaaaaaacaagtaacttcaggtcttaagtagtaagatctaattgttaaataagtacgggaggcacagcca

SEQ ID NO: 75232 - DNA, 145 bp, Homo sapiens
  misc_feature 1..145: note = chr12:8168130-8168275
  misc_feature 1..145: note = hypo
  source 1..145: mol_type = genomic DNA
tacaacttctgcaaacggagacaaagaaattggcaatatcatctccaatgcaatgaaaaaggttggaagaaagggtgtcatcacagtaaaggatggaaaaacactgaatgatgaattagaaattattgaaagtggctgggcgagg

SEQ ID NO: 75233 - DNA, 205 bp, Homo sapiens
  misc_feature 1..205: note = chr12:8170311-8170516
  misc_feature 1..205: note = hypo
  source 1..205: mol_type = genomic DNA
tccatctgaaagtttcgccagctgttcattcagtttttgcttttcatattcactagttgtgacatctaactgctcaatgacttctcaaatacgtttttcaatttgagccttattaccttttccttttaagagcatggcatcggctgggcgcggtggacttgtcagaagttttcaggagttttgctcttgttgcccaggctggagt

SEQ ID NO: 75234 - DNA, 592 bp, Homo sapiens; identical to SEQ ID NO: 34242
  misc_feature 1..592: note = chr12:8171294-8171886
  misc_feature 1..592: note = hyper
  source 1..592: mol_type = genomic DNA

SEQ ID NO: 75235 - DNA, 37 bp, Homo sapiens
  misc_feature 1..37: note = chr12:82032738-82032775
  misc_feature 1..37: note = hypo
  source 1..37: mol_type = genomic DNA
tacaggcgtgagccaccgcgcccggcctgttttgtca

SEQ ID NO: 75236 - DNA, 30 bp, Homo sapiens
  misc_feature 1..30: note = chr12:8214437-8214467
  misc_feature 1..30: note = hypo
  source 1..30: mol_type = genomic DNA
tgtttaccatattcacgttgtacaaccaat

SEQ ID NO: 75237 - DNA, 93 bp, Homo sapiens
  misc_feature 1..93: note = chr12:82152505-82152598
  misc_feature 1..93: note = hyper
  source 1..93: mol_type = genomic DNA
ggctcttaaagcagccgcggcccctttgccagaacagccgcagctccccgcgtgcagctggagccccggggcggagaccggagaccggggact

SEQ ID NO: 75238 - DNA, 263 bp, Homo sapiens
  misc_feature 1..263: note = chr12:82152992-82153255
  misc_feature 1..263: note = hyper
  source 1..263: mol_type = genomic DNA
ccatttttctcctcccggcctttctgcaagcctctttgcttgcttcaattggccggaagaaccaacctgctggcagccggtgaggacgctacagcatcttctctcctcacttgcctcgtgcggtggctgctactcctcctcctccgtctcctcccctcctcctccttggcagccaccacctcctcttcctctggaacaagggcttcccctggaagctgctgcagtggtttccaccggcccttaaataaattctgaagtaatca

SEQ ID NO: 75239 - DNA, 195 bp, Homo sapiens; identical to SEQ ID NO: 34545
  misc_feature 1..195: note = chr12:82153283-82153478
  misc_feature 1..195: note = hyper
  source 1..195: mol_type = genomic DNA

SEQ ID NO: 75240 - DNA, 30 bp, Homo sapiens
  misc_feature 1..30: note = chr12:8298283-8298313
  misc_feature 1..30: note = hypo
  source 1..30: mol_type = genomic DNA
ttccaccaagaaggacgaaaatggcgaatg

SEQ ID NO: 75241 - DNA, 162 bp, Homo sapiens
  misc_feature 1..162: note = chr12:8322370-8322532
  misc_feature 1..162: note = hypo
  source 1..162: mol_type = genomic DNA
gtgtgtctaaatagccgtgaaagggctaggaggtcacaagtcggcctcttaatttttacagttgccgttaaaacattaaggtaatattgagggtgcagaatggctccttcctcatgactttttaacagatctgggccgggcacggtggctcacgcctgtaat

SEQ ID NO: 75242 - DNA, 125 bp, Homo sapiens
  misc_feature 1..125: note = chr12:8386013-8386138
  misc_feature 1..125: note = hypo
  source 1..125: mol_type = genomic DNA
ctgtgcgaggttgtgcgggactctgtcatggaacccagtatgccttcatgtgctggcttgtttgttgactctgtagttaacgggctgccccacgtgggcaggtactgggtcgtctgtgtctctgt

SEQ ID NO: 75243 - DNA, 30 bp, Homo sapiens
  misc_feature 1..30: note = chr12:8388556-8388586
  misc_feature 1..30: note = hypo
  source 1..30: mol_type = genomic DNA
acattcctgagacaacggaattctggcgat

SEQ ID NO: 75244 - DNA, 30 bp, Homo sapiens
  misc_feature 1..30: note = chr12:84953382-84953412
  misc_feature 1..30: note = hypo
  source 1..30: mol_type = genomic DNA
ttttcctctcaaaaccgactaggagtacca

SEQ ID NO: 75245 - DNA, 191 bp, Homo sapiens; identical to SEQ ID NO: 11344
  misc_feature 1..191: note = chr12:85305054-85305245
  misc_feature 1..191: note = hyper
  source 1..191: mol_type = genomic DNA

SEQ ID NO: 75246 - DNA, 323 bp, Homo sapiens
  misc_feature 1..323: note = chr12:85305657-85305980
  misc_feature 1..323: note = hyper
  source 1..323: mol_type = genomic DNA
cagccacgtgcctttcgtacggcgaaaggccccctttcgggccatttatcacaggatacctcaagcaaaggggaactgtggtcacgtgaaaacactctgtcctcggtagtcgccttctgcctttgctaaagcgaacggaagcgaatgaggaataaagctctctgctctccccgccccatcgcccacctgcacgaggtttagcttccaattcacctcgcgtctctctctgccccaaccctcccaactttcctcttggactttcccgtgttggaccccacccttcaaccaaccccgacttggcttggaaacgagtaggtctctgg

SEQ ID NO: 75247 - DNA, 48 bp, Homo sapiens
  misc_feature 1..48: note = chr12:85306234-85306282
  misc_feature 1..48: note = hyper
  source 1..48: mol_type = genomic DNA
ctgggtggctaatggcgagccccacctcacccccagttgtgcccttag

SEQ ID NO: 75248 - DNA, 243 bp, Homo sapiens
  misc_feature 1..243: note = chr12:85306322-85306565
  misc_feature 1..243: note = hyper
  source 1..243: mol_type = genomic DNA
cgcctcttgctgcttccacgtccgggcagcagcagcagcagtcgcgaaagggtagggtccaggtggctgtgacggaggccgaagaggagctgttggcagagaagcagcttcttgcctaggttgggacccggagctgggttttgggggtcgccgccctgcaggctggcaaggagagactcgtgagcgcctgtgtgtctgccagggaaacagcacgggatacaggcgcgcgggtgcgggtgcgcg

SEQ ID NO: 75249 - skipped

SEQ ID NO: 75250 - DNA, 158 bp, Homo sapiens; identical to SEQ ID NO: 34550
  misc_feature 1..158: note = chr12:85306798-85306956
  misc_feature 1..158: note = hyper
  source 1..158: mol_type = genomic DNA

SEQ ID NO: 75251 - DNA, 30 bp, Homo sapiens
  misc_feature 1..30: note = chr12:85430069-85430099
  misc_feature 1..30: note = hyper
  source 1..30: mol_type = genomic DNA
cctgtagggaaaaaccggtgtctcttcctt

SEQ ID NO: 75252 - DNA, 718 bp, Homo sapiens
  misc_feature 1..718: note = chr12:85667044-85667762
  misc_feature 1..718: note = hyper
  source 1..718: mol_type = genomic DNA
gtccttaccaagggacggctagatgatccatctgccaacatcaatatttggagggaaagcttaaaatatgctgtttttccaagggttaaactttaaaggggtgaaaacacaactgatgaaatgttagcatcaaatcggttaaccactaactcctttccatattcgtcgtcgaggctcttttaagtttccatgagaagcgaaacttcattctctttgctcagaatagagactcctccacctatgcgcgtttaaccacagagttgttcttgattgtaagggacttcgcccacttggttgaagtggagagccggtcctcattccagacgtcccgcacggcagtcgctcatggctccctccaggccgggagccaggaaggtggtccttcaccgaggtgcgcaccaagcggcggtccacccaggcaatggggtgcaccaatttgcctccaaaaatttgctgcgcacacaacctgttcacagttcctgatcagaaagggctaacgagatgtctgtctacagctgtctctgggcgagggcgcaggctttgggaagtggttcagcgcgatcggggacaccgcttgcagcccttggtcctgcacccctaggaggggtgtcccacaagctcggcttcccttttgcgagccacagagagctttttgttccgaaactctcattacgacagatagtatttaaaactcatcaaaattcgcttcagaaatctg

SEQ ID NO: 75253 - DNA, 42 bp, Homo sapiens
  misc_feature 1..42: note = chr12:85671757-85671799
  misc_feature 1..42: note = hyper
  source 1..42: mol_type = genomic DNA
ggagtgagtgaataacgcaacactcaacgtttccacaaggct

SEQ ID NO: 75254 - DNA, 30 bp, Homo sapiens
  misc_feature 1..30: note = chr12:85672332-85672362
  misc_feature 1..30: note = hyper
  source 1..30: mol_type = genomic DNA
gctaaggagcagctccggggtgcacagccc

SEQ ID NO: 75255 - DNA, 1185 bp, Homo sapiens
  misc_feature 1..1185: note = chr12:85672730-85673915
  misc_feature 1..1185: note = hyper
  source 1..1185: mol_type = genomic DNA
cgcatttcccccaagcgccgcgggctcctaggaagccaagagtcgtgccaaaagtcacacagaagggctttcaacctagcagtgctgtcctgcctgccctaccatcccctctggtggaaatggaggccttggacctgtccgcgcccaggacgccgcgccgcgagtgcccgcagctccgcgcgctcaccactcactcccagagcgcttttcggagtaactccacagcaactctttaaaattaaaagtaatttctgtaaaaatatgcagacattcctcttcttcataaacccctatttgtaacaatcctcactttggcattagagtaaaagcctttcaaaggcactgatcctaacgggttttcttaaaataatttgggtctaatgataaaatcgtggaccaaagggaagggtggcgaagagggtgtagggaattggttggcattagtataatggcttcattgcctcttgctcggcttctctctcccacccatcgccaccgcgtccacactccgccgcattccagagaaaaagaaaaggccacggcctcgtaaagctcccagctggcccggaccccgagctcctcccggttagaagccgaagcggcccctctactacggcggctgcgattaacagttgccaatgcatctggttccttgggcttcggattaatgtgaatcttccacgtaaacgatttacggatgaaataaaagccttttagagcaatatttcctttcaagttcttaagacgcctctaaatctttctggtagtgagtggccggcatgggggcggggtggggacgggtggctcaggaaggcgcaggcagtagggagtggaggtttaactgctttgcgatctcaccaagatcttccgaaatgccagtccactgtcacggcggcaatgaatctgggtgtcaggggctcgtctctcctggcatttgtctgaaatggagctgtctgtctgtctatcctaggcctggacgccctctgcccgggtaagtggggaaaatgggggtggggtaggggcggagggggacctggggtggagttagtcgcccgcctattttcatattcattagaactgggaggctgcccgaggaggccagctgagtttcaagatataaaagcaacttcgggtgctccttttccagccgggacgtattaaagggaccggagcggggcagttccc

SEQ ID NO: 75256 - DNA, 968 bp, Homo sapiens; identical to SEQ ID NO: 34553
  misc_feature 1..968: note = chr12:85673916-85674884
  misc_feature 1..968: note = hyper
  source 1..968: mol_type = genomic DNA

SEQ ID NO: 75257 - DNA, 81 bp, Homo sapiens
  misc_feature 1..81: note = chr12:8599745-8599826
  misc_feature 1..81: note = hypo
  source 1..81: mol_type = genomic DNA
tgtgtgcaacccctgcgatattgggagtgatatcatcgtcgccccctgaacataagaaacaatatcgcagtggcatgtata

SEQ ID NO: 75258 - DNA, 30 bp, Homo sapiens
  misc_feature 1..30: note = chr12:8702283-8702313
  misc_feature 1..30: note = hypo
  source 1..30: mol_type = genomic DNA
atttttgtttaatcgcgaaccctattatat

SEQ ID NO: 75259 - DNA, 143 bp, Homo sapiens
  misc_feature 1..143: note = chr12:8746970-8747113
  misc_feature 1..143: note = hypo
  source 1..143: mol_type = genomic DNA
aagtctggagcaaacacaatctgcaggtaattaacattattgttcccccttacctggagcagtcactcggggttggccaaagatagtttctggacaacatgggtaaacaagcctatttagataaattccgctatacttccttg

SEQ ID NO: 75260 - DNA, 30 bp, Homo sapiens; identical to SEQ ID NO: 43368
  misc_feature 1..30: note = chr12:8748716-8748746
  misc_feature 1..30: note = hypo
  source 1..30: mol_type = genomic DNA

SEQ ID NO: 75261 - DNA, 175 bp, Homo sapiens
  misc_feature 1..175: note = chr12:8749845-8750020
  misc_feature 1..175: note = hypo
  source 1..175: mol_type = genomic DNA
tgattaaaataacatcgataaaatcctaacattgtaaaaacacacaaaaatacatagacttggttatttctaaccttacaccactcatgacagtcgggtgatttggagggaaggtcaaataaaatgaagatttgctctggattagatgttgttagggaatcgggtcaattctgta

SEQ ID NO: 75262 - DNA, 149 bp, Homo sapiens
  misc_feature 1..149: note = chr12:8751025-8751174
  misc_feature 1..149: note = hypo
  source 1..149: mol_type = genomic DNA
caaaagccaaagatacgtgaaatgttaatattaatggacccattttacagagaggaaagaaattaaggctttacagagattaaacatctaacccattgtcacatggaaccagaactctagtttaggtttacttgacttcgaagtcatac

SEQ ID NO: 75263 - DNA, 30 bp, Homo sapiens
  misc_feature 1..30: note = chr12:8757665-8757695
  misc_feature 1..30: note = hypo
  source 1..30: mol_type = genomic DNA
tctaatctttaatttcggctccagaggtga

SEQ ID NO: 75264 - DNA, 40 bp, Homo sapiens
  misc_feature 1..40: note = chr12:8757926-8757966
  misc_feature 1..40: note = hypo
  source 1..40: mol_type = genomic DNA
aggttggggttccctcgcagaaagtcggccacatgtcggg

SEQ ID NO: 75265 - DNA, 198 bp, Homo sapiens; identical to SEQ ID NO: 43370
  misc_feature 1..198: note = chr12:8790007-8790205
  misc_feature 1..198: note = hypo
  source 1..198: mol_type = genomic DNA

SEQ ID NO: 75266 - DNA, 61 bp, Homo sapiens; identical to SEQ ID NO: 43371
  misc_feature 1..61: note = chr12:8799944-8800005
  misc_feature 1..61: note = hypo
  source 1..61: mol_type = genomic DNA

SEQ ID NO: 75267 - DNA, 81 bp, Homo sapiens; identical to SEQ ID NO: 15635
  misc_feature 1..81: note = chr12:8808559-8808640
  misc_feature 1..81: note = hypo
  source 1..81: mol_type = genomic DNA

SEQ ID NO: 75268 - DNA, 29 bp, Homo sapiens
  misc_feature 1..29: note = chr12:8835074-8835103
  misc_feature 1..29: note = hypo
  source 1..29: mol_type = genomic DNA
ttactgggaaatggccgggtgcggtggct

SEQ ID NO: 75269 - DNA, 214 bp, Homo sapiens
  misc_feature 1..214: note = chr12:8850501-8850715
  misc_feature 1..214: note = hyper
  source 1..214: mol_type = genomic DNA
cgggcgggcggcgttcggtctgagggagcggggcggtctccgccggcgtcgcgcgcgctgtgtgtgagcggggtcgcgcgcgcgcgcggcaggcgagtgagggaacgaggagcggccgggtgtgagtgtgtgggagtgagagtgtgtgggagtggggtgagggagaagctgacgggacgcgaggctgtgagaaactgggcgagtgtgcgaggac

SEQ ID NO: 75270 - DNA, 221 bp, Homo sapiens
  misc_feature 1..221: note = chr12:8851054-8851275
  misc_feature 1..221: note = hyper
  source 1..221: mol_type = genomic DNA
cggtggtcgccgctccgcggagtcggtggggagcgaggcggggcccggccttcgcgcgtgtgccgggaggcgccggcccgtggcgtgtgcgtgcgaccgggcgagccgtgtcgagggggcggcgacttcgggcgtgtaaggagtatggtttccccgccggcgagggggtgtggtaaccccgggaacgccggctggagtcggacccgcgggctgctgacctg

SEQ ID NO: 75271 - DNA, 25 bp, Homo sapiens
  misc_feature 1..25: note = chr12:8869424-8869449
  misc_feature 1..25: note = hypo
  source 1..25: mol_type = genomic DNA
caggctcaagcgatcttcccacctc

SEQ ID NO: 75272 - DNA, 24 bp, Homo sapiens
  misc_feature 1..24: note = chr12:8878090-8878114
  misc_feature 1..24: note = hypo
  source 1..24: mol_type = genomic DNA
ctcacctgacgtcaggatgctcta

SEQ ID NO: 75273 - DNA, 30 bp, Homo sapiens
  misc_feature 1..30: note = chr12:88820631-88820661
  misc_feature 1..30: note = hypo
  source 1..30: mol_type = genomic DNA
tatgtgacatctacacgaaagaatttgtat

SEQ ID NO: 75274 - DNA, 30 bp, Homo sapiens
  misc_feature 1..30: note = chr12:88861136-88861166
  misc_feature 1..30: note = hypo
  source 1..30: mol_type = genomic DNA
tcagccatcttggctcgagccaatatttta

SEQ ID NO: 75275 - DNA, 249 bp, Homo sapiens
  misc_feature 1..249: note = chr12:88974430-88974679
  misc_feature 1..249: note = hyper
  source 1..249: mol_type = genomic DNA
ctcgcctgggggccccggacctgcactggcgggagaccgcgaaggcgcggggacgcagagggcgaagcttggtaccctgcagctactgctcgcgaggagtcccagcttaccctcccggatccgctggggctcacctggcacccccggggacagacgaaatacctcgcgcgccagagagggctcggagctccctctgttatacaaagtcggagagggagaggagtccgggaggttcggagcaaagaattc

SEQ ID NO: 75276 - DNA, 30 bp, Homo sapiens
  misc_feature 1..30: note = chr12:8905690-8905720
  misc_feature 1..30: note = hypo
  source 1..30: mol_type = genomic DNA
acatattttgtgtttcggcagggatggctg

SEQ ID NO: 75277 - DNA, 80 bp, Homo sapiens; identical to SEQ ID NO: 43374
  misc_feature 1..80: note = chr12:8908240-8908320
  misc_feature 1..80: note = hypo
  source 1..80: mol_type = genomic DNA

SEQ ID NO: 75278 - DNA, 42 bp, Homo sapiens
  misc_feature 1..42: note = chr12:8926134-8926176
  misc_feature 1..42: note = hypo
  source 1..42: mol_type = genomic DNA
cttctaccctctggccggctcacccggcgtatgtccctgctc

SEQ ID NO: 75279 - DNA, 190 bp, Homo sapiens
  misc_feature 1..190: note = chr12:8975180-8975370
  misc_feature 1..190: note = hypo
  source 1..190: mol_type = genomic DNA
tagtatataaagctacgcggagcgatctctgcccctgaccctggaaaaatctgtctcacccacaaagatgtgggctcagctccttctaggaatgttggccctatcaccagccattgcagaagaacttccgtgagtgcttggtgtcagaattggtttattagggcagcggcttcttcgcctaactttctca

SEQ ID NO: 75280 - DNA, 30 bp, Homo sapiens; identical to SEQ ID NO: 43518
  misc_feature 1..30: note = chr12:89794228-89794258
  misc_feature 1..30: note = hypo
  source 1..30: mol_type = genomic DNA

SEQ ID NO: 75281 - DNA, 173 bp, Homo sapiens
  misc_feature 1..173: note = chr12:8982315-8982488
  misc_feature 1..173: note = hypo
  source 1..173: mol_type = genomic DNA
tttccagtgtatttccgcattgtcaccatggatagcaacttcgttccagtgaatgacaaggtgagttgggaggaggagaaggagtggcgcagggagaacagggaaaaggatgagagattctctagggtggaagtcctctcagcctgggcgtggcaaggcgaggccctctgggt

SEQ ID NO: 75282 - DNA, 103 bp, Homo sapiens; identical to SEQ ID NO: 43377
  misc_feature 1..103: note = chr12:8983831-8983934
  misc_feature 1..103: note = hypo
  source 1..103: mol_type = genomic DNA

SEQ ID NO: 75283 - DNA, 18 bp, Homo sapiens
  misc_feature 1..18: note = chr12:8989364-8989382
  misc_feature 1..18: note = hypo
  source 1..18: mol_type = genomic DNA
caccgcgcccagccaaga

SEQ ID NO: 75284 - DNA, 30 bp, Homo sapiens
  misc_feature 1..30: note = chr12:89953769-89953799
  misc_feature 1..30: note = hypo
  source 1..30: mol_type = genomic DNA
gtccctacacctgatcgcctgatcagccca

SEQ ID NO: 75285 - DNA, 102 bp, Homo sapiens
  misc_feature 1..102: note = chr12:8995503-8995605
  misc_feature 1..102: note = hypo
  source 1..102: mol_type = genomic DNA
attcagcccttctgtcgctctcctacataccaaaatattgctgtacacagctacgtttatggattctttatccatccttggctggaccgctaatgaaatacc

SEQ ID NO: 75286 - DNA, 30 bp, Homo sapiens
  misc_feature 1..30: note = chr12:90025918-90025948
  misc_feature 1..30: note = hypo
  source 1..30: mol_type = genomic DNA
ttttttttttttacacgttatcattgattt

SEQ ID NO: 75287 - DNA, 198 bp, Homo sapiens
  misc_feature 1..198: note = chr12:9006823-9007021
  misc_feature 1..198: note = hypo
  source 1..198: mol_type = genomic DNA
catcaagccagttctcgtcaaagtgagttttcttcagaggtagagacagcaaccaaccgagggatgctcagcatctcgtcttgctgtgagttagtctctcacagcaaccatactccagtccaaccaggcagcttcaactttctccttccctggccccttgaacatttgcctaatccacacccacggcctatgaaagca

SEQ ID NO: 75288 - DNA, 30 bp, Homo sapiens
  misc_feature 1..30: note = chr12:9008301-9008331
  misc_feature 1..30: note = hypo
  source 1..30: mol_type = genomic DNA
atgaaggaaaaagagcgtattttatatagg

SEQ ID NO: 75289 - DNA, 149 bp, Homo sapiens
  misc_feature 1..149: note = chr12:9010027-9010176
  misc_feature 1..149: note = hypo
  source 1..149: mol_type = genomic DNA
tcccatatccttgaacggcatgggggtgttttctgaagttgtcgctgtgatctaaaaccacatttggcttcccagggtaccagaaggagctgatgtacaaacacagcaatggctcatacagtgcctttggggagcgagatggaaatgga

SEQ ID NO: 75290 - DNA, 135 bp, Homo sapiens; identical to SEQ ID NO: 43379
  misc_feature 1..135: note = chr12:9016413-9016548
  misc_feature 1..135: note = hypo
  source 1..135: mol_type = genomic DNA

SEQ ID NO: 75291 - DNA, 30 bp, Homo sapiens
  misc_feature 1..30: note = chr12:9020600-9020630
  misc_feature 1..30: note = hypo
  source 1..30: mol_type = genomic DNA
tccctggaatgtacacgttggaggcctcag

SEQ ID NO: 75292 - DNA, 30 bp, Homo sapiens
  misc_feature 1..30: note = chr12:90219938-90219968
  misc_feature 1..30: note = hypo
  source 1..30: mol_type = genomic DNA
gaaagtctcattctccgaagaaagaaaggt

SEQ ID NO: 75293 - DNA, 86 bp, Homo sapiens
  misc_feature 1..86: note = chr12:9026553-9026639
  misc_feature 1..86: note = hypo
  source 1..86: mol_type = genomic DNA
ctcatagggcagtagcggtacatagagggtttcagagaatctttttttaattaaaaaaaaaatttttttttaatttgagatggagt

SEQ ID NO: 75294 - DNA, 189 bp, Homo sapiens
  misc_feature 1..189: note = chr12:90313512-90313701
  misc_feature 1..189: note = hypo
  source 1..189: mol_type = genomic DNA
ctccatgagaggcaccgggcctcaggtggacaaggcctcctccttggccgggcgctgggcgggaggcgggagcgagcgtgctagccaagcatgtgggccgcgctgaggcttgacgaggccggcgtcccttttcctgaggcacgtgcgccgccgccgccatcatgccgtgcgcgccgccctaatgctttt

SEQ ID NO: 75295 - DNA, 20 bp, Homo sapiens
  misc_feature 1..20: note = chr12:9187316-9187336
  misc_feature 1..20: note = hypo
  source 1..20: mol_type = genomic DNA
acaggcgtgaggcaccgtgc

SEQ ID NO: 75296 - DNA, 152 bp, Homo sapiens
  misc_feature 1..152: note = chr12:9203194-9203346
  misc_feature 1..152: note = hypo
  source 1..152: mol_type = genomic DNA
ggatatgagcctccctgtgctcccggagggggccgggagtaggcaggatctgctcttttgggtgcagctgcagctgcccaatcctcagctgcagacctgggcctcgcgctccacggagcaggcaggagccagggacacgtgggaacctcccc

SEQ ID NO: 75297 - DNA, 30 bp, Homo sapiens
  misc_feature 1..30: note = chr12:9251150-9251180
  misc_feature 1..30: note = hypo
  source 1..30: mol_type = genomic DNA
tctgagcccctggcacggcccttcttgatt

SEQ ID NO: 75298 - DNA, 30 bp, Homo sapiens
  misc_feature 1..30: note = chr12:926703-926733
  misc_feature 1..30: note = hypo
  source 1..30: mol_type = genomic DNA
gctttttggacctttcgagtttctaccttt

SEQ ID NO: 75299 - DNA, 36 bp, Homo sapiens
  misc_feature 1..36: note = chr12:93436029-93436065
  misc_feature 1..36: note = hypo
  source 1..36: mol_type = genomic DNA
atacactttgggaaacgctgccgtaaaacaaatacc

SEQ ID NO: 75300 - DNA, 33 bp, Homo sapiens; identical to SEQ ID NO: 43520
  misc_feature 1..33: note = chr12:93711081-93711114
  misc_feature 1..33: note = hypo
  source 1..33: mol_type = genomic DNA

SEQ ID NO: 75301 - DNA, 30 bp, Homo sapiens; identical to SEQ ID NO: 43521
  misc_feature 1..30: note = chr12:93797551-93797581
  misc_feature 1..30: note = hypo
  source 1..30: mol_type = genomic DNA

SEQ ID NO: 75302 - DNA, 16 bp, Homo sapiens
  misc_feature 1..16: note = chr12:93966301-93966317
  misc_feature 1..16: note = hyper
  source 1..16: mol_type = genomic DNA
agagctgggccagggc

SEQ ID NO: 75303 - DNA, 898 bp, Homo sapiens; identical to SEQ ID NO: 34555
  misc_feature 1..898: note = chr12:93966318-93967216
  misc_feature 1..898: note = hyper
  source 1..898: mol_type = genomic DNA

SEQ ID NO: 75304 - DNA, 525 bp, Homo sapiens
  misc_feature 1..525: note = chr12:93985095-93985620
  misc_feature 1..525: note = hyper
  source 1..525: mol_type = genomic DNA
tacatatacaaggaacggaaatgaattagcccggctagatatttctaggaactagttaagggagaatgaacaagatgggagcgaggagaaagcgtgtgtgcgttcgtgtgtggctgtctgtctgtctgtctgcggcaagaggaatctcagagtttcggttatttctccttgaagaattttcaaacggagttcctgcaggggctggctctagcgtctacgatgtgcacacactgtctctcaagagggaagtgatcctggcgccacggggtgatgcagcagaagttctttttgtctgtggccagggtagagtgcggagccccacggagctgtggcgtggcggctcctcccagacgcgtccggggcgccgctcgggtctcccaggaccttatgtaacccagcgtcggcagcaaggagccggtcacaggctgaccaacgtcaaggcgtttcactttggaagcgcaccagatgagtgtggtattgagagcagacggctgggtgcaatgtttttgccgcatatctcatggg

SEQ ID NO: 75305 - DNA, 30 bp, Homo sapiens
  misc_feature 1..30: note = chr12:94019213-94019243
  misc_feature 1..30: note = hypo
  source 1..30: mol_type = genomic DNA
gcccttcaaagcttacgaatttattgaggg

SEQ ID NO: 75306 - DNA, 30 bp, Homo sapiens
  misc_feature 1..30: note = chr12:94233462-94233492
  misc_feature 1..30: note = hypo
  source 1..30: mol_type = genomic DNA
atctctttatgtgctcgcttttgtgtttcc

SEQ ID NO: 75307 - DNA, 201 bp, Homo sapiens
  misc_feature 1..201: note = chr12:94501597-94501798
  misc_feature 1..201: note = hypo
  source 1..201: mol_type = genomic DNA
gaagtaagagcgatccgtggagaattgcctctcaagagcatgtggtaagaactttattattactatgggaaaatgaacttatactacataactttcttctggtgactttaaaattgatagaaattagagcaaatcaggacatggactaaggaaaagttacaaagactaatggcaagtcaaggaatccgagttaacattcgg

SEQ ID NO: 75308 - DNA, 60 bp, Homo sapiens
  misc_feature 1..60: note = chr12:94541897-94541957
  misc_feature 1..60: note = hyper
  source 1..60: mol_type = genomic DNA
tccacacctgtcagccgctctcgcagcagccctgtggcccgagcccggggcctcagctgc

SEQ ID NO: 75309 - DNA, 859 bp, Homo sapiens
  misc_feature 1..859: note = chr12:94543088-94543947
  misc_feature 1..859: note = hyper
  source 1..859: mol_type = genomic DNA
gggggcggccggcctcggggggctgctgctcaccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcgtaagtcctgcccccggggcgccgcggagagcgctgctgccggggagccgccgccgccgccgaggcagaacgagctgggggcgagcggcggggcgggggtacagccgggtgacatttaccaggtctcaggttcacacc

SEQ ID NO: 75310 - DNA, 44 bp, Homo sapiens
  misc_feature 1..44: note = chr12:94543948-94543992
  misc_feature 1..44: note = hyper
  source 1..44: mol_type = genomic DNA
cgggcggccgtccgaaggctcctctcggacggtccccgagacct

SEQ ID NO: 75311 - DNA, 30 bp, Homo sapiens
  misc_feature 1..30: note = chr12:94544301-94544331
  misc_feature 1..30: note = hyper
  source 1..30: mol_type = genomic DNA
gtggccccctgtctccgccccccaccggca

SEQ ID NO: 75312 - DNA, 90 bp, Homo sapiens
  misc_feature 1..90: note = chr12:94641622-94641712
  misc_feature 1..90: note = hypo
  source 1..90: mol_type = genomic DNA
atcacagctgggattcgttaacaaagttactaaaacattcttttctttttgtccaggtctctgaatattgtgtggcgacttactgcgggt

SEQ ID NO: 75313 - DNA, 30 bp, Homo sapiens
  misc_feature 1..30: note = chr12:94642514-94642544
  misc_feature 1..30: note = hypo
  source 1..30: mol_type = genomic DNA
ctcttttctcaaatgcggaggtgacatgtc

SEQ ID NO: 75314 - DNA, 100 bp, Homo sapiens
  misc_feature 1..100: note = chr12:94891920-94892020
  misc_feature 1..100: note = hypo
  source 1..100: mol_type = genomic DNA
cagctttatcaagcacgctctcacagtgtcagtgatacatctatgcacgtcacagataacagtgactcagaaccaggtgatgagtccatccataacatgg

SEQ ID NO: 75315 - DNA, 83 bp, Homo sapiens
  misc_feature 1..83: note = chr12:95008472-95008555
  misc_feature 1..83: note = hypo
  source 1..83: mol_type = genomic DNA
tgcatgatatgctgtcggaacaactggcctctctgacttttttctttttttaaacaacagacagatttttttttttttttttg

SEQ ID NO: 75316 - DNA, 22 bp, Homo sapiens
  misc_feature 1..22: note = chr12:95008675-95008697
  misc_feature 1..22: note = hypo
  source 1..22: mol_type = genomic DNA
ttacagacgctgctaccactcc

SEQ ID NO: 75317 - DNA, 34 bp, Homo sapiens
  misc_feature 1..34: note = chr12:9501895-9501929
  misc_feature 1..34: note = hypo
  source 1..34: mol_type = genomic DNA
tcacagatggggcagcgaccgcagaggcactcct

SEQ ID NO: 75318 - DNA, 377 bp, Homo sapiens
  misc_feature 1..377: note = chr12:95266817-95267194
  misc_feature 1..377: note = hyper
  source 1..377: mol_type = genomic DNA
gagggtgggggtgagcgcgggctccctggcacctgccggtaaagcagcagccgcagcccccgagggcgccccaggccaggagctgcgcgccgtcggcgggccgtgcctggaggaggctcgcgccttccaaatgccggagtgcaggcatccttcctctccccaaccccagccccggcctcgacctgtcgcccacctggcccggacctggggctggctccgtctctggggtgtgcgccaagggagccccaccgacgcccagcagagctgcccgggctcccaaagaaggaccggggctttgggcagaattctggcagccaggcgggcgtcaggggagccggagaaggggctcgccagcaggcgtggggcggagtgccggg

SEQ ID NO: 75319 - DNA, 434 bp, Homo sapiens
  misc_feature 1..434: note = chr12:95267247-95267681
  misc_feature 1..434: note = hyper
  source 1..434: mol_type = genomic DNA
cgaagagtgcgggcccggggtccccgcggcgccccttcccctcctcagtcccccgggggcgaccgcgctccccgccgaggtccgtccccgccgcaccctcactattcccgctgggaggaccccggcgcacgcccccgcccccgcaccccggggcgacggcgcactcaccctccgcatggtgtctgggccgtccgggcggggctcggcgacttgggcgcgagaagggctgggccggcggcgacgctcggccggccgggagctccgcgctgccccctcctgcacacgcctgcgccgcggccgccaagccggcgggggcggggcggggtagcgctggccgcggggtccccggggctctcccgggctgcggcggaggcgcggagccggccaagggcgcactgagctcgcggagctccggggccccggggcctttctgc

SEQ ID NO: 75320 - DNA, 294 bp, Homo sapiens
  misc_feature 1..294: note = chr12:95267706-95268000
  misc_feature 1..294: note = hyper
  source 1..294: mol_type = genomic DNA
cgggccgcttcgcccctctcctcttcctcgagttctggccccaccaggagcggagcgagtctccgatgcctgccccgcggcccccagaactgagctggagaagctttggggtgaaagctgggcccaccctacagggaccccaagtttgcggagcaagagtggattggcggagagcgcagatggcaattctcacccgccttaaaagtaccaccttaaaattctccccatgggatgggaaggtggcccgctaatgtccgttcctactcttcgttttctttttaatttttcagacag

SEQ ID NO: 75321 - DNA, 34 bp, Homo sapiens
  misc_feature 1..34: note = chr12:95467953-95467987
  misc_feature 1..34: note = hypo
  source 1..34: mol_type = genomic DNA
actagagactgggcacggtagctcacgcctgtaa

SEQ ID NO: 75322 - DNA, 40 bp, Homo sapiens
  misc_feature 1..40: note = chr12:95826267-95826307
  misc_feature 1..40: note = hypo
  source 1..40: mol_type = genomic DNA
aaaaaagaagtgtggattttattctcggtgcaatagcaac

SEQ ID NO: 75323 - DNA, 28 bp, Homo sapiens
  misc_feature 1..28: note = chr12:95942964-95942992
  misc_feature 1..28: note = hyper
  source 1..28: mol_type = genomic DNA
gcgtggcaaactccgttatctttaaaac

SEQ ID NO: 75324 - DNA, 84 bp, Homo sapiens
  misc_feature 1..84: note = chr12:96185037-96185121
  misc_feature 1..84: note = hyper
  source 1..84: mol_type = genomic DNA
tctcggggagtcccacgacccggggacggaacaccccaacccagccccgcgtcacccgcactgagagcgcgccaactgctaagc

SEQ ID NO: 75325 - DNA, 30 bp, Homo sapiens
  misc_feature 1..30: note = chr12:96817042-96817072
  misc_feature 1..30: note = hypo
  source 1..30: mol_type = genomic DNA
tatgatcaaggcaaacgaatattaacctca

SEQ ID NO: 75326 - DNA, 15 bp, Homo sapiens
  misc_feature 1..15: note = chr12:96844259-96844274
  misc_feature 1..15: note = hypo
  source 1..15: mol_type = genomic DNA
cgtctcaaaaaaaaa

SEQ ID NO: 75327 - DNA, 20 bp, Homo sapiens
  misc_feature 1..20: note = chr12:96881018-96881038
  misc_feature 1..20: note = hypo
  source 1..20: mol_type = genomic DNA
agccacgacacccagccaat

SEQ ID NO: 75328 - DNA, 746 bp, Homo sapiens
  misc_feature 1..746: note = chr12:96883069-96883815
  misc_feature 1..746: note = hyper
  source 1..746: mol_type = genomic DNA
ggtcgtcatcattatcgttattaagtggccaacatggataaagagtatagtctggatttgtgaccttaaatttttggctctaatattcgccagcgctctgctcagaacattctctgttcgcatttcatacagcggtgccagcgcacaaccaggcaacgccctcaggagcatcattgttttctggacctggttctttctcgctctgccctccaggggccgctgtgtttctcggaatgcgcgcgggatgcccggttgccacgagaccgtcgccaggcaaccgcgtgtacacatactccaggcgggccggggcgcgtcaatatggcggcgcagggctccccctcgagctctccgtcagacgactctaccacctcggggtctctgccagaactgccgccgacctccaccgcgacttcgaggtcgcccccagagtcgaaggggagctcccggagctcgctgcttcagtggacctgccccgaggactcattgcccctagccgtgttttatgggccgctggacgcgaaaaacccgctcctggcctcttgtgagaaggagatccaggagttgttaggctttatgaggaaaaagaaggctttagccaccacggaggaagagaagcacgaattccgccggcgttggtaagcgctggcggggcactggggagggcgccggccagaggagggacccctggaaagggctggaggatgcaggtggtggccccagagatggttcagcgttgcggacgcagg

SEQ ID NO: 75329 - DNA, 30 bp, Homo sapiens; identical to SEQ ID NO: 43525
  misc_feature 1..30: note = chr12:97073402-97073432
  misc_feature 1..30: note = hypo
  source 1..30: mol_type = genomic DNA

SEQ ID NO: 75330 - DNA, 51 bp, Homo sapiens
  misc_feature 1..51: note = chr12:97379992-97380043
  misc_feature 1..51: note = hyper
  source 1..51: mol_type = genomic DNA
cgcctggcagcgcaggccgtgcactccccgcgcttccgggaacctgtttgc

SEQ ID NO: 75331 - DNA, 212 bp, Homo sapiens
  misc_feature 1..212: note = chr12:98763870-98764082
  misc_feature 1..212: note = hypo
  source 1..212: mol_type = genomic DNA
tcaaatagctcagaccgtcaacctgcctactatgaatgaggtaccggctagattgttggcaacacagcaggtagacaagagtcagtccctgttatcaagggatcacagttcagtgagctaaatagaaacgtgccttcaactgcactgcgctacactgaaacaagtgctagtactggataagacccagttgttgttggcgccaacaagagaag

SEQ ID NO: 75332 - DNA, 87 bp, Homo sapiens
  misc_feature 1..87: note = chr12:98849530-98849617
  misc_feature 1..87: note = hypo
  source 1..87: mol_type = genomic DNA
gcgggtagatatgggcggctctgcccaggaagacagcaacaaaagctccaatgatgaaaacagggctgaaaacgtgcttctggaagg

SEQ ID NO: 75333 - DNA, 143 bp, Homo sapiens
  misc_feature 1..143: note = chr12:98895762-98895905
  misc_feature 1..143: note = hypo
  source 1..143: mol_type = genomic DNA
cctgattggttgggtcggagacgagacacgtaagtttaagttctataatgaaacgctttcaatcatgtcagtttatctgtgcctataaacacactcctttagagaaaatcaaaagtttatagccaggcgcggtggctcacgcc

SEQ ID NO: 75334 - DNA, 98 bp, Homo sapiens
  misc_feature 1..98: note = chr12:98896397-98896495
  misc_feature 1..98: note = hypo
  source 1..98: mol_type = genomic DNA
gagcgaaacagaagtcggctgataaaattttgataaaatttcatttgcccgcagctggtcatttcattgggcgcttttgtgttacaaaagtgtgtgaa

SEQ ID NO: 75335 - DNA, 38 bp, Homo sapiens; identical to SEQ ID NO: 43527
  misc_feature 1..38: note = chr12:98947863-98947901
  misc_feature 1..38: note = hypo
  source 1..38: mol_type = genomic DNA

SEQ ID NO: 75336 - DNA, 42 bp, Homo sapiens; identical to SEQ ID NO: 15681
  misc_feature 1..42: note = chr12:98948376-98948418
  misc_feature 1..42: note = hypo
  source 1..42: mol_type = genomic DNA

SEQ ID NO: 75337 - DNA, 30 bp, Homo sapiens
  misc_feature 1..30: note = chr12:98951496-98951526
  misc_feature 1..30: note = hypo
  source 1..30: mol_type = genomic DNA
tgtgaatctcaaaaacgctgagtaaaagaa

SEQ ID NO: 75338 - DNA, 43 bp, Homo sapiens
  misc_feature 1..43: note = chr12:98986165-98986208
  misc_feature 1..43: note = hypo
  source 1..43: mol_type = genomic DNA
gcaaactaaaaaaagcgtggccccttgttcatacatgtattaa

SEQ ID NO: 75339 - DNA, 19 bp, Homo sapiens
  misc_feature 1..19: note = chr12:9916173-9916192
  misc_feature 1..19: note = hypo
  source 1..19: mol_type = genomic DNA
tttttttttttttttcgag

SEQ ID NO: 75340 - DNA, 81 bp, Homo sapiens
  misc_feature 1..81: note = chr12:99287423-99287504
  misc_feature 1..81: note = hyper
  source 1..81: mol_type = genomic DNA
caattccaaagttcccgtgtctctaatctactgatccaacgtgcccggcgcacataagcagcaccgcgactgaatttcaag

SEQ ID NO: 75341 - DNA, 258 bp, Homo sapiens; identical to SEQ ID NO: 34567
  misc_feature 1..258: note = chr12:99288150-99288408
  misc_feature 1..258: note = hyper
  source 1..258: mol_type = genomic DNA

SEQ ID NO: 75342 - DNA, 316 bp, Homo sapiens; identical to SEQ ID NO: 34568
  misc_feature 1..316: note = chr12:99288621-99288937
  misc_feature 1..316: note = hyper
  source 1..316: mol_type = genomic DNA

SEQ ID NO: 75343 - skipped

SEQ ID NO: 75344 - DNA, 188 bp, Homo sapiens
  misc_feature 1..188: note = chr12:99289161-99289349
  misc_feature 1..188: note = hyper
  source 1..188: mol_type = genomic DNA
ggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggagacgcctc

SEQ ID NO: 75345 - DNA, 30 bp, Homo sapiens
  misc_feature 1..30: note = chr12:9964565-9964595
  misc_feature 1..30: note = hypo
  source 1..30: mol_type = genomic DNA
aaaggtgaactatagcgtacaaaaatagtt

SEQ ID NO: 75346 - DNA, 30 bp, Homo sapiens
  misc_feature 1..30: note = chr12:99809435-99809465
  misc_feature 1..30: note = hypo
  source 1..30: mol_type = genomic DNA
gcaattccatcaccacgaggatccctccca

SEQ ID NO: 75347 - DNA, 30 bp, Homo sapiens; identical to SEQ ID NO: 43831
  misc_feature 1..30: note = chr13:100095884-100095914
  misc_feature 1..30: note = hypo
  source 1..30: mol_type = genomic DNA

SEQ ID NO: 75348 - DNA, 37 bp, Homo sapiens; identical to SEQ ID NO: 43832
  misc_feature 1..37: note = chr13:100146505-100146542
  misc_feature 1..37: note = hypo
  source 1..37: mol_type = genomic DNA

SEQ ID NO: 75349 - DNA, 81 bp, Homo sapiens; identical to SEQ ID NO: 15770
  misc_feature 1..81: note = chr13:100356871-100356952
  misc_feature 1..81: note = hypo
  source 1..81: mol_type = genomic DNA

SEQ ID NO: 75350 - DNA, 30 bp, Homo sapiens
  misc_feature 1..30: note = chr13:100452188-100452218
  misc_feature 1..30: note = hypo
  source 1..30: mol_type = genomic DNA
ctgagccattcagagcgtggccttcctcca

SEQ ID NO: 75351 - DNA, 30 bp, Homo sapiens
  misc_feature 1..30: note = chr13:100523137-100523167
  misc_feature 1..30: note = hypo
  source 1..30: mol_type = genomic DNA
gtttgaacatctgttcgttgtttcgtggtt

SEQ ID NO: 75352 - DNA, 26 bp, Homo sapiens
  misc_feature 1..26: note = chr13:100547868-100547894
  misc_feature 1..26: note = hyper
  source 1..26: mol_type = genomic DNA
cccgcgcttgggacccggcagctctg

SEQ ID NO: 75353 - DNA, 276 bp, Homo sapiens; identical to SEQ ID NO: 43834
  misc_feature 1..276: note = chr13:100575337-100575613
  misc_feature 1..276: note = hypo
  source 1..276: mol_type = genomic DNA

SEQ ID NO: 75354 - DNA, 30 bp, Homo sapiens; identical to SEQ ID NO: 43835
  misc_feature 1..30: note = chr13:100583792-100583822
  misc_feature 1..30: note = hypo
  source 1..30: mol_type = genomic DNA

SEQ ID NO: 75355 - DNA, 344 bp, Homo sapiens; identical to SEQ ID NO: 4040
  misc_feature 1..344: note = chr13:100608461-100608805
  misc_feature 1..344: note = hyper
  source 1..344: mol_type = genomic DNA

SEQ ID NO: 75356 - DNA, 431 bp, Homo sapiens
  misc_feature 1..431: note = chr13:100608838-100609269
  misc_feature 1..431: note = hyper
  source 1..431: mol_type = genomic DNA
cgagttctgggacggctgggaccaaagggctggcctccggcctgcgccctgtttgttttcctttcgccccctgaatactagattgagacgtaaagattacccgggccgaataatgccgggagtcaacactcgagcaaacaaaagtgcttgcacaactagtcaaccccgctgggacccgggccgcgggctgggggagagaacgcgctcctcgctgctaattacaaataaatgatgatgtgctcactaagtaattgatttaatgaagttcctatgaaactattaaacccgggtggaggtcaggctggaggcgccccagagcgcccattgtgggctgtttaactccaccaggctcctcggaaagacatcggggctaataggtgaagtcacagctgctcgcgctgacttctcggagcgcccggctggccgcgggc

SEQ ID NO: 75357 - DNA, 109 bp, Homo sapiens
  misc_feature 1..109: note = chr13:100609476-100609585
  misc_feature 1..109: note = hyper
  source 1..109: mol_type = genomic DNA
tcctcactccacccccgccacttcgtgcaggaactccaaccagtgtgccacgcagggtgctcgcgagctcttggcaaggtgcctggatcccgagcgtgtgcccagtgca

SEQ ID NO: 75358 - DNA, 350 bp, Homo sapiens
  misc_feature 1..350: note = chr13:100611882-100612232
  misc_feature 1..350: note = hyper
  source 1..350: mol_type = genomic DNA
tttaaatgtcacctccgcctttctaatgggcacagggctggaggcgacccttcaaagcgcctcggtgatgaacgacccttattaaatatggcccgagctgctgggaaagtcccgcgcccggccgcgcgccctagagcgcccctcgccggtgggccctggaggagccgggcctccgctgccaccgagcggagtccgggcccgcagagccccagcccggactggcgagggggtgcagagggaagaagagggaagcctggacgagggggggcgttgtaatacaacttcttatctgccgaccccaacacgcccgtgcgcccccagccccagagcctcggcgtgaaaggttggtg

SEQ ID NO: 75359 - DNA, 30 bp, Homo sapiens
  misc_feature 1..30: note = chr13:100620344-100620374
  misc_feature 1..30: note = hyper
  source 1..30: mol_type = genomic DNA
ccttcggaagtggcccggggattagtccct

SEQ ID NO: 75360 - DNA, 276 bp, Homo sapiens
  misc_feature 1..276: note = chr13:100620640-100620916
  misc_feature 1..276: note = hyper
  source 1..276: mol_type = genomic DNA
aaaaacccaaatgaccgcgggtcccctcgccgcctggggtcccccgcgccccccccgaccccacgcacgcgcgcgtgccccgggaagccaccggggacagtgcgcagggcgtggcctgtcccgccgggggcccggatcggcttctgcgcccgcagctcccggcagccgcctagggaaggccgctcccctcgcgaggcctgggcaggcgggaagggccctaggccgcgcgcggccccgcgcttgggagttccctttcggggccgggctggggagcgg

SEQ ID NO: 75361 - DNA, 231 bp, Homo sapiens
  misc_feature 1..231: note = chr13:100621135-100621366
  misc_feature 1..231: note = hyper
  source 1..231: mol_type = genomic DNA
cgcctcgggccaccccgacgctgctgcccccgcagagccccgagcgcccccggcccgagcgtgggacccggcggctacctcctggccgcagcagcgccgataaatctgccaagtgattactgaacgtaaactccagttacttaagtgtcctccgaggggtaatcgtatctgtccctataaatcccgactgcgttcgcgctcatcagcgcttccgcccgacgcgctggtccg

SEQ ID NO: 75362 - DNA, 299 bp, Homo sapiens
  misc_feature 1..299: note = chr13:100621716-100622015
  misc_feature 1..299: note = hyper
  source 1..299: mol_type = genomic DNA
taaagttgtgggagacgcacgcagaagaaggtgtgcgtgaagagtgtgtcacggtgggcgagtgcgagtggtctccggggttccgaaagcgcattcctgtcttcccggaggggtcccttcccctcccggaaggcctgcctcgggcggcccaaatccggcagcaaatcccacgcccggtcctcggagcgcggagactgcgcggggcctacgacccggtgggaagagaggcgcttgccggggcggcccggcctctctttccatcgccctcccagacttcccagggccgggcgggtggggac

SEQ ID NO: 75363 - DNA, 959 bp, Homo sapiens
  misc_feature 1..959: note = chr13:100622222-100623181
  misc_feature 1..959: note = hyper
  source 1..959: mol_type = genomic DNA
aagaagtcacatgtccgggttatacgtatgcgaagagaagcagcagaaggagaaaaaaattaaggcgagcaggaggaggaggagaagcagcggcggaagcggcggcggcgcaggagctggtggcggcggcggcggcgcggccggggacagacacccacctgtatgagtacgcttgtggatcttgaggttctcggagcgcgcgaagaccttgccgcagccggggaaagggcagggaaagggcttctcgccggtgtgcacgcggatgtggttgatgagcttgtatttggccttgaagggcttgccctcgcgcggacagtcctcccagaagcagacgtggctgctctgctcggggcctcccacgtgctccaccgtgacgtgattcaccagctcgtgcatggtgccgaaagttttggagcagggcttggcgccgccggccgggggcggtggcggcggcggcggcggcggcggcggcggcggcggcagcccggccagctcgtcggggtcgatccacttgcagatgagctcctgcttgattggctgccgcatgtagcgcaggaaggccccagccgcccctgggaggtgggggtggtgctggtgcgggtgctgcgcgggcgccggcggcggcggcggcgccgggggcggcgcgtggtgctgcaggtggggcccgggcccggccgctgctgcggccgccgcagccgccaggttcaggtttaagttcacggctccgtagccgtgcagggcggccgccgctgcggccgcaaccgccccgtagtgcgcgtccccagagcgcggcgcgaagggcggttcggcgcggccgtacagctcagccgccgcggctgccgctgccgccgccagccccaggcgcatctggccgttgagcgggtgcgggtggccgcctggggcccccggcgtgtcgtgcagcgcggggaagagcgccgggccgccgctgccgtccgggc

SEQ ID NO: 75364 - DNA, 231 bp, Homo sapiens; identical to SEQ ID NO: 35039
  misc_feature 1..231: note = chr13:100623899-100624130
  misc_feature 1..231: note = hyper
  source 1..231: mol_type = genomic DNA

SEQ ID NO: 75365 - DNA, 102 bp, Homo sapiens; identical to SEQ ID NO: 35040
  misc_feature 1..102: note = chr13:100624131-100624233
  misc_feature 1..102: note = hyper
  source 1..102: mol_type = genomic DNA

SEQ ID NO: 75366 - DNA, 349 bp, Homo sapiens
  misc_feature 1..349: note = chr13:100624323-100624672
  misc_feature 1..349: note = hyper
  source 1..349: mol_type = genomic DNA
cgccggcacgcgggcagagggcgcggggtggtgaggggctgaggacccccgaggggcagtcccagtttcaaaaaccttggcctcacttctctgtgtgccttctggcacccaagtactttctgcctctacctccacctctcttgtggggtggaagagccctgggctgctgtttgggagagaagggtgaatagcccgtcctacctgtagtggtgatgctagaaacttcttgtttggacacccaacctgcctagcgctcacctagggcgcatagacagtagacggagtgaagaagataaagtctattggttgcaagacaacttgagtgatttggctccgcgaaacaccaggt

SEQ ID NO: 75367 - DNA, 154 bp, Homo sapiens
  misc_feature 1..154: note = chr13:100626366-100626520
  misc_feature 1..154: note = hyper
  source 1..154: mol_type = genomic DNA
tcttgttaaacacagcgtgatatgtatctgtcatcgatttaatatgtcttaattcaaatatagctccctgatcaatttctttttatggaagccttaaaaaagaaaagactttcttaggaaataatagagatttgggtagcgataggaaagaggg

SEQ ID NO: 75368 - DNA, 511 bp, Homo sapiens
  misc_feature 1..511: note = chr13:100630630-100631141
  misc_feature 1..511: note = hyper
  source 1..511: mol_type = genomic DNA
agtaaaggggttttgcggtttgtagagaaataaagcacttctgagaagggacggcgacgtgactttgaacttggctcagctcttctgtgccctgcagagagaggagaactagagccgggaaagaatagccaggagcgcccaacccgtagggtctccggcgggaattaaggcgtccgccccaccgcccggccgcgcgcggcccctggaatccggcgcgagcgagcgcccagccgcgcgatccccaaacgcgggagcagcaaaggcgaaatcaaagcgaaagagagaatgggtcaaagaggagagggagggaggactggggagggggtaagacagtgggaaaggaggaaaacttcgaagtctgatggcctgaaagaaggaagggaagtgaggtctctgcatgtgcaggtctgctattctcataaccaatctccaagaaaacattttccttcggaaatatttttggagtaagcccttccaaatactctcctctcgtgctcgcctcccattccca

SEQ ID NO: 75369 - DNA, 32 bp, Homo sapiens
  misc_feature 1..32: note = chr13:100631610-100631642
  misc_feature 1..32: note = hyper
  source 1..32: mol_type = genomic DNA
ctagaggattcttcccgcgtttttgtttattt

SEQ ID NO: 75370 - DNA, 54 bp, Homo sapiens; identical to SEQ ID NO: 35044
  misc_feature 1..54: note = chr13:100631883-100631937
  misc_feature 1..54: note = hyper
  source 1..54: mol_type = genomic DNA

SEQ ID NO: 75371 - DNA, 85 bp, Homo sapiens
  misc_feature 1..85: note = chr13:100632429-100632514
  misc_feature 1..85: note = hyper
  source 1..85: mol_type = genomic DNA
agcagaccagccccccgccgctccttgtggcgcgctcccggcgaggccccgggcctgaaatgtccccgcgcgcagagcctcctgc

SEQ ID NO: 75372 - DNA, 42 bp, Homo sapiens
  misc_feature 1..42: note = chr13:100633842-100633884
  misc_feature 1..42: note = hyper
  source 1..42: mol_type = genomic DNA
gtgagtgtgtgcgtgcgcgcgcgggtgcgcgcaggggtgggg

SEQ ID NO: 75373 - DNA, 30 bp, Homo sapiens
  misc_feature 1..30: note = chr13:100634277-100634307
  misc_feature 1..30: note = hyper
  source 1..30: mol_type = genomic DNA
cggaggcgcagggctcgcaggggcgggcgg

SEQ ID NO: 75374 - DNA, 386 bp, Homo sapiens
  misc_feature 1..386: note = chr13:100634944-100635330
  misc_feature 1..386: note = hyper
  source 1..386: mol_type = genomic DNA
actccacaaccagtacggccccatgaatatgaacatgggtatgaacatggcagcagccgcggcccaccaccaccaccaccaccaccaccaccccggtgcctttttccgctatatgcggcagcagtgcatcaagcaggagctaatctgcaagtggatcgaccccgagcaactgagcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttcccctgccccttcc

SEQ ID NO: 75375 - DNA, 120 bp, Homo sapiens
  misc_feature 1..120: note = chr13:100635398-100635518
  misc_feature 1..120: note = hyper
  source 1..120: mol_type = genomic DNA
cgcgggctgggacagggaccaggcgcggaggggagacacgcacaggctgagactcaggctgtgggtgccgacgctgggcgcagaccgccagccggggacctgggatgggaggtgtttttg

SEQ ID NO: 75376 - DNA, 176 bp, Homo sapiens
  misc_feature 1..176: note = chr13:100635935-100636111
  misc_feature 1..176: note = hyper
  source 1..176: mol_type = genomic DNA
cgtctcggggtgggtcgcgggggctttactgtggtttcgcagcagtttgtgaaattctctaatgggcaccacagagtttgcgattcccaacttggacccaggtcagctagagccccaggtcagctagagccccaggcagcgcggccccgcggggggatcgcgtgagaagagagagc

SEQ ID NO: 75377 - DNA, 311 bp, Homo sapiens
  misc_feature 1..311: note = chr13:100636130-100636441
  misc_feature 1..311: note = hyper
  source 1..311: mol_type = genomic DNA
cgcctcatagattattcatctatgaccaggtctcagccaaaatcgtgccagacgatttcctaaaagaaagccaaatgttttagcaacttcccccgtcaatatttactccgaagtggggatgcgccagcggcctattgttctcttccgggaagggagggagccgaggtgcgagacaagcttttaacaaggtttaaaatttgagaaatttatttgcatgaaatgctcgctttcgagtcctgtgtctgagcggatgtctttaagaaacaatttaggtgctaatggaatttaacgttaaacggtcccctttccaa

SEQ ID NO: 75378 - DNA, 1159 bp, Homo sapiens
  misc_feature 1..1159: note = chr13:100636859-100638018
  misc_feature 1..1159: note = hyper
  source 1..1159: mol_type = genomic DNA
acagcttctccgtggcgagagcaacttgttagaagctgcaaatccaagaagccctctagaaaggcaggcagggctaggagcttccccacattcctgagaaatttgaggagatggacgtcagcctggaagaaagtaaaatacgaaataaatgagcaggactgtcgggcgggaaggcggttaatttgatcttagttctgccgcagaggggatcggactggtttgagggacccagccccctcaggtccttctccctcgccgcggcccagccccctcgcagcctgagtgggggctctgcaggctctgggtgtctgcagccagcgccgatgtttgccgtccacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtaccaccgcggcggccgggaggagggcgaggcaggccgaggcgccggtgcagcactggcccggaccacctcagccggcctgggagggtccccaggggccagggcggcggggggaacatttctgggggtgctctcccccaggggcccggccccacagcagctgcactcacacccagtcccctctggtcccccctcccggcttttgtcttgcaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtg

SEQ ID NO: 75379 - DNA, 194 bp, Homo sapiens
  misc_feature 1..194: note = chr13:100640276-100640470
  misc_feature 1..194: note = hyper
  source 1..194: mol_type = genomic DNA
gctcgccttccccagcggctctgcgaactgcccaagcgccaactcctgaagcaatcagagccccattaaaatcaaatttataacccctaataatattaggcgaaattattaaaataattggcatatgttactgatccttgggagagttcattgaacacattataagctgtgaggaaaatcgtttagagttttcc

SEQ ID NO: 75380 - DNA, 254 bp, Homo sapiens
  misc_feature 1..254: note = chr13:100640905-100641159
  misc_feature 1..254: note = hyper
  source 1..254: mol_type = genomic DNA
ggagcgggcgggagccgcttttcctcgaaagggctcccagtccctggtccctcgcttcccaaggctttgtccaaacaagtcacggacccgacaaggtggtccattctctctctttggcctttcttttctgcccttcgaatccgaaggactggatggaggggaggggatatggcaatagtgtagaagtgtcaagatgtgaaaattgctcaactgagaacgcacgcgggggctcgcggcccaacagcctgcaccac

SEQ ID NO: 75381 - DNA, 51 bp, Homo sapiens; identical to SEQ ID NO: 1121
  misc_feature 1..51: note = chr13:100642150-100642201
  misc_feature 1..51: note = hyper
  source 1..51: mol_type = genomic DNA

SEQ ID NO: 75382 - DNA, 176 bp, Homo sapiens
  misc_feature 1..176: note = chr13:100642886-100643062
  misc_feature 1..176: note = hyper
  source 1..176: mol_type = genomic DNA
gtgctggggccacctcgtcgccctcccacgtttctcttttgttcccaggagccgacgagcttttgaagaggtgacacctcgcttcgccttctcctgctctaggccctgccctcgtccagcatccctcctgccccacgaagcgagaggatgctcagcgcagctgccaggcagagagt

SEQ ID NO: 75383 - DNA, 380 bp, Homo sapiens
  misc_feature 1..380: note = chr13:100643790-100644170
  misc_feature 1..380: note = hyper
  source 1..380: mol_type = genomic DNA
cggcggaggcctacagaggctcctgactggcagaactggaggtgtgggtgtggttcccttttcaccccggctcttatgttgccagtctcccccctaccaccaggcaaagcccccctaaacttagggtctggaacaaggccgagccagcgagggcctgccaggagctgcgctggagcctctcgctgcatccagagctggttcttgttcttttctctctcttggcccactgggcccacagtggttaggtggccgagtgtggtttcccgaaactctttggagtcgcctgggtctgcgtgcccctggccccgtcctcacccccgggctcgtcccccagcctccgccggcccgcctgtgaatggtggatttaatgagcgtttgtg

SEQ ID NO: 75384 - DNA, 405 bp, Homo sapiens
  misc_feature 1..405: note = chr13:100647898-100648303
  misc_feature 1..405: note = hyper
  source 1..405: mol_type = genomic DNA
tgctaagcagatctccgcgttaaattagcctaatcatttgcctctctgttttttctaaaggtctgtggtccaagtagcagtcattcctgcaatagacgataggttctgttcggtagcgggaatgtcctgtttctttgctttaagtttcactttgtgattaaaatgcaataaaataagtctggaaaatcatttttaagagaacactttcaagaagcacttcctttcctagtgccagacaacggtgctccccaaccacttggctggaacgcttgctttcgatttgtttgtttcgcgcatttccctaaagagccgggctctttgcgctgttttaattctgctttaaaaatgcatcgcttctgccctgaatccttctctgaaacaaattcctatcgaaagtgtatcaga

SEQ ID NO: 75385 - DNA, 243 bp, Homo sapiens
  misc_feature 1..243: note = chr13:100649333-100649576
  misc_feature 1..243: note = hyper
  source 1..243: mol_type = genomic DNA
ccctgggcgcagggctgtgtgtgcgaggacaattattttcatcagctgcttgctagcccgcgcccgactgctcctctttgcagaaccgacgggctttcaactctggaagtgaagcaggacgaattcctccatggagactccctccttgggaacgtcgaactctctctgccttggggagtggggctcgataaagggtacctaggtcgcaccctggcaggggagcactagagggccgcgaggtcc

SEQ ID NO: 75386 - DNA, 86 bp, Homo sapiens; identical to SEQ ID NO: 1123
  misc_feature 1..86: note = chr13:100649799-100649885
  misc_feature 1..86: note = hyper
  source 1..86: mol_type = genomic DNA

SEQ ID NO: 75387 - DNA, 75 bp, Homo sapiens
  misc_feature 1..75: note = chr13:100649944-100650019
  misc_feature 1..75: note = hyper
  source 1..75: mol_type = genomic DNA
cggccgagggagcctagagccggtgggagacgggcagcggcctctcctgatcctttcctgcggtcatacaagttc

SEQ ID NO: 75388 - DNA, 30 bp, Homo sapiens
  misc_feature 1..30: note = chr13:101298018-101298048
  misc_feature 1..30: note = hypo
  source 1..30: mol_type = genomic DNA
attttctgtcattcccgagtcgagggtctg

SEQ ID NO: 75389 - DNA, 31 bp, Homo sapiens
  misc_feature 1..31: note = chr13:101532259-101532290
  misc_feature 1..31: note = hypo
  source 1..31: mol_type = genomic DNA
agaaggacaaaagatcgagaccagcctggcc

SEQ ID NO: 75390 - DNA, 30 bp, Homo sapiens
  misc_feature 1..30: note = chr13:101714425-101714455
  misc_feature 1..30: note = hypo
  source 1..30: mol_type = genomic DNA
agctgcaagctcttccggatgtccacggac

SEQ ID NO: 75391 - DNA, 30 bp, Homo sapiens
  misc_feature 1..30: note = chr13:101787561-101787591
  misc_feature 1..30: note = hypo
  source 1..30: mol_type = genomic DNA
aaaactataaatatacgctagatagatttt

SEQ ID NO: 75392 - DNA, 200 bp, Homo sapiens
  misc_feature 1..200: note = chr13:102068158-102068358
  misc_feature 1..200: note = hyper
  source 1..200: mol_type = genomic DNA
ccccacctccccacccgcgcgttggcccagaggtttacccaggcagcggccctggtgccgagggggcaggtgcagcgctgtagtgatgcccagtggcctcgtcctcagccacctgccccccaacacctgctagatgcccaggcggggcaggcccgaggtgtcgccggccctgggcttcccaagccagcccaggggcatcc

SEQ ID NO: 75393 - DNA, 113 bp, Homo sapiens
  misc_feature 1..113: note = chr13:102068417-102068530
  misc_feature 1..113: note = hyper
  source 1..113: mol_type = genomic DNA
cgccccggccaggccggcaaggaccccaccgccccgctctcgggtggaggcgcccctccccacccctcccccgcgcggggcccccgcccgcagcccctctagcagcccctctc

SEQ ID NO: 75394 - DNA, 115 bp, Homo sapiens
  misc_feature 1..115: note = chr13:102068531-102068646
  misc_feature 1..115: note = hyper
  source 1..115: mol_type = genomic DNA
cagccccagcgcccctgagccgtcctggcccggaccggccaaggaactaacgagcgcgcatcgcgggcctcgggcgcagggcacggagccggccgcgccgcagcctcccgggcac

SEQ ID NO: 75395 - DNA, 260 bp, Homo sapiens
  misc_feature 1..260: note = chr13:102068811-102069071
  misc_feature 1..260: note = hyper
  source 1..260: mol_type = genomic DNA
cgctcggcccggctggggccgcggctcacgctcgccgtgtcactcactgagcgccgccgccgccgggcaggctgggggaggggtgggagccggagttttcgggcctttaaaaaattattattttatttaaatttttaaagttagctttgctacagggactgcagtgatgccgaagggcgggcaccgcagaggaggctgcgccgcagttggtggggagcgccagggtcggtactggcagttccttcttgccggctgccacc

SEQ ID NO: 75396 - DNA, 30 bp, Homo sapiens; identical to SEQ ID NO: 43836
  misc_feature 1..30: note = chr13:102206088-102206118
  misc_feature 1..30: note = hypo
  source 1..30: mol_type = genomic DNA

SEQ ID NO: 75397 - DNA, 30 bp, Homo sapiens; identical to SEQ ID NO: 43837
  misc_feature 1..30: note = chr13:102385630-102385660
  misc_feature 1..30: note = hypo
  source 1..30: mol_type = genomic DNA

SEQ ID NO: 75398 - DNA, 163 bp, Homo sapiens; identical to SEQ ID NO: 35062
  misc_feature 1..163: note = chr13:102568410-102568573
  misc_feature 1..163: note = hyper
  source 1..163: mol_type = genomic DNA

SEQ ID NO: 75399 - DNA, 109 bp, Homo sapiens; identical to SEQ ID NO: 35063
  misc_feature 1..109: note = chr13:102568659-102568768
  misc_feature 1..109: note = hyper
  source 1..109: mol_type = genomic DNA

SEQ ID NO: 75400 - DNA, 683 bp, Homo sapiens
  misc_feature 1..683: note = chr13:102569312-102569995
  misc_feature 1..683: note = hyper
  source 1..683: mol_type = genomic DNA
gctcgtcgcaggaaccccggcgggggtcgccaccgccactcgcgctgccttctcgccctgcccggctcccgggcgggaggtagagccggccggcggctccccgggcgccggctggagggcgggtcccggcagggtctctgcgcgtccgtcggtccgggtcgcgctgggcaggactcagcgccgggctccagctgcccgcgggccggtgccgccgccggcgccgcccgctctcggcttctgccggtgattgtcaagtgctttggaaatcagcatctggagagaccaatcttctcccctgagatctctaatcaaacgctccgttcccaccccactacaccccctccacctatgtggtccccctcctgatgtacctcttcagaaagaaacaaaacgtataggtaataatgatttaaaaataataagaaagaaagctaagatggattgcagggatggggtgctaagaggccgagccaaagcaggtggaattgaaggaacatcggggcgctttttcttagatgcaactcgctggttcccgagccttccgcggcttggttggggcttctcggtcttaacgtggttaccggtgcactgaaactctcagcagcggttggagggcgaggtggtttccgccctccctgctaatccctccagcaccaacgcccccccgtcgccacccccaaccc

SEQ ID NO: 75401 - DNA, 46 bp, Homo sapiens
  misc_feature 1..46: note = chr13:102571921-102571967
  misc_feature 1..46: note = hyper
  source 1..46: mol_type = genomic DNA
tcagagccctcccttcgttgttcagcagcctcggaccagcctgaca

SEQ ID NO: 75402 - DNA, 46 bp, Homo sapiens
  misc_feature 1..46: note = chr13:102572229-102572275
  misc_feature 1..46: note = hyper
  source 1..46: mol_type = genomic DNA
gcagcgcctgaacagcggactccggagtctccgggcatctattctg

SEQ ID NO: 75403 - DNA, 388 bp, Homo sapiens; identical to SEQ ID NO: 11707
  misc_feature 1..388: note = chr13:103046665-103047053
  misc_feature 1..388: note = hyper
  source 1..388: mol_type = genomic DNA

SEQ ID NO: 75404 - DNA, 274 bp, Homo sapiens
  misc_feature 1..274: note = chr13:103047054-103047328
  misc_feature 1..274: note = hyper
  source 1..274: mol_type = genomic DNA
gcgggaccggggactctgggccaatgggtaaagccaggaggaagcccgtgcctggcccgttgggctccctcctcctcagagccgaagcagtccacactcggaacccagcttcacccggattaccgaggggttccacgcctggaggcagagctgcagcgtgggcccgctcgcggctttgcagaaaacaaataatgacacacttctctggaagcccggggcctgggcccagagccgtggcttctgccaaactttctggtcccggacaccaactccc

SEQ ID NO: 75405 - DNA, 374 bp, Homo sapiens
  misc_feature 1..374: note = chr13:103052094-103052468
  misc_feature 1..374: note = hyper
  source 1..374: mol_type = genomic DNA
aggagggtaaaaggacggaggaggaggaaacagatggggtgaatagaaacggtgtaagaactagaacacagggaggaggactcagggcagagcccagagcccactgcagcaccgagtccacggagcagccagaggctactaccagagcctcaattgccaccccaaagtaccagctgggggcaatcttctccgccccagcataggagcctctgcccttttagactgtctaacaactcgcagtttctcctttgctgcaggaatggtggccgcaaacggtctcagcctccgcacccaccgcctccgtccccgcccacccgcacctcctcctcctctgcctcgcgctgcacccgcaggcggcagacccctcggagcgc

SEQ ID NO: 75406 - DNA, 359 bp, Homo sapiens; identical to SEQ ID NO: 35070
  misc_feature 1..359: note = chr13:103052469-103052828
  misc_feature 1..359: note = hyper
  source 1..359: mol_type = genomic DNA

SEQ ID NO: 75407 - DNA, 594 bp, Homo sapiens
  misc_feature 1..594: note = chr13:103052829-103053423
  misc_feature 1..594: note = hyper
  source 1..594: mol_type = genomic DNA
ccgccaccaccatgcagccctccagcctgcctcccctgggttgctcgcccacagctccgcggccgcccccaatcgcctcggactgagacgcggggacgggaacccctgggatccgactccccaaatcagatgcatttgcatttcttatgtaatgtactgcaagttcccttgttggagccctttggaatcggggcgcatgatcaccagtaggcttaaaagcaggaactcacggcctggctcatccccacccctggccctgtgggaccccgacgcagggctttgacaccgctttctaaagggggggacttcaattacaaatattagaggggctgggcttgtcctctcagtctggggttccctcccggcgcaagccttgctcaagtattcccggtggcaggatgtgtcagaggcagacagggggaatgagttaatgctcgggcacccggagctggacgggggagggacgcgggggctgacggaggagcggggccgcgagggagggggcctcttttactttggtaaaggtgatcgtggtggcgaatattgtgcaagctaatcagaaagtctagagcaggttctcggaacccagctacg

SEQ ID NO: 75408 - DNA, 189 bp, Homo sapiens
  misc_feature 1..189: note = chr13:103054542-103054731
  misc_feature 1..189: note = hyper
  source 1..189: mol_type = genomic DNA
ttttttataatcaatcgccagtgctcagtgggatcggtttgaacctgcagttctcaatcaccacgaagaaaagatgcaaatttaggtgccccctccccttgtcagtcttgtagtaggtagagagcgccacaaatccccttcctccttcctctcactcttccagtttccaacaaccgtgagcatgaggaa

SEQ ID NO: 75409 - DNA, 133 bp, Homo sapiens
  misc_feature 1..133: note = chr13:103157771-103157904
  misc_feature 1..133: note = hypo
  source 1..133: mol_type = genomic DNA
gttgtaaactctatacggataagcattacgtctgtctcgtattccactaaaatggtggataaatatttaatcaattaattaaaaacattttttatcagttctcagagatccacttgcacgtaaacctttgagt

SEQ ID NO: 75410 - DNA, 30 bp, Homo sapiens
  misc_feature 1..30: note = chr13:103451013-103451043
  misc_feature 1..30: note = hyper
  source 1..30: mol_type = genomic DNA
caaacatttacaagacggactctcgaaatg

SEQ ID NO: 75411 - DNA, 27 bp, Homo sapiens
  misc_feature 1..27: note = chr13:103569166-103569193
  misc_feature 1..27: note = hypo
  source 1..27: mol_type = genomic DNA
ccggccgtcccccgttaatcttactcc

SEQ ID NO: 75412 - DNA, 30 bp, Homo sapiens
  misc_feature 1..30: note = chr13:103598335-103598365
  misc_feature 1..30: note = hypo
  source 1..30: mol_type = genomic DNA
ctgtaagtccatgcacgtactaatgataga

SEQ ID NO: 75413 - DNA, 163 bp, Homo sapiens
  misc_feature 1..163: note = chr13:103724063-103724226
  misc_feature 1..163: note = hypo
  source 1..163: mol_type = genomic DNA
aaatccatgaccttgcggtggctgattatattattgctgtcagttaattgcttcctacttctctgtaatgggattctatagccacagctgttgaaattgacttgcagtgcttccctgttgaaggaatagccaattttttttggctttttttgcagggtggggg

SEQ ID NO: 75414 - DNA, 23 bp, Homo sapiens
  misc_feature 1..23: note = chr13:103931640-103931663
  misc_feature 1..23: note = hypo
  source 1..23: mol_type = genomic DNA
tatagaaaacctggccgggcgcg

SEQ ID NO: 75415 - DNA, 21 bp, Homo sapiens
  misc_feature 1..21: note = chr13:104514710-104514731
  misc_feature 1..21: note = hypo
  source 1..21: mol_type = genomic DNA
cccggccgagaattttatgta

SEQ ID NO: 75416 - DNA, 30 bp, Homo sapiens
  misc_feature 1..30: note = chr13:104659524-104659554
  misc_feature 1..30: note = hypo
  source 1..30: mol_type = genomic DNA
aaatcgcatatgcctcggggttaaggaata

SEQ ID NO: 75417 - DNA, 19 bp, Homo sapiens
  misc_feature 1..19: note = chr13:105886013-105886032
  misc_feature 1..19: note = hypo
  source 1..19: mol_type = genomic DNA
ttttttcttttgagacgga

SEQ ID NO: 75418 - DNA, 18 bp, Homo sapiens
  misc_feature 1..18: note = chr13:106549803-106549821
  misc_feature 1..18: note = hypo
  source 1..18: mol_type = genomic DNA
actcggcccattatcaat

SEQ ID NO: 75419 - DNA, 39 bp, Homo sapiens
  misc_feature 1..39: note = chr13:107001648-107001687
  misc_feature 1..39: note = hyper
  source 1..39: mol_type = genomic DNA
aaacagccatcagcgcggcgcgctcgttttttcccgcag

SEQ ID NO: 75420 - DNA, 496 bp, Homo sapiens
  misc_feature 1..496: note = chr13:107186664-107187160
  misc_feature 1..496: note = hyper
  source 1..496: mol_type = genomic DNA
ggctccagggctctgcgggcagcgtagcgactccaggctcccctctccagaacgcgcttcgctgccagcgtcctgccaccccggtcgcccgcccgcgggccccggaccacgccgcccgcgctccccgcgaatgcagcatctccgcctctctccagagcccaccagtccccgcgtgccggccagcctagattgtggccatgtccttcgtcctcgaaaacaggagagggtcaggtatcgccatcggacaccttcccggacttgacacccgagccgatagtagcttttagcgcctgggagcgttcgggggaggaaaggcggagagaccgtccgttccagcggggctcgggttggaaagccgagcgaggagtctccacctagtgaaatggggcgggggttgggggtgggggacggggaaccgaggttccagaaacaggctccgaggccccgcggactgacccctcctcccgcccggacggcgcggcggaccccggggcgg

SEQ ID NO: 75421 - DNA, 70 bp, Homo sapiens
  misc_feature 1..70: note = chr13:107188738-107188808
  misc_feature 1..70: note = hyper
  source 1..70: mol_type = genomic DNA
tcgccggcacaggcacgacgcggggaccgtctcactagcctctaggagacacgcgcgcttcccaaagtga

SEQ ID NO: 75422 - DNA, 30 bp, Homo sapiens
  misc_feature 1..30: note = chr13:107189087-107189117
  misc_feature 1..30: note = hyper
  source 1..30: mol_type = genomic DNA
acagtaggaagaacacggtagaaataaggc

SEQ ID NO: 75423 - DNA, 30 bp, Homo sapiens
  misc_feature 1..30: note = chr13:107323934-107323964
  misc_feature 1..30: note = hypo
  source 1..30: mol_type = genomic DNA
tgtgtctgcttgaagcgatgctccggaggg

SEQ ID NO: 75424 - DNA, 37 bp, Homo sapiens
  misc_feature 1..37: note = chr13:107552994-107553031
  misc_feature 1..37: note = hypo
  source 1..37: mol_type = genomic DNA
tgtctgtgtgtttatcgagatttgttgcccaggctga

SEQ ID NO: 75425 - DNA, 245 bp, Homo sapiens
  misc_feature 1..245: note = chr13:107570101-107570346
  misc_feature 1..245: note = hyper
  source 1..245: mol_type = genomic DNA
gaaacggggacagggcgcagggcagagcacagagcgcaggggcgcagagaaggggacgaagacggggccggaggcgcctgaggggggctccgtgcgggaatcggcggcgccacccagccccgcacatcgccgagagaggcccgcgtgcttctgagagcgccgcccctgacgtttctgctgcgcgctgggaccgaacctacaggaagcaaaaccctagaggaagaagtcggcggctttttggctcg

SEQ ID NO: 75426 - DNA, 22 bp, Homo sapiens
  misc_feature 1..22: note = chr13:108122378-108122400
  misc_feature 1..22: note = hypo
  source 1..22: mol_type = genomic DNA
ccacgcccgaccaactatgtat

SEQ ID NO: 75427 - DNA, 143 bp, Homo sapiens; identical to SEQ ID NO: 43839
  misc_feature 1..143: note = chr13:108218849-108218992
  misc_feature 1..143: note = hypo
  source 1..143: mol_type = genomic DNA

SEQ ID NO: 75428 - DNA, 30 bp, Homo sapiens
  misc_feature 1..30: note = chr13:108518091-108518121
  misc_feature 1..30: note = hyper
  source 1..30: mol_type = genomic DNA
cgctttcaaactcttcgtatttctcctgag

SEQ ID NO: 75429 - DNA, 213 bp, Homo sapiens
  misc_feature 1..213: note = chr13:108518444-108518657
  misc_feature 1..213: note = hyper
  source 1..213: mol_type = genomic DNA
cgccacacgggcttggcagagtttcctagaaaaagagccttgccccggtcgtctttgcctcggttgcccttgccgccgccgccgccgccgtctcccggggaggggggcagggtgggggacgaggaggcggagaggagtctgtgtgcctgggcggcgggcgaggactcccccatgctcgccaggagcgcgggccaggagggctcctgctgccgc

SEQ ID NO: 75430 - DNA, 216 bp, Homo sapiens
  misc_feature 1..216: note = chr13:108518717-108518933
  misc_feature 1..216: note = hyper
  source 1..216: mol_type = genomic DNA
tgctgctgctggtgctccttgtcccgggcccgggtcagcttggcctcggcgcagaaccacaagtgatcagagagcaggactgtgaaaaacaagagagatgccagagacagtcgccatttctgagccctctcggaatcgatgaacggtttctcgttctctcggggtgctgccaaccagatttttaagccgtcgtcatactgccgacacatccaagca

SEQ ID NO: 75431 - DNA, 156 bp, Homo sapiens; identical to SEQ ID NO: 35076
  misc_feature 1..156: note = chr13:108519254-108519410
  misc_feature 1..156: note = hyper
  source 1..156: mol_type = genomic DNA

SEQ ID NO: 75432 - DNA, 124 bp, Homo sapiens; identical to SEQ ID NO: 35077
  misc_feature 1..124: note = chr13:108519622-108519746
  misc_feature 1..124: note = hyper
  source 1..124: mol_type = genomic DNA

SEQ ID NO: 75433 - DNA, 31 bp, Homo sapiens
  misc_feature 1..31: note = chr13:108519901-108519932
  misc_feature 1..31: note = hyper
  source 1..31: mol_type = genomic DNA
cgcagtggcgccggctcggcccgggaggagg

SEQ ID NO: 75434 - DNA, 70 bp, Homo sapiens; identical to SEQ ID NO: 35079
  misc_feature 1..70: note = chr13:108520465-108520535
  misc_feature 1..70: note = hyper
  source 1..70: mol_type = genomic DNA

SEQ ID NO: 75435 - DNA, 125 bp, Homo sapiens
  misc_feature 1..125: note = chr13:108520701-108520826
  misc_feature 1..125: note = hyper
  source 1..125: mol_type = genomic DNA
cgagctgggtgcctgcgagtcgccgccgcagtctgagcctctggtgccccttagcgttggctctcggagttctgagaagggaaaggagacagacactctgggaaaatctggggtcacctcgattc

SEQ ID NO: 75436 - DNA, 286 bp, Homo sapiens
  misc_feature 1..286: note = chr13:109147577-109147863
  misc_feature 1..286: note = hyper
  source 1..286: mol_type = genomic DNA
cactgccacagtccccgcgatggcctttgttctgttaggactccccagggggacctcggctccaggtcacagctctgggcactcccttctcctcctgctcccaggatcttgctaaagtggagacggaaggaaaagtttcaggagtgagctgcgttcttagaattgtagcagagagagaggagggagagagcagaggatcggagggcaggagtggagagaggcgcggtctcctggaacgcgcgggggaacgtggaaaggagggcgcgggagacccggagggctgccc

SEQ ID NO: 75437 - DNA, 125 bp, Homo sapiens; identical to SEQ ID NO: 35082
  misc_feature 1..125: note = chr13:109148154-109148279
  misc_feature 1..125: note = hyper
  source 1..125: mol_type = genomic DNA

SEQ ID NO: 75438 - DNA, 656 bp, Homo sapiens
  misc_feature 1..656: note = chr13:109148376-109149032
  misc_feature 1..656: note = hyper
  source 1..656: mol_type = genomic DNA
cgccgggctggggacgccgggagggtgccccgggtcggacttgcggcgctgggtccccacccagagttcccgcacggtgagggttggacgcgtctggggggcgtggagaggaggcttgtcggtcccttcctgggaaaggaatcgcggggacttcccaaccgctaggacgcgtaagccgaggctgggagtagaagccttctgaactctggacctaccccagaaggagggggcgaaactggccatttcgagggacgcggaagccccgttgctaggggagatgggggaagcggcgtggtcacctacacaaccgctcccaggcgcgatgggggctctgcttcctcctcctctgtttctttggggatggaaaagagagcagaacaaagatgtagagtgaaggagggctccccagctgttgcctcttgcgcggattctgctgacccctctgcgcgaccccagctgggcagtgtcagctccattgtctcagaggccggcggccaagtgagggaccagtctcacccggggggcgtcgagcctcagcgcatcgccccgtcttccctggctgcagaaaaccactaggccggtggaagtgctccgtttaattggtccctagtacgcccccgaaaggaaatggagacgatttccgtcaagttctctta

SEQ ID NO: 75439 - DNA, 30 bp, Homo sapiens
  misc_feature 1..30: note = chr13:109149238-109149268
  misc_feature 1..30: note = hyper
  source 1..30: mol_type = genomic DNA
cagagggctgacctgcgtcttccaaaggca

SEQ ID NO: 75440 - DNA, 30 bp, Homo sapiens
  misc_feature 1..30: note = chr13:109779816-109779846
  misc_feature 1..30: note = hypo
  source 1..30: mol_type = genomic DNA
agggaccccaacacccggctgagtgcttcc

SEQ ID NO: 75441 - DNA, 30 bp, Homo sapiens
  misc_feature 1..30: note = chr13:109917328-109917358
  misc_feature 1..30: note = hypo
  source 1..30: mol_type = genomic DNA
gggctgccagagattcgcactctatgctga

SEQ ID NO: 75442 - DNA, 30 bp, Homo sapiens
  misc_feature 1..30: note = chr13:109944512-109944542
  misc_feature 1..30: note = hypo
  source 1..30: mol_type = genomic DNA
ctcttatttcatgctcgctatgcatattaa

SEQ ID NO: 75443 - DNA, 23 bp, Homo sapiens
  misc_feature 1..23: note = chr13:110053866-110053889
  misc_feature 1..23: note = hypo
  source 1..23: mol_type = genomic DNA
tacctgagattcaatcgctgagg

SEQ ID NO: 75444 - DNA, 23 bp, Homo sapiens
  misc_feature 1..23: note = chr13:110053949-110053972
  misc_feature 1..23: note = hypo
  source 1..23: mol_type = genomic DNA
ttttggcccgataaattccattt

SEQ ID NO: 75445 - DNA, 30 bp, Homo sapiens
  misc_feature 1..30: note = chr13:110174352-110174382
  misc_feature 1..30: note = hypo
  source 1..30: mol_type = genomic DNA
cattcttttttgagacggagtctcactctg

SEQ ID NO: 75446 - DNA, 30 bp, Homo sapiens
  misc_feature 1..30: note = chr13:110344624-110344654
  misc_feature 1..30: note = hypo
  source 1..30: mol_type = genomic DNA
gctctgagaaaatggcgatcctctgagaac

SEQ ID NO: 75447 - DNA, 160 bp, Homo sapiens
  misc_feature 1..160: note = chr13:110424427-110424587
  misc_feature 1..160: note = hypo
  source 1..160: mol_type = genomic DNA
ggctcacccggcatgcgctgggcccaggcagcgcagggcagtcatgggtgagggtggccactgagatgacgggatcgggggcggcttctgccgcagacccgggaattcacgtggtcagatggtccctgacttcagtccctattttcggtggttcatagca

SEQ ID NO: 75448 - DNA, 2130 bp, Homo sapiens
  misc_feature 1..2130: note = chr13:110434379-110436509
  misc_feature 1..2130: note = hypo
  source 1..2130: mol_type = genomic DNA
cctcctcacctttcacgatggtggcctccttcaagtggtgggacaagaagtcaatgctggcgtaggtgttggcagggggcagggcaccgggacccggccccccgcacccgccgccggtgctgccgacgcccacagcgctgatgagacccccgaggcttcgggtccggccccaggagctcttgtctcccggctgaggaagcggcggcggcggcggctgcggctggggtggcagcccgggctcctccctcacgtcgatggcgatgtagttgagaccattctggaagccggcagaggtctctctgcgcatgggcgatccaccgctcccaggacaaccgaccaagcccccgggctgacccggggtccacggccggccctgcggtgccaaagggggcgccggctgcaactgtcgtggggaggtgggcggctcgtcgccccctccagggccgacacccacgccgccctcgctgcttttcctgagagagacattttccacggaggccgagttgtggcgcttggggttgtgggcgaaggacggggacacgggggtgaccgtcgtggtggaggagaaggtctcggaactgtggcggcggcggcccccctgcgggtctgcgcggatgaccttggcgccgcggtgggggtccgggggctggctggcctgcaggaaggcctcgactcccgacacctgctccatgaggctcagcctcttcacgcccgacgtcgggctggccacgcgggcagcttctggcttcgggggggccgcgataggttgcggcggggtggcggccacaccaaaagccatctcggtgtagtcaccattgtccccggtgtccgaggacaacgatgaggcggcgcccgggccctgggcggtggcaacggccgaggcggggggcaggcggtacagctcccccggggccggcggcggtggcggcggctgcagagacgacgacggggacgcggacggacgcgggggcaacggcggatacggggaggaggcctcgggggacaggaggccgtccaaggagcccacggggtggccgctcggggcgcccggcttaggagacttgggggagctgaagtcgaggttcatgtagtcggagagcggagaccgctgccggctgtcgctgctggtgcccggggtgcctgagcccagcgacgaggccgggctgctggcggacaagagcgaggaggacgaggccgccgacgccagcaggggaggcgcgggcggcgacaggcgggccccgggctcgccaaagtcgatgttgatgtactcgccggggctcttgggctccggtggcagtgggtactcgtgcatgctgggcaggctgggcagcccctccagggacaggcgcgtgggcctcaccgcccggccgcgctggcccaagaagccctccgggcggccgccgctaggccgcacgggcgaaggcactacagggtgagggggctgcgtggggccggccccgaaggcgctggccgcctggctgggccctggcgtggcctgaggctccagacgctcctcctccaggatgcgccccacgggggagctcatgagcacgtactggtcgctgtccccgccacaggtgtagggggccttgtaggagcggggcaaggagctgtagcagcagccgggaacgcccctgagcggctccccgccggggtgcagggctgcggagaagaagtcgggcggggtgcccgtggtgaccgcgtcgctgggggacacgttgaggtagtccccgttgggcagcagcttgccatctgcatgctccatggacagcttggaaccgcaccacatgcgcatgtacccactgtcctcgggggagctctcggcgggcgagctggccttgtagccgcccccgctcgccgggaatgtcctgcccgccgcagaggtgggtgctggccccgcaggccccgcagaaggcacggcggcggcggcggcggcggcggccctgggctgcaagatctgcttgggggcggacacgctggcggggctcatgggcatgtagtcgtcgctcctgcagctgccgctcccactgcccgcgagggccgcgccgggcgtcatgggcatgtagccgtcgtctgcccccaggttgctgctggagctcctgtgggagccgatctcgatgtctccgtagt

SEQ ID NO: 75449 - DNA, 35 bp, Homo sapiens
  misc_feature 1..35: note = chr13:110438921-110438956
  misc_feature 1..35: note = hyper
  source 1..35: mol_type = genomic DNA
gtgagtaacacatcgcgcaccgagtgactgaacta

SEQ ID NO: 75450 - DNA, 45 bp, Homo sapiens
  misc_feature 1..45: note = chr13:110439819-110439864
  misc_feature 1..45: note = hyper
  source 1..45: mol_type = genomic DNA
caggcggagaaagtgcggtttccatagcgccggggagagggcgga

SEQ ID NO: 75451 - DNA, 30 bp, Homo sapiens
  misc_feature 1..30: note = chr13:110525952-110525982
  misc_feature 1..30: note = hypo
  source 1..30: mol_type = genomic DNA
caacggtgtcacacacggtggcctcagtgt

SEQ ID NO: 75452 - DNA, 30 bp, Homo sapiens; identical to SEQ ID NO: 43842
  misc_feature 1..30: note = chr13:110659714-110659744
  misc_feature 1..30: note = hypo
  source 1..30: mol_type = genomic DNA

SEQ ID NO: 75453 - DNA, 30 bp, Homo sapiens
  misc_feature 1..30: note = chr13:110767621-110767651
  misc_feature 1..30: note = hypo
  source 1..30: mol_type = genomic DNA
attatctcttccagtcgtatcacatgaggt

SEQ ID NO: 75454 - DNA, 30 bp, Homo sapiens
  misc_feature 1..30: note = chr13:110958402-110958432
  misc_feature 1..30: note = hyper
  source 1..30: mol_type = genomic DNA
aagtctttattctctcggaggggaaggaaa

SEQ ID NO: 75455 - DNA, 268 bp, Homo sapiens; identical to SEQ ID NO: 35085
  misc_feature 1..268: note = chr13:110958709-110958977
  misc_feature 1..268: note = hyper
  source 1..268: mol_type = genomic DNA

SEQ ID NO: 75456 - DNA, 76 bp, Homo sapiens; identical to SEQ ID NO: 35086
  misc_feature 1..76: note = chr13:110958978-110959054
  misc_feature 1..76: note = hyper
  source 1..76: mol_type = genomic DNA

SEQ ID NO: 75457 - DNA, 132 bp, Homo sapiens; identical to SEQ ID NO: 4051
  misc_feature 1..132: note = chr13:110959517-110959649
  misc_feature 1..132: note = hyper
  source 1..132: mol_type = genomic DNA

SEQ ID NO: 75458 - DNA, 391 bp, Homo sapiens; identical to SEQ ID NO: 35088
  misc_feature 1..391: note = chr13:110959752-110960143
  misc_feature 1..391: note = hyper
  source 1..391: mol_type = genomic DNA

SEQ ID NO: 75459 - DNA, 259 bp, Homo sapiens; identical to SEQ ID NO: 35089
  misc_feature 1..259: note = chr13:110960344-110960603
  misc_feature 1..259: note = hyper
  source 1..259: mol_type = genomic DNA

SEQ ID NO: 75460 - DNA, 221 bp, Homo sapiens; identical to SEQ ID NO: 35090
  misc_feature 1..221: note = chr13:110960909-110961130
  misc_feature 1..221: note = hyper
  source 1..221: mol_type = genomic DNA

SEQ ID NO: 75461 - DNA, 97 bp, Homo sapiens
  misc_feature 1..97: note = chr13:110998830-110998927
  misc_feature 1..97: note = hypo
  source 1..97: mol_type = genomic DNA
agtgaccaagacattcgaagacaggcaaggaaaccttcaaatgcaggcaactcatatttcgacggggcaccctccagtgctccgagatggaaattgc

SEQ ID NO: 75462 - DNA, 126 bp, Homo sapiens
  misc_feature 1..126: note = chr13:110999273-110999399
  misc_feature 1..126: note = hypo
  source 1..126: mol_type = genomic DNA
gagcctcatcccctgcgcttatcgtggctcactgccaagtgcgaacacctgggtccacgcctccgcatgccgggcccgtgtgcacacctgccttcctcgctggtgagagggcgcatctcagcctgc

SEQ ID NO: 75463 - DNA, 149 bp, Homo sapiens; identical to SEQ ID NO: 43844
  misc_feature 1..149: note = chr13:111144888-111145037
  misc_feature 1..149: note = hypo
  source 1..149: mol_type = genomic DNA

SEQ ID NO: 75464 - DNA, 30 bp, Homo sapiens
  misc_feature 1..30: note = chr13:111207973-111208003
  misc_feature 1..30: note = hypo
  source 1..30: mol_type = genomic DNA
gggcagaggacgccacggaagcgcaaacgt

SEQ ID NO: 75465 - DNA, 66 bp, Homo sapiens
  misc_feature 1..66: note = chr13:111267526-111267592
  misc_feature 1..66: note = hypo
  source 1..66: mol_type = genomic DNA
aaagcgaaggggcctcgcagcgagctggtttggggttcagggcagaggttgcgcctggagcagaaa

SEQ ID NO: 75466 - DNA, 580 bp, Homo sapiens
  misc_feature 1..580: note = chr13:111277084-111277664
  misc_feature 1..580: note = hypo
  source 1..580: mol_type = genomic DNA
aggcgtgagccactgcacctggcctcaattgaagcccatttttaaaacctaaagcgtgatttgtattgtactccaccaaagtgcacctgggatgcctttgtaggtcgcagctgaagccgctgatcctgcagtttcccatgagctgagcaagtgctaacggccggcctcttcctgtgacccttcctcctggagggtgaccagaccgagctgggccgtgctggtgtgtgtggctctgaccctgcctctgcagtggcggcaaaagtctttctttttaggtattgtgctctgcgccctggccctttgctaagccacctggctgggtgtaatccgagctagtacgtttctcatgcacgtcaccagggctgagtaatgagcgctggacgcctgtgtctggcgggtgggcagcgatgccggagcgatccctgagtcggcctcttgtgctccttcatcagggcgcagacttgtcccacgtgttctgtgccagtgcggccgcacctgtgattaaggcctacagcccggagctgatcgtccacccagttctgtgagtcgctctgcgccggcttctcgtaggttctctttc

SEQ ID NO: 75467 - DNA, 105 bp, Homo sapiens
  misc_feature 1..105: note = chr13:111278321-111278426
  misc_feature 1..105: note = hypo
  source 1..105: mol_type = genomic DNA
agcacagtgtgatgacgcctgggtcgagcccggcctctccacaccagagaggagccggcgcggagctccaggtgcggtgctgtgatgtgtcgggtgaccaagagg

SEQ ID NO: 75468 - DNA, 178 bp, Homo sapiens
  misc_feature 1..178: note = chr13:111289167-111289345
  misc_feature 1..178: note = hypo
  source 1..178: mol_type = genomic DNA
ctgcctgcttgggctcgtctgaggcggttccgagctgcaggtgtctccaccaacctgctgtgctacacagcggggtctggggcagcctcaccactgcgtgtcttggtttcctcttctgtaaaacagaggctgcctccaacccttggaacaaacagggaagagccgtagcaggcaggat

SEQ ID NO: 75469 - DNA, 30 bp, Homo sapiens
  misc_feature 1..30: note = chr13:111337750-111337780
  misc_feature 1..30: note = hypo
  source 1..30: mol_type = genomic DNA
atcctcagggcctcacgtgctcatcttacg

SEQ ID NO: 75470 - DNA, 88 bp, Homo sapiens
  misc_feature 1..88: note = chr13:111363884-111363972
  misc_feature 1..88: note = hypo
  source 1..88: mol_type = genomic DNA
ccaagtagtggccaataaatcttgtagaaactaaagtactcatttgcttttaactaggccaagactagaatagcgtgatctgtaagta

SEQ ID NO: 75471 - DNA, 214 bp, Homo sapiens
  misc_feature 1..214: note = chr13:111477321-111477535
  misc_feature 1..214: note = hypo
  source 1..214: mol_type = genomic DNA
gcggaccgacgggtgcggtgagtggagatgattttgtgagagtttttaggacaatcctggaagtgggtttgtcacttctggctgcactccattggcctgaaaggaatcacacggccccaccccaatgcgggaggctgggagtgttcagcgcctgcagagaaggtcaggtgggctggaagccctgcgccaggcatggccacgccctggtgaaggt

SEQ ID NO: 75472 - DNA, 37 bp, Homo sapiens
  misc_feature 1..37: note = chr13:111682046-111682083
  misc_feature 1..37: note = hypo
  source 1..37: mol_type = genomic DNA
acgcaggctcagggtcggactccgatggggatgcatt

SEQ ID NO: 75473 - DNA, 39 bp, Homo sapiens
  misc_feature 1..39: note = chr13:111704359-111704398
  misc_feature 1..39: note = hypo
  source 1..39: mol_type = genomic DNA
cccagaagcaggtcacgagaccctcatgtgagagcacgt

SEQ ID NO: 75474 - DNA, 30 bp, Homo sapiens
  misc_feature 1..30: note = chr13:111745610-111745640
  misc_feature 1..30: note = hypo
  source 1..30: mol_type = genomic DNA
gatgtgaaacccccacgactcctctctcct

SEQ ID NO: 75475 - DNA, 30 bp, Homo sapiens; identical to SEQ ID NO: 43850
  misc_feature 1..30: note = chr13:111764740-111764770
  misc_feature 1..30: note = hypo
  source 1..30: mol_type = genomic DNA

SEQ ID NO: 75476 - DNA, 146 bp, Homo sapiens
  misc_feature 1..146: note = chr13:111766799-111766945
  misc_feature 1..146: note = hyper
  source 1..146: mol_type = genomic DNA
gagtgagtggagactcgtgtccttttaagaagaggctccatttcttcctcgcatgtcaatgtgtgcgtgtcatcagttgttcgaggaagctcgcgcatgacgcgacacttgccgtctgggctctccaggttcggcctgctgctttc

SEQ ID NO: 75477 - DNA, 905 bp, Homo sapiens
  misc_feature 1..905: note = chr13:111767213-111768118
  misc_feature 1..905: note = hyper
  source 1..905: mol_type = genomic DNA
tgcaaggtagcaaagcgaaacaaacgtctcgttttcagcctgtccccgccaccttgaaataaaaccggcaaaaataaaaagagcattctgggaagtacttcatcatttcaacgctcacgaattcaaaacataaacaaaggcttccgagtgccccggccaggggcgcggggcgcacggcgggcccggggcaggtaagcgcaggtgcgcgcccgcccccacccccggctccctccccatccgctccccgctccccttcccctttcccttccccgcccgctcccagccgccgccgccgccccgcgcacggcctggagcggaggctgcgcagggcgcggggcggcgcgggccgggcgcgggccgggcggacggccgcgtctttcttctcctggcggtgatgtcattgggcgacggcggccgaggccggggggcggcggcgggcgcccgcaggttcccgagccgctcctgagaaggcgcctgacagcgggccggggcgcacggagaagcgggccgggccggacctgctgggccgcgccgagccaatcgccggcgccggccgctcgatgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaagtaagtcccggcccgcgcccccgcccgcgccccccggtccggcccgctgcggcccgggatgcgcgcggagcacctgaggc

SEQ ID NO: 75478 - DNA, 92 bp, Homo sapiens
  misc_feature 1..92: note = chr13:111768416-111768508
  misc_feature 1..92: note = hyper
  source 1..92: mol_type = genomic DNA
cggctcactccgctggctttgtgtggacagttcttgccggtggcgttgcgtgagtttcgcctcccaggttaattgaccggttgctctgtatt

SEQ ID NO: 75479 - DNA, 30 bp, Homo sapiens
  misc_feature 1..30: note = chr13:111768797-111768827
  misc_feature 1..30: note = hyper
  source 1..30: mol_type = genomic DNA
tcatcgcccacaagccggccagcagggccg

SEQ ID NO: 75480 - DNA, 30 bp, Homo sapiens
  misc_feature 1..30: note = chr13:111773890-111773920
  misc_feature 1..30: note = hypo
  source 1..30: mol_type = genomic DNA
agggtggattttagccgtttggattggagt

SEQ ID NO: 75481 - DNA, 30 bp, Homo sapiens
  misc_feature 1..30: note = chr13:111797673-111797703
  misc_feature 1..30: note = hypo
  source 1..30: mol_type = genomic DNA
aggtggtttatgagacgatttatgaagtga

SEQ ID NO: 75482 - DNA, 30 bp, Homo sapiens
  misc_feature 1..30: note = chr13:111932841-111932871
  misc_feature 1..30: note = hypo
  source 1..30: mol_type = genomic DNA
acctgtgtttccactcggcctattttttcc

SEQ ID NO: 75483 - DNA, 30 bp, Homo sapiens
  misc_feature 1..30: note = chr13:111972934-111972964
  misc_feature 1..30: note = hypo
  source 1..30: mol_type = genomic DNA
tgtgtgatgtcacagcgggcggggtggtgt

SEQ ID NO: 75484 - DNA, 408 bp, Homo sapiens
  misc_feature 1..408: note = chr13:111978537-111978945
  misc_feature 1..408: note = hypo
  source 1..408: mol_type = genomic DNA
gggtggaggagactgcgggcagtgtgagcctgtctggtggggtggagactgcgggcaacgcgagcctggcgctggtgggtgtctggtggggtggaagagactgcgggcagtgtgagcctgtctggtggggtggagactgcgggcaacgcgagcctggggctggtgggtgtctggtggggtggaggagaccgcgggcagcgtgaggctgtctggtggggtggaggagacggtgggcagcgtgagcctggcgctggtgggtgtctggtggggtggaagagactgcgggcagtgcgagcctgtctggtggggtggaggagaccacgggcagcgcgaggctgtctggtggggtggagactgcgggcaacgcgagcctggtgctggcgggtgtctggtcgggtggaagagact

SEQ ID NO: 75485 - DNA, 137 bp, Homo sapiens
  misc_feature 1..137: note = chr13:111997459-111997596
  misc_feature 1..137: note = hypo
  source 1..137: mol_type = genomic DNA
gctctgcggctgtagcgtgaaggcagacaccgacgatgcctccaggaaggacgtggccttgctccaaaaagactttcttatggaagccagtgacgggctggacgctgcctacaagctgtagtcggtaaacccccagg

SEQ ID NO: 75486 - DNA, 30 bp, Homo sapiens
  misc_feature 1..30: note = chr13:112052769-112052799
  misc_feature 1..30: note = hypo
  source 1..30: mol_type = genomic DNA
tgctccagacacccacggtgcacatccatc

SEQ ID NO: 75487 - DNA, 149 bp, Homo sapiens
  misc_feature 1..149: note = chr13:112060039-112060188
  misc_feature 1..149: note = hypo
  source 1..149: mol_type = genomic DNA
tccagggcgctcctccggtctcactctttgagtcccccccacactctgggactctccagtcagctctggtccggctcatgcagacaccagttggtaaacaggaggtgctcaacgagtgttggctggtcatagagcgtgcctcatggatg

SEQ ID NO: 75488 - DNA, 30 bp, Homo sapiens; identical to SEQ ID NO: 43852
  misc_feature 1..30: note = chr13:112062748-112062778
  misc_feature 1..30: note = hypo
  source 1..30: mol_type = genomic DNA

SEQ ID NO: 75489 - DNA, 187 bp, Homo sapiens
  misc_feature 1..187: note = chr13:112078320-112078507
  misc_feature 1..187: note = hypo
  source 1..187: mol_type = genomic DNA
gtgggatgctctgcccgcgtggctgtggaaggagactgaagtcagagataggtggtcaggctttcccagttaaaaaaaatagctgaacttgatggcgtgtttaacatgcacctggcattttgccacacactgtctcatttaaccagcgccgctgactgggaaggaaccactgcggccacctccacct

SEQ ID NO: 75490 - DNA, 60 bp, Homo sapiens
  misc_feature 1..60: note = chr13:112090514-112090574
  misc_feature 1..60: note = hypo
  source 1..60: mol_type = genomic DNA
aggctttggggcaatcggtgcgctgccatagacagcagacacccccgggagtcagaatcc

SEQ ID NO: 75491 - DNA, 30 bp, Homo sapiens
  misc_feature 1..30: note = chr13:112165349-112165379
  misc_feature 1..30: note = hypo
  source 1..30: mol_type = genomic DNA
gtagcccattggacacggctgaggtgaccc

SEQ ID NO: 75492 - DNA, 30 bp, Homo sapiens
  misc_feature 1..30: note = chr13:112172192-112172222
  misc_feature 1..30: note = hypo
  source 1..30: mol_type = genomic DNA
aaaacttttccaaagcggtttaatgaagat

SEQ ID NO: 75493 - DNA, 111 bp, Homo sapiens
  misc_feature 1..111: note = chr13:112192088-112192199
  misc_feature 1..111: note = hypo
  source 1..111: mol_type = genomic DNA
cccggtgggtggctgcgattcctgcctctgagattcaggggccctgctggggtttgctgagcatggatgtgtccttggggctgctgctatcattcccgttccacaaacaag

SEQ ID NO: 75494 - DNA, 30 bp, Homo sapiens
  misc_feature 1..30: note = chr13:112196610-112196640
  misc_feature 1..30: note = hypo
  source 1..30: mol_type = genomic DNA
ggagtagacaccaaacgccacattcccaat

SEQ ID NO: 75495 - DNA, 272 bp, Homo sapiens
  misc_feature 1..272: note = chr13:112200634-112200906
  misc_feature 1..272: note = hypo
  source 1..272: mol_type = genomic DNA
tgtggacgtcaaactcgctgccggccagggggcttgccctgggaaccccactcccgctgaaggccagcagtgagagaggtgggacagcagtttctgcatctgttcgcagcaaggcagtctcttctgcctcgcagtctcgttcaggcaacactgcgggaattcggcgtgcatcgctggcgggccgctgctccctgccgccctcccgggttgtggctgagcccacgggaggcgcgtatttcccacgccatcgctggctgcgcttgctcctgtgg

SEQ ID NO: 75496 - DNA, 66 bp, Homo sapiens
  misc_feature 1..66: note = chr13:112236766-112236832
  misc_feature 1..66: note = hypo
  source 1..66: mol_type = genomic DNA
ttgttttccctagcacgctgcctggagcgctgatgtgttgtaggagaaagacgttgttatgacaat

SEQ ID NO: 75497 - DNA, 30 bp, Homo sapiens; identical to SEQ ID NO: 43855
  misc_feature 1..30: note = chr13:112243149-112243179
  misc_feature 1..30: note = hypo
  source 1..30: mol_type = genomic DNA

SEQ ID NO: 75498 - DNA, 79 bp, Homo sapiens
  misc_feature 1..79: note = chr13:112272942-112273021
  misc_feature 1..79: note = hypo
  source 1..79: mol_type = genomic DNA
ggaggtggcatatcacgtgtcatggcgtctaataatgtggtgggttagaacatggtgagaccaacgtctggaatggcca

SEQ ID NO: 75499 - DNA, 30 bp, Homo sapiens
  misc_feature 1..30: note = chr13:112274381-112274411
  misc_feature 1..30: note = hypo
  source 1..30: mol_type = genomic DNA
ccctctgaggtccggcgcctcatccatcag

SEQ ID NO: 75500 - DNA, 68 bp, Homo sapiens; identical to SEQ ID NO: 43857
  misc_feature 1..68: note = chr13:112274715-112274783
  misc_feature 1..68: note = hypo
  source 1..68: mol_type = genomic DNA

SEQ ID NO: 75501 - DNA, 36 bp, Homo sapiens
  misc_feature 1..36: note = chr13:112276380-112276416
  misc_feature 1..36: note = hypo
  source 1..36: mol_type = genomic DNA
cacagggtccagatccgagtgcgctgttatcctcaa

SEQ ID NO: 75502 - DNA, 30 bp, Homo sapiens
  misc_feature 1..30: note = chr13:112309025-112309055
  misc_feature 1..30: note = hypo
  source 1..30: mol_type = genomic DNA
agggcgctccagaaacgtcaccatcaccac

SEQ ID NO: 75503 - DNA, 179 bp, Homo sapiens
  misc_feature 1..179: note = chr13:112320583-112320762
  misc_feature 1..179: note = hypo
  source 1..179: mol_type = genomic DNA
gcagtggtggttccacgttggccgaggtccactccctgctgcaatcactcgtggcatctacagggaactcagaggctccctctgaggggctgagctttgcgggagagaacaggggctgggaagtcccttggtgtctaaaagtctgaattgcagacaatccctgtcgttaacctggaact

SEQ ID NO: 75504 - DNA, 32 bp, Homo sapiens
  misc_feature 1..32: note = chr13:112321043-112321075
  misc_feature 1..32: note = hypo
  source 1..32: mol_type = genomic DNA
gacccccgcagggcccgcggctcccccagcct

SEQ ID NO: 75505 - DNA, 30 bp, Homo sapiens
  misc_feature 1..30: note = chr13:112323073-112323103
  misc_feature 1..30: note = hypo
  source 1..30: mol_type = genomic DNA
ccgcaggggtcagtgcggagggggcggccg

SEQ ID NO: 75506 - DNA, 167 bp, Homo sapiens
  misc_feature 1..167: note = chr13:112341901-112342068
  misc_feature 1..167: note = hypo
  source 1..167: mol_type = genomic DNA
cccccacactgaacacggcttctccaataatccacgacccctaggggagagtaacaatttatttttctttcttggctacaattaggcttccaaccatggtgcaccattcccgccgttgcctccatcacaacttaagacaatgagaatgcattcggatgaaagtcacc

SEQ ID NO: 75507 - DNA, 30 bp, Homo sapiens
  misc_feature 1..30: note = chr13:112347214-112347244
  misc_feature 1..30: note = hypo
  source 1..30: mol_type = genomic DNA
ctccctctctctctccgctgtctccccaga

SEQ ID NO: 75508 - DNA, 36 bp, Homo sapiens
  misc_feature 1..36: note = chr13:112512707-112512743
  misc_feature 1..36: note = hypo
  source 1..36: mol_type = genomic DNA
cacccctgtctcctacgtcctcggaaacgggcgggt

SEQ ID NO: 75509 - DNA, 116 bp, Homo sapiens
  misc_feature 1..116: note = chr13:112513008-112513124
  misc_feature 1..116: note = hypo
  source 1..116: mol_type = genomic DNA
gatctggggcccctgcgtgccagctcccagtgtggctggagggcaagggcaggtccccgtcctcacgctccctgtagaaagagccgctgcacccccgtgaccgctccatgctgggg

SEQ ID NO: 75510 - DNA, 325 bp, Homo sapiens
  misc_feature 1..325: note = chr13:112553503-112553828
  misc_feature 1..325: note = hypo
  source 1..325: mol_type = genomic DNA
acagcaaagggttggcgtatcccagtggcaacccagcccccccaactgccgccgtccttgcccgggctgatcacgacaagggttggcatatcccagtggcaacccgggcccctccactgctgccatccctgcccgggctaatcacgacaagggttggcacatcccagcggcagcccggcgcccccccaccccgccccactgctgccgtccttgcccgggctaatcacgacaagcgttgccgtatcccagtggcaacccgggcccctccactgccaccgtccctgcccaggctaatcacaacaagggctggcgtatcccagtggca

SEQ ID NO: 75511 - DNA, 64 bp, Homo sapiens
  misc_feature 1..64: note = chr13:112558994-112559058
  misc_feature 1..64: note = hypo
  source 1..64: mol_type = genomic DNA
ggcaatgatgccacccgcatgtatctgtgtggcagcaaaatccaggccacggccttccatcatt

SEQ ID NO: 75512 - DNA, 62 bp, Homo sapiens
  misc_feature 1..62: note = chr13:112559680-112559742
  misc_feature 1..62: note = hypo
  source 1..62: mol_type = genomic DNA
agtggactagcaaggcgggaggagcacgtgtttggagtgtggccccacgtccccgccccctt

SEQ ID NO: 75513 - DNA, 60 bp, Homo sapiens
  misc_feature 1..60: note = chr13:112573418-112573478
  misc_feature 1..60: note = hypo
  source 1..60: mol_type = genomic DNA
ctcataaggaccacacggctgaacacctgcccatgccggggactgcgtgagagcccccat

SEQ ID NO: 75514 - DNA, 35 bp, Homo sapiens; identical to SEQ ID NO: 43861
  misc_feature 1..35: note = chr13:112573696-112573731
  misc_feature 1..35: note = hypo
  source 1..35: mol_type = genomic DNA

SEQ ID NO: 75515 - DNA, 81 bp, Homo sapiens
  misc_feature 1..81: note = chr13:112618899-112618980
  misc_feature 1..81: note = hypo
  source 1..81: mol_type = genomic DNA
atagcccagggcctgcggcctgagagcagcaccgtggagaggctctgcctgagcgctctggtccagcgtttccacccacag

SEQ ID NO: 75516 - DNA, 30 bp, Homo sapiens
  misc_feature 1..30: note = chr13:112679985-112680015
  misc_feature 1..30: note = hypo
  source 1..30: mol_type = genomic DNA
caaaacgaaacttcacgcatgtacatacac

SEQ ID NO: 75517 - DNA, 58 bp, Homo sapiens
  misc_feature 1..58: note = chr13:112682842-112682900
  misc_feature 1..58: note = hypo
  source 1..58: mol_type = genomic DNA
aaccaggaggaaggacggaccagagggaggaaaaacggcccagcgggagggaggacaa

SEQ ID NO: 75518 - DNA, 270 bp, Homo sapiens
  misc_feature 1..270: note = chr13:112690736-112691006
  misc_feature 1..270: note = hypo
  source 1..270: mol_type = genomic DNA
ctctccagggccacccggagatgcccagactcagaggcctgcctccagccctgcctgcctggacagcaggcctgagagccggacatgcttccgtgtggccgtcacatccccagagttgcacccgcgcaggccgtgtgtgcacgtgttcttgaatcctagggtgtacatcatgtccccaaccccaccccactcagcgccaagggagggaaggggagtccagctcccctcgcagggccggactgagcactctgcactcggccctgccgtccc

SEQ ID NO: 75519 - DNA, 374 bp, Homo sapiens
  misc_feature 1..374: note = chr13:112707631-112708005
  misc_feature 1..374: note = hyper
  source 1..374: mol_type = genomic DNA
tcctgttcccatgtgcggttggtgtcggagttagacatcatcaagaggtgaaaatttgggaagacatttcaaggatgacggaagctctgagtgagtgaacagatattcttcgtgcagaataatcccccgtggcactggtttgccggcagagcagaatgtttgagacctcaccccgcagccacgcgcgggcgtaaatcgttctcagcacgagaaacacaaaggccgcaggatcccgcgagccgcagggggttggggtcatttttttgatgccgccgcccttaagagttccagtccttcaggcgaaaggggcagatcaggccttcggggaggacccttgcctgggagagggagggcagtgccccaggggccgcctc

SEQ ID NO: 75520 - DNA, 394 bp, Homo sapiens
  misc_feature 1..394: note = chr13:112708307-112708701
  misc_feature 1..394: note = hyper
  source 1..394: mol_type = genomic DNA
cgcaggacagcctcgctgcccggggccgagttcggtggacaagggggcagcgcccacagcaagccggaaagagggaggcgcggggccgcgcttggggcctgccgctgcacgccagcctgggcaaagagctgccaccttctgcgggcgaagcgggtcgggacgcaggacggcagcggggctggaggcagctacgtgggtccacacccccatgccctgcaaggctccttggccctgcttctcctctgtctcggcgggagaggagcagcctcggttttacagaatttcagggtcgcgtctccagcgccccgggcgaggccactacgtttaggagcgctcgccttcgctgcgctgtgtaccgtgtacacactggctccgtgcgcgagaccccgatgtg

SEQ ID NO: 75521 - DNA, 30 bp, Homo sapiens; identical to SEQ ID NO: 35097
  misc_feature 1..30: note = chr13:112709027-112709057
  misc_feature 1..30: note = hyper
  source 1..30: mol_type = genomic DNA

SEQ ID NO: 75522 - DNA, 75 bp, Homo sapiens
  misc_feature 1..75: note = chr13:112709489-112709564
  misc_feature 1..75: note = hyper
  source 1..75: mol_type = genomic DNA
aaaaaaattaccctgcgtttgtccgggggagatgtgtgcgtgggtccgcgcgccccgcaccgacactgagggctg

SEQ ID NO: 75523 - DNA, 438 bp, Homo sapiens
  misc_feature 1..438: note = chr13:112709815-112710253
  misc_feature 1..438: note = hyper
  source 1..438: mol_type = genomic DNA
cagagacccagaccccgagaaacaagtgtggctccagcccaggagcctcacagaacacatttcctcctccgccttcggctctgcgtgggctagccccgcgctagggagggcaggcaactaggtcctccgaggtgaggctggggctccgcctgcagagggagtgacagcgcgccgcgagggtccgcgacccaggcaggggtggccgcaccaccccggagcgccgcacagccccgcaggcctcccctcccgcagtgcgtgcctggaacgcggggccgcctggccgagggacgtttacctggagagctttgtgtccacaacactaatccttagacactgcttcgttcagcagctgccgtcagtcgtgagggcactagtgtggggatgggggcgaattcaggagcccgtcgcagagcaatatttaaaaaggggggggggagc

SEQ ID NO: 75524 - DNA, 117 bp, Homo sapiens; identical to SEQ ID NO: 11728
  misc_feature 1..117: note = chr13:112710359-112710476
  misc_feature 1..117: note = hyper
  source 1..117: mol_type = genomic DNA

SEQ ID NO: 75525 - DNA, 188 bp, Homo sapiens
  misc_feature 1..188: note = chr13:112710635-112710823
  misc_feature 1..188: note = hyper
  source 1..188: mol_type = genomic DNA
cgcaggccaggccggaacgcgggggcgggggcgcgggagggggacccgcggcgggaggcgagagcgagcgaatggggagaggagcggggagcaggaggggacgcaggggagaggggactggggagcggcgagaggaggacgggagacgcggctccacctcccagctcaaaacggcgtcccagctgctc

SEQ ID NO: 75526 - DNA, 470 bp, Homo sapiens; identical to SEQ ID NO: 35102
  misc_feature 1..470: note = chr13:112710824-112711294
  misc_feature 1..470: note = hyper
  source 1..470: mol_type = genomic DNA

SEQ ID NO: 75527 - DNA, 1654 bp, Homo sapiens; identical to SEQ ID NO: 35103
  misc_feature 1..1654: note = chr13:112711375-112713029
  misc_feature 1..1654: note = hyper
  source 1..1654: mol_type = genomic DNA

SEQ ID NO: 75528 - DNA, 556 bp, Homo sapiens
  misc_feature 1..556: note = chr13:112715163-112715719
  misc_feature 1..556: note = hyper
  source 1..556: mol_type = genomic DNA
aagacttagcttaggcgacttctctaaagaactcaaccaaatctgaaaggcacaggcattttctcctcaaaatccgaggctcgagaaccatctcctctggcagggtccagtctcagctccgcctcttgcctcctcacccacttgggcataacttttgcgggtcctagaaatctgggcagcagaagagggaggggaacgctcccagccggcagccgctctgggcgtgcacccgccacgcgaagccagaggttggacgacgcagccggccaggcgcggctcccgggggaccccgaaaccgcctgtggctcaggccctacttggcaagaagagactggggagtgagaggaggggtcactcttgctctctcgcacaatagacttcccgcaggcgagtgcgaacggccttttgcttcctccttcttttccaggacccttagcgacaggagaggaagagaagcggcccggcggtttaattgccaatttcctgatgcagccacagggcccagcagcggctcagcctaggccaccgggtccaggcctctaggcaataggcccgg

SEQ ID NO: 75529 - DNA, 550 bp, Homo sapiens; identical to SEQ ID NO: 35105
  misc_feature 1..550: note = chr13:112715803-112716353
  misc_feature 1..550: note = hyper
  source 1..550: mol_type = genomic DNA

SEQ ID NO: 75530 - DNA, 27 bp, Homo sapiens
  misc_feature 1..27: note = chr13:112716607-112716634
  misc_feature 1..27: note = hyper
  source 1..27: mol_type = genomic DNA
ttcacccagagagctcggaggcacaca

SEQ ID NO: 75531 - DNA, 27 bp, Homo sapiens
  misc_feature 1..27: note = chr13:112716694-112716721
  misc_feature 1..27: note = hyper
  source 1..27: mol_type = genomic DNA
attgtgaatgtgcggctctccacacga

SEQ ID NO: 75532 - DNA, 187 bp, Homo sapiens
  misc_feature 1..187: note = chr13:112717056-112717243
  misc_feature 1..187: note = hyper
  source 1..187: mol_type = genomic DNA
atgatggactcagagcgcccagggaccctagagagaggagcactcctcaagagccccctggccatcacccgagcgccctggagcgccatcacccgaacgcgcgctccaggccctcgaacaaggcctctggctgccagagcgagtgaggggcgcagaggcggcagagagcggagagccccggtgtctc

SEQ ID NO: 75533 - DNA, 723 bp, Homo sapiens
  misc_feature 1..723: note = chr13:112717322-112718045
  misc_feature 1..723: note = hyper
  source 1..723: mol_type = genomic DNA
cgggccggagccgtgcagccgggcccgctgcctctttgcccctcatggctccgcgcgggaggaaaccgggccttctccgcccgccctcctctcgctgcggtgtccccagcacccccgccccgcccccgcgcggtccccaccgtcgcgctcccctccctcctcgccctcgctccgcgcctcctgttggcagagatggcctcgaaggcctcttccaatttgaatggctctttcttcttctctctcccgcgctttcttttccgccttctcctcctctccttctgactactcttgtctctttcaaaagctccgcctggaaactagcggcttcctcttcatctgcctcctttaactgtggcctcggccctctggggcgacaccagagcgcggaagcctgagcccctcggagatccggggaggcacctacacatggcctcaatcctccaaccggccccagaagccgtaggagctgaacccaggagggcaaccggttgtggtgcggccacatgtccctggagagtgtcagcaagacgggtcgacttcaccaggaccacgaaagacagggcagagtttctgtcttctttcactgtcccgtagaactcctagcttgtccatcgtgctccttgcttgggactcgggactgacactgggccagaaaatccacctctagatgcctcaaagctcgctttcatgctggggggcgggcgggagcggggaagggggaca

SEQ ID NO: 75534 - DNA, 994 bp, Homo sapiens
  misc_feature 1..994: note = chr13:112720033-112721027
  misc_feature 1..994: note = hyper
  source 1..994: mol_type = genomic DNA
tgctacttgagactgcgtttgaaaatctctttcacgttcccaaatcaaagccactttgaggtttaagaatgataaccacaggtgaatgccttactctttccacgagccaggcctttcctttgcatgacgcagaccggcggctgagacccgtcctgaggccccgcctttcattcggtttatgtggccccgcgcagttcacgcagttttctccgttcttaggcaaccagctcgtgggaaattcactccagaaaagcgtgcgccatatcattattttgcgattcaacaaactttttcaactgttgttcaggaactagattccagatagatcttgttgtgttcggccttcctagaaattccttttccagaggaagaagatccgggttgggaagagtgcgtgactatggccccgggctcattgaaagactcctccccacaaaagtttagggctgatactaaacgaagctatggagccatgcccacacaaatactccccctttacccgaattgtggggcctggactgtgaaggccttcgctgcaagagcgggcactggcgaacttcagtgcacgccgcggccgagaacggatgcagggcgggggatggctgagccgcctgatccttgcagagaacctgcaggggccctcggagggtatcccctgcgtccaagggagcgcccctccttttcagcactcgggggaactgagggcgacgtgccagccccgcactcaactttccccttccctgcaggcacagagttggccggcgggggcagaggaggagctgggtctccactgcgcccgtttaaacctggccaggggctgcgtttcctccccccaccccacgacgatcctttcttagtcttcgcttttcaacccaatcgttaatcattcggaacgcgcgggcggggagcggcgaggagggcgagctcggggttcgccgccgccgccgccgccgcgcgcgcgcgctcaggaagcggtgtggctgtcaccccctcc

SEQ ID NO: 75535 - DNA, 93 bp, Homo sapiens; identical to SEQ ID NO: 4060
  misc_feature 1..93: note = chr13:112722128-112722221
  misc_feature 1..93: note = hyper
  source 1..93: mol_type = genomic DNA

SEQ ID NO: 75536 - DNA, 129 bp, Homo sapiens; identical to SEQ ID NO: 35111
  misc_feature 1..129: note = chr13:112722274-112722403
  misc_feature 1..129: note = hyper
  source 1..129: mol_type = genomic DNA

SEQ ID NO: 75537 - DNA, 138 bp, Homo sapiens
  misc_feature 1..138: note = chr13:112722844-112722982
  misc_feature 1..138: note = hyper
  source 1..138: mol_type = genomic DNA
gcaccagaactcggccgtggcggcggcggcggcggcggcggccgcgtcgtcgggcgccctgggcgcgctgggctctctggtgaagtcggagcccagcggcagcccgcccgccccagcgcactcgcgggcgccgtgccc

SEQ ID NO: 75538 - DNA, 432 bp, Homo sapiens
  misc_feature 1..432: note = chr13:112723292-112723724
  misc_feature 1..432: note = hyper
  source 1..432: mol_type = genomic DNA
gggtgacgcgtgtcccccactcaccttccccggagaccctggcgaccgccgggcgctgacaccagacttgggttttagactgaacttcggtgttttcttgagactttttgtacagtatttatcacctacggaggaagcggaaagcgttttctttgctcgaggggacaaaaaagtcaaaacgaggcgagaggcgaagcccacttttgtataccggccggcgcgctcactttcctccgcgttgcttccggacggcgccgaccgccggagcccaagtgacgcggagctcgtcgcatttgttataaatgtagtaaggcaggtccaagcacttacaagttttttgtagttgttaccgctcttttgggttggtttgttaatttatacaaagagattaccaccaccaccccctccttcagacggcggagttatattctg

SEQ ID NO: 75539 - DNA, 423 bp, Homo sapiens
  misc_feature 1..423: note = chr13:112724172-112724595
  misc_feature 1..423: note = hyper
  source 1..423: mol_type = genomic DNA
aagtatcttctgctccggctgtttcactgcggacggctggggctgctgcgcgttaccttgctgcaagcggggcgccttccacctggctgggggtctgcgccacagtttggtccagaggagggaggaggaagggaagaccccagtggtgggaccctggaccaggccatggatgaaggacaaagaccagggcaggtcacgggtttcccaattccccagcaattaagatttcgagcagaatttatctaaatgtgtttcaaggaaacacaatcgctgaaccaaaacgtactgcagccgagccccctccgtccatcctctgcccctccccctggcttctttctcttgggaaaacgggcaaaataattgtgctggattctcacacacacagaaatatcgaccatcaccctcccccgcgtgaactgggat

SEQ ID NO: 75540 - DNA, 190 bp, Homo sapiens
  misc_feature 1..190: note = chr13:112725278-112725468
  misc_feature 1..190: note = hyper
  source 1..190: mol_type = genomic DNA
cactacgacttagtccgggataagggcctccccagtcctctccgggagatgatttgggaaattttataatgcttgttctgttaactcaccgggaccttgagggtccaatgggaccttgagggttttctctgaaatatacaaacttaaaggactctctctgaggttctttgactgacgtccactctcagtc

SEQ ID NO: 75541 - DNA, 45 bp, Homo sapiens; identical to SEQ ID NO: 35116
  misc_feature 1..45: note = chr13:112725825-112725870
  misc_feature 1..45: note = hyper
  source 1..45: mol_type = genomic DNA

SEQ ID NO: 75542 - skipped

SEQ ID NO: 75543 - DNA, 294 bp, Homo sapiens; identical to SEQ ID NO: 35117
  misc_feature 1..294: note = chr13:112726435-112726729
  misc_feature 1..294: note = hyper
  source 1..294: mol_type = genomic DNA

SEQ ID NO: 75544 - DNA, 380 bp, Homo sapiens
  misc_feature 1..380: note = chr13:112726796-112727176
  misc_feature 1..380: note = hyper
  source 1..380: mol_type = genomic DNA
cggggtgcgggcccccagtatccggcggggtggggcggcgtcaggacggagcgagggccggcgggggggctcgcgtggaggcccaggccgggaggtggggacgcagggacccctcacccagtcctctgctcccgcccgagccaggcctcgggatcacctccccttgcctgagggcgagctctcctcctccctcttcctccccgcctcccccgttcttccctccctctctccctcctccctccccggcccttcctctccagctgcgcgcccgccgggaccacgctcctcccgcccccgggagccgagcggcgtctgcggctggtccggacgtgtcccctccgggcgggggtggccgggcctcctcggggcctcgggcctcc

SEQ ID NO: 75545 - DNA, 42 bp, Homo sapiens; identical to SEQ ID NO: 35119
  misc_feature 1..42: note = chr13:112727837-112727879
  misc_feature 1..42: note = hyper
  source 1..42: mol_type = genomic DNA

SEQ ID NO: 75546 - DNA, 240 bp, Homo sapiens
  misc_feature 1..240: note = chr13:112727961-112728201
  misc_feature 1..240: note = hyper
  source 1..240: mol_type = genomic DNA
cgcaccagcgacccgggcgcggactggggcctgcagggcgtgactggctgccccccaggactccatctccttcataaacacctgccttttccattccccggggccgcttcggctgctcctctggagggaagactggggagaaggttgcctgcgctctctgccccagaggctctgttttagaaactgtttcttaatttccataagaaacaaaaaaatcacaggaaggcctggttcctctcc

SEQ ID NO: 75547 - DNA, 15 bp, Homo sapiens
  misc_feature 1..15: note = chr13:112728335-112728350
  misc_feature 1..15: note = hyper
  source 1..15: mol_type = genomic DNA
cgctttctccacccg

SEQ ID NO: 75548 - DNA, 370 bp, Homo sapiens; identical to SEQ ID NO: 35121
  misc_feature 1..370: note = chr13:112758003-112758373
  misc_feature 1..370: note = hyper
  source 1..370: mol_type = genomic DNA

SEQ ID NO: 75549 - DNA, 196 bp, Homo sapiens; identical to SEQ ID NO: 1129
  misc_feature 1..196: note = chr13:112758495-112758691
  misc_feature 1..196: note = hyper
  source 1..196: mol_type = genomic DNA

SEQ ID NO: 75550 - DNA, 670 bp, Homo sapiens; identical to SEQ ID NO: 35123
  misc_feature 1..670: note = chr13:112759111-112759781
  misc_feature 1..670: note = hyper
  source 1..670: mol_type = genomic DNA

SEQ ID NO: 75551 - DNA, 438 bp, Homo sapiens
  misc_feature 1..438: note = chr13:112760006-112760444
  misc_feature 1..438: note = hyper
  source 1..438: mol_type = genomic DNA
cggggcctgggggggcccaggcgccggaggagccgtcggtgccggaatgcagcgtgtttcacttgggagaaacgttgccctcggtcccttgcctccctcctgttgtctcggtttttctggcttcgtccttcgtcccacccacccgttcccacctcaggtccctcccccaggatcccctccttaaggatccaggtctctgaaaattattggcaacagttacacgccccacgattgaaatccacaagagaagagtcccagttctgcaggccgctccagggctaggggtagagatggtggcaggtggtgcgtcaactctctagggaagaggaacttgcattacaaagacttgtctttctgagctgaagtcaaaacgggggcgtcaagcgcgctccgtttggcggcggtggaggggccgcgcgcccgcgctgtcccagccgg

SEQ ID NO: 75552 - DNA, 527 bp, Homo sapiens
  misc_feature 1..527: note = chr13:112760850-112761377
  misc_feature 1..527: note = hyper
  source 1..527: mol_type = genomic DNA
ggccaaggctctccccgcgttttcttctcgtgacctggggaatgtcccgccccatcgctcacctggctcttgtcatctcgctcatcttgaagtgacccgtggacaatgctgctccctgccgcagctccgccggtcactcaggcagaacggggtatgcaaatggcctggagaggccgaggccgaacactgcgcccattgtcccgggcgctcaaagcgccgagcagctgcgcagactttctgggctcggaccctcggccgccacgctaatgtcatcattgcaaaacatcagattttgagaactatgcagtctgaattcattagcagccttctcggcgaaggttcttttccccgtgacaagtttcaaagtccagaccccctccaacgttggtaggggtaggaagaggaggaggggcccagggaggggggtctttcgcaagtggggcctcgggggatccctgctctccttctggtgcattccgcaactttaaaagccttccttggggttctgagcgcggatgtctgacttg

SEQ ID NO: 75553 - DNA, 30 bp, Homo sapiens; identical to SEQ ID NO: 43865
  misc_feature 1..30: note = chr13:112800543-112800573
  misc_feature 1..30: note = hypo
  source 1..30: mol_type = genomic DNA

SEQ ID NO: 75554 - DNA, 30 bp, Homo sapiens
  misc_feature 1..30: note = chr13:112805073-112805103
  misc_feature 1..30: note = hypo
  source 1..30: mol_type = genomic DNA
cccccccacagcaagcgcacacacacaccc

SEQ ID NO: 75555 - DNA, 41 bp, Homo sapiens; identical to SEQ ID NO: 43866
  misc_feature 1..41: note = chr13:112830483-112830524
  misc_feature 1..41: note = hypo
  source 1..41: mol_type = genomic DNA

SEQ ID NO: 75556 - DNA, 30 bp, Homo sapiens
  misc_feature 1..30: note = chr13:112846818-112846848
  misc_feature 1..30: note = hypo
  source 1..30: mol_type = genomic DNA
gcatcctttctgtgacggcatcctttctgt

SEQ ID NO: 75557 - DNA, 212 bp, Homo sapiens
  misc_feature 1..212: note = chr13:112882188-112882400
  misc_feature 1..212: note = hypo
  source 1..212: mol_type = genomic DNA
tcatctccacacatgcggtcacccaaggagctgagatctcgagaaactttatccttcacaaacacagatgcacaaaaaggacatctcttcatttacggaggaagtttcagtgtttctgtgtacacacacacacacagacacacacacacagacacacaatgcttacacacaaattcaaggttatgatcacgcactttcgtggagtcaaattt

SEQ ID NO: 75558 - DNA, 20 bp, Homo sapiens
  misc_feature 1..20: note = chr13:112882956-112882976
  misc_feature 1..20: note = hypo
  source 1..20: mol_type = genomic DNA
ttttttcttttgagacgcag

SEQ ID NO: 75559 - DNA, 222 bp, Homo sapiens
  misc_feature 1..222: note = chr13:112895421-112895643
  misc_feature 1..222: note = hypo
  source 1..222: mol_type = genomic DNA
cagaaacggcgagggcgtcctcggccgtgcacacgccatcaacacgcaagccgctgctgagagccccggtgctgtccttcatcctggaaagcctttcctaaccggagacttccaaattgaaaatcgcaacgctctgttgaagagaagacagagcccgttcttaggcattacaaaaattatccaacctacttttaacatcaaactcagcgaaccagcccagaa

SEQ ID NO: 75560 - DNA, 36 bp, Homo sapiens
  misc_feature 1..36: note = chr13:112899548-112899584
  misc_feature 1..36: note = hypo
  source 1..36: mol_type = genomic DNA
catcagccacgacgacgacgacgactgatccatgag

SEQ ID NO: 75561 - DNA, 34 bp, Homo sapiens
  misc_feature 1..34: note = chr13:112906409-112906443
  misc_feature 1..34: note = hypo
  source 1..34: mol_type = genomic DNA
gcgagcggtggagcacgtgcgggtgcaagcctta

SEQ ID NO: 75562 - DNA, 30 bp, Homo sapiens
  misc_feature 1..30: note = chr13:112910078-112910108
  misc_feature 1..30: note = hypo
  source 1..30: mol_type = genomic DNA
ccccagcacaagccccgtgcccatagagga

SEQ ID NO: 75563 - DNA, 77 bp, Homo sapiens
  misc_feature 1..77: note = chr13:112998058-112998135
  misc_feature 1..77: note = hypo
  source 1..77: mol_type = genomic DNA
gtaaatggtggctgccgcatgctggccgccccccaaacagccccagcgcggcgtgtcctcgccgtcaccctcctctc

SEQ ID NO: 75564 - DNA, 30 bp, Homo sapiens
  misc_feature 1..30: note = chr13:113013574-113013604
  misc_feature 1..30: note = hypo
  source 1..30: mol_type = genomic DNA
gcaagaagctaatcccgcactgtagggcta

SEQ ID NO: 75565 - DNA, 30 bp, Homo sapiens
  misc_feature 1..30: note = chr13:113050319-113050349
  misc_feature 1..30: note = hypo
  source 1..30: mol_type = genomic DNA
ggtggctcggccccccgcctctctttggcc

SEQ ID NO: 75566 - DNA, 42 bp, Homo sapiens; identical to SEQ ID NO: 43869
  misc_feature 1..42: note = chr13:113099281-113099323
  misc_feature 1..42: note = hypo
  source 1..42: mol_type = genomic DNA

SEQ ID NO: 75567 - DNA, 95 bp, Homo sapiens
  misc_feature 1..95: note = chr13:113107030-113107125
  misc_feature 1..95: note = hypo
  source 1..95: mol_type = genomic DNA
actcctggcagcagacggaagggcggctgccgggccctcagacccaggacgggcaccacgctggagctcagccatcccggcggtggcatcacaga

SEQ ID NO: 75568 - DNA, 294 bp, Homo sapiens
  misc_feature 1..294: note = chr13:113107711-113108005
  misc_feature 1..294: note = hypo
  source 1..294: mol_type = genomic DNA
agccccgcctgacgccgcggtcgcttgacttcacaatcacaggagcgtgacgcctacagcctaatgttgccgtgtagggcacagacttcttaaaaagaatcttcaggggatgtcgccaggtgatggcgggaatcctcagtgagagggtgaggccaccggggctgctgtgtccgcagatgtggtgccacctccgagggcctccaagggtgcatgtgagccacagtcaccaccacagtgcgccgacgaccgccacagaaacagccacggcaccgcgaggaccgtcctgcaccacaa

SEQ ID NO: 75569 - DNA, 30 bp, Homo sapiens
  misc_feature 1..30: note = chr13:113108949-113108979
  misc_feature 1..30: note = hypo
  source 1..30: mol_type = genomic DNA
ctctcggaagcgaggcgagcctccatcccc

SEQ ID NO: 75570 - DNA, 34 bp, Homo sapiens
  misc_feature 1..34: note = chr13:113119848-113119882
  misc_feature 1..34: note = hypo
  source 1..34: mol_type = genomic DNA
agccgccagaacccacgagcggctggtgagaatg

SEQ ID NO: 75571 - DNA, 30 bp, Homo sapiens
  misc_feature 1..30: note = chr13:113132528-113132558
  misc_feature 1..30: note = hypo
  source 1..30: mol_type = genomic DNA
gccttgatctaaagccggcaattgaaatta

SEQ ID NO: 75572 - DNA, 59 bp, Homo sapiens
  misc_feature 1..59: note = chr13:113160568-113160627
  misc_feature 1..59: note = hypo
  source 1..59: mol_type = genomic DNA
gctccaaagggccctcgtccacatccatgcaccgcccagcgactcgcaagggagcacac

SEQ ID NO: 75573 - DNA, 218 bp, Homo sapiens
  misc_feature 1..218: note = chr13:113269889-113270107
  misc_feature 1..218: note = hypo
  source 1..218: mol_type = genomic DNA
atggaccttggcagccggagggagccctcaggaaggagcccaggtacttgcagcagtggccctcagtgggtgtgcccggggcaaggcggggcagtgcgggcaggctcagcacagaacctcaccactctcatgtgattcatccatttgactctgagctccctgagggtggaggccatgctttattaatacctatatcccagcatcgatatattgccatt

SEQ ID NO: 75574 - DNA, 49 bp, Homo sapiens
  misc_feature 1..49: note = chr13:113285488-113285537
  misc_feature 1..49: note = hypo
  source 1..49: mol_type = genomic DNA
gagacagaagaaagacgaggaaagtgcaccaactcgtttttggaaccag

SEQ ID NO: 75575 - DNA, 30 bp, Homo sapiens; identical to SEQ ID NO: 43871
  misc_feature 1..30: note = chr13:113319347-113319377
  misc_feature 1..30: note = hypo
  source 1..30: mol_type = genomic DNA

SEQ ID NO: 75576 - DNA, 245 bp, Homo sapiens
  misc_feature 1..245: note = chr13:113350398-113350643
  misc_feature 1..245: note = hypo
  source 1..245: mol_type = genomic DNA
tggttgccccctgtacgcttggtgccccatctgcaaggtggggactatgatggtgcccacctggtgggtctgtgcagtgacgggacaggtcacggcgctcgtgcacgctgggtgcccagtgcacggggcgtctttgttgcgcgcatggacctgcggctgcatcaccgtccatgcttctgggcttcttaaggagaccgcctctcaccttgggctttccggaaccttctccccgcactcctcttcac

SEQ ID NO: 75577 - DNA, 36 bp, Homo sapiens
  misc_feature 1..36: note = chr13:113368582-113368618
  misc_feature 1..36: note = hypo
  source 1..36: mol_type = genomic DNA
ccgattagcacctcccgctgccgctccagctgtgtt

SEQ ID NO: 75578 - DNA, 30 bp, Homo sapiens
  misc_feature 1..30: note = chr13:113396823-113396853
  misc_feature 1..30: note = hypo
  source 1..30: mol_type = genomic DNA
atttcaggcactggacgaccaaaagtgaga

SEQ ID NO: 75579 - DNA, 333 bp, Homo sapiens
  misc_feature 1..333: note = chr13:113400400-113400733
  misc_feature 1..333: note = hypo
  source 1..333: mol_type = genomic DNA
tgatggactcttgggcgtctgccgtaggccgctgtgaatgctggcggcggtgatcgtgtgctgacgtctcctccacgtactgagttcgtgtcttttggatgcgcgcccagaggtggcactgctggatcctgtgctgggtcatacctatgtttaattctctgaggaacctccgtgctgtctccatagcagccgtgtcgtttcacacttgcaccaacagtgcacagggctccggttccccacgtcctcaccgggtaactggggttccggctccccacgtcctccccgggtaactggggttccggttccccacgtcctcaccgggtaactggggtt

SEQ ID NO: 75580 - DNA, 39 bp, Homo sapiens; identical to SEQ ID NO: 43873
  misc_feature 1..39: note = chr13:113401430-113401469
  misc_feature 1..39: note = hypo
  source 1..39: mol_type = genomic DNA

SEQ ID NO: 75581 - DNA, 30 bp, Homo sapiens
  misc_feature 1..30: note = chr13:113424191-113424221
  misc_feature 1..30: note = hypo
  source 1..30: mol_type = genomic DNA
ctgtaaatggacacacgttagccacagctg

SEQ ID NO: 75582 - DNA, 52 bp, Homo sapiens
  misc_feature 1..52: note = chr13:113424883-113424935
  misc_feature 1..52: note = hypo
  source 1..52: mol_type = genomic DNA
accctgcttacatgccgggacgaaggtgggagagaaccgtgcatctcagcac

SEQ ID NO: 75583 - DNA, 30 bp, Homo sapiens
  misc_feature 1..30: note = chr13:113505580-113505610
  misc_feature 1..30: note = hypo
  source 1..30: mol_type = genomic DNA
gccgacggcccagggcgtgtgagggcgagt

SEQ ID NO: 75584 - DNA, 30 bp, Homo sapiens
  misc_feature 1..30: note = chr13:113542925-113542955
  misc_feature 1..30: note = hypo
  source 1..30: mol_type = genomic DNA
accacacaggccacccgaggcccccacagc

SEQ ID NO: 75585 - DNA, 30 bp, Homo sapiens
  misc_feature 1..30: note = chr13:113545760-113545790
  misc_feature 1..30: note = hypo
  source 1..30: mol_type = genomic DNA
ttggggtcacaggcacgggcaccacagctt

SEQ ID NO: 75586 - DNA, 156 bp, Homo sapiens
  misc_feature 1..156: note = chr13:113546374-113546530
  misc_feature 1..156: note = hypo
  source 1..156: mol_type = genomic DNA
ggccagctccatgcccgtccacggtgtgcaggtggaggcatctttcagggtatcaggtgggaatccgtgcttcctggcaaagtctgttccagtgtggtgcccactgtccatgcgcctgtgggtgtgagcctgcaccctgcacgaatgtgtggagcg

SEQ ID NO: 75587 - DNA, 167 bp, Homo sapiens
  misc_feature 1..167: note = chr13:113547082-113547249
  misc_feature 1..167: note = hyper
  source 1..167: mol_type = genomic DNA
tgcagggtttctgcacgctggggagggcaggttccccagtggagccactccctgcgggtctgagtggggcccggggtctctgcacggtcaccgatgctgctgctgctccagggagcgggcttgcaggagcaaggatccagtccctgaacgcacgtgctccccccggg

SEQ ID NO: 75588 - DNA, 30 bp, Homo sapiens
  misc_feature 1..30: note = chr13:113552672-113552702
  misc_feature 1..30: note = hypo
  source 1..30: mol_type = genomic DNA
cgtgtttgttttgttcgcttggaacctgtg

SEQ ID NO: 75589 - DNA, 30 bp, Homo sapiens
  misc_feature 1..30: note = chr13:113552957-113552987
  misc_feature 1..30: note = hypo
  source 1..30: mol_type = genomic DNA
cctccatttgctattcggctgcctgtgtca

SEQ ID NO: 75590 - DNA, 190 bp, Homo sapiens
  misc_feature 1..190: note = chr13:113566241-113566431
  misc_feature 1..190: note = hypo
  source 1..190: mol_type = genomic DNA
gctaggtggccaatccgccaagaataggaatgagatgaactttgaattctttttaaaaagaaaaaacaatgtcttcattgagtaagttctaccccaccctcaccaagagtcacgtggctggggaggtggccgtgcatgtggcccaagtcccttgttctgtgaagtttcccatccccgggcccagcagtca

SEQ ID NO: 75591 - DNA, 30 bp, Homo sapiens
  misc_feature 1..30: note = chr13:113568768-113568798
  misc_feature 1..30: note = hypo
  source 1..30: mol_type = genomic DNA
atacatgcccttcagcgtgtgtactggtgt

SEQ ID NO: 75592 - DNA, 309 bp, Homo sapiens
  misc_feature 1..309: note = chr13:113598542-113598851
  misc_feature 1..309: note = hypo
  source 1..309: mol_type = genomic DNA
gtgaggggagggtcccgggccatgaagggagggtcccgggtgaagagcaagctcatgaccctcatttactgggaatccattgctctggccccgtcatgagtggggttcgcagactgggccaatccctacagcgtatgtgtgctctggtgtctcggggcagcacagacgttgttactgctccatctggcctgggtgaacacctgggtctctctgtggagttgggggatgccgcctgctcaagggtcgcgttcctagtatgcgttccaggaatgctatgcaccaccagtgctaagccgcagaagagctgtc

SEQ ID NO: 75593 - DNA, 51 bp, Homo sapiens
  misc_feature 1..51: note = chr13:113608271-113608322
  misc_feature 1..51: note = hypo
  source 1..51: mol_type = genomic DNA
tctctgtgtggccaacggaactgtctgctctgagaacgctgtggcatgctg

SEQ ID NO: 75594 - DNA, 64 bp, Homo sapiens
  misc_feature 1..64: note = chr13:113623284-113623348
  misc_feature 1..64: note = hyper
  source 1..64: mol_type = genomic DNA
acacttccaggtgaccgcggcggtgacccgcggggctcccaggtgacctcgttggtgagccccg

SEQ ID NO: 75595 - DNA, 290 bp, Homo sapiens
  misc_feature 1..290: note = chr13:113648342-113648632
  misc_feature 1..290: note = hypo
  source 1..290: mol_type = genomic DNA
ccgaccctccgccttcgtctttttcctgattaaaaaaaagcaccttcatgcggggtgcggcgcttgggaccccccaagctgacgtcactgtctgtgccggtgtctcgggcaggggcaggtgtggatgccaagctgacgtcactgtgccagtgtctcgggcaggggcgtggctgccaacggggcacggtgcgtgggatgccaagctgacatcactatgcaggtgtctcgggcaggggctggcgtggctgtcggcgtgacggggcgcggcgcgtgggacgccaagctgacgt

SEQ ID NO: 75596 - DNA, 38 bp, Homo sapiens
  misc_feature 1..38: note = chr13:113678958-113678996
  misc_feature 1..38: note = hypo
  source 1..38: mol_type = genomic DNA
tgggcgggggcaggacggaagcccggttatcaccttcc

SEQ ID NO: 75597 - DNA, 148 bp, Homo sapiens
  misc_feature 1..148: note = chr13:113718501-113718649
  misc_feature 1..148: note = hypo
  source 1..148: mol_type = genomic DNA
cagcatccaggcagacgtggtcctctctgtgctgctgggtgttctgctgatggggcagctcttttgggagccaacaataatcccaaacactaccacgcattccctttctcctccaggtcataatgctgagctccgtaccagacttaca

SEQ ID NO: 75598 - DNA, 104 bp, Homo sapiens
  misc_feature 1..104: note = chr13:113719085-113719189
  misc_feature 1..104: note = hypo
  source 1..104: mol_type = genomic DNA
tcaaggagggcaggacgctatgggagggcgttcaccgtctttgcgtcagccggtctcacctgatgggtctgtgtgggaacggtttccgccggtgtctgctttca

SEQ ID NO: 75599 - DNA, 19 bp, Homo sapiens
  misc_feature 1..19: note = chr13:113763577-113763596
  misc_feature 1..19: note = hypo
  source 1..19: mol_type = genomic DNA
ggagcgtgggtgtcgggga

SEQ ID NO: 75600 - DNA, 127 bp, Homo sapiens
  misc_feature 1..127: note = chr13:113775919-113776046
  misc_feature 1..127: note = hypo
  source 1..127: mol_type = genomic DNA
aaacatgcctagaggcgatgtcagagggtggagaccaggagaggcaggagtcagacatctggtgccaccaggaaggcccttctcagaggaccaggctgtgcgtggtgcccgccgtgggaggccagcc

SEQ ID NO: 75601 - DNA, 30 bp, Homo sapiens
  misc_feature 1..30: note = chr13:113797930-113797960
  misc_feature 1..30: note = hypo
  source 1..30: mol_type = genomic DNA
tccattgttcacaggcggtcacctgagggg

SEQ ID NO: 75602 - DNA, 30 bp, Homo sapiens
  misc_feature 1..30: note = chr13:113825962-113825992
  misc_feature 1..30: note = hypo
  source 1..30: mol_type = genomic DNA
gcacatgcggtatgacgcggacgcggggga

SEQ ID NO: 75603 - DNA, 30 bp, Homo sapiens
  misc_feature 1..30: note = chr13:113848551-113848581
  misc_feature 1..30: note = hypo
  source 1..30: mol_type = genomic DNA
ggagtgaggcagtgacggtcagagttctgt

SEQ ID NO: 75604 - DNA, 50 bp, Homo sapiens
  misc_feature 1..50: note = chr13:113984359-113984409
  misc_feature 1..50: note = hypo
  source 1..50: mol_type = genomic DNA
atggaaacccgggtgcgtgcatggaaacccgggtgcgtgcatggaaaccc

SEQ ID NO: 75605 - DNA, 503 bp, Homo sapiens
  misc_feature 1..503: note = chr13:113985469-113985972
  misc_feature 1..503: note = hypo
  source 1..503: mol_type = genomic DNA
tgtgtgcatggaaaccggtcgcagctctcctgtgaagaagcacctgcccagccccggcttccatccagataggaggaatccacctcttcccaacagacatggtctttgctcctcatctgagccacaggattgaccatggcagagaccaggtgcatgacctgggggttgggggctcaggggcggctgctaccaggatggccttgcctctgtgagtgaccacagctgcggggctgggataccaggaggcacgggctgcagcatgggaggcggcccaggaggagatgccaagaaggcacagcaaggacagccagtgcaggagccacccgggtgcccacccagcagctgcgcacccccactgcccgagccagcctctctgcatctcttttcctgagaagacttcggcgtggcacagcccttacagggcgtgagccttctcagacgcagctcaggttacagcaaggaagctgcaaggctggttttgctgtttggtttacttttttttt

SEQ ID NO: 75606 - DNA, 129 bp, Homo sapiens
  misc_feature 1..129: note = chr13:114017816-114017945
  misc_feature 1..129: note = hyper
  source 1..129: mol_type = genomic DNA
gcatggatcgagttttgatccatcccgatatggctccctgctgggagggacgggtctccttcgcgtccgacccgccggcccatctcaaagcgggaaaaccggtccctgcggctgccctagctcggagcc

SEQ ID NO: 75607 - DNA, 111 bp, Homo sapiens
  misc_feature 1..111: note = chr13:114018219-114018330
  misc_feature 1..111: note = hyper
  source 1..111: mol_type = genomic DNA
tcgatcctgcaaaaccgagagaaggaggccggcgtccccgaagtttcctctggggggtcgcgggcccgcgcggggaccgcagccgccggggacgcccgcaccccgcgccac

SEQ ID NO: 75608 - DNA, 33 bp, Homo sapiens
  misc_feature 1..33: note = chr13:114019204-114019237
  misc_feature 1..33: note = hypo
  source 1..33: mol_type = genomic DNA
tgaattttgctctggcgacgtggcaaaggggag

SEQ ID NO: 75609 - DNA, 38 bp, Homo sapiens
  misc_feature 1..38: note = chr13:114028380-114028418
  misc_feature 1..38: note = hypo
  source 1..38: mol_type = genomic DNA
cggcagcttcacactcgtacaggcgccttgtggtccct

SEQ ID NO: 75610 - DNA, 211 bp, Homo sapiens
  misc_feature 1..211: note = chr13:114055940-114056151
  misc_feature 1..211: note = hypo
  source 1..211: mol_type = genomic DNA
ccccgggggccctgtcgggggagctgtggggaccggccccccagagctcagcacagcccggccctccttccagacaccagcactcgcatgtcccagcaggtgagggtgggtcaaacctgctggatctgaagttaattgttcgactggaaggaaacctgtgcgctccccggagcatgacgccacgccgcctccttggcgctgcagagccaaa

SEQ ID NO: 75611 - DNA, 36 bp, Homo sapiens
  misc_feature 1..36: note = chr13:114056508-114056544
  misc_feature 1..36: note = hypo
  source 1..36: mol_type = genomic DNA
agccgtgtggcctcacgggtccgggtttcagaggcc

SEQ ID NO: 75612 - DNA, 30 bp, Homo sapiens; identical to SEQ ID NO: 43882
  misc_feature 1..30: note = chr13:114059583-114059613
  misc_feature 1..30: note = hypo
  source 1..30: mol_type = genomic DNA

SEQ ID NO: 75613 - DNA, 479 bp, Homo sapiens; identical to SEQ ID NO: 43883
  misc_feature 1..479: note = chr13:114059986-114060465
  misc_feature 1..479: note = hypo
  source 1..479: mol_type = genomic DNA

SEQ ID NO: 75614 - DNA, 146 bp, Homo sapiens
  misc_feature 1..146: note = chr13:114060775-114060921
  misc_feature 1..146: note = hypo
  source 1..146: mol_type = genomic DNA
ctgggacactgtggtcggcgcccacagcccctcttgctgctgccagacgcggagctgcccgtggcccctgcggcgaagaggcgctgagtcccgcctgcatccctgaaagcttgctcagttccactggggctcggtgaccccttctg

SEQ ID NO: 75615 - DNA, 113 bp, Homo sapiens
  misc_feature 1..113: note = chr13:114064741-114064854
  misc_feature 1..113: note = hypo
  source 1..113: mol_type = genomic DNA
aaccactgaggcagacggcgctccttccaaacctgccaaggatgagacatttacacgaaaactaaactcggaacctgctgcaaggccacagtgtgctgcgagctgggacgact

SEQ ID NO: 75616 - DNA, 727 bp, Homo sapiens
  misc_feature 1..727: note = chr13:114074574-114075301
  misc_feature 1..727: note = hypo
  source 1..727: mol_type = genomic DNA
gccagcttttgtttacgatgcttgtggattttgtgtttgtgtgttttaatctataatcagtttgtaaatagactcactttctgattctcacggaggggtttgatttgcggatggagaccgagtccaccctgtttgaatgcagccgcgccctgctcatgcgagctggccttctcttccatacagcagggtggagagggaagcccactttccggtaagcgggcaaaacaggtactacgaccgtgttacttatgctagcaacagttccgacttaccttaattgggtttcttttcctgaaaggtaattctcagttaatttccccacacccacgggtgctgggaccacactccatggacgtgtgtgacgtgaggcccttcgcccccgtgtgcctgtctctctggttcttctgacttaaagcaccagtagcagcacagttagtccagttattcggaagctcagcacggagccacattgctgcagcatagaaggccacggattcctccatcagcatggactacacttcccacaaaacgaacggggcatctctatggaaaaagcaaagcgtgtccctatccctgggacacctctacccctgggacacacctagccccaggacccgcccacccccgggacccgctcaccccgggacaccactacccctgggacatgcccacccctgggacaaccctaccccccccgacacgccctgggacacgcccaccccccagg

SEQ ID NO: 75617 - DNA, 30 bp, Homo sapiens
  misc_feature 1..30: note = chr13:114080589-114080619
  misc_feature 1..30: note = hypo
  source 1..30: mol_type = genomic DNA
ctcctgcctgccttacggtgagcacccctg

SEQ ID NO: 75618 - DNA, 75 bp, Homo sapiens
  misc_feature 1..75: note = chr13:114103353-114103428
  misc_feature 1..75: note = hypo
  source 1..75: mol_type = genomic DNA
gcaacatgggcttgtcgtttcagggccatggatgccacctctcctatgtgtcttgtagagcgctagacacggcta

SEQ ID NO: 75619 - DNA, 59 bp, Homo sapiens
  misc_feature 1..59: note = chr13:114108109-114108168
  misc_feature 1..59: note = hypo
  source 1..59: mol_type = genomic DNA
gcagatgtgtgcaggcgtgcctgtcactgccgcccgctgcggggcgtgccctcacccct

SEQ ID NO: 75620 - DNA, 30 bp, Homo sapiens
  misc_feature 1..30: note = chr13:114115112-114115142
  misc_feature 1..30: note = hypo
  source 1..30: mol_type = genomic DNA
ctgagaggagcttcccgtgactgccaagaa

SEQ ID NO: 75621 - DNA, 374 bp, Homo sapiens
  misc_feature 1..374: note = chr13:114122901-114123275
  misc_feature 1..374: note = hypo
  source 1..374: mol_type = genomic DNA
acgcgagacgtgccacgctccatcaacctctccttcagacaagcggcctatgaggacgcagcactaaagggggcgggggagggccctggacaggcggggcggaggcagcacagtgtgtaaccttccctgaatctgcgcataaaagcagatgcagcaattagaaagcaaagccaaacacccagaggcaacatttaccataaatttaggtgagaaagtatcaccacaaacccaagttgtaagctaggggatgagccactgccagcaacaggacccgtgtgttgccgtcatgccggggacgtggggggcacagggcctctgacagatgtgagaacaggagggcctcagaggtgcctacacgccgggaccaggtaagg

SEQ ID NO: 75622 - DNA, 22 bp, Homo sapiens
  misc_feature 1..22: note = chr13:114123716-114123738
  misc_feature 1..22: note = hypo
  source 1..22: mol_type = genomic DNA
tgaaaccatggctcacgcctgt

SEQ ID NO: 75623 - DNA, 86 bp, Homo sapiens; identical to SEQ ID NO: 15788
  misc_feature 1..86: note = chr13:114188403-114188489
  misc_feature 1..86: note = hypo
  source 1..86: mol_type = genomic DNA

SEQ ID NO: 75624 - DNA, 221 bp, Homo sapiens
  misc_feature 1..221: note = chr13:114189411-114189632
  misc_feature 1..221: note = hypo
  source 1..221: mol_type = genomic DNA
tgtgatgataaaaagcgccataaacactaatatcaaaccatgctactctgtcttaaattttcaaatagctttgcacctgaaatacaaaattaagtttggaaaaacagtttttaactgtgttgctcacaagctaattaactgtataagttctgccatgtgaaaggttaaaaaataaagttcattttggaaagtgggcttctgcttaccgagacgacagtctt

SEQ ID NO: 75625 - DNA, 30 bp, Homo sapiens
  misc_feature 1..30: note = chr13:114190112-114190142
  misc_feature 1..30: note = hypo
  source 1..30: mol_type = genomic DNA
ggcactcgctgtcttcgctgtgtctgtatc

SEQ ID NO: 75626 - DNA, 30 bp, Homo sapiens
  misc_feature 1..30: note = chr13:114191082-114191112
  misc_feature 1..30: note = hypo
  source 1..30: mol_type = genomic DNA
gctgctgcccattctcgtgtttctggaagg

SEQ ID NO: 75627 - DNA, 30 bp, Homo sapiens
  misc_feature 1..30: note = chr13:114202484-114202514
  misc_feature 1..30: note = hypo
  source 1..30: mol_type = genomic DNA
cctttccctacttgacgtgttattcaggga

SEQ ID NO: 75628 - DNA, 39 bp, Homo sapiens
  misc_feature 1..39: note = chr13:114202814-114202853
  misc_feature 1..39: note = hypo
  source 1..39: mol_type = genomic DNA
actctgggtttgagtcgggtgtggcgaaggcggctcggc

SEQ ID NO: 75629 - DNA, 177 bp, Homo sapiens
  misc_feature 1..177: note = chr13:114203823-114204000
  misc_feature 1..177: note = hypo
  source 1..177: mol_type = genomic DNA
cccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggct

SEQ ID NO: 75630 - DNA, 30 bp, Homo sapiens
  misc_feature 1..30: note = chr13:114212474-114212504
  misc_feature 1..30: note = hypo
  source 1..30: mol_type = genomic DNA
ctggttcccagtgggcgggggaaacataag

SEQ ID NO: 75631 - DNA, 79 bp, Homo sapiens
  misc_feature 1..79: note = chr13:114220555-114220634
  misc_feature 1..79: note = hypo
  source 1..79: mol_type = genomic DNA
ttctaggtctggggccggggcgggcgacagcggggctcggagccaccgccacagccctgcccgacgtaggtaattcacc

SEQ ID NO: 75632 - DNA, 33 bp, Homo sapiens
  misc_feature 1..33: note = chr13:114221622-114221655
  misc_feature 1..33: note = hypo
  source 1..33: mol_type = genomic DNA
taaaccaccagtttccgacttctgtactaaaac

SEQ ID NO: 75633 - DNA, 78 bp, Homo sapiens
  misc_feature 1..78: note = chr13:114271924-114272002
  misc_feature 1..78: note = hypo
  source 1..78: mol_type = genomic DNA
cttcacctgcagagccgctcacctgcagagccgctcacctgcagagccgctcacctgcagagccgctcacctgcagag

SEQ ID NO: 75634 - DNA, 30 bp, Homo sapiens
  misc_feature 1..30: note = chr13:114283331-114283361
  misc_feature 1..30: note = hypo
  source 1..30: mol_type = genomic DNA
gcaaagcctctgtctcgttcctgggagggc

SEQ ID NO: 75635 - DNA, 30 bp, Homo sapiens; identical to SEQ ID NO: 43894
  misc_feature 1..30: note = chr13:114285192-114285222
  misc_feature 1..30: note = hypo
  source 1..30: mol_type = genomic DNA

SEQ ID NO: 75636 - DNA, 30 bp, Homo sapiens; identical to SEQ ID NO: 43895
  misc_feature 1..30: note = chr13:114285597-114285627
  misc_feature 1..30: note = hypo
  source 1..30: mol_type = genomic DNA

SEQ ID NO: 75637 - DNA, 76 bp, Homo sapiens
  misc_feature 1..76: note = chr13:114302276-114302352
  misc_feature 1..76: note = hypo
  source 1..76: mol_type = genomic DNA
ccctcccacaggtaccgtgtcttctgtgctggtgtcgcacccgccggccaccgccaccctgcgtcttagacgtccc

SEQ ID NO: 75638 - DNA, 374 bp, Homo sapiens
  misc_feature 1..374: note = chr13:114304719-114305093
  misc_feature 1..374: note = hypo
  source 1..374: mol_type = genomic DNA
cctgggctttcttcccgtaataagggaagtagtgcagactgaaggtgccgttgggagggtagtacttgacctgcagcggctggccgagctcgcggggctggtcctggggaggagaggccactgcctgagtcaggcgggagctggtgtgtgccggtgtctgtgtgttgcgtttgtgtgcgtgtgtgcacacacgcgctgtgtaggtgcttgcataaacactttattgcatacttagcataaatcagatgcaatctttctaatcagtgctgagatctcagcaaggatatgatttgttagcatgcaaaatgcccagtgacccctccgtgtgcctctaacaacttgaaatgttggaaggatgacgcaggtgggtgaag

SEQ ID NO: 75639 - DNA, 30 bp, Homo sapiens
  misc_feature 1..30: note = chr13:114305730-114305760
  misc_feature 1..30: note = hypo
  source 1..30: mol_type = genomic DNA
agcgtgctgctgacacgctactcagatgct

SEQ ID NO: 75640 - DNA, 91 bp, Homo sapiens
  misc_feature 1..91: note = chr13:114312311-114312402
  misc_feature 1..91: note = hypo
  source 1..91: mol_type = genomic DNA
ctccatgcacccagccggcccgccccccgcacgtaccccacctggacagggtgcggcccagcatctgccccgtgtccgggttccagcagta

SEQ ID NO: 75641 - DNA, 40 bp, Homo sapiens
  misc_feature 1..40: note = chr13:114318203-114318243
  misc_feature 1..40: note = hypo
  source 1..40: mol_type = genomic DNA
ttcttcaaaactaaacgtgcaattacgacacttttaggca

SEQ ID NO: 75642 - DNA, 30 bp, Homo sapiens
  misc_feature 1..30: note = chr13:114323035-114323065
  misc_feature 1..30: note = hypo
  source 1..30: mol_type = genomic DNA
gggcagcggctgtgccgggtgtggacgtga

SEQ ID NO: 75643 - DNA, 30 bp, Homo sapiens; identical to SEQ ID NO: 43899
  misc_feature 1..30: note = chr13:114426896-114426926
  misc_feature 1..30: note = hypo
  source 1..30: mol_type = genomic DNA

SEQ ID NO: 75644 - DNA, 30 bp, Homo sapiens
  misc_feature 1..30: note = chr13:114438068-114438098
  misc_feature 1..30: note = hypo
  source 1..30: mol_type = genomic DNA
ctccaaaactgtctacgcaaaggatattca

SEQ ID NO: 75645 - DNA, 30 bp, Homo sapiens
  misc_feature 1..30: note = chr13:114438450-114438480
  misc_feature 1..30: note = hypo
  source 1..30: mol_type = genomic DNA
cccaggtccccatcacgccatctccttgcg

SEQ ID NO: 75646 - DNA, 136 bp, Homo sapiens
  misc_feature 1..136: note = chr13:114450586-114450722
  misc_feature 1..136: note = hypo
  source 1..136: mol_type = genomic DNA
aggctgggccctgtgcgaatcctctgggcacagaatccgccgggcacagattccgctgggcacagaatctgccagacacagaatctgccaggcacagactcggcgattctcccctggagcccggccttgccccatg

SEQ ID NO: 75647 - DNA, 38 bp, Homo sapiens
  misc_feature 1..38: note = chr13:114454880-114454918
  misc_feature 1..38: note = hypo
  source 1..38: mol_type = genomic DNA
cagttgtgccagctccgtggctgaggaggcggtttctt

SEQ ID NO: 75648 - DNA, 97 bp, Homo sapiens
  misc_feature 1..97: note = chr13:114462710-114462807
  misc_feature 1..97: note = hyper
  source 1..97: mol_type = genomic DNA
cttcgtttggaagagcgaggtagccttttcctgtttgaacgtgcagaggcgctcacagaactggacagtgttgcttggtttcggctcgcccctctct

SEQ ID NO: 75649 - DNA, 132 bp, Homo sapiens; identical to SEQ ID NO: 35127
  misc_feature 1..132: note = chr13:114462866-114462998
  misc_feature 1..132: note = hyper
  source 1..132: mol_type = genomic DNA

SEQ ID NO: 75650 - DNA, 153 bp, Homo sapiens
  misc_feature 1..153: note = chr13:114466991-114467144
  misc_feature 1..153: note = hypo
  source 1..153: mol_type = genomic DNA
cgggtgcctgggcctcggtcacttgaggggagtgtcctccccatccaaagacaagaaaggacgtgctccatgcacacaggaaggcaggtgtggcctggggtgggatgggccggggcgtgggcgtgggacacggggacacgggttggggctggg

SEQ ID NO: 75651 - DNA, 70 bp, Homo sapiens
  misc_feature 1..70: note = chr13:114478858-114478928
  misc_feature 1..70: note = hypo
  source 1..70: mol_type = genomic DNA
accatgggacccctgcggccccacaggtggcttgagtcagacttttccaggtgcacgtggcctgtggcat

SEQ ID NO: 75652 - DNA, 68 bp, Homo sapiens
  misc_feature 1..68: note = chr13:114479383-114479451
  misc_feature 1..68: note = hypo
  source 1..68: mol_type = genomic DNA
cgcacctctcttctgcgggcggcacctgcttcctgtcgtcctcccgacagctacgtccagcccagaca

SEQ ID NO: 75653 - DNA, 132 bp, Homo sapiens
  misc_feature 1..132: note = chr13:114492908-114493040
  misc_feature 1..132: note = hypo
  source 1..132: mol_type = genomic DNA
taacactgaactgaccgggcatgtggacatcctagcgctggactgactgggcacgtggacatcctagcactggactgactgggcacctgaacatcctagcgctggactgactgggcacgtggacatcctagt

SEQ ID NO: 75654 - DNA, 30 bp, Homo sapiens
  misc_feature 1..30: note = chr13:114494463-114494493
  misc_feature 1..30: note = hypo
  source 1..30: mol_type = genomic DNA
ctgtgggagcgacgtcgtgtggacagatgt

SEQ ID NO: 75655 - DNA, 30 bp, Homo sapiens
  misc_feature 1..30: note = chr13:114495640-114495670
  misc_feature 1..30: note = hypo
  source 1..30: mol_type = genomic DNA
ccatgcgatgggctccgtcattatttagtc

SEQ ID NO: 75656 - DNA, 30 bp, Homo sapiens; identical to SEQ ID NO: 43903
  misc_feature 1..30: note = chr13:114497409-114497439
  misc_feature 1..30: note = hypo
  source 1..30: mol_type = genomic DNA

SEQ ID NO: 75657 - DNA, 516 bp, Homo sapiens
  misc_feature 1..516: note = chr13:114497813-114498329
  misc_feature 1..516: note = hypo
  source 1..516: mol_type = genomic DNA
ttagggttgggcacacgccctgccgtctggggttgcttctcagaggcgcgtgccgagggcccggggatggcaacgcccttccgtgcagaaggcgcctgggtgggtcttgcggaatagacgcgtgaggacgacccgcagggtggagtccggcctggccagggctggaagtcataggacgaaaggtagaggtgagaagaggcagttctgtgaaagaagccccgacctcgagctgggactttgaattggtttgcgtttgaaaaccggggttggtaaaagctgggcacccacacctctccttctgttgcagctggtggcagcgatcgtgtttatcagttttggcgtggtggccgccttctgctgcgccatcgtggacggcgtatttgcagcacagcacattgtgagtacattgtcattgtgtgcacagtcgctttccggggctgaaagagtcgacgtgaaaaaagtacaatttcattttgcagatctcagctcagacggcttcaccgtcagtctccacgc

SEQ ID NO: 75658 - DNA, 38 bp, Homo sapiens
  misc_feature 1..38: note = chr13:114499931-114499969
  misc_feature 1..38: note = hypo
  source 1..38: mol_type = genomic DNA
acacacacactcccacggaggtgcgtcatgggagcttt

SEQ ID NO: 75659 - DNA, 30 bp, Homo sapiens
  misc_feature 1..30: note = chr13:114502300-114502330
  misc_feature 1..30: note = hypo
  source 1..30: mol_type = genomic DNA
tgtttctctaggaaccgaggcccctcacca

SEQ ID NO: 75660 - DNA, 175 bp, Homo sapiens; identical to SEQ ID NO: 43905
  misc_feature 1..175: note = chr13:114502787-114502962
  misc_feature 1..175: note = hypo
  source 1..175: mol_type = genomic DNA

SEQ ID NO: 75661 - DNA, 185 bp, Homo sapiens
  misc_feature 1..185: note = chr13:114506372-114506557
  misc_feature 1..185: note = hypo
  source 1..185: mol_type = genomic DNA
acattccaagctggacgtgcccttcgtagacgagggcaaattacttgtgatgggtgcgtgggaggcacttaacgtgccggcaagggcgggcggctgagccagcctctcaggggcctcctccgcgtgtgactccgtggcccccgtgttctctgctttctgtgcactcgccccggccccatcctcag

SEQ ID NO: 75662 - DNA, 30 bp, Homo sapiens
  misc_feature 1..30: note = chr13:114507314-114507344
  misc_feature 1..30: note = hypo
  source 1..30: mol_type = genomic DNA
cgagagccatcagcccggtgctgagagggc

SEQ ID NO: 75663 - DNA, 30 bp, Homo sapiens
  misc_feature 1..30: note = chr13:114508713-114508743
  misc_feature 1..30: note = hypo
  source 1..30: mol_type = genomic DNA
acaacccaaactctccggacgtgtcccgtg

SEQ ID NO: 75664 - DNA, 48 bp, Homo sapiens
  misc_feature 1..48: note = chr13:114515287-114515335
  misc_feature 1..48: note = hypo
  source 1..48: mol_type = genomic DNA
tgtgtcctggagaagcgcagggcagaagccacccgcccctcgtgctgt

SEQ ID NO: 75665 - DNA, 252 bp, Homo sapiens
  misc_feature 1..252: note = chr13:114515648-114515900
  misc_feature 1..252: note = hypo
  source 1..252: mol_type = genomic DNA
accagcttagctccccgcgggcccagcatgcacctgccgggcacacctggggagacgggtgagcacgcctgggaagcagcaggtcccgggtgggtcacaggccccgggtgggtcacaggacaggtctcaggtgggtcacaggtcctgagtgggtcacaggtcccgggtgggtcacaggcatcccgggtgggtcacaggtcccgagtgggtcacaggccccgggtgagtcacaggccccgggtgagtcacggg

SEQ ID NO: 75666 - DNA, 30 bp, Homo sapiens
  misc_feature 1..30: note = chr13:114517682-114517712
  misc_feature 1..30: note = hypo
  source 1..30: mol_type = genomic DNA
cccctctctgggctccgctggggccttctg

SEQ ID NO: 75667 - DNA, 30 bp, Homo sapiens
  misc_feature 1..30: note = chr13:114524666-114524696
  misc_feature 1..30: note = hypo
  source 1..30: mol_type = genomic DNA
ctgaagatgcaggttcgtggggcctgactc

SEQ ID NO: 75668 - DNA, 142 bp, Homo sapiens
  misc_feature 1..142: note = chr13:114526487-114526629
  misc_feature 1..142: note = hypo
  source 1..142: mol_type = genomic DNA
aggttgattcagtcccgacgtccagaggggtccgcactgcaatgaaagcggtgcattatagggtggtatgcacggtggagaggccacagtgaggtcggagcagggcctcgagagatgcagtcccagccggggtgggaagctg

SEQ ID NO: 75669 - DNA, 36 bp, Homo sapiens
  misc_feature 1..36: note = chr13:114531771-114531807
  misc_feature 1..36: note = hypo
  source 1..36: mol_type = genomic DNA
gagccaagagggtcccgacctcggggaggccacctg

SEQ ID NO: 75670 - DNA, 30 bp, Homo sapiens
  misc_feature 1..30: note = chr13:114601611-114601641
  misc_feature 1..30: note = hypo
  source 1..30: mol_type = genomic DNA
gtgctcccattccatcgcacctgaatgagg

SEQ ID NO: 75671 - DNA, 154 bp, Homo sapiens; identical to SEQ ID NO: 43908
  misc_feature 1..154: note = chr13:114742788-114742942
  misc_feature 1..154: note = hypo
  source 1..154: mol_type = genomic DNA

SEQ ID NO: 75672 - DNA, 69 bp, Homo sapiens
  misc_feature 1..69: note = chr13:114744097-114744166
  misc_feature 1..69: note = hypo
  source 1..69: mol_type = genomic DNA
ctctccccacccacacggcgccaggacgaaaccctgatgtggccggggctccggcgagggctttccggg

SEQ ID NO: 75673 - DNA, 50 bp, Homo sapiens
  misc_feature 1..50: note = chr13:114744515-114744565
  misc_feature 1..50: note = hypo
  source 1..50: mol_type = genomic DNA
cagcctgtactgagccgaacagaaaatccccggcacgctgtctcctccag

SEQ ID NO: 75674 - DNA, 77 bp, Homo sapiens; identical to SEQ ID NO: 43909
  misc_feature 1..77: note = chr13:114746775-114746852
  misc_feature 1..77: note = hypo
  source 1..77: mol_type = genomic DNA

SEQ ID NO: 75675 - DNA, 812 bp, Homo sapiens
  misc_feature 1..812: note = chr13:114748324-114749136
  misc_feature 1..812: note = hypo
  source 1..812: mol_type = genomic DNA
agccacagagcccagcgtcacacgcaccgtgcacgcaagacagacgtgcacgagactgacgcacacacggccggaggtgcatgtcacagtcgactagacgggccgtggctccctgaggctggctgtggtgtggctagggcacagcccacacttcctgatccttcagctgatccccagatccccacaaacaaggagcaaaaagcacagaatcaaatgacgacacgttccacagggccaggtgggctttctgcggagggcgtggcggtggtggcagcggttctgggagagggaaaccccagcgccacttgtctatgggccgggacggcgtgcatctcactttgccggctctgcgctcttccttctcttctccctcccaaaggctgcggctttgcatgggcagcttgctggcgccactgggcgcgtcccgcagactttaaatggaatgagtggaggtctcggactgctgccggatgtagttctggaagctcttgtctccgatggggtgctccctgaaaagggggatgggagagggaatgaggcacagaccccgttgcctggtgctcacccgtggctgcgggagcttttcctgttcctaaatgtgacacactcacactgcaatccacacaaaaaatagaggagccaaaggaaccacagtgcccccggaagcacccacggtgactctgatgtgtgtgcacaggtgggtcaggcgtgcaagtacatgtgcacgtgtgctctccctgtggcacgtgtgtagcgcatatacatgtgcagatgtggaatatgtagagtgtatggcacgtgtgcagaatgtg

SEQ ID NO: 75676 - DNA, 32 bp, Homo sapiens; identical to SEQ ID NO: 43911
  misc_feature 1..32: note = chr13:114749950-114749982
  misc_feature 1..32: note = hypo
  source 1..32: mol_type = genomic DNA

SEQ ID NO: 75677 - DNA, 30 bp, Homo sapiens
  misc_feature 1..30: note = chr13:114750396-114750426
  misc_feature 1..30: note = hypo
  source 1..30: mol_type = genomic DNA
gcccctgaatgagcccgtgtgggggcttct

SEQ ID NO: 75678 - DNA, 78 bp, Homo sapiens
  misc_feature 1..78: note = chr13:114750975-114751053
  misc_feature 1..78: note = hypo
  source 1..78: mol_type = genomic DNA
acacctgagcacgggcggccccacccgggagctccctgcagccccacccccactgcaatctcccgcccactacactgg

SEQ ID NO: 75679 - DNA, 30 bp, Homo sapiens; identical to SEQ ID NO: 43912
  misc_feature 1..30: note = chr13:114751360-114751390
  misc_feature 1..30: note = hypo
  source 1..30: mol_type = genomic DNA

SEQ ID NO: 75680 - DNA, 39 bp, Homo sapiens
  misc_feature 1..39: note = chr13:114755827-114755866
  misc_feature 1..39: note = hypo
  source 1..39: mol_type = genomic DNA
gctggagctgtgatgcggggcgcacggcctaggaggagc

SEQ ID NO: 75681 - DNA, 30 bp, Homo sapiens
  misc_feature 1..30: note = chr13:114758007-114758037
  misc_feature 1..30: note = hypo
  source 1..30: mol_type = genomic DNA
atacgctccgtctcacggtccccatcaatg

SEQ ID NO: 75682 - DNA, 111 bp, Homo sapiens
  misc_feature 1..111: note = chr13:114760934-114761045
  misc_feature 1..111: note = hypo
  source 1..111: mol_type = genomic DNA
tatgcgaaagcatcacgtggccacaacaacagcgaggtgcatctcacggagcataaccagggggaccgccaggcacccaggcctcctccttaggaccggcagatatgaccc

SEQ ID NO: 75683 - DNA, 197 bp, Homo sapiens
  misc_feature 1..197: note = chr13:114762623-114762820
  misc_feature 1..197: note = hypo
  source 1..197: mol_type = genomic DNA
tcagcccaggtggcccggcctgctcagctccttccccaactgaccagcccaggattcttcctcctcctcccagctggggttagggggctgcttcctcttgaagcgtctcggggcagcaacaacctttaccatttattactcattcaacaaacatgactgagcaccagcactctcctatgtcccggagacaaagcctg

SEQ ID NO: 75684 - DNA, 193 bp, Homo sapiens
  misc_feature 1..193: note = chr13:114765044-114765237
  misc_feature 1..193: note = hypo
  source 1..193: mol_type = genomic DNA
ggggccccacactcacgtttttcattttgaaagactcctcctccagcttctccactgccaggatgttctcgatgggaatgctgtagagaggctggtcccctgcagcagagatggactgtcagtgggtgcgggccccgctgtcccggctggggtccgggtggggctgaggggtctctgccggggggtctcccag

SEQ ID NO: 75685 - DNA, 754 bp, Homo sapiens
  misc_feature 1..754: note = chr13:114767261-114768015
  misc_feature 1..754: note = hypo
  source 1..754: mol_type = genomic DNA
ggggcaggcagcagacgcccacaaaacccacacctgtgttgtgcgggagtcacgcaccagcgcctctgccagaccaaacctgccccctcagggccagccctgctgtggtagaaggcgccactgggccacgtcctcaggaaacgtggggagcaggagacaggatggccaccgaggatgcaaggcctcagcgaggaggacctcaagccttgccctgggcagggtcctcgaacaccctcccggcagcccagggccctctgaggctcggccttcattgccgggcaggggtccctgaccagaaccggcggccgagctggaggagaagaaagtggccagacagagtgactggaggacagaggtggaagctgaggacgagaagccaagctggagagacagagtggggaggtgggcgggggagacgcacctcgacaagcgcactcagaaatcggaaagaggggctttgagcagcaacacagccagatgtggccagagagctgtggacgcacaccggagggtgtggaagctgctgggagctgttcaagagagaaaagggcggggcgctgggagccgccaggacagcgcagttcacaaccagtggatgccgaacgccgttcattccagggattcacaggcaggaagtcagcccaggaggctgttgaggaccagcaggacccagtgggatgcgcagggcggggcctacacagacgggggttggggggggactgggagctccacgacatgccggcctccttgaggg

SEQ ID NO: 75686 - DNA, 206 bp, Homo sapiens; identical to SEQ ID NO: 43917
  misc_feature 1..206: note = chr13:114769986-114770192
  misc_feature 1..206: note = hypo
  source 1..206: mol_type = genomic DNA

SEQ ID NO: 75687 - DNA, 143 bp, Homo sapiens
  misc_feature 1..143: note = chr13:114770922-114771065
  misc_feature 1..143: note = hypo
  source 1..143: mol_type = genomic DNA
gctgtgggacacagacgtccccctccaaggtcaccgagaaggtggcagaggggtcccaggctgaaggcgcaggggccagacccccagggctgtcccctctgactctggttccctgagcaaagagccctcgggagcctggaggg

SEQ ID NO: 75688 - DNA, 200 bp, Homo sapiens
  misc_feature 1..200: note = chr13:114774947-114775147
  misc_feature 1..200: note = hypo
  source 1..200: mol_type = genomic DNA
gaaacggagatcactcgaggacagcccgaagtacctcggctcacggcccaaatctgaaaaagctagaggcaagaactgtccaagcctaaatgacgataaacaggcaaagaacccggtgttaccgggcaagtgagagcccgcagggctgcccggaggacgaatcacataaatcgctcaggcgccaacgaagaccatcagac

SEQ ID NO: 75689 - DNA, 146 bp, Homo sapiens
  misc_feature 1..146: note = chr13:114776302-114776448
  misc_feature 1..146: note = hypo
  source 1..146: mol_type = genomic DNA
aggagcctccagcaccgcaacgcccaggaggcgccaggttaggccatctgcctggcctgttcagccgcttcccacacctgacaggtcagatgctgctcctgccacggggccggcgacgagccacaggctcccgaaaaaggcaaggg

SEQ ID NO: 75690 - DNA, 40 bp, Homo sapiens; identical to SEQ ID NO: 43921
  misc_feature 1..40: note = chr13:114777010-114777050
  misc_feature 1..40: note = hypo
  source 1..40: mol_type = genomic DNA

SEQ ID NO: 75691 - DNA, 30 bp, Homo sapiens
  misc_feature 1..30: note = chr13:114777780-114777810
  misc_feature 1..30: note = hypo
  source 1..30: mol_type = genomic DNA
caccagcactccccacgcaccgtccacaca

SEQ ID NO: 75692 - DNA, 34 bp, Homo sapiens; identical to SEQ ID NO: 43922
  misc_feature 1..34: note = chr13:114778697-114778731
  misc_feature 1..34: note = hypo
  source 1..34: mol_type = genomic DNA

SEQ ID NO: 75693 - DNA, 113 bp, Homo sapiens
  misc_feature 1..113: note = chr13:114779925-114780038
  misc_feature 1..113: note = hypo
  source 1..113: mol_type = genomic DNA
ggaccatggccaccccggggtgtctgcagctgtcccgaggccacaggacacgcaaggaagagaggagccggcagcaaggccctcgctgagcctctcagcgccccatacatagc

SEQ ID NO: 75694 - DNA, 543 bp, Homo sapiens
  misc_feature 1..543: note = chr13:114780540-114781083
  misc_feature 1..543: note = hypo
  source 1..543: mol_type = genomic DNA
ggaaaaatccagcatcggaactggggttcacgaccccgcagttctagtctagccagggctgcggggggttctgcctgggtgggagtcaccctgcacagcgctatggcagtttctcagcaacatgagggtgttcagggcactcaccctggaagcgcttggccgccgcctcccggagggagaagaagatgtcacacatgacggtcgggcagctcaccccagactcagtgatggcgtggaagacgcggtccacatactgccgtaggttctcctgcaacgggacacggcactgggacccactcccgaggctgcccacaggtgcgtgtagcaccagggcacgcccagggaggggcgcgtggggaggggctgagggcgggcgcagggcagctgcggcagtgagacacgtgtgaacagccactccctggaaatctgtgctgggagctgtggcaattcacgcgtgaaaatcactacacaggcaccacgtcggctccccggctcggccccgacctcgtttactgagtggggaatggacgttcactagaatgt

SEQ ID NO: 75695 - DNA, 35 bp, Homo sapiens
  misc_feature 1..35: note = chr13:114781299-114781334
  misc_feature 1..35: note = hypo
  source 1..35: mol_type = genomic DNA
aagggaaggaggagccggggcggaggcagagctgg

SEQ ID NO: 75696 - DNA, 93 bp, Homo sapiens
  misc_feature 1..93: note = chr13:114782866-114782959
  misc_feature 1..93: note = hypo
  source 1..93: mol_type = genomic DNA
acgcggaagtgcagacggagcagagcctggccccgagcacctgcctgtgggctgtgaggtcagtgcacgcccatcagtcggcttcctgacatt

SEQ ID NO: 75697 - DNA, 56 bp, Homo sapiens
  misc_feature 1..56: note = chr13:114784530-114784586
  misc_feature 1..56: note = hypo
  source 1..56: mol_type = genomic DNA
ctggggactccccaccgaagacccccagcagggctggtcaccggggatccccagga

SEQ ID NO: 75698 - DNA, 66 bp, Homo sapiens; identical to SEQ ID NO: 43926
  misc_feature 1..66: note = chr13:114785766-114785832
  misc_feature 1..66: note = hypo
  source 1..66: mol_type = genomic DNA

SEQ ID NO: 75699 - DNA, 165 bp, Homo sapiens
  misc_feature 1..165: note = chr13:114786866-114787031
  misc_feature 1..165: note = hypo
  source 1..165: mol_type = genomic DNA
aacatcatcttaccacgcctcgtaggagctggactgccgcaggactttcaacgggatccttagttctcccaggaattcatctccaaacttcaggttactggcattccagaggtcaactctgaaaaacagcatcaggacagctctagctgacggcgggcagcccgt

SEQ ID NO: 75700 - DNA, 116 bp, Homo sapiens
  misc_feature 1..116: note = chr13:114789389-114789505
  misc_feature 1..116: note = hypo
  source 1..116: mol_type = genomic DNA
ggcgtcgtgctgacccgccaggccctgcgacctctgagtgaggcctgaacccatggaaggcggagggcttagaacaagaccttaagaacggctgcagcccccgtcactccaggtgg

SEQ ID NO: 75701 - DNA, 20 bp, Homo sapiens
  misc_feature 1..20: note = chr13:114802298-114802318
  misc_feature 1..20: note = hypo
  source 1..20: mol_type = genomic DNA
caccgcgcccagcctggagt

SEQ ID NO: 75702 - DNA, 115 bp, Homo sapiens
  misc_feature 1..115: note = chr13:114802580-114802695
  misc_feature 1..115: note = hypo
  source 1..115: mol_type = genomic DNA
gcttggccacgggtacgcagcctcgggcgttaattatgagattccaccagctgtgagatcaacctgcggcattcttatttacagctttgtggagatgcaacgtctgagtcctgat

SEQ ID NO: 75703 - DNA, 42 bp, Homo sapiens
  misc_feature 1..42: note = chr13:114803361-114803403
  misc_feature 1..42: note = hypo
  source 1..42: mol_type = genomic DNA
caggagaagggagcacggccgtccgttcgggggagccgggag

SEQ ID NO: 75704 - DNA, 30 bp, Homo sapiens
  misc_feature 1..30: note = chr13:114803808-114803838
  misc_feature 1..30: note = hypo
  source 1..30: mol_type = genomic DNA
tccgtgggagcagcacgctggggcccttgt

SEQ ID NO: 75705 - DNA, 346 bp, Homo sapiens
  misc_feature 1..346: note = chr13:114807501-114807847
  misc_feature 1..346: note = hypo
  source 1..346: mol_type = genomic DNA
cttccagtgaaaatacgtatcagaatatatttgtacaatatacgtttacctagtatggatttatatgtgtaaattcgcatctgcaaccattattatctgcttatacgttcacctcattccagaaacattcccgaggcgcggcaaacgtgtgcccatcccatccccggcaggacagggcttgtcaggcgctgggcaccgagccatctcccatcctgcgtcccttcatggcaccaccatgtcaaccctgccagtggcctccgcacactgcggaccacgccacccaccacggtgagcacccacggcagcacatgcacctctgttgaccgatgcacgtgaactcctaggg

SEQ ID NO: 75706 - DNA, 46 bp, Homo sapiens
  misc_feature 1..46: note = chr13:114808091-114808137
  misc_feature 1..46: note = hypo
  source 1..46: mol_type = genomic DNA
cctgggcctcctacccggccaccctgcctcacgccaggacagcgca

SEQ ID NO: 75707 - DNA, 18 bp, Homo sapiens
  misc_feature 1..18: note = chr13:114812180-114812198
  misc_feature 1..18: note = hypo
  source 1..18: mol_type = genomic DNA
gtccgagccctgccttca

SEQ ID NO: 75708 - DNA, 30 bp, Homo sapiens
  misc_feature 1..30: note = chr13:114816511-114816541
  misc_feature 1..30: note = hypo
  source 1..30: mol_type = genomic DNA
agtgtgagcagcgagcgtcagatggaccgg

SEQ ID NO: 75709 - DNA, 72 bp, Homo sapiens
  misc_feature 1..72: note = chr13:114820299-114820371
  misc_feature 1..72: note = hypo
  source 1..72: mol_type = genomic DNA
ctttaaacacattctcgcgttggtcgttgacgcagcgagccatcctctgatctcctgcgtctgcgtgggcac

SEQ ID NO: 75710 - DNA, 30 bp, Homo sapiens
  misc_feature 1..30: note = chr13:114838479-114838509
  misc_feature 1..30: note = hypo
  source 1..30: mol_type = genomic DNA
cgcgggaaaatgggacggtgatgtccacgc

SEQ ID NO: 75711 - DNA, 30 bp, Homo sapiens
  misc_feature 1..30: note = chr13:114840646-114840676
  misc_feature 1..30: note = hypo
  source 1..30: mol_type = genomic DNA
aaacaaaatcaaaaacgggagcagagtaga

SEQ ID NO: 75712 - DNA, 316 bp, Homo sapiens
  misc_feature 1..316: note = chr13:114842818-114843134
  misc_feature 1..316: note = hypo
  source 1..316: mol_type = genomic DNA
tccatccctgcctgacgatgcccagtcctaccgcactggcaccaacgcacccaattcatccctccgtccctgcctgacgatgcccagtccccccacactggcaccaacacaccggattcatcccttcctccctccccactcaatgatgcccagtccccccacactggcaccaacgcaccggattcatccctccctccctgcccgacgatgcccagtcccaccgcactggcaccaatgcaccggattcatccttcctccctgcccgacaatgcccagtccccccacactggcaccaacgcaccggattcatccctcc

SEQ ID NO: 75713 - DNA, 30 bp, Homo sapiens
  misc_feature 1..30: note = chr13:114844847-114844877
  misc_feature 1..30: note = hypo
  source 1..30: mol_type = genomic DNA
gggaaggagaccctgcgggagaattggagg

SEQ ID NO: 75714 - DNA, 37 bp, Homo sapiens
  misc_feature 1..37: note = chr13:114845313-114845350
  misc_feature 1..37: note = hypo
  source 1..37: mol_type = genomic DNA
ccacccggcaccctccgtgggacgaggctgcacatct

SEQ ID NO: 75715 - DNA, 460 bp, Homo sapiens
  misc_feature 1..460: note = chr13:114847212-114847672
  misc_feature 1..460: note = hypo
  source 1..460: mol_type = genomic DNA
acacccagggaataacgaggaaagagaaggcaaaggtgggctgaaatgaagccgcccttctgagttcacaaaggagcagagacacaccggtgctgcacaggaacccccagggcccccgtgttcctagcgcagcagagcctgccccgcatccaggctgcatctcctggggctgtgactcctctcctgagtccacacacaggacctcacacctgcactcaccggctgcagctgcacacacaggagagcttctcacaggacaaatgcctggaccccacccagagattgccattctttgactaggacgggctccaggcagtaagaacagacattcgtcttgattagaaagcctgcaggtggttctgggtgcagccaggactgagaggcattacttactgctgagaactgagaaggtgtgaagatgcccctacctcctcgccccactcaccggggagctgcgggt

SEQ ID NO: 75716 - DNA, 227 bp, Homo sapiens
  misc_feature 1..227: note = chr13:114855474-114855701
  misc_feature 1..227: note = hypo
  source 1..227: mol_type = genomic DNA
tgatatttcatgtcacggatggaacgcattctgtgtatttgttaatcactgatggatgtttgggctgttcccagctttcagttgttgtgaatggtgccgctgtgaagtgtgcacaagttcccatgtgaacacggacagctttgggattctcttgattatttaccaacgggtggggccgcacggcaacaggtttaattaccctaggagccacccggctgcctgcccag

SEQ ID NO: 75717 - DNA, 30 bp, Homo sapiens
  misc_feature 1..30: note = chr13:114862455-114862485
  misc_feature 1..30: note = hypo
  source 1..30: mol_type = genomic DNA
gagtctgctcctccacgaggctcccagatc

SEQ ID NO: 75718 - DNA, 37 bp, Homo sapiens
  misc_feature 1..37: note = chr13:114886881-114886918
  misc_feature 1..37: note = hypo
  source 1..37: mol_type = genomic DNA
ccgtgtcttctgccacggatctcggctaaaggaaaag

SEQ ID NO: 75719 - DNA, 53 bp, Homo sapiens
  misc_feature 1..53: note = chr13:114889099-114889152
  misc_feature 1..53: note = hypo
  source 1..53: mol_type = genomic DNA
tcccagagaatcctccgtcctaccctgggcacgccatgcgcaccaggcaggga

SEQ ID NO: 75720 - DNA, 30 bp, Homo sapiens
  misc_feature 1..30: note = chr13:114889446-114889476
  misc_feature 1..30: note = hypo
  source 1..30: mol_type = genomic DNA
gcaggagtcgttcctcgatcaattccaggt

SEQ ID NO: 75721 - DNA, 38 bp, Homo sapiens
  misc_feature 1..38: note = chr13:114892617-114892655
  misc_feature 1..38: note = hypo
  source 1..38: mol_type = genomic DNA
cgctcatccactctgcgcctgcgcggttcacacgctcc

SEQ ID NO: 75722 - DNA, 30 bp, Homo sapiens
  misc_feature 1..30: note = chr13:114911257-114911287
  misc_feature 1..30: note = hypo
  source 1..30: mol_type = genomic DNA
gtgcacacaggagcccgggggctcaggcgt

SEQ ID NO: 75723 - DNA, 69 bp, Homo sapiens
  misc_feature 1..69: note = chr13:114917035-114917104
  misc_feature 1..69: note = hypo
  source 1..69: mol_type = genomic DNA
cactcaccagtgccacgtgcacacggatcatctaattctaggggggcaactgcacggtttgcccccgac

SEQ ID NO: 75724 - DNA, 30 bp, Homo sapiens
  misc_feature 1..30: note = chr13:114917570-114917600
  misc_feature 1..30: note = hypo
  source 1..30: mol_type = genomic DNA
cagccctagcaaacacggccacgctgccct

SEQ ID NO: 75725 - DNA, 37 bp, Homo sapiens
  misc_feature 1..37: note = chr13:114922755-114922792
  misc_feature 1..37: note = hypo
  source 1..37: mol_type = genomic DNA
ggattacaggcatgagccaccacgcccagccagctgt

SEQ ID NO: 75726 - DNA, 351 bp, Homo sapiens
  misc_feature 1..351: note = chr13:114961720-114962071
  misc_feature 1..351: note = hypo
  source 1..351: mol_type = genomic DNA
ttccaaatctaagcacgagcctctttcagaacttcaggccgtgtgctgacatggaatccctggtgccacgaaagaccccagagcagcacaatctgagctcactctgtttccaatactgcgcccaggtaacgctgcctcctcatgccacaggtccagagcgcccagccgctggtagacacccgcgccccgctgacgttccgccatctccacctgaaactcaagaggctgaaggtacactttcatttctaccttacttaatgtaatagctaactagaaaatgccagcttaaaagcccaggaaaatagaaaaggcagggttagtaaggaataaactcaccgaagacaaaatgca

SEQ ID NO: 75727 - DNA, 107 bp, Homo sapiens
  misc_feature 1..107: note = chr13:114989891-114989998
  misc_feature 1..107: note = hypo
  source 1..107: mol_type = genomic DNA
ctgagatgccggcatcgggccgggaggagctgggcctctgcccactgcagccatgacctctccaggcagccccgcccccctgtgtcgtgaagcgcaactgggcacag

SEQ ID NO: 75728 - DNA, 207 bp, Homo sapiens
  misc_feature 1..207: note = chr13:115024113-115024320
  misc_feature 1..207: note = hypo
  source 1..207: mol_type = genomic DNA
atgtatcaaataagacgtctttaaatagaaacacacataaaacaaggttacgcattgatcaattagagaaaatgtgaccagagaattgcaggaatctaactgtatttcccctggcagccgcggttcaatatttgctaactcagtgtacacagtgactttatagaacataaatactgtggttgggtgcggtggctcccgtctgtaatc

SEQ ID NO: 75729 - DNA, 259 bp, Homo sapiens
  misc_feature 1..259: note = chr13:19517655-19517914
  misc_feature 1..259: note = hypo
  source 1..259: mol_type = genomic DNA
gcctcaacatacccccgcaagcctggcatcccgtccccgtgacccgggggacttcttgccgctttggagggcccccggtggggggagacacagggtgaagccggggactccacgaccccctgggccccacgcaggggctgcagggaaggcactggcctctgagggatgatcccagcctcctcggcctcaccgctttttcccccggctacctcaacctccccctgcaagcctggcgtcctgtacccgtgacccaggggac

SEQ ID NO: 75730 - DNA, 44 bp, Homo sapiens
  misc_feature 1..44: note = chr13:19537201-19537245
  misc_feature 1..44: note = hypo
  source 1..44: mol_type = genomic DNA
ggcaggagacaaggccggggcagctgcatcgcccccagagctgg

SEQ ID NO: 75731 - DNA, 106 bp, Homo sapiens
  misc_feature 1..106: note = chr13:19756080-19756186
  misc_feature 1..106: note = hypo
  source 1..106: mol_type = genomic DNA
accacgtagtggggacgccctctgattggatgcaggattggcgggaaggcagcaggctcagagagggccctctgactggatgcaggactggcgggaaggcagtggg

SEQ ID NO: 75732 - DNA, 30 bp, Homo sapiens
  misc_feature 1..30: note = chr13:19964867-19964897
  misc_feature 1..30: note = hypo
  source 1..30: mol_type = genomic DNA
tggtccttcccgactcgctgaagcttgggg

SEQ ID NO: 75733 - DNA, 101 bp, Homo sapiens; identical to SEQ ID NO: 43749
  misc_feature 1..101: note = chr13:20078200-20078301
  misc_feature 1..101: note = hypo
  source 1..101: mol_type = genomic DNA

SEQ ID NO: 75734 - DNA, 30 bp, Homo sapiens
  misc_feature 1..30: note = chr13:20138821-20138851
  misc_feature 1..30: note = hypo
  source 1..30: mol_type = genomic DNA
caacagcaagaggtccgaattgcccttttc

SEQ ID NO: 75735 - DNA, 78 bp, Homo sapiens
  misc_feature 1..78: note = chr13:20312627-20312705
  misc_feature 1..78: note = hypo
  source 1..78: mol_type = genomic DNA
actgtttacagagaacgacaagtaacaaaaagtcctcctacacacttaaaagcatctctagattacttataataccta

SEQ ID NO: 75736 - DNA, 87 bp, Homo sapiens; identical to SEQ ID NO: 43750
  misc_feature 1..87: note = chr13:20392358-20392445
  misc_feature 1..87: note = hypo
  source 1..87: mol_type = genomic DNA

SEQ ID NO: 75737 - DNA, 63 bp, Homo sapiens
  misc_feature 1..63: note = chr13:20500420-20500483
  misc_feature 1..63: note = hypo
  source 1..63: mol_type = genomic DNA
agggcttctccaattcgcttcaaacaataaaggatgtattgttttttgcgggggtgagtgggt

SEQ ID NO: 75738 - DNA, 30 bp, Homo sapiens
  misc_feature 1..30: note = chr13:20531916-20531946
  misc_feature 1..30: note = hyper
  source 1..30: mol_type = genomic DNA
ctcagcccctccaaccggtgggagcccagc

SEQ ID NO: 75739 - DNA, 27 bp, Homo sapiens
  misc_feature 1..27: note = chr13:20692250-20692277
  misc_feature 1..27: note = hypo
  source 1..27: mol_type = genomic DNA
cgtgagccactgcgcctggccacattt

SEQ ID NO: 75740 - DNA, 166 bp, Homo sapiens
  misc_feature 1..166: note = chr13:20692809-20692975
  misc_feature 1..166: note = hyper
  source 1..166: mol_type = genomic DNA
ccttcttccaggaggcgtttctcagccacaccaacgcggcacttcttttcccttttggcacagaagtgaggaagagcagctgagctggtctcggtctcccagctcctgcagtctgaggaccccgggatgctccagccagggcagacccgcgcggggggtgcccttc

SEQ ID NO: 75741 - DNA, 151 bp, Homo sapiens
  misc_feature 1..151: note = chr13:20701930-20702081
  misc_feature 1..151: note = hyper
  source 1..151: mol_type = genomic DNA
gtgaggtctggtggccgaggggaggtgcccagcgtgcgcgtccgcatccggcgggcgacagagcagccccggaacaggagcttcccggcaccggccgtggcgtggcgccctccgctgggccgttctcccccgcagccgctaagtcagcatc

SEQ ID NO: 75742 - DNA, 129 bp, Homo sapiens
  misc_feature 1..129: note = chr13:20702784-20702913
  misc_feature 1..129: note = hyper
  source 1..129: mol_type = genomic DNA
ttgtcctggatgatccgggcggaccctaaatgtcatcaaagtgtcctcgtaggagagggagaggaggcgaccgtgggggcagaggctggaggaccgcggcgcccgggacctgcccgcacctgactgcag

SEQ ID NO: 75743 - DNA, 128 bp, Homo sapiens
  misc_feature 1..128: note = chr13:20734542-20734670
  misc_feature 1..128: note = hyper
  source 1..128: mol_type = genomic DNA
gcgatgctgaatgcccgtggacggctgggtgcgcgccgttagctggcgcggtgacatctgcttagagttttcaagcatttcagcatcgctaggagccctacagcctgacggtccgggacagcccggct

SEQ ID NO: 75744 - DNA, 100 bp, Homo sapiens
  misc_feature 1..100: note = chr13:20735432-20735532
  misc_feature 1..100: note = hyper
  source 1..100: mol_type = genomic DNA
ggggctcttccctgccgcctacgcactccggggcatgcccgcgcgggacgtgagaggagagccgagggctgttggggcgggcccgacccgcttgcggggc

SEQ ID NO: 75745 - DNA, 577 bp, Homo sapiens
  misc_feature 1..577: note = chr13:20735533-20736110
  misc_feature 1..577: note = hyper
  source 1..577: mol_type = genomic DNA
cccaccgcacgcagatgcgccagcccgcgccccgctcgcgcctgtcctgggcttcgcaggcccggcgaggtagctgctctccgggcgctcccacggtcggaggcgcgtgggcgtcgggcacctaggtctcgcccgcctgcagccgcctggggacgcgggttccggacggctggcgcggggcggggcggggaccaccgagcaggaagtccccgcggaagcgccgccgggcacagcgtgggtgctgtcgaggagtggcgcccgggcggggcgggaggttataaatagcggccgccatcctgcttctcttcagacacacttaatttagccggcaggcacacggatgcttatttttaaaaaaagaacttgttttattgcgctcgaggtgaccgggaaggtgtccccgcgggtcactcgctccatctggtcctggagacgagatgccagggcgaggcctaacctgcctgctggcgcccaacgaagattttaacgttttctgttcccttcggggtggttttaccacgcttgagagggacgcctaccgcggaaggccgcggaccgagggcggcatcgcgtcctt

SEQ ID NO: 75746 - DNA, 90 bp, Homo sapiens
  misc_feature 1..90: note = chr13:20766251-20766341
  misc_feature 1..90: note = hyper
  source 1..90: mol_type = genomic DNA
cacaccacctcttcgcgaacaagggtcctaaaaattttccttctaggcggggagcacagcccggaaacagaccctcgtgaagtgtttagg

SEQ ID NO: 75747 - DNA, 714 bp, Homo sapiens
  misc_feature 1..714: note = chr13:20805970-20806684
  misc_feature 1..714: note = hyper
  source 1..714: mol_type = genomic DNA
agtcaaaggggaccacgctggggtaaaagtcaaaccagtccatcctcgttcctctgcgtacagagagagggtccagcgcgggcggcgcccactgccatcgggccggggccggggcgcgtggacaggagggtgcggatagaggcagatcgggggcccggtcgccccacgtgcggccagacacccatcccggccgcgctctgccggctctgatccggtgccagacaggagcgacaggggcgaggtggggaccagccgccgacctcacctgttttgttttcttggaggaaattcctccgctggggggccgaggtggcaccgcccgctcgccccccgcaagacccagccggtccgcgcccgcttacctgctctgcggccggcggccctggcgcgggctctgcgcggggcggcgcccttcgctccggctgggcaggcaggtcgggctcgggcgccgccggctgtcgggctctcgtcgggtttcgggtgaaggccccggctcccacctgctgcgccttttaaccgcgccccaccccgcctctgccctgacgcggctcgggcgggctgcgggaggcgagcgctgtcactcgacgagccccccgcccccacctacccggggcgcactagccgctgggcgcggaccgtccccctgaggagcaaggagtgcaggaccggggctgtccctccggggccggatgcgcagagcggggacctttttcc

SEQ ID NO: 75748 - DNA, 18 bp, Homo sapiens
  misc_feature 1..18: note = chr13:20875611-20875629
  misc_feature 1..18: note = hyper
  source 1..18: mol_type = genomic DNA
gggctggtccgattgcgc

SEQ ID NO: 75749 - DNA, 154 bp, Homo sapiens
  misc_feature 1..154: note = chr13:21057336-21057490
  misc_feature 1..154: note = hypo
  source 1..154: mol_type = genomic DNA
acaataaaagataaacgtgtgaggttctggatatcctaatacaccgggattttaccatgacacactgaacacacaaatcaatcacacatgaatcccaaatatgtacaattaagatacagcaagtaattttttatttattattatttttttaaga

SEQ ID NO: 75750 - DNA, 33 bp, Homo sapiens
  misc_feature 1..33: note = chr13:21057550-21057583
  misc_feature 1..33: note = hypo
  source 1..33: mol_type = genomic DNA
ctccgcctcctgggttcacgccatctggactga

SEQ ID NO: 75751 - DNA, 30 bp, Homo sapiens
  misc_feature 1..30: note = chr13:21475790-21475820
  misc_feature 1..30: note = hypo
  source 1..30: mol_type = genomic DNA
tagaactacaaactacgctagaattagttc

SEQ ID NO: 75752 - DNA, 45 bp, Homo sapiens; identical to SEQ ID NO: 34793
  misc_feature 1..45: note = chr13:21520313-21520358
  misc_feature 1..45: note = hyper
  source 1..45: mol_type = genomic DNA

SEQ ID NO: 75753 - DNA, 30 bp, Homo sapiens
  misc_feature 1..30: note = chr13:21549397-21549427
  misc_feature 1..30: note = hypo
  source 1..30: mol_type = genomic DNA
ccaggcggtggtctgcggagcagcacagct

SEQ ID NO: 75754 - DNA, 181 bp, Homo sapiens
  misc_feature 1..181: note = chr13:21634356-21634537
  misc_feature 1..181: note = hyper
  source 1..181: mol_type = genomic DNA
gccgcactccatccccgagggaaagctccccagaagttctggagttgggctgaaggatgtgatggcaagatgtgaatgatgtcagaatccccatctccagagtccggctggggagctaagcgcaggtgagcttacatcagaagagaaagccaaaccccccacacgtcgctaaactagggca

SEQ ID NO: 75755 - DNA, 218 bp, Homo sapiens
  misc_feature 1..218: note = chr13:21634747-21634965
  misc_feature 1..218: note = hyper
  source 1..218: mol_type = genomic DNA
agccggcggcgcggccgcggggaacggggtgggaaccgcgcggcagtgggtgaggcggcgcagccaccgggggctgaggggcggcgcggcctcgactgcggcaccgccgtgggtccgtcggctcgcgggacgacggggcggccggcgggggccaacagggcgggctctgaaggactgattggcccgtgggacgatggcgcggccgggaggatggcccc

SEQ ID NO: 75756 - DNA, 419 bp, Homo sapiens; identical to SEQ ID NO: 11520
  misc_feature 1..419: note = chr13:21649623-21650042
  misc_feature 1..419: note = hyper
  source 1..419: mol_type = genomic DNA

SEQ ID NO: 75757 - DNA, 30 bp, Homo sapiens; identical to SEQ ID NO: 43753
  misc_feature 1..30: note = chr13:21711382-21711412
  misc_feature 1..30: note = hypo
  source 1..30: mol_type = genomic DNA

SEQ ID NO: 75758 - DNA, 34 bp, Homo sapiens
  misc_feature 1..34: note = chr13:21713712-21713746
  misc_feature 1..34: note = hypo
  source 1..34: mol_type = genomic DNA
cgtgagccaccaccacgcccggccagagttctta

SEQ ID NO: 75759 - DNA, 23 bp, Homo sapiens
  misc_feature 1..23: note = chr13:22049000-22049023
  misc_feature 1..23: note = hypo
  source 1..23: mol_type = genomic DNA
tttttttttttgagacggagtct

SEQ ID NO: 75760 - DNA, 23 bp, Homo sapiens
  misc_feature 1..23: note = chr13:22049278-22049301
  misc_feature 1..23: note = hypo
  source 1..23: mol_type = genomic DNA
accgcgcccggctgtttctgcat

SEQ ID NO: 75761 - DNA, 33 bp, Homo sapiens
  misc_feature 1..33: note = chr13:22122977-22123010
  misc_feature 1..33: note = hypo
  source 1..33: mol_type = genomic DNA
atacaaggattctatcgccgtatctcagacctt

SEQ ID NO: 75762 - DNA, 620 bp, Homo sapiens
  misc_feature 1..620: note = chr13:22243244-22243864
  misc_feature 1..620: note = hyper
  source 1..620: mol_type = genomic DNA
actaagtaaccatcccggcgcactgtacccaactggtcgaggaacgcccctgctgtacccatcactgctggctgcctcggagattaatgcgagcgactcgggtggtttatgagaagtgacacttaatacccagcttcttgtatctgccgccgagcagttaacgttaaagcccgctctgtaccaccgcggatgtgactgctgtaaataccacggggcagggctctcatgcttcagaaacacgtaagcaagacgcaccgagccagccccggacacccaatgaccctggactgcggcaaagggggggtgggaaaggaagaggggaggaccactcgctcttctctccttcctcctcgcccgggccggagcacgccttcctccccggagggcaggggaaggtcgctccaggtcgctggcacctccagcgcccccgaaatctgcaaattcatcgctccctttcgtcttcaggcgaagccctcccgtccggagtagggccagccccagttatgcatctccagcctttagctgactactaaggcggatccgacttctcccccataaccaggttttgattcgcttccccaccgcaggggttcagtctctgctttcgactttgcttctca

SEQ ID NO: 75763 - DNA, 176 bp, Homo sapiens
  misc_feature 1..176: note = chr13:22247052-22247228
  misc_feature 1..176: note = hyper
  source 1..176: mol_type = genomic DNA
tggtgtgagtgtgtgcgcgcgtgcaaacgctgcgagcgaattttaaagggcattccgaggatttcatttttcagcggagggtatttgtgactcagcactgagggctgcagactcgagggctggtggctctgcccactttatgcttgcacacacgtgcttgccggggcaccctgagc

SEQ ID NO: 75764 - DNA, 42 bp, Homo sapiens
  misc_feature 1..42: note = chr13:22336937-22336979
  misc_feature 1..42: note = hypo
  source 1..42: mol_type = genomic DNA
cagtcgctgccgaaacgatcacccagtcgcagtcactttgct

SEQ ID NO: 75765 - DNA, 30 bp, Homo sapiens; identical to SEQ ID NO: 43756
  misc_feature 1..30: note = chr13:22391874-22391904
  misc_feature 1..30: note = hypo
  source 1..30: mol_type = genomic DNA

SEQ ID NO: 75766 - DNA, 16 bp, Homo sapiens
  misc_feature 1..16: note = chr13:22707389-22707405
  misc_feature 1..16: note = hypo
  source 1..16: mol_type = genomic DNA
gcgcctggccaggtta

SEQ ID NO: 75767 - DNA, 42 bp, Homo sapiens
  misc_feature 1..42: note = chr13:22766880-22766922
  misc_feature 1..42: note = hypo
  source 1..42: mol_type = genomic DNA
ctgacttccctgctccgagggagtacttggtcagtggatttt

SEQ ID NO: 75768 - DNA, 31 bp, Homo sapiens
  misc_feature 1..31: note = chr13:23174977-23175008
  misc_feature 1..31: note = hypo
  source 1..31: mol_type = genomic DNA
ggccacaggctggtaccggcccacagcctgg

SEQ ID NO: 75769 - DNA, 352 bp, Homo sapiens
  misc_feature 1..352: note = chr13:23489676-23490028
  misc_feature 1..352: note = hyper
  source 1..352: mol_type = genomic DNA
tagggggcggggggacgcggagcgatgcccgcgccggcgcaggggcggataaaaagccgtagcgccacgggagtgggcgggagggagagggggtacccgagggccacaagagtatgacggggctgtaagagctggtgtggcgggtgctgcccccctgctctgtctgcaccgcaagctcacctcctggctccgcgttcggttcggcacttggaactggatctggcgactgtgccggcgcgccgcctctgccgcggtcctagcgccgctcggcttcacgctccgcaagtcccaggcgtctgcaggaaccgccatcaccacccgcacccgcgccgggggtcgtgcctgcccgcag

SEQ ID NO: 75770 - DNA, 108 bp, Homo sapiens
  misc_feature 1..108: note = chr13:23507321-23507429
  misc_feature 1..108: note = hypo
  source 1..108: mol_type = genomic DNA
ccctggagcctggctcggaggatgcgaggaggattctccagcaggcaagcatggtcagaggggccactgggtcgccagatggagtccctgtgccgatcccacagtaca

SEQ ID NO: 75771 - DNA, 30 bp, Homo sapiens; identical to SEQ ID NO: 43757
  misc_feature 1..30: note = chr13:23717527-23717557
  misc_feature 1..30: note = hypo
  source 1..30: mol_type = genomic DNA

SEQ ID NO: 75772 - DNA, 851 bp, Homo sapiens; identical to SEQ ID NO: 34800
  misc_feature 1..851: note = chr13:23733447-23734298
  misc_feature 1..851: note = hyper
  source 1..851: mol_type = genomic DNA

SEQ ID NO: 75773 - skipped

SEQ ID NO: 75774 - DNA, 115 bp, Homo sapiens
  misc_feature 1..115: note = chr13:23896852-23896967
  misc_feature 1..115: note = hypo
  source 1..115: mol_type = genomic DNA
cccaggccctatcatcgcacctgcggcgatgcacagaccgccccccacccatccacctccccccccccccccccccgccaacaggtgtaacgtggtgccgcgggcagaggattca

SEQ ID NO: 75775 - DNA, 20 bp, Homo sapiens
  misc_feature 1..20: note = chr13:23920566-23920586
  misc_feature 1..20: note = hypo
  source 1..20: mol_type = genomic DNA
gccaccgagcctggccccct

SEQ ID NO: 75776 - DNA, 288 bp, Homo sapiens
  misc_feature 1..288: note = chr13:23949125-23949413
  misc_feature 1..288: note = hyper
  source 1..288: mol_type = genomic DNA
aagcacaggcggccacgctgccggagtcattcgcgccgcccgcggaaacctgcgtcgcccaccccgggccctcgacgcccgccgttcctccgcgtggcggagcccagcccagcgcccccggccaccgcctacctcgcggccgccgcgccacagccgctgctccgacaccgggaagccagtctccgcgaagatacgttccttcacatcgcgcacggtccaggacgccagcgccgcgacggtcctgcagcccacgcagccggggagcacggtcaccgggacccacctgtg

SEQ ID NO: 75777 - DNA, 29 bp, Homo sapiens
  misc_feature 1..29: note = chr13:23961293-23961322
  misc_feature 1..29: note = hypo
  source 1..29: mol_type = genomic DNA
tcgatttgttaaaaacgaatgtcggccgg

SEQ ID NO: 75778 - DNA, 30 bp, Homo sapiens; identical to SEQ ID NO: 34801
  misc_feature 1..30: note = chr13:24007814-24007844
  misc_feature 1..30: note = hyper
  source 1..30: mol_type = genomic DNA

SEQ ID NO: 75779 - DNA, 641 bp, Homo sapiens
  misc_feature 1..641: note = chr13:24040375-24041016
  misc_feature 1..641: note = hyper
  source 1..641: mol_type = genomic DNA
cgggaacaccctgcacgtgagaggggccctgaaattcacgaggggctggggctttgcgtttattcctccagttccgcctgcagcaaccctgacgatcgagcagggcccgcgggggagcgagcggaagcgggcagcgtgcgctgctgtcccgctacccagcccgctaggctgcgcagctgcgtctgcgggcggggagccggggcggccgtgggcttcctccgggcgcgggctgacggctgccgcctgtgggcgccccagccctgcagccgagcgggaggggcggaccagcgggtgtcgggagcaggctgcagcggccaggcctctgcggcttctcggagtactgggtccactggagagcgaagagccgcggccgccaggattcccagcagcggccgcgtgttgagagcctagaagtggccccgaagccgtgcctttcccgatagccaagcagaagtaggacttgaagcaccgaggctgggatgcccatgctggtgacgccttggggctcgcagttatacttggtgaccggtctacacggcgattcggtgctttccggagtagcagattcatctatctttagacccaccttcgtccttcggcggtttagcacggcctgcgctttcctgcgagccctgctgtca

SEQ ID NO: 75780 - DNA, 154 bp, Homo sapiens
  misc_feature 1..154: note = chr13:24153182-24153336
  misc_feature 1..154: note = hyper
  source 1..154: mol_type = genomic DNA
tggggaacaccccggcggaaaggaaccctccctctctgctctgaaggaaagtttcccaacacagccatgttcttggtggtctccggtcccccatccccaagcccccagtcagcctcacactcatccgcttcagtagccgcggagtgggggcctc

SEQ ID NO: 75781 - DNA, 213 bp, Homo sapiens
  misc_feature 1..213: note = chr13:24153538-24153751
  misc_feature 1..213: note = hyper
  source 1..213: mol_type = genomic DNA
ggtgcacggtgtgcacgctggactggacccccatgcaaccccgcgccctgcgccttaaccaggactgctccgcgcgcccctgagcctcgggctccggcccggacctgcagcctcccaggtggctgggaaggtaggtgcgtcgctgtccccggcgcgcggcgtcccgcgaggtcttcagccctcgccctggtggatccccgctgggtgggagcc

SEQ ID NO: 75782 - DNA, 70 bp, Homo sapiens; identical to SEQ ID NO: 34805
  misc_feature 1..70: note = chr13:24154053-24154123
  misc_feature 1..70: note = hyper
  source 1..70: mol_type = genomic DNA

SEQ ID NO: 75783 - DNA, 30 bp, Homo sapiens
  misc_feature 1..30: note = chr13:24155137-24155167
  misc_feature 1..30: note = hypo
  source 1..30: mol_type = genomic DNA
atttgtttctttggccggagtgtgtcttgc

SEQ ID NO: 75784 - DNA, 70 bp, Homo sapiens
  misc_feature 1..70: note = chr13:24289608-24289678
  misc_feature 1..70: note = hypo
  source 1..70: mol_type = genomic DNA
gtttggggtgctatccgggtttgcattgcaggcggtggggccagctgcggtatggcggtggcggggggtg

SEQ ID NO: 75785 - DNA, 590 bp, Homo sapiens
  misc_feature 1..590: note = chr13:24477427-24478017
  misc_feature 1..590: note = hyper
  source 1..590: mol_type = genomic DNA
ggtttccccagatgccgcggtgcaccgagcaggagcagaggccacgcgggagccgggtgtgcgggtgggtaccggccgcgcccctgctcggaggcggcgactccctcccccgccttactcacaccgtgcctcagtttccccgtcagtgcagcggacaagacaatgccgaggtcccaggcgggcggcaggatccaattagtccgtgtaaaatgagaggcatctggcttctcccgggcaccccgcagcctgccccgcctcttagtggctaaaggcagggagcccctgagtcccagcgcggctgggggctctcagcagttctggccgagctccctcccgcccgcgtcgcctggcctcgaaccgctgcaccgcgggcggccccgacgggttcccgacctcccgctggggacacctgtcccgccgcccggcccttccccgcctcccgcgcctccgccccaggggagctccgggacaggcccacctaggcagcctgccggcgcagacccagcgagggaaggccagtctcgggcctccaaccggacacgcgctccccattccgggctctcccacgtctgcacactccagcccagcca

SEQ ID NO: 75786 - DNA, 35 bp, Homo sapiens
  misc_feature 1..35: note = chr13:24553829-24553864
  misc_feature 1..35: note = hyper
  source 1..35: mol_type = genomic DNA
ctgagttctgctgggcggggagccagagactgatt

SEQ ID NO: 75787 - DNA, 189 bp, Homo sapiens
  misc_feature 1..189: note = chr13:24553924-24554113
  misc_feature 1..189: note = hyper
  source 1..189: mol_type = genomic DNA
cgcagggcatgggggcggcgcgcacccgggacagtttccagtcggcttctccgtgaccttcctcccccttccagctcggagcgggatgctgggatccctccaaggaccctctgaggacgtaggagggatgctgagacaggcaagtgggatttctctacatattgtcacctcgcccgcacttttggagaa

SEQ ID NO: 75788 - DNA, 53 bp, Homo sapiens
  misc_feature 1..53: note = chr13:24554519-24554572
  misc_feature 1..53: note = hyper
  source 1..53: mol_type = genomic DNA
tgctcagcgtcactgcgtgagcccccactctgatgcttcgttggtgtgtgtgt

SEQ ID NO: 75789 - DNA, 68 bp, Homo sapiens
  misc_feature 1..68: note = chr13:24931992-24932060
  misc_feature 1..68: note = hypo
  source 1..68: mol_type = genomic DNA
gccaggcaggtcctccgacagtgccacagccccaggcttgtgcagctaaatcacggaggccttccagg

SEQ ID NO: 75790 - DNA, 15 bp, Homo sapiens
  misc_feature 1..15: note = chr13:25115633-25115648
  misc_feature 1..15: note = hyper
  source 1..15: mol_type = genomic DNA
gtccagtctgtttcc

SEQ ID NO: 75791 - DNA, 78 bp, Homo sapiens
  misc_feature 1..78: note = chr13:25115693-25115771
  misc_feature 1..78: note = hyper
  source 1..78: mol_type = genomic DNA
cgggctgtgtggggaccgctttcccccaggcccgtcgtcagtgtcctgagctccgccgactcccgcccattggcgtcg

SEQ ID NO: 75792 - DNA, 250 bp, Homo sapiens
  misc_feature 1..250: note = chr13:25254947-25255197
  misc_feature 1..250: note = hyper
  source 1..250: mol_type = genomic DNA
accggagcaggctgacgggaagcgaggaaaaggcgaagaggagaaacgccccgtcccggggcaaggggaggccgcctttcctctgagcgccccccggcctgggcaccgcttctctgactccccgccacggctccgtgcggccgccggggctggctggggaaagaagccagtccagaggagcgagaaggggccaaggggtcctaggccagctccatggcacctgcgggctccgactcggaggatggggtga

SEQ ID NO: 75793 - DNA, 81 bp, Homo sapiens
  misc_feature 1..81: note = chr13:25319824-25319905
  misc_feature 1..81: note = hyper
  source 1..81: mol_type = genomic DNA
tggcgaccagaacaacgagggcgacgaagacaggactgaggaacatgcgcccctgccgccctcacccggaaccagggctcc

SEQ ID NO: 75794 - skipped

SEQ ID NO: 75795 - DNA, 153 bp, Homo sapiens; identical to SEQ ID NO: 34810
  misc_feature 1..153: note = chr13:25320387-25320540
  misc_feature 1..153: note = hyper
  source 1..153: mol_type = genomic DNA

SEQ ID NO: 75796 - DNA, 416 bp, Homo sapiens; identical to SEQ ID NO: 34811
  misc_feature 1..416: note = chr13:25320613-25321029
  misc_feature 1..416: note = hyper
  source 1..416: mol_type = genomic DNA

SEQ ID NO: 75797 - DNA, 1082 bp, Homo sapiens; identical to SEQ ID NO: 34812
  misc_feature 1..1082: note = chr13:25321112-25322194
  misc_feature 1..1082: note = hyper
  source 1..1082: mol_type = genomic DNA

SEQ ID NO: 75798 - DNA, 43 bp, Homo sapiens
  misc_feature 1..43: note = chr13:25561078-25561121
  misc_feature 1..43: note = hypo
  source 1..43: mol_type = genomic DNA
tgtgggaaccatgcccgtgaccggtcctcggggatgctgctgc

SEQ ID NO: 75799 - DNA, 323 bp, Homo sapiens
  misc_feature 1..323: note = chr13:25592243-25592566
  misc_feature 1..323: note = hyper
  source 1..323: mol_type = genomic DNA
cccgcccaacaggcccgaggcagagaaaccgccttagcagctctcgcggcgcccagtacaggcggcggttgctgcgcaggtgccgcgggctggcagggctccctggagccgcaaggcgcgccctgccccagggcctgtttgactgtggcccgcgccctcttctcctcttccaacggctcccgatgctcagagacccccgcgctgggccctctgcagcccagggatggggttgagtggtgcttctccacctggtgccgccgctgggcccacagcccgacttcgccactgcgtcgcccccggggtccgcgctgatgggcgcgagg

SEQ ID NO: 75800 - DNA, 32 bp, Homo sapiens
  misc_feature 1..32: note = chr13:25592593-25592625
  misc_feature 1..32: note = hyper
  source 1..32: mol_type = genomic DNA
cgctgcagtcagcccaccgcttgcaggtggca

SEQ ID NO: 75801 - DNA, 180 bp, Homo sapiens
  misc_feature 1..180: note = chr13:25592860-25593040
  misc_feature 1..180: note = hyper
  source 1..180: mol_type = genomic DNA
tccatgtgctggtggcggctgcagctgcagcgcccatgggctgatgtggcttaccggagctgcggccggccacgcccaagggcctcacaggctgcgctgcccttgccagctgctcctgacccgcgcccagagagcaggacctggcgcttggcactgtgcagccacggggatgaggctgag

SEQ ID NO: 75802 - DNA, 60 bp, Homo sapiens
  misc_feature 1..60: note = chr13:25593061-25593121
  misc_feature 1..60: note = hyper
  source 1..60: mol_type = genomic DNA
cgccactggggccacagcctgacttcacctccccgtcgcccaagtcgtgtgatgggcaca

SEQ ID NO: 75803 - DNA, 30 bp, Homo sapiens
  misc_feature 1..30: note = chr13:25607882-25607912
  misc_feature 1..30: note = hypo
  source 1..30: mol_type = genomic DNA
gtctgtccccactaccgcctaacttcctag

SEQ ID NO: 75804 - DNA, 55 bp, Homo sapiens; identical to SEQ ID NO: 34815
  misc_feature 1..55: note = chr13:25620899-25620954
  misc_feature 1..55: note = hyper
  source 1..55: mol_type = genomic DNA

SEQ ID NO: 75805 - DNA, 251 bp, Homo sapiens
  misc_feature 1..251: note = chr13:25620955-25621206
  misc_feature 1..251: note = hyper
  source 1..251: mol_type = genomic DNA
aggagccctggagactcagggcccgtctggtgcggcccgggctttgctccgcgctcgccccctgcagctgccggggccgccgcaacttttcaaacctcaccgcaccgacagctctgtcccttcttttatctggagacgctgagcctcatcaactctcacctgcgtttcaggaaaaataataataataataaatgttccacggacacaggatttcggccaaatgctgcttagctctaccttccccaaaaggg

SEQ ID NO: 75806 - DNA, 387 bp, Homo sapiens
  misc_feature 1..387: note = chr13:25621263-25621650
  misc_feature 1..387: note = hyper
  source 1..387: mol_type = genomic DNA
cgtccgcaggaggccttgcggggatccgagcatcccgctccgagatggaagtggtaggacagtccgggagaagccgacgggaaactgtcctgggcgcgcaccgcccccgtgccctgcgccctcctcatttgctcggccagcgcgggacctcccagccgctgggcccgcgaccgcggcgaatcagtctccgcttccccgcccagcagagctcagatctgctctggagggctctcgggatgtcgcctttccctggagatgagcagttctgcgtcaccctccgtggccagcgcggcttccagggctgggctggtctattgtttgctgttcttgaaaggacgtggggagggtgggagggtgggagggtgggagggccggggctgagccggg

SEQ ID NO: 75807 - DNA, 24 bp, Homo sapiens
  misc_feature 1..24: note = chr13:25642802-25642826
  misc_feature 1..24: note = hypo
  source 1..24: mol_type = genomic DNA
acatgcatgcatgcacgtggacac

SEQ ID NO: 75808 - DNA, 27 bp, Homo sapiens
  misc_feature 1..27: note = chr13:25668696-25668723
  misc_feature 1..27: note = hypo
  source 1..27: mol_type = genomic DNA
ctactctaggctaggcgcggcggctca

SEQ ID NO: 75809 - DNA, 38 bp, Homo sapiens
  misc_feature 1..38: note = chr13:25669254-25669292
  misc_feature 1..38: note = hypo
  source 1..38: mol_type = genomic DNA
tacatatttattggtcgggcacggtggcttacgcctgt

SEQ ID NO: 75810 - DNA, 71 bp, Homo sapiens; identical to SEQ ID NO: 15753
  misc_feature 1..71: note = chr13:25670585-25670656
  misc_feature 1..71: note = hypo
  source 1..71: mol_type = genomic DNA

SEQ ID NO: 75811 - DNA, 98 bp, Homo sapiens; identical to SEQ ID NO: 34818
  misc_feature 1..98: note = chr13:25744637-25744735
  misc_feature 1..98: note = hyper
  source 1..98: mol_type = genomic DNA

SEQ ID NO: 75812 - DNA, 295 bp, Homo sapiens; identical to SEQ ID NO: 1089
  misc_feature 1..295: note = chr13:25745300-25745595
  misc_feature 1..295: note = hyper
  source 1..295: mol_type = genomic DNA

SEQ ID NO: 75813 - DNA, 244 bp, Homo sapiens
  misc_feature 1..244: note = chr13:25745726-25745970
  misc_feature 1..244: note = hyper
  source 1..244: mol_type = genomic DNA
cgccgccgccgcggctccggctcgtctccatggaaaccgcgcgggataagccgctttcgtcagcagtgggctcgcgccaggccactgtcacccgtattctaaatcaacctgagccgcgctcgccgccgccgctgcaaaagaaacacacataaaagaccatcttccctcccgcaagggcttatataataccctaacccacttccatccgacttggctcggcgctgcatggcgtttttgtggcagg

SEQ ID NO: 75814 - DNA, 67 bp, Homo sapiens
  misc_feature 1..67: note = chr13:25862385-25862452
  misc_feature 1..67: note = hypo
  source 1..67: mol_type = genomic DNA
gtgggggggtggcggcggggggcaactggtgggtggaggccaagtcacaagtcggctgctgaacacc

SEQ ID NO: 75815 - DNA, 122 bp, Homo sapiens
  misc_feature 1..122: note = chr13:25945896-25946018
  misc_feature 1..122: note = hyper
  source 1..122: mol_type = genomic DNA
gacaggcagagactccgagtcccccaggtgcacccctctcctggaagagcccccgaaagtacaggcccaatctcccaccccaccaagccctccccatcgccttccccgacacctaaaagccc

SEQ ID NO: 75816 - DNA, 374 bp, Homo sapiens
  misc_feature 1..374: note = chr13:25946300-25946674
  misc_feature 1..374: note = hyper
  source 1..374: mol_type = genomic DNA
cgtagcctccgtctctcgcccggggccgccgagcccccgacacgggcgagatgctgaacggcgcaggcctggacaaagctcttaagatgtccctgccgcggaggtcgaggatccgctcgtccgtgggtgagctgggaggggcgcggcgagggagggtgggcccggggcgggggcggcgcggggcgcgcctgcggttatgcgacactgccccgcccgcgccccgctcccctccctgggctccctgggctctctgggctgcaggatccgccgacgcggcgcgctggccgcacgggggctgggcgtcgctgcacctgcggggccaaaaggctccaggccggggcgaggtgagcggcgggcgtcagagacccccggct

SEQ ID NO: 75817 - DNA, 57 bp, Homo sapiens
  misc_feature 1..57: note = chr13:25946801-25946858
  misc_feature 1..57: note = hyper
  source 1..57: mol_type = genomic DNA
cggcgcagagaagatgcagccttccctgccggcggccggcaccgctgtgctgcagag

SEQ ID NO: 75818 - DNA, 78 bp, Homo sapiens
  misc_feature 1..78: note = chr13:26041957-26042035
  misc_feature 1..78: note = hypo
  source 1..78: mol_type = genomic DNA
ggattacaggcttgagccaccatgcccggccaagatgtcagttttttaatggtgtgcaacgtccgtttctttgatagt

SEQ ID NO: 75819 - DNA, 108 bp, Homo sapiens
  misc_feature 1..108: note = chr13:26042600-26042708
  misc_feature 1..108: note = hyper
  source 1..108: mol_type = genomic DNA
tggctgcttgcagggcgcattcccattgctgctgtctctgttcctaaggaagatcaaaggatcccagaaaacccagttccagagctcagttcccgggactagagggta

SEQ ID NO: 75820 - DNA, 403 bp, Homo sapiens; identical to SEQ ID NO: 3985
  misc_feature 1..403: note = chr13:26042768-26043171
  misc_feature 1..403: note = hyper
  source 1..403: mol_type = genomic DNA

SEQ ID NO: 75821 - DNA, 159 bp, Homo sapiens; identical to SEQ ID NO: 3986
  misc_feature 1..159: note = chr13:26043340-26043499
  misc_feature 1..159: note = hyper
  source 1..159: mol_type = genomic DNA

SEQ ID NO: 75822 - DNA, 30 bp, Homo sapiens
  misc_feature 1..30: note = chr13:26157703-26157733
  misc_feature 1..30: note = hypo
  source 1..30: mol_type = genomic DNA
ctcatccacaccgcccggcccctgggagca

SEQ ID NO: 75823 - DNA, 30 bp, Homo sapiens
  misc_feature 1..30: note = chr13:26317471-26317501
  misc_feature 1..30: note = hypo
  source 1..30: mol_type = genomic DNA
cttgatctacacctccggctttcagagctg

SEQ ID NO: 75824 - DNA, 30 bp, Homo sapiens
  misc_feature 1..30: note = chr13:26323546-26323576
  misc_feature 1..30: note = hypo
  source 1..30: mol_type = genomic DNA
agagctgaagttagccgaggggagtccaga

SEQ ID NO: 75825 - DNA, 89 bp, Homo sapiens
  misc_feature 1..89: note = chr13:26355034-26355123
  misc_feature 1..89: note = hypo
  source 1..89: mol_type = genomic DNA
agcaccagtccagtccgtggcccaggggttggggatccctgtactacaggatatgagaaaaggccttactggcagtttgttttctgtgt

SEQ ID NO: 75826 - DNA, 322 bp, Homo sapiens
  misc_feature 1..322: note = chr13:26624595-26624917
  misc_feature 1..322: note = hyper
  source 1..322: mol_type = genomic DNA
ggagaaactgaggcccgtgagggtgaattagggacccacaccgaccaaataataagccagaaggcagactccgcctcctggtcctaggccctttcctgaatttccccccttcaaactcccaggtccctgacgtccaggcaacgccaaccgtcctccctttcgcgctgggcgcaggccgccctacctgccgagccgtcggggccgtctttgtccgcccggccaggctcgccagcgccctgctggcggtcattgtcgcagccgccctggtccaggcgcgcctcggcgctggagcagcagtagcgcaacgcgcagctgccgcagc

SEQ ID NO: 75827 - DNA, 391 bp, Homo sapiens; identical to SEQ ID NO: 34828
  misc_feature 1..391: note = chr13:26625266-26625657
  misc_feature 1..391: note = hyper
  source 1..391: mol_type = genomic DNA

SEQ ID NO: 75828 - DNA, 150 bp, Homo sapiens
  misc_feature 1..150: note = chr13:26626239-26626389
  misc_feature 1..150: note = hyper
  source 1..150: mol_type = genomic DNA
gacctcagggacgcccgcgggcgccgggcagcccctcactttcctaccccgggcaaggagaaaggtgtggccaagggcggggtctgcctgctggaataggcgcgggaggaaacccaacctaagcaatccaggcctcgctaacacaaataa

SEQ ID NO: 75829 - DNA, 30 bp, Homo sapiens
  misc_feature 1..30: note = chr13:26693061-26693091
  misc_feature 1..30: note = hypo
  source 1..30: mol_type = genomic DNA
ttgtgcagggtagctcgacaggcctgcagg

SEQ ID NO: 75830 - DNA, 86 bp, Homo sapiens; identical to SEQ ID NO: 34830
  misc_feature 1..86: note = chr13:27050496-27050582
  misc_feature 1..86: note = hyper
  source 1..86: mol_type = genomic DNA

SEQ ID NO: 75831 - DNA, 276 bp, Homo sapiens; identical to SEQ ID NO: 34831
  misc_feature 1..276: note = chr13:27131553-27131829
  misc_feature 1..276: note = hyper
  source 1..276: mol_type = genomic DNA

SEQ ID NO: 75832 - DNA, 451 bp, Homo sapiens; identical to SEQ ID NO: 34832
  misc_feature 1..451: note = chr13:27131859-27132310
  misc_feature 1..451: note = hyper
  source 1..451: mol_type = genomic DNA

SEQ ID NO: 75833 - DNA, 158 bp, Homo sapiens; identical to SEQ ID NO: 34833
  misc_feature 1..158: note = chr13:27132629-27132787
  misc_feature 1..158: note = hyper
  source 1..158: mol_type = genomic DNA

SEQ ID NO: 75834 - DNA, 18 bp, Homo sapiens
  misc_feature 1..18: note = chr13:27144128-27144146
  misc_feature 1..18: note = hypo
  source 1..18: mol_type = genomic DNA
tataccttgatcagccgg

SEQ ID NO: 75835 - DNA, 30 bp, Homo sapiens; identical to SEQ ID NO: 43763
  misc_feature 1..30: note = chr13:27278150-27278180
  misc_feature 1..30: note = hypo
  source 1..30: mol_type = genomic DNA

SEQ ID NO: 75836 - DNA, 32 bp, Homo sapiens
  misc_feature 1..32: note = chr13:27319461-27319493
  misc_feature 1..32: note = hypo
  source 1..32: mol_type = genomic DNA
caagcagtgcacagacgcggaatcccagccta

SEQ ID NO: 75837 - DNA, 512 bp, Homo sapiens
  misc_feature 1..512: note = chr13:27334211-27334723
  misc_feature 1..512: note = hyper
  source 1..512: mol_type = genomic DNA
acttcaaaacaccagcgtgagcgaggcaggcacacacggactcgcggcggtctgtttgcaacagcgctgggaatgcacattggaaaatcacatcttgcatgctgaaaacgaacaactgtttgacatctgggctgctgccgagaaaaccacgcggcagcggcaggtctcgagccaggggccgccatcctcgatggaatatttaaatcgcctatttccatcgaactcccaccctccaaacgcatcccccgcgcgcgtgcacatcctcaaacgcacccccgaccggaacaaagaggggctccagactccccccgtgcgcacggggcagtcgggagggccacgagagggaggtgtgtgcaatggaagtaccgagacagacagacagacagatgcccatgcactgctgccgattccctggcggcggggacgggagtcggacgcgagggggacagacagggtgcggggacaggcggcccgcgggggcgggggggtcatcgagggggtcaccttggctc

SEQ ID NO: 75838 - DNA, 256 bp, Homo sapiens; identical to SEQ ID NO: 34835
  misc_feature 1..256: note = chr13:27334724-27334980
  misc_feature 1..256: note = hyper
  source 1..256: mol_type = genomic DNA

SEQ ID NO: 75839 - DNA, 30 bp, Homo sapiens
  misc_feature 1..30: note = chr13:27390853-27390883
  misc_feature 1..30: note = hypo
  source 1..30: mol_type = genomic DNA
actaattacatataacgaccctactttcaa

SEQ ID NO: 75840 - DNA, 38 bp, Homo sapiens
  misc_feature 1..38: note = chr13:27553623-27553661
  misc_feature 1..38: note = hypo
  source 1..38: mol_type = genomic DNA
ctgttggctatgggccgggtcaacgtccacactgatca

SEQ ID NO: 75841 - DNA, 208 bp, Homo sapiens
  misc_feature 1..208: note = chr13:27610050-27610258
  misc_feature 1..208: note = hypo
  source 1..208: mol_type = genomic DNA
agaaggtgggacattcgttggctaagtagaaagctgagcagatctcagctctctctctgttgagtgcccaagcacacatagaactacacacgtggtatctcagcagtaaggcctgacagcaaggcaaggggggacaggcgggaggtgagtcatgatcctgcgtgtgcgttggtgctcattctgacccgcgcaccgagatggaagctgt

SEQ ID NO: 75842 - DNA, 30 bp, Homo sapiens
  misc_feature 1..30: note = chr13:27811290-27811320
  misc_feature 1..30: note = hypo
  source 1..30: mol_type = genomic DNA
tctattgccatatgccgtttggctgaagta

SEQ ID NO: 75843 - DNA, 67 bp, Homo sapiens
  misc_feature 1..67: note = chr13:27845541-27845608
  misc_feature 1..67: note = hyper
  source 1..67: mol_type = genomic DNA
tccccccagtttgtccgaggtgcctgggtttgacaggcttgttctactccttcggttgattttccta

SEQ ID NO: 75844 - DNA, 108 bp, Homo sapiens; identical to SEQ ID NO: 43764
  misc_feature 1..108: note = chr13:28239991-28240099
  misc_feature 1..108: note = hypo
  source 1..108: mol_type = genomic DNA

SEQ ID NO: 75845 - DNA, 422 bp, Homo sapiens
  misc_feature 1..422: note = chr13:28363673-28364095
  misc_feature 1..422: note = hyper
  source 1..422: mol_type = genomic DNA
gaaagaaggaaagcccgggacaacagaaattctttcaatgttgaactgtccctgatggacacttgaaaaccggctccggcagcagagccgacccgccaggcccaggggctcccgggcccctcctggggctgtcaggctaatccggcagccgcctcccaccccgccccgctctgggggacttttgctcgggtgactaaagttcaaactcggctaaagcaagccctgggaggcgctttaaacaggaaagtggcgcggccgcccgagagagcccgggtagcggcccccggaaaccaggcggcgggcagaggccgcggggtggggaggccgggttggctgggtggggaggccgggttggcggggcggcccggacctcccggctgcccgcgctagcacctgcccaaggctcgggtctctcagaggca

SEQ ID NO: 75846 - DNA, 132 bp, Homo sapiens
  misc_feature 1..132: note = chr13:28364150-28364282
  misc_feature 1..132: note = hyper
  source 1..132: mol_type = genomic DNA
cgccaagcagggagccccctctccggccgcggcccgccgggctgagagaccacagattaagtgcgccttggttctctcagggatgctattttgctccggcccgggtctctcccgcgccgagttgcacaacaa

SEQ ID NO: 75847 - DNA, 52 bp, Homo sapiens
  misc_feature 1..52: note = chr13:28364644-28364696
  misc_feature 1..52: note = hyper
  source 1..52: mol_type = genomic DNA
agctttggccttgctcgcattcaggggctcttaaccccttcctccccgggca

SEQ ID NO: 75848 - DNA, 272 bp, Homo sapiens
  misc_feature 1..272: note = chr13:28364723-28364995
  misc_feature 1..272: note = hyper
  source 1..272: mol_type = genomic DNA
cgctggccactcgcgggctcccagctccgggtgcagtgcccgccccttgcacccctgggccccgcccgcccttgcgcccctccagcctgcctctgcccagcggaaagcccctctccccgcccgggtctcgctcttcgcttcctctcagcgacccagcccagctcaaatttcccagagagcaattagaacgggaattaggctgcattgatgcgttccggctggtttgcaggcaccaccctagagtgggggagccttggcgctgagactctgtc

SEQ ID NO: 75849 - DNA, 609 bp, Homo sapiens
  misc_feature 1..609: note = chr13:28365486-28366095
  misc_feature 1..609: note = hyper
  source 1..609: mol_type = genomic DNA
gtacacagctctgagcgtttgaagttgtttaaccattgtgtgaccagaaagaagagtgacgcggcaggaagaagaagccgggtcttggggagagcggaggcgggtcagggtgggcaaaggcagccgatgccaggaatacaaccgcccttcgcgccgttccaaactaagagatggcagcggtttcccagcgcactgctggaagtgtgctccagtagacagggtgtgggcaagatgcgcgggcagacagtccgcactcgccacatgtgctggggtgcgagatctagatctgcgccatctcggctttcattccccattccctgtctctgttcgtaacgctcagagactgtttttcctcttttacatccacggccctgtcatttgaaggaaagggctggttggccagcatctaccgaacaaagactgggcgtcgtaggcagcaccaaaattaagactatttgagaaacttagagaaaaccgagggacagcgatgggtctagggctggataaggaataatgagcccttctcctccctccccacagacgcctccttcacgcgggaacccggtcctccttcttccgacgcagagagagaagcgattccacaggtgg

SEQ ID NO: 75850 - DNA, 209 bp, Homo sapiens
  misc_feature 1..209: note = chr13:28366393-28366602
  misc_feature 1..209: note = hyper
  source 1..209: mol_type = genomic DNA
agggagaggagggggcgagggcgcctgttacggcgtgggtggggttgacaagaatagagtacattatgcagttcatttagttaacaagtgaaataatgaggaagcgtgcagagtgaatgccaagagaaaaggcacaaaaaccctattgagaggccccggccgctcctggcgtagtccatcacatggcaatagtcctatttaagccgcgc

SEQ ID NO: 75851 - DNA, 375 bp, Homo sapiens; identical to SEQ ID NO: 34841
  misc_feature 1..375: note = chr13:28366664-28367039
  misc_feature 1..375: note = hyper
  source 1..375: mol_type = genomic DNA

SEQ ID NO: 75852 - DNA, 693 bp, Homo sapiens
  misc_feature 1..693: note = chr13:28367253-28367946
  misc_feature 1..693: note = hyper
  source 1..693: mol_type = genomic DNA
cgcgcagagggaccgggcagaggtgatccgaagcaggatggagagccagagatggaggaagagggaccctgggctttctgggggcggtgagggtcatgtcggggactaaggggggcgcttggggtggagtgaggatagagggccgggacacaacgccaggaggcggatgagggcagacgtccaggtcctggagtgtgggccggggtaagtgagggctgggatccaaggctctccatgaaggggaaggggttccagggctgcatgactccgggagaatcaggatctcggagctggacaaggagcgctcactgtagctctgctgtggattgtgttggggcgaagagatgggtaagaggtcaaagtcgtaggattctggcgaccgcctaccaagggattgggtccacagcacagaggtctgatcgcttccttctctgctctgccacctccagacagcagctctaaccagctgcccagcagcaagaggatgcgcacggctttcaccagcacgcagctgctagagctggagcgcgagttcgcttctaatatgtacctgtcccgcctacgtcgcatcgagatcgcgacctacctgaatctgtccgagaagcaggtgaagatctggtttcagaaccgccgagtgaagcacaagaaggagggcaagggcagcaaccatcgtggcggcggcggcgggggtgc

SEQ ID NO: 75853 - DNA, 918 bp, Homo sapiens
  misc_feature 1..918: note = chr13:28368153-28369071
  misc_feature 1..918: note = hyper
  source 1..918: mol_type = genomic DNA
cgctgattcccaggcacccgcagccaaaccactgcctggcatggatttggcactgctttgcagaggtcccgggcctgggcagggctgagagcttggcagagactggaccatggcgtccccgccccagggctcgctcgtgtccaaagccaactccaagctgtgaacactgtaagcgctcgagtcctcctgggcagtgcagcaccgcggcccccgcccgcaagcctgcttggcgcagcgccttgctggcagccggcgcctcctagcccgccctctctgggctggcttgggcttcctcgcttactctactctcctccgctctcggtcaaggtcggcggccttggatgctcgttcgcttctctttttaaaatgtctttttgtccctccccacctctttcctgtgatcatttattcactcggcccccgcccgccaacacacacatttatgaacccccactttttttttccttctccttttcccttcccctcctcagggagcctcctccttcagtcagtccatttgtcccttgatctggccttgctgtcctcagtccccacggctcctctcacagatgataaatttcgcccgtagtatccatattggggaaacagatttgctctgtttccaacacgctcttccttcctctaaacataggaccccgctctgcgccgctggcgaccccactcttccccctccagactctggcccgccccagcctagctgtgtaattgtacggcctctgcaatgccagaagatatttatttatttatttatgtacaaaattttaaataaacttttttttttcttagaaatgcccgtggctctgagcccagaggccttcgctctggagtagacaggcgccaacccggattgggcctcccttctgggaagggttggggatccagttgcagggtccgagc

SEQ ID NO: 75854 - DNA, 906 bp, Homo sapiens; identical to SEQ ID NO: 34846
  misc_feature 1..906: note = chr13:28369161-28370067
  misc_feature 1..906: note = hyper
  source 1..906: mol_type = genomic DNA

SEQ ID NO: 75855 - DNA, 15 bp, Homo sapiens
  misc_feature 1..15: note = chr13:28370409-28370424
  misc_feature 1..15: note = hyper
  source 1..15: mol_type = genomic DNA
tagtcccagtctaac

SEQ ID NO: 75856 - DNA, 959 bp, Homo sapiens
  misc_feature 1..959: note = chr13:28370502-28371461
  misc_feature 1..959: note = hyper
  source 1..959: mol_type = genomic DNA
cgaagacccagactacaaggccccggaaccaggagcttgtggggcttagttctaaaatcttccatcttttccttcaaatcaagctgaggatgggggtgggagggtctctctccagttcccctggaacaagggcaggcacgatctagctccccatggagaaactcttgccggttcttcctggagctaggcatctgagttgtgctctagactgatgaggatctccatcagtctgaacctcactttagacggggaccaattctccaccatcccaggaggcgacattgtgccaatctacggccaatctgaacgaagccaaggtgctttagtgcataccagtgaatagaatcacaactgttttactatcagtgatgaggctgatgcttgctgagttttgctcgtttgcatgttgctctagggccccagggtgagtgcagttgtgcactcttagctccagcaggaccggcccagcctccgtttggctgggatttgggggcgggcggcagcacgattttctggcaacgagttcgttgtgggtctgaaggaccggcttagaactagcacctctcctggattacaggagggggtggtcttgtgcacctgggaaaggccttcgccagcactcagtgtcaggcatcttgatcagaaatgcactttcgagcctgccagggaaccaagtttggaggggatggaaacggcggtgggagacatagaaaggatgaacacacacacccggctctccccgcactcgcctcttctccagctccccctcctctcccgcctaggagtccctcctgttcccagcttctccccagagtccgcagatccacagctgtgagccaggtccgcgtggggccagttttcccaggagtgcacgtttcctcctctcggcttcccagggattcatttccggaagaccaagctttcagctttctagtctgccttagcgagcagcgggagga

SEQ ID NO: 75857 - DNA, 305 bp, Homo sapiens
  misc_feature 1..305: note = chr13:28394662-28394967
  misc_feature 1..305: note = hyper
  source 1..305: mol_type = genomic DNA
agttgtgttggaacccgtggagagaaggaactgtccgtttccaaactctgcttcggcccctctcccctcccacccacggccccaggcagagagggccggaaaggcagcccattcctgcccgcgcattcgggcgcacaagcgcattgcgcatgtactgtggagggggcaccctggtctccacctggaatgcgcttctagccaagtaattgcgtcgcctttgcgcgcagctggcctggggaacctgggcccatcagagccagttactcttggtccccgctttactggagggtcgcaggagactttcg

SEQ ID NO: 75858 - DNA, 481 bp, Homo sapiens
  misc_feature 1..481: note = chr13:28395176-28395657
  misc_feature 1..481: note = hyper
  source 1..481: mol_type = genomic DNA
cgcctccctctcccacgagagaactggctgagagaaaacaaacctcagaacaaaaacccagtcaccccatgggccttttgttttcagtcaaatgcgcaaagccaggtggctcctttaacacccccagagattgtccccatgatctcctctgcgccatggggcgctgggtgctgggggcgccgtctgtatcctctgcctggtaactgcccccatcgcgccccactgcgccccagcccaggctggaaaactgggccaacagggaggcttggatggggggaaacccagcctgaggctggaaacggctagaagtgaacgggacgagtggctttgcaaaagcagccgctgcgattctctagcgccagcgcccctgcttccaggaactttacgcaagataggcgagaggggtggccgcactaaaagaaaaagaaaaattaaaaaaaaagacattccaactactttatccttgcgcagggaccccttc

SEQ ID NO: 75859 - DNA, 75 bp, Homo sapiens; identical to SEQ ID NO: 34851
  misc_feature 1..75: note = chr13:28395998-28396073
  misc_feature 1..75: note = hyper
  source 1..75: mol_type = genomic DNA

SEQ ID NO: 75860 - DNA, 182 bp, Homo sapiens
  misc_feature 1..182: note = chr13:28396536-28396718
  misc_feature 1..182: note = hyper
  source 1..182: mol_type = genomic DNA
ggctacctccaagcccggagctcaaaatgctcaatttatttattcttaattttgtggcgatcattcatggaagcaaaaaaggctacagtgtcctttttaagaaaagaaaagctaattcttgaagtgaccttggcagtctggtgcgtgccccatccgaacagagagggcggcttgtgtcaaca

SEQ ID NO: 75861 - DNA, 292 bp, Homo sapiens; identical to SEQ ID NO: 34853
  misc_feature 1..292: note = chr13:28397177-28397469
  misc_feature 1..292: note = hyper
  source 1..292: mol_type = genomic DNA

SEQ ID NO: 75862 - DNA, 632 bp, Homo sapiens; identical to SEQ ID NO: 34854
  misc_feature 1..632: note = chr13:28491793-28492425
  misc_feature 1..632: note = hyper
  source 1..632: mol_type = genomic DNA

SEQ ID NO: 75863 - DNA, 127 bp, Homo sapiens; identical to SEQ ID NO: 3999
  misc_feature 1..127: note = chr13:28492426-28492553
  misc_feature 1..127: note = hyper
  source 1..127: mol_type = genomic DNA

SEQ ID NO: 75864 - DNA, 58 bp, Homo sapiens
  misc_feature 1..58: note = chr13:28494207-28494265
  misc_feature 1..58: note = hyper
  source 1..58: mol_type = genomic DNA
cccggctccagctcccgactcccggctcccggctcccggctcccggtgcccaatcccg

SEQ ID NO: 75865 - DNA, 825 bp, Homo sapiens
  misc_feature 1..825: note = chr13:28494773-28495598
  misc_feature 1..825: note = hyper
  source 1..825: mol_type = genomic DNA
cgccttggattatcccgggtcggactaaactacatcagggagctaccgagcccatccctcacagcagtgcttctctagtccagtttgaagcatctttcccacccagctctcctgggagtgtacactccttccttccctgttcgctgagcccatcttcgccccaggagcccgcgctcccagcgccatccttagagagccgaggctgagtcctgctcagggcttcggacactacagatcctcctccagcaggggatccgggaacccaggactccttggtagtgcacatcgaggaagccgagtagggacatgggtgcctcggacccaggccccagatcgccttcggagccccggagcccctcacttcccgcgcttcgttaaggaagggcaggcatctaggggcgccaggtaggtgcagaaaggcagggagggaaaggaaactgcacccaacccagcagtgtccggctgccctggttgtggaaacaggataggagtaaagaggaaggggctggggcaaggcgggggctcaccgcgaggctgaaagccggcctctcaacgtcagagcctggcagctaggagagcaatctgagaagcgaattcgtttttcaccaaccgaaagcaattgaagctgtctccccgcaccgcttcccaggaagtaatttttcaggagatgggcgctccctgcctagctggtggggaggcgagaggcctggttcctgcggccctccgcgccggcagagaacagaaggtctttcccggagccgggagccggaggcacggggtagcccccgggtcctttgcggccccgcgcgagcggcaagttccggc

SEQ ID NO: 75866 - DNA, 155 bp, Homo sapiens
  misc_feature 1..155: note = chr13:28495599-28495754
  misc_feature 1..155: note = hyper
  source 1..155: mol_type = genomic DNA
cggcctgtgtcgtcgccgctactcactgtcatcgctgccgtgcctcagccacttctggtcacacctgcaccgcaaatagttgccttttcctttcaactggcagccgggagtagggggaagcagctcgagccggcgtcccccggcccaccccgaaa

SEQ ID NO: 75867 - DNA, 30 bp, Homo sapiens; identical to SEQ ID NO: 34857
  misc_feature 1..30: note = chr13:28503435-28503465
  misc_feature 1..30: note = hyper
  source 1..30: mol_type = genomic DNA

SEQ ID NO: 75868 - DNA, 145 bp, Homo sapiens; identical to SEQ ID NO: 34858
  misc_feature 1..145: note = chr13:28527239-28527384
  misc_feature 1..145: note = hyper
  source 1..145: mol_type = genomic DNA

SEQ ID NO: 75869 - DNA, 1150 bp, Homo sapiens
  misc_feature 1..1150: note = chr13:28527845-28528995
  misc_feature 1..1150: note = hyper
  source 1..1150: mol_type = genomic DNA
tgtgaagagaaggagcgggggttttaagagccacagcgccaccgagagagtggaaaggagtagattagctcgcgcctgctatgcgaggcgactccccccgagacccacccgcagcccagcgcccttggccaggaggcccggaaagccaccgaggcggccgaaaggggccgcggggcacccctcagcccctcctgcggcggctccggctgcccctgctcagcctcccgctccccgcccggagtcccagctctcagatcggccgcagagctgggaacagaggccgcggggtccaggccgttccgcccgctcagccggagcagcagcgccgcctgccgggggcctcgcgcaggcgagacaggccagacgccggaggccgcgggcggctgcagctttgacgggccgaacacaccagcgctcccgttccgccttttgaaaatcaaatcccttgggcctggtgccaccatcgctcagcccaggtcttcgacgacgggtcgaaggccagtgctccaggccttcttcaccgagtggcttcggcgcttgcggcccaggttccccgcacctccgcgccgtagttgcgcgcaccttttgaaaagcttggcgtcttcaggtataaggacaaaaacaaccgcggacatcacaccattccaaagaagaaaaagaaagtgcccggaatctcagggcgcgacttccggggcgacgggcggcggcggagaggcgctccccgggcttcctacccggcaggaggccgcggcgccgggacctcgcctgccctcaccgcgcgccacctctcgggagacgccgcgaatctctccagggaatcccgggcagcggcgcagacccagcaaggaccggcagcaggccgagaccggccgtcttgggcgagagcagcgggacacgagcccccgggcgcccgctgggagcgcggggaggctctgggctcagggaagctgcgctccgagtggccttggaggacggtcaaggagcccgggccccgcggcggccgggagtggacgcgactggtccgcgccggccgcaggggaaggggcgggtcggcgctgcctgagctctatctgctctaatggctggggtagatccgcggagatacttgaataccaggccgaacgcttccccaaggcgtgttgtagacaac

SEQ ID NO: 75870 - DNA, 108 bp, Homo sapiens
  misc_feature 1..108: note = chr13:28534446-28534554
  misc_feature 1..108: note = hyper
  source 1..108: mol_type = genomic DNA
aaatcttgcagcgcccgggtttgggctcagccggagtcggcagaggcgcttgcacctcccaactgggtgaaaactggaacctttccgggttcacgagcccaagcccca

SEQ ID NO: 75871 - DNA, 10 bp, Homo sapiens
  misc_feature 1..10: note = chr13:28535260-28535270
  misc_feature 1..10: note = hyper
  source 1..10: mol_type = genomic DNA
cccgacccca

SEQ ID NO: 75872 - DNA, 268 bp, Homo sapiens
  misc_feature 1..268: note = chr13:28535305-28535573
  misc_feature 1..268: note = hyper
  source 1..268: mol_type = genomic DNA
cgcccgcgggccgggccaccggagcccctttcccaatcctggagctgtatacgccacccggaagggccgcggaattggagaggtgctgcagagggtctatacctcttgctgtttcccggctctgctcatcttccccaactgcccttaaggcgcctccgtgggcgcgctgattaggctctcggatgttggtgggaagatcgaaacgaagggctaagcccccctcgcccgggtcctgccggaaagttcagctcggcggcctccaggatca

SEQ ID NO: 75873 - DNA, 627 bp, Homo sapiens
  misc_feature 1..627: note = chr13:28540473-28541100
  misc_feature 1..627: note = hyper
  source 1..627: mol_type = genomic DNA
taacgcgactttctccgcggtggacgctcggacacgcgtgaccgcctcaaacccactccaggctgccattggtactcgcccctttttacagatgaggaaatggagaatcagaccgggtcacgcagatagtatcaggcggggttggcaccggagcctggctggagccacagaggacacctccggagctgaggcgcagggcagttccctcagccgaacaccccgggagggagactcgcctggaagtgtctcggagcgacccttgctcgggtgctgccccttcagtgtcccggacgtgccgggcaacgcgatgaccagaccctgagcgctcttcgacccatgccccaagggccttggaggcgccccacaccccctgggaacctaggagcggggctatggaggggagggatgagagggacttgtcagaattcattattgactgcgaaagtcaccaccctctttccgggccctaaaagagacaatggcagggctgggaaggtgtatatcaaagcaagccaggccgcgtccccccctccacccccacaccttgacagatgacgctccgcagaggagcccggctccggcccgcgggctgcggccaccccacattaacatcacaagggcacccgg

SEQ ID NO: 75874 - DNA, 104 bp, Homo sapiens
  misc_feature 1..104: note = chr13:28541179-28541283
  misc_feature 1..104: note = hyper
  source 1..104: mol_type = genomic DNA
cggcttccctcccgcccccttcccggccctcaccccgcggccgctctcccgggacacgcaaaggtcttccttagggcgtgcgccacccccgccaaccgcgcccc

SEQ ID NO: 75875 - DNA, 172 bp, Homo sapiens
  misc_feature 1..172: note = chr13:28541956-28542128
  misc_feature 1..172: note = hyper
  source 1..172: mol_type = genomic DNA
tcagaggttcagagacggggcgcgcccccgtcgccttagcagctggggctagcaccttcttcccagcgacagcagctctccctggtctgcctgctcgctgtaccttgaattggcccgagtggccaaacccggtcccacacacagcctagccatcctccgacccccccaggtc

SEQ ID NO: 75876 - DNA, 40 bp, Homo sapiens
  misc_feature 1..40: note = chr13:28542355-28542395
  misc_feature 1..40: note = hyper
  source 1..40: mol_type = genomic DNA
ctcttggaaagaggacgcctgaacacggtgttgagactca

SEQ ID NO: 75877 - DNA, 74 bp, Homo sapiens; identical to SEQ ID NO: 34865
  misc_feature 1..74: note = chr13:28542653-28542727
  misc_feature 1..74: note = hyper
  source 1..74: mol_type = genomic DNA

SEQ ID NO: 75878 - DNA, 708 bp, Homo sapiens; identical to SEQ ID NO: 34866
  misc_feature 1..708: note = chr13:28542728-28543436
  misc_feature 1..708: note = hyper
  source 1..708: mol_type = genomic DNA

SEQ ID NO: 75879 - DNA, 416 bp, Homo sapiens
  misc_feature 1..416: note = chr13:28544169-28544585
  misc_feature 1..416: note = hyper
  source 1..416: mol_type = genomic DNA
gctagtggttattggcgtgcataactggaggcgagctaggggatcgttggtaaagcagtttcttaggctgctggttacacagaatgtcagtttgtgaaaattcattgagctacacttgtatgtttattatacttaaatataaggaaaagagaatttctgctaatgcttacctaggtatttatgtgtcttacatcatacctgtatctttaaaactctctgtcctttacaaagggaaacgttctccgaagaaatttatttctcatttccaggagatgataaggcaactcagggccattattaacgactgctaatgaaaagctctgagttgagaaaggatctctcttggtttgggaagcgctgcggccaaggggcctagggctggaagtggccgtcttggggaccgaagccgcgcagcc

SEQ ID NO: 75880 - DNA, 238 bp, Homo sapiens; identical to SEQ ID NO: 34868
  misc_feature 1..238: note = chr13:28544665-28544903
  misc_feature 1..238: note = hyper
  source 1..238: mol_type = genomic DNA

SEQ ID NO: 75881 - DNA, 30 bp, Homo sapiens; identical to SEQ ID NO: 34869
  misc_feature 1..30: note = chr13:28545247-28545277
  misc_feature 1..30: note = hyper
  source 1..30: mol_type = genomic DNA

SEQ ID NO: 75882 - DNA, 395 bp, Homo sapiens; identical to SEQ ID NO: 4002
  misc_feature 1..395: note = chr13:28549497-28549892
  misc_feature 1..395: note = hyper
  source 1..395: mol_type = genomic DNA

SEQ ID NO: 75883 - DNA, 313 bp, Homo sapiens
  misc_feature 1..313: note = chr13:28550239-28550552
  misc_feature 1..313: note = hyper
  source 1..313: mol_type = genomic DNA
cgccgcgcagccagctctctgtcccttcagctccagctccttctaaagggacagactcagcgtctgcccccatctgcaccccttcccgcaggaataaaatcattttccggacaagcttggaactgttgaaatgtaactatgtaattggagacaccggggtcgtgtctgggagattctgagctcatctacactcttgctaaactgcggggaacccagccctggtgggatctgtgcatctcacatgagcttttttacataaagagcacagacgctgcatttggggcctggtttatctaagcgtggggtttacccc

SEQ ID NO: 75884 - DNA, 420 bp, Homo sapiens; identical to SEQ ID NO: 34873
  misc_feature 1..420: note = chr13:28551129-28551549
  misc_feature 1..420: note = hyper
  source 1..420: mol_type = genomic DNA

SEQ ID NO: 75885 - DNA, 727 bp, Homo sapiens; identical to SEQ ID NO: 34874
  misc_feature 1..727: note = chr13:28551658-28552385
  misc_feature 1..727: note = hyper
  source 1..727: mol_type = genomic DNA

SEQ ID NO: 75886 - DNA, 514 bp, Homo sapiens; identical to SEQ ID NO: 34875
  misc_feature 1..514: note = chr13:28552659-28553173
  misc_feature 1..514: note = hyper
  source 1..514: mol_type = genomic DNA

SEQ ID NO: 75887 - DNA, 30 bp, Homo sapiens
  misc_feature 1..30: note = chr13:28576403-28576433
  misc_feature 1..30: note = hypo
  source 1..30: mol_type = genomic DNA
taagtctgcagccaccgctagtctggtggc

SEQ ID NO: 75888 - DNA, 30 bp, Homo sapiens
  misc_feature 1..30: note = chr13:28599972-28600002
  misc_feature 1..30: note = hypo
  source 1..30: mol_type = genomic DNA
gtgcatggggatctccgtggggcctggtgg

SEQ ID NO: 75889 - DNA, 133 bp, Homo sapiens
  misc_feature 1..133: note = chr13:28613123-28613256
  misc_feature 1..133: note = hypo
  source 1..133: mol_type = genomic DNA
tcggtgggaaaggttcggggccttcatagaggaggtagagctcgagctggagcctcacggatgagttggttttgatgagaggacaaaagaaaaggcatccaaggaggagacaaagcagcgactgaaggcgcca

SEQ ID NO: 75890 - DNA, 327 bp, Homo sapiens
  misc_feature 1..327: note = chr13:28673900-28674227
  misc_feature 1..327: note = hyper
  source 1..327: mol_type = genomic DNA
tttggggacagtcctcggagtccttgaaaacccctttggggtttatgccaggataagaagagactagaagaaagggacagctagtattttaatatgtaaatctgtttgcataatatttcctaggtaaactattcgttgatccaaccaaaattcggcggggctggggggtatcgttattgaggatgactcgctctaggggagaacgcggacgcattttcccatcagagttccctccataaatcaaaacctcaaaagaagagttaaagacgacacccaggtgtctacagtatccaagggccgggccaggagaggtccttggccacctgg

SEQ ID NO: 75891 - DNA, 463 bp, Homo sapiens; identical to SEQ ID NO: 34877
  misc_feature 1..463: note = chr13:28674720-28675183
  misc_feature 1..463: note = hyper
  source 1..463: mol_type = genomic DNA

SEQ ID NO: 75892 - DNA, 1213 bp, Homo sapiens; identical to SEQ ID NO: 1100
  misc_feature 1..1213: note = chr13:29067773-29068986
  misc_feature 1..1213: note = hyper
  source 1..1213: mol_type = genomic DNA

SEQ ID NO: 75893 - DNA, 858 bp, Homo sapiens
  misc_feature 1..858: note = chr13:29068993-29069851
  misc_feature 1..858: note = hyper
  source 1..858: mol_type = genomic DNA
cggcctgctcgcccggtgcccgcgctccccgcggccaacgacccggccgccagagtccgtcctctcgttcgccgccgccggccccgcgccctgagcgcccgtctcgcggctccagccaggagacaaccacttccccgggtaatcctcgccgccaggcgcccgctggccgctgcacccgagccccggagcccgctccgagccgccgccgctgccggggaggagccgagaggagtgtccgcctggcgcgctccgagcctcccgcggacctcgatgaagagcagccgagggcgggggcgatttataacctttccccagcccacttcctaccccggcacctccttctggtgacgtcaaggggtcccccacccctcatccgcctccccacctaccctcttcttcctcccaggctcgcttccctgcggctacggagaggggcgggggccgacgagggcgggtggcccggggccgagcgcgcgtggggaggtgctggcgacgcgggcccgggagcgcggccccggcaggttcagggtctttgctccgcgccctcttgcccttgcccctcctcctgcccatcgcgctcaggaaatccttgcagactccctccacccggcttactcagctctgggggccgcccgaaactggggaagggacaaggctgaagctccgccgcctggccctaggggcggaaagtccgatccaagggaagctggccgcgcctccgcgacggtgttcttggcacggaggactgaggcgcagtccggctgtctccccttgcctgctcttcccgcgctgtcccgccgctcctgaccccttcagactgtcccgagaagtctaggaaggcaccggagaccctcggca

SEQ ID NO: 75894 - DNA, 440 bp, Homo sapiens
  misc_feature 1..440: note = chr13:29105249-29105689
  misc_feature 1..440: note = hyper
  source 1..440: mol_type = genomic DNA
cccttcccaacagatcgagagctcggaggcttggcacggtcggtcccgatggccccagcgggagggtcacggttgagacagcagccccatctcattgtttaaggccggggcttcctcttttggcggagcgggagcgggagcgggagctgagcgggaaggggacggacgccgcgggagccttcgggatgtctattgctgccgctccctcccctcgccgggagcttgggtttcccggggtgtgtgcggattctcaataaaaagggaaaagcacgatccaagttaattttccagcgccgacaggaaatgctgtttcctgcatcgtacaacgctggtgccaacaagactgacacaggagcccattgtcccgcgaacaatgtggcgatggggaaggacgcctgagaaaacagaccccggccccgtgagcgcgtttgtttgatcct

SEQ ID NO: 75895 - DNA, 114 bp, Homo sapiens; identical to SEQ ID NO: 1102
  misc_feature 1..114: note = chr13:29106308-29106422
  misc_feature 1..114: note = hyper
  source 1..114: mol_type = genomic DNA

SEQ ID NO: 75896 - DNA, 392 bp, Homo sapiens; identical to SEQ ID NO: 1103
  misc_feature 1..392: note = chr13:29106423-29106815
  misc_feature 1..392: note = hyper
  source 1..392: mol_type = genomic DNA

SEQ ID NO: 75897 - DNA, 166 bp, Homo sapiens
  misc_feature 1..166: note = chr13:29106898-29107064
  misc_feature 1..166: note = hyper
  source 1..166: mol_type = genomic DNA
cgccctgaggtcagggccggggcctgaggacacggcgctgggctccgggggacgcgggttcacgccggcgcccgagcgccacctccccgccctccgccggctcacgtagtcccggggttcggtacgtgaagtgccggcgcgaggctgctcaggccaccgcatgggc

SEQ ID NO: 75898 - DNA, 72 bp, Homo sapiens
  misc_feature 1..72: note = chr13:29107252-29107324
  misc_feature 1..72: note = hyper
  source 1..72: mol_type = genomic DNA
cggagaaaatcagatgcagtctccttccctttggtgactatccgtgggggtttctcccggtggaaatgagcg

SEQ ID NO: 75899 - DNA, 588 bp, Homo sapiens
  misc_feature 1..588: note = chr13:29292691-29293279
  misc_feature 1..588: note = hyper
  source 1..588: mol_type = genomic DNA
gcctcggatgccctgcgctcgtgcgcgcccgggttcaagggcagcctctggactggggcaacagaggacgcgccggggacagtaacctcggactacgcggccggcgctggggtggggagagtactttcccgtcgaactcgaccaaattacgcttgtcggggagtctcaagcgtattgtaaagcaaacctcggcaagcgcacttccgcgtcccgagtgacacctgcagggttctccggcagccctcggcttccccgcggccctgcggacctcggcctcagcgcggcgcggcggggcgcggagcagctgctccttctgcgcagtggacaatcggccaatcggcgcctccgtcggtcggtcagcggccctgccagcgctaggcgatgactcggccgcagccagctgagcatcgctgtccgccgaggaggcggggtcggctgccgcggcgctgtcactgttctacccggctctcctgcgattgggcccagcggtcggtgccccagcggcgattggtccacccggacgtcactctcccctggagagtggctagtggatcgtgcacccaccctcggaggcccggagtggatccc

SEQ ID NO: 75900 - DNA, 62 bp, Homo sapiens
  misc_feature 1..62: note = chr13:29293280-29293342
  misc_feature 1..62: note = hyper
  source 1..62: mol_type = genomic DNA
cgcgaccgagcagccactcagcaccgctgttgagtggtgggccgcgccgcaggctcaacagc

SEQ ID NO: 75901 - DNA, 70 bp, Homo sapiens
  misc_feature 1..70: note = chr13:29352560-29352630
  misc_feature 1..70: note = hypo
  source 1..70: mol_type = genomic DNA
agggagctggggcctcggggggaggtgacgcttgtataggctcccctctgtgctccggcggggcgatttt

SEQ ID NO: 75902 - DNA, 208 bp, Homo sapiens; identical to SEQ ID NO: 34886
  misc_feature 1..208: note = chr13:29393656-29393864
  misc_feature 1..208: note = hyper
  source 1..208: mol_type = genomic DNA

SEQ ID NO: 75903 - DNA, 119 bp, Homo sapiens
  misc_feature 1..119: note = chr13:29394329-29394448
  misc_feature 1..119: note = hyper
  source 1..119: mol_type = genomic DNA
gggagcgcctgggcgtcgtgcgggcggctccggtccccggctgcgccccggccctcgagcgggggcggcggcctgggcggtgcctgcgccgaggtgagtgcgggggcgcggagcggagc

SEQ ID NO: 75904 - DNA, 428 bp, Homo sapiens
  misc_feature 1..428: note = chr13:29394546-29394974
  misc_feature 1..428: note = hyper
  source 1..428: mol_type = genomic DNA
cggctctcagggcaagtttatctccccccttctgcggaaacccttgaccgcttagcggagtacagacctgtcggtaaatagaaaactcgagctggagaggaggaggaagcagcgtggcggaacccggcccgagatgagcgtctccgtgagggcagtggtggcctcttggacattacatctttcttggctctttttgacccaggtgagcgaatcctctgctgcgcggtccggtggggtcggctggctctgctgccgccctctggacccgccggagacaggtgagcggagttggggagcgcgcagccgggctcggggcagcgccgggctggttcggcttctcgtctccagagcgctgatgcttcctgcccacatcacctgctctggcttagggactgcagctcttttggcaccttcgcttgctgccaggt

SEQ ID NO: 75905 - DNA, 182 bp, Homo sapiens
  misc_feature 1..182: note = chr13:29738377-29738559
  misc_feature 1..182: note = hypo
  source 1..182: mol_type = genomic DNA
ggagggctcccttctcgctctgcctttccaggctccagtcagcatcatttgctttcctggcacgatttttgcggtctgctcatgttgtttacatcattatttctgtcctgaagtcagcagcactgtgcattgggcttagatttttgacagcgattttggcagatgtgcgctacagtgggaag

SEQ ID NO: 75906 - DNA, 208 bp, Homo sapiens
  misc_feature 1..208: note = chr13:29914008-29914216
  misc_feature 1..208: note = hypo
  source 1..208: mol_type = genomic DNA
ggcggcaccctggcccggggcggcactatggtccggggccagcccaggtaccagctcaagtagttgcccatgacagcaatgcagtagtcgggacgttctcttagaaattcagcttccagaagtttccgaagtctgcggccggggccaagtgtgctgagcttggtgaccgttggaatcaggacgccagaaagcgcgcaaagcatcgcaa

SEQ ID NO: 75907 - DNA, 214 bp, Homo sapiens
  misc_feature 1..214: note = chr13:29933425-29933639
  misc_feature 1..214: note = hypo
  source 1..214: mol_type = genomic DNA
ctcgaaatgggtttccgcccaagccggacccgcaggcccgtgaggctgagcggcagctggtgctgcggctgaaggagcggtgtgagcagcagaccagacagctgggcgttgcgcaaggggagctgaagagggccatctgcggctttgatgccctcgccgtggccacgcagcatttctttagaaaggtgaggccccatttcgtgaaggtccaagg

SEQ ID NO: 75908 - DNA, 40 bp, Homo sapiens
  misc_feature 1..40: note = chr13:29954759-29954799
  misc_feature 1..40: note = hypo
  source 1..40: mol_type = genomic DNA
aagacatcagctggccgggcgcggtggctcacgcctgtaa

SEQ ID NO: 75909 - DNA, 19 bp, Homo sapiens
  misc_feature 1..19: note = chr13:30031261-30031280
  misc_feature 1..19: note = hypo
  source 1..19: mol_type = genomic DNA
acagcgagactccattcaa

SEQ ID NO: 75910 - DNA, 30 bp, Homo sapiens
  misc_feature 1..30: note = chr13:30057559-30057589
  misc_feature 1..30: note = hypo
  source 1..30: mol_type = genomic DNA
ccacggcatgtgctccggctacacaggtgg

SEQ ID NO: 75911 - DNA, 81 bp, Homo sapiens
  misc_feature 1..81: note = chr13:30098898-30098979
  misc_feature 1..81: note = hypo
  source 1..81: mol_type = genomic DNA
tggagtccaggagggcgcagcttttgccaggtgtgtggggcccgggcacagctgggcactggcccacgggaggggctcagc

SEQ ID NO: 75912 - DNA, 123 bp, Homo sapiens
  misc_feature 1..123: note = chr13:30106999-30107122
  misc_feature 1..123: note = hypo
  source 1..123: mol_type = genomic DNA
ggttttcagccagcacgccgggggcgttcagagtcatgtgtgtccgtgagaactccccgatgggtctgcctatcagctcgtcgaaggtggcgctccaggccctcgctacgcttgaagtacctg

SEQ ID NO: 75913 - DNA, 144 bp, Homo sapiens
  misc_feature 1..144: note = chr13:30123237-30123381
  misc_feature 1..144: note = hypo
  source 1..144: mol_type = genomic DNA
gaggcctcctctttacgtggagcggacgtgctagtgggcactaagagaatagcctctatcagagaggagaatgcaattcaatttacctgaaattcctttcaggtatctggaaacaaatggccaattgcccgcatgctcacctga

SEQ ID NO: 75914 - DNA, 21 bp, Homo sapiens
  misc_feature 1..21: note = chr13:30149067-30149088
  misc_feature 1..21: note = hypo
  source 1..21: mol_type = genomic DNA
accgtgcgtggccagagcagc

SEQ ID NO: 75915 - DNA, 64 bp, Homo sapiens; identical to SEQ ID NO: 43771
  misc_feature 1..64: note = chr13:30574503-30574567
  misc_feature 1..64: note = hypo
  source 1..64: mol_type = genomic DNA

SEQ ID NO: 75916 - DNA, 26 bp, Homo sapiens
  misc_feature 1..26: note = chr13:30707178-30707204
  misc_feature 1..26: note = hypo
  source 1..26: mol_type = genomic DNA
aggtccaggccatagcgacggggacc

SEQ ID NO: 75917 - DNA, 526 bp, Homo sapiens
  misc_feature 1..526: note = chr13:30707244-30707770
  misc_feature 1..526: note = hypo
  source 1..526: mol_type = genomic DNA
cgtccctgcactgggtgggccgtgctgggagaaggtcccggggatcactcctcctaggccgccggggcagtctctccagccaccctctttccccagagccagcgggctggggttcttggtttagactctcttctctcctgtcctggaggaccagccatttgacgcccttgtccactgggaggatgttttccatgattccacttcttcccttcctcggccacctaaggcaggccggcttatgcgtgactgtcaaccgaggcaggccacagcgctgtgggcaggcggttttgcacgtatccttagtgaccctgaaggcccagcctctgctggctgcctgagccgagggttttacttcttttcatttaatcactttattggtccttgccgggagggagcccatgggtcctggtaaaagtgcatctccctgtggttctggggctgatcctccttctggagcagaagacagagctcagtgaggaccgcctgtgctgcctgcctgggacgccccagccgcagggccgcgcag

SEQ ID NO: 75918 - DNA, 186 bp, Homo sapiens; identical to SEQ ID NO: 43775
  misc_feature 1..186: note = chr13:30761001-30761187
  misc_feature 1..186: note = hypo
  source 1..186: mol_type = genomic DNA

SEQ ID NO: 75919 - DNA, 30 bp, Homo sapiens
  misc_feature 1..30: note = chr13:31003108-31003138
  misc_feature 1..30: note = hypo
  source 1..30: mol_type = genomic DNA
agattgaaatacctgcgagccgggtttggt

SEQ ID NO: 75920 - DNA, 175 bp, Homo sapiens
  misc_feature 1..175: note = chr13:31385108-31385283
  misc_feature 1..175: note = hypo
  source 1..175: mol_type = genomic DNA
ctagtgggttatctgcgtggcttgcctgacctcagcagaaatccacagcgcagggcccagagctgtgtgagcacctgcaattgaagaattcacaattacaagtcatgtgtctaaattggcaggctttcaagaaagtcccaccaatcttcaagcatacagccgccaagggccacgt

SEQ ID NO: 75921 - DNA, 41 bp, Homo sapiens
  misc_feature 1..41: note = chr13:31415119-31415160
  misc_feature 1..41: note = hypo
  source 1..41: mol_type = genomic DNA
gactggatttaggaacgtgtccgtcgcggtgtgtatctgca

SEQ ID NO: 75922 - DNA, 230 bp, Homo sapiens
  misc_feature 1..230: note = chr13:31742917-31743147
  misc_feature 1..230: note = hypo
  source 1..230: mol_type = genomic DNA
cccaggcagataacccgccggctggtgcctcccaactcccaaagctcctttcgcctgggttctggtgtgccatccatgcttacgcatctctctgtgcccagtgccctgcactaagccaggtgtgtagccggccctcacgctgttagctgctgttaaatgccagcactccgccccacccaactctgttgtggctcctccgactgccagcacggctacgtcatcaaacaggt

SEQ ID NO: 75923 - DNA, 89 bp, Homo sapiens; identical to SEQ ID NO: 43777
  misc_feature 1..89: note = chr13:31821217-31821306
  misc_feature 1..89: note = hypo
  source 1..89: mol_type = genomic DNA

SEQ ID NO: 75924 - DNA, 27 bp, Homo sapiens
  misc_feature 1..27: note = chr13:32159215-32159242
  misc_feature 1..27: note = hypo
  source 1..27: mol_type = genomic DNA
ggcatgagccaccgcgcacggcccatg

SEQ ID NO: 75925 - DNA, 25 bp, Homo sapiens
  misc_feature 1..25: note = chr13:32244681-32244706
  misc_feature 1..25: note = hypo
  source 1..25: mol_type = genomic DNA
acaggctaggctgggcgcggtggct

SEQ ID NO: 75926 - DNA, 30 bp, Homo sapiens
  misc_feature 1..30: note = chr13:32605107-32605137
  misc_feature 1..30: note = hyper
  source 1..30: mol_type = genomic DNA
gcagataccaccatgcgtgtggaaggcagg

SEQ ID NO: 75927 - DNA, 34 bp, Homo sapiens
  misc_feature 1..34: note = chr13:32605459-32605493
  misc_feature 1..34: note = hyper
  source 1..34: mol_type = genomic DNA
cccttagccccgcggcggccgtgtgggccggagg

SEQ ID NO: 75928 - DNA, 191 bp, Homo sapiens
  misc_feature 1..191: note = chr13:32605725-32605916
  misc_feature 1..191: note = hyper
  source 1..191: mol_type = genomic DNA
ccggaggaggaggagcggccgagcatctctctctgctccgccgtgtcctttagatgagcactcccggccggagccggaggtggatccgcagagctgcctctgggcgcctgaccccgcgctgacatcacaacctgtgacaggcgcatcacgcccggtacctgctcccggccgctgcccgtcctcccagcctc

SEQ ID NO: 75929 - DNA, 91 bp, Homo sapiens
  misc_feature 1..91: note = chr13:32670558-32670649
  misc_feature 1..91: note = hypo
  source 1..91: mol_type = genomic DNA
tgctagggaaaactgcgggggggggcttcatctgggaaatgacatttaagctgagtcttcaaagaatatgattaagacagtatatttgtgt

SEQ ID NO: 75930 - DNA, 171 bp, Homo sapiens
  misc_feature 1..171: note = chr13:32752857-32753028
  misc_feature 1..171: note = hypo
  source 1..171: mol_type = genomic DNA
aataacattcttaatcgacagttgttcaactctatttgagtacttcctatgatctttatttaataagtgatatttaaaatccagaacttagtttcactcttgttttcgactccatatttctagtagcccaattaatgccaagaaaaccagcactgccggcagcggagacaa

SEQ ID NO: 75931 - DNA, 76 bp, Homo sapiens
  misc_feature 1..76: note = chr13:32755306-32755382
  misc_feature 1..76: note = hypo
  source 1..76: mol_type = genomic DNA
gtgagccaccacgcccagcccagattttattcttaaaagaagtaattgtgggttctgactgcgtaggttaccagtt

SEQ ID NO: 75932 - DNA, 30 bp, Homo sapiens
  misc_feature 1..30: note = chr13:32798473-32798503
  misc_feature 1..30: note = hypo
  source 1..30: mol_type = genomic DNA
tggttgactatctcccggagaccatcactc

SEQ ID NO: 75933 - DNA, 160 bp, Homo sapiens; identical to SEQ ID NO: 34889
  misc_feature 1..160: note = chr13:33001068-33001228
  misc_feature 1..160: note = hyper
  source 1..160: mol_type = genomic DNA

SEQ ID NO: 75934 - DNA, 121 bp, Homo sapiens
  misc_feature 1..121: note = chr13:33113918-33114039
  misc_feature 1..121: note = hypo
  source 1..121: mol_type = genomic DNA
tacagatttctactacgacctttgtctcctcataattaaactcatgcatcctactttgaaacaaccacatttacgtgaggttgtggcgttctcagtgtgttacatccgcaggcacactata

SEQ ID NO: 75935 - DNA, 17 bp, Homo sapiens
  misc_feature 1..17: note = chr13:33410944-33410961
  misc_feature 1..17: note = hypo
  source 1..17: mol_type = genomic DNA
ctcggcctcccaaagtg

SEQ ID NO: 75936 - DNA, 86 bp, Homo sapiens
  misc_feature 1..86: note = chr13:33590122-33590208
  misc_feature 1..86: note = hyper
  source 1..86: mol_type = genomic DNA
caggtgcttccccagcggcgcgctccgctagggcccggcaggatcccgcccccaagtcggggaaagttggtcggcgccttttctcc

SEQ ID NO: 75937 - DNA, 191 bp, Homo sapiens
  misc_feature 1..191: note = chr13:33590467-33590658
  misc_feature 1..191: note = hyper
  source 1..191: mol_type = genomic DNA
gagcccgccggggagcgggggtgggcgcgccggcggtgggcgggcgggcgcggcggggcgcgggcataaaggggcgcggcgcggggccccggagcctggctcccgcgcagcatgcccgccagcgccccgccgcgccgcccgcggccgccgccgccgtcgctgtcgctgctgctggtgctgctgggcctggg

SEQ ID NO: 75938 - DNA, 375 bp, Homo sapiens; identical to SEQ ID NO: 34891
  misc_feature 1..375: note = chr13:33591066-33591441
  misc_feature 1..375: note = hyper
  source 1..375: mol_type = genomic DNA

SEQ ID NO: 75939 - DNA, 105 bp, Homo sapiens
  misc_feature 1..105: note = chr13:33924609-33924714
  misc_feature 1..105: note = hyper
  source 1..105: mol_type = genomic DNA
gactcagactcccggcgactggaaaggacggacgcggcactcccgccggggtcccgggacccaatgcgggcgcgacatgggtcggtccggcgctgggaggctgcg

SEQ ID NO: 75940 - DNA, 30 bp, Homo sapiens
  misc_feature 1..30: note = chr13:34345129-34345159
  misc_feature 1..30: note = hypo
  source 1..30: mol_type = genomic DNA
ttatttggtctttggcgtggaattttgtca

SEQ ID NO: 75941 - DNA, 42 bp, Homo sapiens
  misc_feature 1..42: note = chr13:35516493-35516535
  misc_feature 1..42: note = hyper
  source 1..42: mol_type = genomic DNA
cagcggcggcagcagcgtcaatagcatcggccacagcctgag

SEQ ID NO: 75942 - DNA, 41 bp, Homo sapiens; identical to SEQ ID NO: 34893
  misc_feature 1..41: note = chr13:35517132-35517173
  misc_feature 1..41: note = hyper
  source 1..41: mol_type = genomic DNA

SEQ ID NO: 75943 - DNA, 646 bp, Homo sapiens; identical to SEQ ID NO: 34894
  misc_feature 1..646: note = chr13:36704800-36705446
  misc_feature 1..646: note = hyper
  source 1..646: mol_type = genomic DNA

SEQ ID NO: 75944 - DNA, 119 bp, Homo sapiens; identical to SEQ ID NO: 34895
  misc_feature 1..119: note = chr13:36705447-36705566
  misc_feature 1..119: note = hyper
  source 1..119: mol_type = genomic DNA

SEQ ID NO: 75945 - DNA, 15 bp, Homo sapiens
  misc_feature 1..15: note = chr13:36705621-36705636
  misc_feature 1..15: note = hyper
  source 1..15: mol_type = genomic DNA
cgcccttcttggcag

SEQ ID NO: 75946 - DNA, 91 bp, Homo sapiens; identical to SEQ ID NO: 34897
  misc_feature 1..91: note = chr13:36729246-36729337
  misc_feature 1..91: note = hyper
  source 1..91: mol_type = genomic DNA

SEQ ID NO: 75947 - DNA, 30 bp, Homo sapiens
  misc_feature 1..30: note = chr13:36788716-36788746
  misc_feature 1..30: note = hypo
  source 1..30: mol_type = genomic DNA
acagccgctgcgtcccgggcccgccccctg

SEQ ID NO: 75948 - DNA, 30 bp, Homo sapiens
  misc_feature 1..30: note = chr13:36878705-36878735
  misc_feature 1..30: note = hypo
  source 1..30: mol_type = genomic DNA
tacgccaacattgaccgcagaatccaccgc

SEQ ID NO: 75949 - DNA, 29 bp, Homo sapiens
  misc_feature 1..29: note = chr13:36883103-36883132
  misc_feature 1..29: note = hypo
  source 1..29: mol_type = genomic DNA
aggtgtggtggctcacgcctgtaatccca

SEQ ID NO: 75950 - DNA, 44 bp, Homo sapiens
  misc_feature 1..44: note = chr13:36885927-36885971
  misc_feature 1..44: note = hypo
  source 1..44: mol_type = genomic DNA
acaagagatttagtccgccaggcatggtggcttacgcctgtaat

SEQ ID NO: 75951 - DNA, 368 bp, Homo sapiens
  misc_feature 1..368: note = chr13:36919856-36920224
  misc_feature 1..368: note = hyper
  source 1..368: mol_type = genomic DNA
taaagagtaaaatcacgcgcaatccatcccaatataaccgcagttgttcgtgggccttcttgcagagaaaggctgcccaaccttgacggggccatgggcgctgcgggagggcaaaagaccacagagatctgcgaagccaaagtaaacaacggggttggggcggcgagaatgatcaatagcgatgctccgaaaggactccgcgataggaatcgagcgggaaggattccctccatcctaacagtccatgggttaagaggccgaagcttccctaaataccacactcccgcgagagaagggactgagaacaacttctcaaactattctctctcgaaatcgctcccttcctcgaaaattccatctctgagact

SEQ ID NO: 75952 - DNA, 66 bp, Homo sapiens; identical to SEQ ID NO: 34899
  misc_feature 1..66: note = chr13:36920266-36920332
  misc_feature 1..66: note = hyper
  source 1..66: mol_type = genomic DNA

SEQ ID NO: 75953 - DNA, 54 bp, Homo sapiens; identical to SEQ ID NO: 34900
  misc_feature 1..54: note = chr13:36920333-36920387
  misc_feature 1..54: note = hyper
  source 1..54: mol_type = genomic DNA

SEQ ID NO: 75954 - DNA, 724 bp, Homo sapiens
  misc_feature 1..724: note = chr13:36920464-36921188
  misc_feature 1..724: note = hyper
  source 1..724: mol_type = genomic DNA
cgctcgccgggggccggtcccgaggttcccaaggcctcgcgcgcgcgcttgccgtggcaaccaagacgttccacgacgcgcgctctcgaacgcttcgcgtcacgcggccgcgcggccccgcccgtcggcctcgctcccgccacagagcccgcagcacgccgccgccgcagcctaggtcacgtgagtacccacgcgcgcgtcttgccagcggattcatcaccggcctgctcagactaggttctgcccactctgaccttctaaatggtacgtgggaggacgtccgtccccttcggacccaagagtcaccgtaacactctagaaggggagaaaaggagcgagggcggcaggcgacagagaacctcgcgagtcagcggccccgcgcagacccccccaggcacggtcccctgcggccacgtcggctgctcggcgcctgcgcaatctctttctctccagcgaaaccgaggcctccggagagcctagtagagagtgtgggcagtgagcgcttgtagccgctagagggagcgctgggcacagtgcacgagagacaataaaggctgattatcccctcaatgtctctgcagcctgagctttgtgacttctgtatccagagcacagttaatttccaaaagcccgcctgcaccacgtgttttaagtcttggtgtgtgtgtaaagtctatatcactatcataaaactgttagttcctgattccgggatacaaagagt

SEQ ID NO: 75955 - DNA, 161 bp, Homo sapiens
  misc_feature 1..161: note = chr13:37004731-37004892
  misc_feature 1..161: note = hyper
  source 1..161: mol_type = genomic DNA
ttgtccgctcccaagcgactcaggctcttggcaggacttgctgtagagtcccagacggagttagccactgagtccttcagcgacccaggaaataacaacactgttggcaggtgggggagggcgcccgggaagatatccaatagtggcgtcaggcaagagga

SEQ ID NO: 75956 - DNA, 108 bp, Homo sapiens; identical to SEQ ID NO: 4013
  misc_feature 1..108: note = chr13:37005473-37005581
  misc_feature 1..108: note = hyper
  source 1..108: mol_type = genomic DNA

SEQ ID NO: 75957 - DNA, 164 bp, Homo sapiens; identical to SEQ ID NO: 4014
  misc_feature 1..164: note = chr13:37005899-37006063
  misc_feature 1..164: note = hyper
  source 1..164: mol_type = genomic DNA

SEQ ID NO: 75958 - DNA, 225 bp, Homo sapiens; identical to SEQ ID NO: 34905
  misc_feature 1..225: note = chr13:37006433-37006658
  misc_feature 1..225: note = hyper
  source 1..225: mol_type = genomic DNA

SEQ ID NO: 75959 - DNA, 138 bp, Homo sapiens; identical to SEQ ID NO: 34906
  misc_feature 1..138: note = chr13:37006733-37006871
  misc_feature 1..138: note = hyper
  source 1..138: mol_type = genomic DNA

SEQ ID NO: 75960 - DNA, 176 bp, Homo sapiens
  misc_feature 1..176: note = chr13:37247973-37248149
  misc_feature 1..176: note = hyper
  source 1..176: mol_type = genomic DNA
attttccaatggtggcgcaagctcctccctcgcccgagctgggcgccgtcctagagccaagcgcccgctagagccgagactagggggcggtgaggagtgggacccgctcgcggccattggttgtgcggccaggaggggcggagggacgacgcgcgggctgtgcggggccggcagcc

SEQ ID NO: 75961 - DNA, 482 bp, Homo sapiens
  misc_feature 1..482: note = chr13:37248512-37248994
  misc_feature 1..482: note = hyper
  source 1..482: mol_type = genomic DNA
gtgtccttactgtcccgagaagcaatcgcagcccggctctccgagtcttggggtgactccacgggctgcaggaggagccgcgaggggccctgagtgcaatgtccttggccccgtgttgacctgcctcggtcccagacactgggaaccgggaaggtctaccctcgctctgcaaggtggattcctccatgcaagtgtagacagttctacactttgcagagtgtgtctaggtgccttctgtttgcttttgcctttgtggtgtgtggagggtcattcttgggtttgttttgctcctgtctgattttctagggtcatttgcgtcccttctcgggaacggggactcgccatgcgcacactgacagctggctttgcacctgctaaggcgctggagagtcttttcgcccgtcttagggtggccctaaatccggggaagttttatgtggcgctgaacacttgcgtttcccaggggcgttttccctagctcc

SEQ ID NO: 75962 - DNA, 15 bp, Homo sapiens
  misc_feature 1..15: note = chr13:37249039-37249054
  misc_feature 1..15: note = hyper
  source 1..15: mol_type = genomic DNA
cgggtctgatgagac

SEQ ID NO: 75963 - DNA, 67 bp, Homo sapiens
  misc_feature 1..67: note = chr13:37493463-37493530
  misc_feature 1..67: note = hyper
  source 1..67: mol_type = genomic DNA
atctgcttcccacctcgccccctcccctctgcggagagctggcaccgaggggcgggccaaggaaaag

SEQ ID NO: 75964 - DNA, 103 bp, Homo sapiens
  misc_feature 1..103: note = chr13:37494004-37494107
  misc_feature 1..103: note = hyper
  source 1..103: mol_type = genomic DNA
cccgggaacaacgaccgccaaaagccaagcctcacgccgaggagcctcccaggctgccccgaggacgaacaacttcgccctccactcaatgcgctcacacgca

SEQ ID NO: 75965 - DNA, 461 bp, Homo sapiens
  misc_feature 1..461: note = chr13:37643689-37644150
  misc_feature 1..461: note = hypo
  source 1..461: mol_type = genomic DNA
tcccggaagcaacctcctgtgctgcccccaaactcatgcagccaggtgggacccgaccctaggcccggagctttcatcactcgggactctggccccacactgctgctctcacccacgcactgctgctgtggggagggcgtggggaggaggcggagctgggcccggggctgtgccacgcttcacgcttcacggaaccagcgggagccaaggacaagcaggagccgccccgcagccccttgggggccgccgctatgaggccaggccaagtcgcccagcccagagggggagtgatggagccacgcgattgggcacagaggagtgggcagagaggcacccagcaaggacctggagcccccgccccaggctgtgaggaggcatggcccgggctgcctgcacattccacagagcaggcaggagccccaccttcccaggtgcaggacccaggccgtctgtgggatctg

SEQ ID NO: 75966 - DNA, 210 bp, Homo sapiens
  misc_feature 1..210: note = chr13:38443222-38443432
  misc_feature 1..210: note = hyper
  source 1..210: mol_type = genomic DNA
gacgcagaatgtaatcgatcggtagaacattgatcactctccttccttcgttaccctactttaagtgccggagagctaaggcctcacttatatgcacccagatgcccccgagatctccattttccccaaatgcataaaaggctaaaaacggccacattccccagcaccacggcgtggctgcagctcctttgtttaccatataagtcacac

SEQ ID NO: 75967 - DNA, 155 bp, Homo sapiens
  misc_feature 1..155: note = chr13:38443479-38443634
  misc_feature 1..155: note = hyper
  source 1..155: mol_type = genomic DNA
cggaagactgaggagcacccccaaactcctgctcagcccgagtcaagcaccgaaagcttcacaggtttttttcctgagccttgaagagaaaccacatagccagaaccttttgaactcctaaccccgcagggatgtccgcctcccagaagagagcc

SEQ ID NO: 75968 - DNA, 75 bp, Homo sapiens
  misc_feature 1..75: note = chr13:38443635-38443710
  misc_feature 1..75: note = hyper
  source 1..75: mol_type = genomic DNA
gcttcccaggcagcttaggaaacttaaccgagatcccagaaagaaggcgaggtgtagctccggtcgaacggagcc

SEQ ID NO: 75969 - DNA, 291 bp, Homo sapiens
  misc_feature 1..291: note = chr13:39260356-39260647
  misc_feature 1..291: note = hyper
  source 1..291: mol_type = genomic DNA
ttggtctaattactgcgaagagaacaggaacgtctctaatgacagctaccctaacagagtcggatttgggagcgcctggggccacattccctagaatttattctttggtgcaagactagcaattctgatcagactgcatttctcacgcattccaaatgccctttttcccttttactctgtgaacctcggttgcaaaggaggggcttgttaaaaactcaccaatcggaggactgtgcccattgtaattcacgaggagaaggcagcgtctgggcgcgccgaagggggctgggc

SEQ ID NO: 75970 - DNA, 389 bp, Homo sapiens
  misc_feature 1..389: note = chr13:39261007-39261396
  misc_feature 1..389: note = hyper
  source 1..389: mol_type = genomic DNA
caggacaacctgttgcgcctctatctcctcccctccccgcagtttccccgccttggcctctaagagctgattggcagaaattactacccaaccctcagctccgcacctcctcccccgaccaacgattggccacctgggaggactggagtaaggggtgcgagcggagggatttccctcaaagcccagggtccggggacctggaaagtagaagtggagggattcaattctccgcgcgattgaggcgctagcggcggagctggacggcctgggaaggcttcggctcctcggctgcggctccagcccggacggcgccgcgcaactttgccatccttctggcccagccccggctacaggaggaccccgcgggcaacgcgcggagttcctggcac

SEQ ID NO: 75971 - DNA, 94 bp, Homo sapiens; identical to SEQ ID NO: 34912
  misc_feature 1..94: note = chr13:39261689-39261783
  misc_feature 1..94: note = hyper
  source 1..94: mol_type = genomic DNA

SEQ ID NO: 75972 - DNA, 102 bp, Homo sapiens; identical to SEQ ID NO: 34913
  misc_feature 1..102: note = chr13:39261928-39262030
  misc_feature 1..102: note = hyper
  source 1..102: mol_type = genomic DNA

SEQ ID NO: 75973 - DNA, 183 bp, Homo sapiens
  misc_feature 1..183: note = chr13:39262129-39262312
  misc_feature 1..183: note = hyper
  source 1..183: mol_type = genomic DNA
cgcgtgggcatcctgtccggcttgggcgcgctgcctcgctatggagaactcctccactacccgcaggtccctggaggagccagagagggaggcgccccggagactctcctgatggactgcaaagctttccaggaactaggcgtgcgctatcgccacacagccgccagtcgctcaccaaacagg

SEQ ID NO: 75974 - DNA, 231 bp, Homo sapiens
  misc_feature 1..231: note = chr13:40020679-40020910
  misc_feature 1..231: note = hypo
  source 1..231: mol_type = genomic DNA
agggtaaacaaagatcgtgtcccaactgtgtaccacaatcaacgtcgtatctgaggatctcggtgatcctcatagcttccctatgaggctgataccatcttcattctgtagctagagaaactaagatttaggaaagtaaaccatattgcccaaagtactctagttaagtggcaaagccggtattttcatttaggtcccgtccaatagcaaacttcacgatactaagtggca

SEQ ID NO: 75975 - DNA, 30 bp, Homo sapiens
  misc_feature 1..30: note = chr13:40211522-40211552
  misc_feature 1..30: note = hypo
  source 1..30: mol_type = genomic DNA
tttttttttttgattcgttgttaggcacgt

SEQ ID NO: 75976 - DNA, 86 bp, Homo sapiens
  misc_feature 1..86: note = chr13:41103265-41103351
  misc_feature 1..86: note = hypo
  source 1..86: mol_type = genomic DNA
ttttacaaccttactcgtactcttcaaagctgtcaacgtcttaaaaacaaagaaagtctgagaaactgtcgcggtcaagaggaggc

SEQ ID NO: 75977 - DNA, 48 bp, Homo sapiens
  misc_feature 1..48: note = chr13:41238485-41238533
  misc_feature 1..48: note = hyper
  source 1..48: mol_type = genomic DNA
tcagcttggggaggccgcgccacgactggaccccgcccccgggaagcc

SEQ ID NO: 75978 - DNA, 35 bp, Homo sapiens
  misc_feature 1..35: note = chr13:41241688-41241723
  misc_feature 1..35: note = hyper
  source 1..35: mol_type = genomic DNA
tgggcgggaatctcccgctccgtccactaagtcca

SEQ ID NO: 75979 - DNA, 30 bp, Homo sapiens
  misc_feature 1..30: note = chr13:41496219-41496249
  misc_feature 1..30: note = hypo
  source 1..30: mol_type = genomic DNA
acacaagctacaggccgagcgtggtggctc

SEQ ID NO: 75980 - DNA, 53 bp, Homo sapiens; identical to SEQ ID NO: 15760
  misc_feature 1..53: note = chr13:41681520-41681573
  misc_feature 1..53: note = hypo
  source 1..53: mol_type = genomic DNA

SEQ ID NO: 75981 - DNA, 30 bp, Homo sapiens; identical to SEQ ID NO: 43786
  misc_feature 1..30: note = chr13:41705935-41705965
  misc_feature 1..30: note = hypo
  source 1..30: mol_type = genomic DNA

SEQ ID NO: 75982 - DNA, 53 bp, Homo sapiens
  misc_feature 1..53: note = chr13:41859167-41859220
  misc_feature 1..53: note = hypo
  source 1..53: mol_type = genomic DNA
ttattgtgagttcctcgaattgttgacttactgattaacgtatgatctactga

SEQ ID NO: 75983 - DNA, 30 bp, Homo sapiens
  misc_feature 1..30: note = chr13:42021853-42021883
  misc_feature 1..30: note = hypo
  source 1..30: mol_type = genomic DNA
cgaatattttcagagcgtgaacaccttctg

SEQ ID NO: 75984 - DNA, 30 bp, Homo sapiens
  misc_feature 1..30: note = chr13:42022516-42022546
  misc_feature 1..30: note = hypo
  source 1..30: mol_type = genomic DNA
taggataatcatccccgtggataactacaa

SEQ ID NO: 75985 - DNA, 231 bp, Homo sapiens
  misc_feature 1..231: note = chr13:42031162-42031393
  misc_feature 1..231: note = hyper
  source 1..231: mol_type = genomic DNA
aactcctgcccctctcgccccgaccctctccactccgcccgcccaccatctcggaagtccccttgggacaatgcgtaggggacctccgcgtccccgacacccgactgggacacggccgcgggctccttcgtccctcaccgccagccagggaggctctgcatgcccacgtccacttcacagccgaggaagctgcggctcgcggaggtgcctggcacgcggcgggaagcagca

SEQ ID NO: 75986 - DNA, 153 bp, Homo sapiens
  misc_feature 1..153: note = chr13:42032496-42032649
  misc_feature 1..153: note = hyper
  source 1..153: mol_type = genomic DNA
cgcgtcgcccttccacgagcgccacttccactacgaggagcacctggagcgcatgaagcggcgcagcagcgccagtgtcagcgacagcagcggcttcagcgactcggagagtaagtgcggcccccgctaggatggcgccgggatctcccagct

SEQ ID NO: 75987 - DNA, 29 bp, Homo sapiens
  misc_feature 1..29: note = chr13:42063589-42063618
  misc_feature 1..29: note = hypo
  source 1..29: mol_type = genomic DNA
ggcgtgagccaccgcgcctggccactcct

SEQ ID NO: 75988 - DNA, 181 bp, Homo sapiens; identical to SEQ ID NO: 43787
  misc_feature 1..181: note = chr13:42540722-42540903
  misc_feature 1..181: note = hypo
  source 1..181: mol_type = genomic DNA

SEQ ID NO: 75989 - DNA, 19 bp, Homo sapiens
  misc_feature 1..19: note = chr13:43149215-43149234
  misc_feature 1..19: note = hyper
  source 1..19: mol_type = genomic DNA
gtgggcagaatgacacggc

SEQ ID NO: 75990 - DNA, 98 bp, Homo sapiens
  misc_feature 1..98: note = chr13:43149235-43149333
  misc_feature 1..98: note = hyper
  source 1..98: mol_type = genomic DNA
cgaccagagaggcgcgggctcgggatgggggctctgcggctgtggcgctgtcctgtgggggtgaaggaagagggacagccccacgtgcctgctaggga

SEQ ID NO: 75991 - DNA, 51 bp, Homo sapiens
  misc_feature 1..51: note = chr13:43543176-43543227
  misc_feature 1..51: note = hypo
  source 1..51: mol_type = genomic DNA
atccataggtggccccgccctccctcattccggcagcggctgtgcttgctt

SEQ ID NO: 75992 - DNA, 637 bp, Homo sapiens
  misc_feature 1..637: note = chr13:43565939-43566576
  misc_feature 1..637: note = hyper
  source 1..637: mol_type = genomic DNA
tcaatttataaggtgcggcatggatactttcatttaagcaaatgagctttcattcagtcaaaatccctgttgttgggcccctgtggttttaaactccaaggaccaaggtgcttgtgagtgagtatgtttggggcccgggctcccgccccgaagccaggttgttaaaatactcaccgcctctggcccgcgtgcacgacgctctcccgcgaagggcccttaggggctgcctccaaaccctctctctggtcttccacggggctcagctccccttgccgcccagaagggtcctggggatcccgggtcgggcgggaggcaggggaggcgccgagcccggagttcaccactctattgcgggtgttcatggttcacagcccgcgggtcccgggccgccgtcgctgcgggagggatgcggctgggacgcttagcgagtctcaagatgggattccaaagtgcagaggcagcggttttaacagctgagtttcggtttctcagaatcagcagcagactgcgcccgccccagagaacttccccacgtattctccactgaggccccgtccgaccttatcgcgggttaacagcccaggatgttgacttgagctggcttggtcggctacaggtgagacggtttaaagtctca

SEQ ID NO: 75993 - DNA, 30 bp, Homo sapiens
  misc_feature 1..30: note = chr13:43728041-43728071
  misc_feature 1..30: note = hypo
  source 1..30: mol_type = genomic DNA
gcgtgattctggttgcgttgtttttctgac

SEQ ID NO: 75994 - DNA, 199 bp, Homo sapiens
  misc_feature 1..199: note = chr13:43985951-43986150
  misc_feature 1..199: note = hypo
  source 1..199: mol_type = genomic DNA
actgtgtccaacactcgcggtacagagagattaccaggcacctgtcacctacacccttcggcactgctgcaagcatctctgaaaccaggagaaagcttaccagacacgagctgctgtccaggcaaccctacgggaaccatgcccaggttattcatggctgtagcccaggctgtgggatctgtcacggacatgttgagct

SEQ ID NO: 75995 - DNA, 160 bp, Homo sapiens
  misc_feature 1..160: note = chr13:44359820-44359980
  misc_feature 1..160: note = hyper
  source 1..160: mol_type = genomic DNA
ggcttgcccacctgtcgaccccactttccccatgtgctcgccgcgggatgacaaccacaacactccagaaccaccccccttccgaaagagggcggggttacgccttcagccaatcaggacccgcgagccccgggtgtccaacctatggggtggctgtggc

SEQ ID NO: 75996 - DNA, 236 bp, Homo sapiens; identical to SEQ ID NO: 34919
  misc_feature 1..236: note = chr13:44360043-44360279
  misc_feature 1..236: note = hyper
  source 1..236: mol_type = genomic DNA

SEQ ID NO: 75997 - DNA, 327 bp, Homo sapiens; identical to SEQ ID NO: 34920
  misc_feature 1..327: note = chr13:44360467-44360794
  misc_feature 1..327: note = hyper
  source 1..327: mol_type = genomic DNA

SEQ ID NO: 75998 - DNA, 231 bp, Homo sapiens
  misc_feature 1..231: note = chr13:44360995-44361226
  misc_feature 1..231: note = hyper
  source 1..231: mol_type = genomic DNA
cggctggaagcctgtgtgagtagcggcgcccgggagagcggggatctgctgaggggcgctggagactccgcggctggaggcgcgcgggcgtgcgcacgcgcgcctgcgagtgtgagtgtatgggtgcgcgcgcgcccacggggtgggggagtcgcgaggggagggggagagaggccgagagatgctcgtagggaccgaggcaaaattctacgaccccggaaatccgtaaac

SEQ ID NO: 75999 - DNA, 34 bp, Homo sapiens
  misc_feature 1..34: note = chr13:44361544-44361578
  misc_feature 1..34: note = hyper
  source 1..34: mol_type = genomic DNA
gccaagagaagaacccgggcgcacgtggccgact

SEQ ID NO: 76000 - DNA, 817 bp, Homo sapiens
  misc_feature 1..817: note = chr13:44947725-44948542
  misc_feature 1..817: note = hyper
  source 1..817: mol_type = genomic DNA
cgtccccgtccccgacgcgctcacaaacgccgtggtcgcccgaaccttcggccccgcagcattcggctacaggaccgcgacactgcagggccccggctctgcgcgctgcgctccggccgctcggcgcgggaggacgtgcggtcgcgcctgcctcggtggccgcgcggggtaggtggctgcggggaccggaaggatggcgaggaagtcggaaagggtttcctgagatgagagattacttccgtccgggctgcggcctctctctggagtcggctagccggggctcggggagcggggtgcgcagggctcggggccacgccttgccacctgcagcgcccgggtgggccgcgggggcctcggcgggacgcgctcggccctgtcgcaggagctaacgcagggggaatccttgcaggtgggagcatttcagagcgcacaagccatggtggccaaacagcggatccggatggctaacgagaagcacagcaaaaacatcacccagagggggaacgtagccaaaaccctggtaaggcggggtcggcgccggccaggcagagccctgcagcccggcggggtggggcggaaggtgggggcggggccgggcgggtagcggcgcagggtccggcctcccggctcccggcccgccccttctgcggggtcctgcagagtgggggctgagagctgggttcagggcggcgcggtctgcttggcgtcctcgtgggcggagagggccctggttggtcgtggcccctctgggagtggctacctgggctaccagggaggcgcagaggagccctcctccccgacccgcaccccctgtccc

SEQ ID NO: 76001 - DNA, 56 bp, Homo sapiens
  misc_feature 1..56: note = chr13:45165560-45165616
  misc_feature 1..56: note = hypo
  source 1..56: mol_type = genomic DNA
ccctgccccaggcttcgagggggcgctgccggttgccggtgcgaggcgctgggagc

SEQ ID NO: 76002 - DNA, 38 bp, Homo sapiens
  misc_feature 1..38: note = chr13:45491139-45491177
  misc_feature 1..38: note = hypo
  source 1..38: mol_type = genomic DNA
gcccgtgcgacataactagactccgtctcaaaaaacaa

SEQ ID NO: 76003 - DNA, 26 bp, Homo sapiens
  misc_feature 1..26: note = chr13:45562261-45562287
  misc_feature 1..26: note = hypo
  source 1..26: mol_type = genomic DNA
ctgcactacctggcccggcgtggtgg

SEQ ID NO: 76004 - DNA, 26 bp, Homo sapiens
  misc_feature 1..26: note = chr13:45562467-45562493
  misc_feature 1..26: note = hypo
  source 1..26: mol_type = genomic DNA
ttgcttgaactcgggaggcagaggtt

SEQ ID NO: 76005 - DNA, 260 bp, Homo sapiens
  misc_feature 1..260: note = chr13:45564543-45564803
  misc_feature 1..260: note = hypo
  source 1..260: mol_type = genomic DNA
cctttccagattccccgaagcattgtcatgcctttctttttgccctcgggttttttcctaattacattgcatatttagtacactgtatttgaataatttgtcgacataatctgtctccaccattgcactatggtcttctacctgaacacgcaacaggcacttggtatatacgaaacgaatgcttctcggattccggcatgcatacctatctgctttaatgtttattcacatttgtagactagcaccgacacccagttgga

SEQ ID NO: 76006 - DNA, 281 bp, Homo sapiens
  misc_feature 1..281: note = chr13:45885713-45885994
  misc_feature 1..281: note = hyper
  source 1..281: mol_type = genomic DNA
ttctggtctgaatggcggtggaggggaaggtagaaaggaggcgtctgccgagcagcatccgcgcggagcgagctgcggtcctcgggaccccgcagcaggagccacgagcccgccccggcgtccgagccctgcaggcgaggccaggcttggcgcggagggacctcagcgtccggggagcgctcgctgtctttgagttcctgctgccagagccgggcctcctctgctctccgcagcctcgcagggagggcgcaggggcgagtcctgggcgggcagggcagccg

SEQ ID NO: 76007 - DNA, 22 bp, Homo sapiens
  misc_feature 1..22: note = chr13:45905242-45905264
  misc_feature 1..22: note = hypo
  source 1..22: mol_type = genomic DNA
cttttgtcgatttgtcttttgt

SEQ ID NO: 76008 - DNA, 34 bp, Homo sapiens
  misc_feature 1..34: note = chr13:45926312-45926346
  misc_feature 1..34: note = hypo
  source 1..34: mol_type = genomic DNA
ttactcagagaatagcgaacgcttccttgtgcca

SEQ ID NO: 76009 - DNA, 30 bp, Homo sapiens; identical to SEQ ID NO: 43794
  misc_feature 1..30: note = chr13:45939250-45939280
  misc_feature 1..30: note = hypo
  source 1..30: mol_type = genomic DNA

SEQ ID NO: 76010 - DNA, 34 bp, Homo sapiens; identical to SEQ ID NO: 43795
  misc_feature 1..34: note = chr13:45950905-45950939
  misc_feature 1..34: note = hypo
  source 1..34: mol_type = genomic DNA

SEQ ID NO: 76011 - DNA, 30 bp, Homo sapiens
  misc_feature 1..30: note = chr13:45992804-45992834
  misc_feature 1..30: note = hyper
  source 1..30: mol_type = genomic DNA
tggaaaagcaaccttcgcagggggcaacct

SEQ ID NO: 76012 - DNA, 146 bp, Homo sapiens; identical to SEQ ID NO: 34924
  misc_feature 1..146: note = chr13:46189788-46189934
  misc_feature 1..146: note = hyper
  source 1..146: mol_type = genomic DNA

SEQ ID NO: 76013 - DNA, 30 bp, Homo sapiens
  misc_feature 1..30: note = chr13:46424993-46425023
  misc_feature 1..30: note = hyper
  source 1..30: mol_type = genomic DNA
ctccagtacacagagcgcatctaaccagca

SEQ ID NO: 76014 - DNA, 195 bp, Homo sapiens
  misc_feature 1..195: note = chr13:46425360-46425555
  misc_feature 1..195: note = hyper
  source 1..195: mol_type = genomic DNA
ctctcaggttgacagcgtcggggaaagacatcagaccatcaatccagcttttcctgccagctggggaaacaacactcggtcactaacagcacccaatcacctagagagcgagagtgagccgaggcaaacacgccgggttccagacaccgtcccagcccccgagacccgggtttgcaaagggctgcacacgttcgc

SEQ ID NO: 76015 - DNA, 79 bp, Homo sapiens
  misc_feature 1..79: note = chr13:46425575-46425654
  misc_feature 1..79: note = hyper
  source 1..79: mol_type = genomic DNA
cgagaaaggacttgaacctgagcccggtgaaggtaaaatgacacagagactcacctttaggttgtgtgtggggttgacg

SEQ ID NO: 76016 - DNA, 90 bp, Homo sapiens
  misc_feature 1..90: note = chr13:46659250-46659340
  misc_feature 1..90: note = hypo
  source 1..90: mol_type = genomic DNA
ctgggattacaggcacgagccactacacgtactttttcaaagcactttcacactcatttcctttgatatttataacgctttgatatagac

SEQ ID NO: 76017 - DNA, 20 bp, Homo sapiens
  misc_feature 1..20: note = chr13:46660849-46660869
  misc_feature 1..20: note = hypo
  source 1..20: mol_type = genomic DNA
tcctacggctatttatggca

SEQ ID NO: 76018 - DNA, 147 bp, Homo sapiens
  misc_feature 1..147: note = chr13:46661276-46661423
  misc_feature 1..147: note = hypo
  source 1..147: mol_type = genomic DNA
ggtctgtagctgcagcgggcagctgcagctgcgcctggggagcatgaggctgccgccctgccatcacagaagggggcgggacttttacctcctcctggcttctgctggctccgtggagcacacagccccagccgtgcctcccgcatg

SEQ ID NO: 76019 - DNA, 406 bp, Homo sapiens
  misc_feature 1..406: note = chr13:46785697-46786103
  misc_feature 1..406: note = hyper
  source 1..406: mol_type = genomic DNA
attagccccgggacccggctgcacaaaagtgcagccttaaagaatgccagcccatattctagacacccaagtaaagcatcctgtaatcgagagaaaataataaataatagtggtcattgccattaagcataaaaatagtaataacaattgtcaccacggcgttccgtacagcagctgcgcgtggagccggcttctcctccggcccccacggcccgcagcttcccctgcagccccacagtgcgtcggaggaaggcgagggctccgcgcgcgctgcaccgtgggctgggcctgcccctcccggcgcccgcctcgcctcgcctgtcccgcgcccgcctcgcctgtcccgcccccgcgcctgcgcgtcaagtggctgggctggcttagcggaccccggttgctagggtgt

SEQ ID NO: 76020 - DNA, 30 bp, Homo sapiens
  misc_feature 1..30: note = chr13:46896454-46896484
  misc_feature 1..30: note = hypo
  source 1..30: mol_type = genomic DNA
ggtgtgggtaactgtcggggcaactgtgtg

SEQ ID NO: 76021 - DNA, 172 bp, Homo sapiens; identical to SEQ ID NO: 15765
  misc_feature 1..172: note = chr13:46920144-46920316
  misc_feature 1..172: note = hypo
  source 1..172: mol_type = genomic DNA

SEQ ID NO: 76022 - DNA, 21 bp, Homo sapiens
  misc_feature 1..21: note = chr13:46926247-46926268
  misc_feature 1..21: note = hypo
  source 1..21: mol_type = genomic DNA
ccaccacgcccactgcacttt

SEQ ID NO: 76023 - DNA, 599 bp, Homo sapiens
  misc_feature 1..599: note = chr13:46961084-46961683
  misc_feature 1..599: note = hyper
  source 1..599: mol_type = genomic DNA
tctccaaggggtccccgacactgctctgagcgaccctaagatacctgggtgtctctgctgggcacaaacctctctggcgccacttccaccatccaacctctcccgcggccctcccttccctttctccaaccaccctctccaccccgcgccgctcccatctcgcccccggccccgccagcctcacccagccaaacccgagcggtggaacgctgcgctgggtaaacgccgcgcgtcgggtcctccctcgcgcggctccgggcagcgttccgtggccaccgcgctcccggtaacagcagaaaggggagggaggagagctaccgaggaggggacagcgacgccccgacgccgccacgccccccgcctcccacacgggggccaccgtagctctctagaagctcctcagggaagcaaagcgccgttcccgccgcaggcaccgagacgtcgcccagatggaagaaactctggagatgcgcgctcctacaccggtgccgcggcgcccgggcccagcaccacgcacctatgcgcgcctctgccggtcctcctagaaatcccgccctgcctacccgcggcgcgagacgcaacgacgctttcaggggtca

SEQ ID NO: 76024 - DNA, 158 bp, Homo sapiens
  misc_feature 1..158: note = chr13:47043913-47044071
  misc_feature 1..158: note = hypo
  source 1..158: mol_type = genomic DNA
agagacaccatctcaaaaaaaagaaaagaaaaggaaaaataaaaccatgtatttacccatggagtcaccatttccagtgctgtcattcataggtgaggatgatgcaattgacccattaaaagacaagggcttggggccgggcgcggtgggtgactcac

SEQ ID NO: 76025 - DNA, 16 bp, Homo sapiens
  misc_feature 1..16: note = chr13:47526166-47526182
  misc_feature 1..16: note = hypo
  source 1..16: mol_type = genomic DNA
tcgctatcttttaacc

SEQ ID NO: 76026 - DNA, 142 bp, Homo sapiens; identical to SEQ ID NO: 43800
  misc_feature 1..142: note = chr13:47528522-47528664
  misc_feature 1..142: note = hypo
  source 1..142: mol_type = genomic DNA

SEQ ID NO: 76027 - DNA, 30 bp, Homo sapiens
  misc_feature 1..30: note = chr13:47685252-47685282
  misc_feature 1..30: note = hypo
  source 1..30: mol_type = genomic DNA
atcagagtccccttccgtccttatgggacg

SEQ ID NO: 76028 - DNA, 29 bp, Homo sapiens
  misc_feature 1..29: note = chr13:48318948-48318977
  misc_feature 1..29: note = hypo
  source 1..29: mol_type = genomic DNA
ggagttggccgggcgcggtggctcacgcc

SEQ ID NO: 76029 - DNA, 30 bp, Homo sapiens; identical to SEQ ID NO: 15766
  misc_feature 1..30: note = chr13:48667877-48667907
  misc_feature 1..30: note = hypo
  source 1..30: mol_type = genomic DNA

SEQ ID NO: 76030 - DNA, 30 bp, Homo sapiens
  misc_feature 1..30: note = chr13:49254587-49254617
  misc_feature 1..30: note = hypo
  source 1..30: mol_type = genomic DNA
tcacgcagcatgtttcgttttcttcctaac

SEQ ID NO: 76031 - DNA, 809 bp, Homo sapiens
  misc_feature 1..809: note = chr13:49794117-49794926
  misc_feature 1..809: note = hyper
  source 1..809: mol_type = genomic DNA
gcagacatcgctcaccggaccgggtagggctcgtgcgctaagggcgccgggtattccagttagtggagagggaagcgccctggaactgcatgggcccgggagagggcgcgggagcggagcagggccgggccggggcgggccgcggccgtgggcggagactgcgcgcagctagctcgggagcgcctcggagcccaccccgcagagccgcttctcgcgccccgcagcgcagcgcagcgctccgccgtctgacctgccgcgcccgcagcgtgcgggctgggaaaggaggcgctcaccgagagggaccacgcgccaggctcccagcccgacccgggacgcggcggccgcgcggagcacccatgggcagcccctggaacggcagcgacggccccgagggggcgcgggagccgccgtggcccgcgctgccgccttgcgacgagcgccgctgctcgccctttcccctgggggcgctggtgccggtgaccgctgtgtgcctgtgcctgttcgtcgtcggggtgagcggcaacgtggtgaccgtgatgctgatcgggcgctaccgggacatgcggaccaccaccaacttgtacctgggcagcatggccgtgtccgacctactcatcctgctcgggctgccgttcgacctgtaccgcctctggcgctcgcggccctgggtgttcgggccgctgctctgccgcctgtccctctacgtgggcgagggctgcacctacgccacgctgctgcacatgaccgcgctcagcgtcgagcgctacctggccatctgccgcccgctccgcgcccgcgtcttggtcacc

SEQ ID NO: 76032 - DNA, 30 bp, Homo sapiens
  misc_feature 1..30: note = chr13:49877160-49877190
  misc_feature 1..30: note = hypo
  source 1..30: mol_type = genomic DNA
cagaggtgggagccacggtggggcacgcac

SEQ ID NO: 76033 - DNA, 63 bp, Homo sapiens; identical to SEQ ID NO: 43802
  misc_feature 1..63: note = chr13:49922188-49922251
  misc_feature 1..63: note = hypo
  source 1..63: mol_type = genomic DNA

SEQ ID NO: 76034 - DNA, 138 bp, Homo sapiens
  misc_feature 1..138: note = chr13:49922941-49923079
  misc_feature 1..138: note = hypo
  source 1..138: mol_type = genomic DNA
ccaggacttgcctcccgcttaaccacccaccactctttggtcttctccatcacaacaaatctctctgacggcccagcctgcaggctccgcctccagggagaccacgccccgtccctcaccctccgccaggcattcttc

SEQ ID NO: 76035 - DNA, 238 bp, Homo sapiens
  misc_feature 1..238: note = chr13:50070420-50070658
  misc_feature 1..238: note = hyper
  source 1..238: mol_type = genomic DNA
ggccagaggacagggcgcggcccaggccagttccacaggtggctctgactgcccatggtttcgcgcgagtggtgggcacgcttcggtttacctcccccgcgggtgacagcccagtgcttccaccacaaccgatgtcaactctcctagcgcccctccgctcaccggtaaaccaggacagtggaggggcgccctgatgcggtgaggcagggggcggccctgagggaagagctgggtctca

SEQ ID NO: 76036 - DNA, 33 bp, Homo sapiens
  misc_feature 1..33: note = chr13:50070684-50070717
  misc_feature 1..33: note = hyper
  source 1..33: mol_type = genomic DNA
cgtctccccttctccagtcgttccagtcctccc

SEQ ID NO: 76037 - DNA, 21 bp, Homo sapiens
  misc_feature 1..21: note = chr13:50367842-50367863
  misc_feature 1..21: note = hypo
  source 1..21: mol_type = genomic DNA
ataaagagctgctttcggccg

SEQ ID NO: 76038 - DNA, 311 bp, Homo sapiens
  misc_feature 1..311: note = chr13:50704489-50704800
  misc_feature 1..311: note = hyper
  source 1..311: mol_type = genomic DNA
gataagatactccctcgccggctccctccgtgagcggggctgggcgggtgcggaggggcgggcggtgcgcctcgccgagcccggggcgctgaggtcggcaagtcgtcttcggaactggcggcggcgcttctccagtcgacgtggaaaaaaaaatcgtctcaaatagcacccctcggtctgcagccctttaacactggtaaagtagataacaaggaactctgctgaacgagggaaactcagtttagaacgtcccagagtttccaagtttgtcaagcgactgggaatcttggtcgccgcgtggagagctgcgc

SEQ ID NO: 76039 - DNA, 52 bp, Homo sapiens
  misc_feature 1..52: note = chr13:50705047-50705099
  misc_feature 1..52: note = hyper
  source 1..52: mol_type = genomic DNA
caattggctgaatctcgaaataacttttttgatagtccggaaaagaaacatg

SEQ ID NO: 76040 - DNA, 92 bp, Homo sapiens
  misc_feature 1..92: note = chr13:51086819-51086911
  misc_feature 1..92: note = hyper
  source 1..92: mol_type = genomic DNA
tctctgcaatttggccgctcctggacttgttgcagccaggcttcaaagagaaaccaccgcttcctccccgagccccacgccagcctcagagg

SEQ ID NO: 76041 - DNA, 104 bp, Homo sapiens
  misc_feature 1..104: note = chr13:51796701-51796805
  misc_feature 1..104: note = hyper
  source 1..104: mol_type = genomic DNA
gagggtgagccgcgccgggccgggccgcgggcggggggcgctctccgagttgcgcggcggctcctccccggacggggaccctcctgatccgtgcgacgggaccg

SEQ ID NO: 76042 - DNA, 231 bp, Homo sapiens
  misc_feature 1..231: note = chr13:51797015-51797246
  misc_feature 1..231: note = hyper
  source 1..231: mol_type = genomic DNA
tgtttcctccttcctcggggactttcctcctgtagctccggagccccctggagtccggccctggagatcgggagaggaagaaaagcagggtgggacacccgcacctaaaagtctttccgaagtcggctaggaggatggcatttctcgttatatggcttcatcgtgggactttaatctgtgctgccgagtccccctccccgactcctccagtcccgccgaacttcctcacct

SEQ ID NO: 76043 - DNA, 30 bp, Homo sapiens
  misc_feature 1..30: note = chr13:52389910-52389940
  misc_feature 1..30: note = hypo
  source 1..30: mol_type = genomic DNA
ttagtggtcactgttcggtgtcatcctgga

SEQ ID NO: 76044 - DNA, 30 bp, Homo sapiens
  misc_feature 1..30: note = chr13:52390252-52390282
  misc_feature 1..30: note = hypo
  source 1..30: mol_type = genomic DNA
aagctactgctttgacgttgttagatttta

SEQ ID NO: 76045 - DNA, 84 bp, Homo sapiens
  misc_feature 1..84: note = chr13:52532586-52532670
  misc_feature 1..84: note = hypo
  source 1..84: mol_type = genomic DNA
tgcttgtggccaggacgatgagcacgtccatgttggctgacctgtgtctcagagatttgtaggcctgaacgtagaagtaccacc

SEQ ID NO: 76046 - DNA, 35 bp, Homo sapiens
  misc_feature 1..35: note = chr13:52928634-52928669
  misc_feature 1..35: note = hypo
  source 1..35: mol_type = genomic DNA
aagccaaaagactgagcaggcgcaagtcagactgg

SEQ ID NO: 76047 - DNA, 706 bp, Homo sapiens
  misc_feature 1..706: note = chr13:52979745-52980451
  misc_feature 1..706: note = hyper
  source 1..706: mol_type = genomic DNA
tggaagtctacccctcgcgtcgtcagcttaaagccctccttaatgaggaccgtctttaatttaatttaatccttgtatttcatactttttgtatatcagaaaggatttctttttggaaagaaacagtagctcaagacgcgatttttcaaggttctgtggccagtctcagtcactcggcaacatctgagccaaggcagagccaggttcacttaaattcgggactccgaagtgtggagaccaataccccttaaaagcgtcccctggggccgaggcgggtgtggggaggggccgccaccgtccacctgcgccttcaggctgcggtgaggtggcagagtccggaggcatttcccgaccccagaggagcctccaagagtctcgcggcacgggcgcgaacaccaggatgcggagggcgcttcttacctttcgagactgacgggcagcaaccccaggccgtccgggcgcgtggcgaggcggacgggaaggctcaggggcggcgaggtagagcgccaagcatcccgcgtcccagactgcacgccctgaccccgcggcgttcggctcccacagccccgcggggcccgcccccgacggcgtggggagggcgggcgccgggagggcggggggcacacgggaccgggcgtggtcggttcccgccccttctgggcagcgcatcctttcctgccggtccccagctcgccagctgctggac

SEQ ID NO: 76048 - DNA, 36 bp, Homo sapiens; identical to SEQ ID NO: 43806
  misc_feature 1..36: note = chr13:53025686-53025722
  misc_feature 1..36: note = hypo
  source 1..36: mol_type = genomic DNA

SEQ ID NO: 76049 - DNA, 32 bp, Homo sapiens
  misc_feature 1..32: note = chr13:53055615-53055647
  misc_feature 1..32: note = hypo
  source 1..32: mol_type = genomic DNA
attgttggccgggcacggtggctcacgcttgt

SEQ ID NO: 76050 - DNA, 349 bp, Homo sapiens
  misc_feature 1..349: note = chr13:53174056-53174405
  misc_feature 1..349: note = hyper
  source 1..349: mol_type = genomic DNA
ctagtccccagagcccgggctttagggcgcccggatgcaaaccagttttgccgccaaggaacccggacaggcgcgcctcctccccggcctcgcaaggaacaggttaaggagacatttcccactttctctgcccggccctgaacgctcgccgcccctgcccagccgcccactgtctggcagcctgcaagtctccattcagaagcggctccgtgctgcccagcgatggcgccctggcggcgcggaagcccgcggccaaatgacacgacttgggggcaaaggaggacaacagttcccaccaggtaggcactgggggaaggaggccgatgaccctgagattctccagcgaccc

SEQ ID NO: 76051 - DNA, 41 bp, Homo sapiens
  misc_feature 1..41: note = chr13:53174673-53174714
  misc_feature 1..41: note = hyper
  source 1..41: mol_type = genomic DNA
gggtgctttcctacctctgggctccccgagaccctttctga

SEQ ID NO: 76052 - DNA, 458 bp, Homo sapiens
  misc_feature 1..458: note = chr13:53312856-53313314
  misc_feature 1..458: note = hyper
  source 1..458: mol_type = genomic DNA
gacgtgccttccccacggtcgcgccactgcttagtgggagatgagccgagaacggcctttctcggaccgtccactacattctcccctactctacgcttcaatcttctcccgtgaaaccttcacttgcttttctacaacgttgacctaaggcggaaagccgcgtgccagagtgggatgggagaggggagctcacgctgggcccgaggggcccgccggcagccgcgcgcccctcgccggcccgcgctcgggctccccctaggggcaccatgggcgacacgggggtccccgcgcgccgccctctggacttacgtgactgtcgctccccttccagaagtagaaggccccgatggccccaaagagcagcagcacagctcccgaaatgaggaccacggctcccaccttgagcagccgcgcggggctggagggcttcaccgtcagcgtagcgtacgcctgcgggc

SEQ ID NO: 76053 - DNA, 17 bp, Homo sapiens
  misc_feature 1..17: note = chr13:53313512-53313529
  misc_feature 1..17: note = hyper
  source 1..17: mol_type = genomic DNA
cgcagcacagggccttc

SEQ ID NO: 76054 - DNA, 83 bp, Homo sapiens; identical to SEQ ID NO: 1109
  misc_feature 1..83: note = chr13:53313530-53313613
  misc_feature 1..83: note = hyper
  source 1..83: mol_type = genomic DNA

SEQ ID NO: 76055 - DNA, 273 bp, Homo sapiens; identical to SEQ ID NO: 34941
  misc_feature 1..273: note = chr13:53313677-53313950
  misc_feature 1..273: note = hyper
  source 1..273: mol_type = genomic DNA

SEQ ID NO: 76056 - DNA, 30 bp, Homo sapiens
  misc_feature 1..30: note = chr13:53353373-53353403
  misc_feature 1..30: note = hypo
  source 1..30: mol_type = genomic DNA
aactgtaggctgctgcgggagacccacgag

SEQ ID NO: 76057 - DNA, 16 bp, Homo sapiens
  misc_feature 1..16: note = chr13:53419713-53419729
  misc_feature 1..16: note = hyper
  source 1..16: mol_type = genomic DNA
caccgccacagggggc

SEQ ID NO: 76058 - DNA, 291 bp, Homo sapiens
  misc_feature 1..291: note = chr13:53419730-53420021
  misc_feature 1..291: note = hyper
  source 1..291: mol_type = genomic DNA
ccggctcctttccaaaacccggggaggcaccgtagggctgcagcagggaataggggaatgggagtggggggagggttggataagaaacaaacaaaaaacaagtgcgacaggttgtctacctgaatgcacccaccctacccctccagtctcccttcccccagcctgtccgcggagctcggaggggggcgcccagccgaaggaaggcctcacctcggcgtgcgcgccgcggagccgctgctgcccctcgaagtgacaggcgctttccccagtggcgctgccgccctctgagcc

SEQ ID NO: 76059 - DNA, 31 bp, Homo sapiens
  misc_feature 1..31: note = chr13:53421826-53421857
  misc_feature 1..31: note = hyper
  source 1..31: mol_type = genomic DNA
cgccctgcgggaaggccgggctgtggtcatt

SEQ ID NO: 76060 - DNA, 15 bp, Homo sapiens
  misc_feature 1..15: note = chr13:53422237-53422252
  misc_feature 1..15: note = hyper
  source 1..15: mol_type = genomic DNA
agaagctgaccacat

SEQ ID NO: 76061 - DNA, 146 bp, Homo sapiens
  misc_feature 1..146: note = chr13:53422634-53422780
  misc_feature 1..146: note = hyper
  source 1..146: mol_type = genomic DNA
tcagtctcaggctctcggaatcacgctctttgcgagccctgtgcgggagaagtctgcgggtagcagctccgagcctccagcgggctctgaggacgcgcggacccgccctcactctgcgcctctccgtctcttacagaagctgcgcc

SEQ ID NO: 76062 - DNA, 27 bp, Homo sapiens
  misc_feature 1..27: note = chr13:53422781-53422808
  misc_feature 1..27: note = hyper
  source 1..27: mol_type = genomic DNA
cctcgcgccgcctttgcctttatagcc

SEQ ID NO: 76063 - DNA, 76 bp, Homo sapiens; identical to SEQ ID NO: 34946
  misc_feature 1..76: note = chr13:53422809-53422885
  misc_feature 1..76: note = hyper
  source 1..76: mol_type = genomic DNA

SEQ ID NO: 76064 - DNA, 82 bp, Homo sapiens
  misc_feature 1..82: note = chr13:53423116-53423198
  misc_feature 1..82: note = hyper
  source 1..82: mol_type = genomic DNA
agtggctcctgattccgccttcccccagcccctgccaacacacacactctgcattttgcacctctgacgcttccaaaccctt

SEQ ID NO: 76065 - DNA, 360 bp, Homo sapiens
  misc_feature 1..360: note = chr13:53423765-53424125
  misc_feature 1..360: note = hyper
  source 1..360: mol_type = genomic DNA
ctaaacggtgatgggcgctgaattccacacaatacccggctcgtattaaagtgcatttagagaactttttcctcctgatgccttgttccgcctatttagaggattttctttctgttctaatagggccactctgggaagcaacactcgtccggttccagaagaacaaaatcacagcgtgacgttgaaacctggcaggaacgtggggggaacttaaccatctgcttaggaaagtgtggagcttcggcactgccaaaatctgggctgggcggatcctggggctggccgggcgctgcgctgccccacagatagccccctcccatccctgacggccagggagatggagctcggatctgcaacaag

SEQ ID NO: 76066 - DNA, 1249 bp, Homo sapiens
  misc_feature 1..1249: note = chr13:53424759-53426008
  misc_feature 1..1249: note = hyper
  source 1..1249: mol_type = genomic DNA
tccttggggggtacacgcagtcgaaggaactttctattttccttccgagccccgcaacactcccaccccaacctggggctggctggtgacctttagcgcccctaggctaacgtcatctctcctcacccctcttcccccggagacccagacgggaacaggttcagaacttggctggtggacagcggcctcagcgcttccgctggcgtacccagggcaaggtcaggcccgcctggcgctgctgctgccgggcggaggacccggaaggtggggaaagtgggtggaaatggggccggagtcccaaaggaagggatttcagcggtttccgcgagcacagcccggccgcgaatggctgggacccggacctcgcgccagcgccccctgcgcatctgcaccccgcagttctgggctggactcgggagccccgccacgcgctaagtttgggtttttcgcttggccagagattcggaactacttgcaatttctactcaaagtgcttccgcgtcagcatgctcattctcaaggctgaaataaaccaaggcgtgcttgaaagtgggaaaaggaaaggggagtaggggcaggcaaaagccaggaggcgggaggaggggtgtagggtggctggtagcaggtctaaagtgttttttccgcggccaggccctcgtcgatcggaagtagccacgacggcggcggcgccgggaggctgagagctgggagccggggagcccgggaagggagccgcgagcctccagccgccaccggcgcgcacaggtctttccgtgccggcggtggaggtgtgaaggcacgcgaacaccgtgagctccgggccggcagcggacagccactcgattatggaaatacgatttaaaatagcacatcaacgtccgcagcaactccccgggaaggaaaatatgtccggggaggtggcgctggagaggagtaggggaaagggaggggagctcgcccgcccgggtgctgatcaggcctcacaaaagccgctcgaatcgccttgttatcataccaaaaggtctgggcaggcccaaaggagcccctttctctcggttttagcaacttcgccggcaactgtctcgcaatcttgagaacaaacacagctccacaatggccggcgttttctcggaatgcaaatgttgcgggctccgcaaagctgggtttctgttaccgagcctaatgccggcattgtgaaactcgcgtgcaaacaccaagattgacatgggcgtcacgtgatggattaggg

SEQ ID NO: 76067 - DNA, 18 bp, Homo sapiens
  misc_feature 1..18: note = chr13:53427247-53427265
  misc_feature 1..18: note = hypo
  source 1..18: mol_type = genomic DNA
gcccggcctgtctgtatc

SEQ ID NO: 76068 - DNA, 76 bp, Homo sapiens
  misc_feature 1..76: note = chr13:53580906-53580982
  misc_feature 1..76: note = hypo
  source 1..76: mol_type = genomic DNA
cgctgggattacgggcgtgagccaccgcgcccggccggtgctaagcattatttctaaagttcgtttctttaaccca

SEQ ID NO: 76069 - DNA, 40 bp, Homo sapiens
  misc_feature 1..40: note = chr13:53775398-53775438
  misc_feature 1..40: note = hyper
  source 1..40: mol_type = genomic DNA
cgggcgccaaccggcagatgcgctgcgccctctactggca

SEQ ID NO: 76070 - DNA, 30 bp, Homo sapiens; identical to SEQ ID NO: 43808
  misc_feature 1..30: note = chr13:56180149-56180179
  misc_feature 1..30: note = hypo
  source 1..30: mol_type = genomic DNA

SEQ ID NO: 76071 - DNA, 39 bp, Homo sapiens
  misc_feature 1..39: note = chr13:57484515-57484554
  misc_feature 1..39: note = hypo
  source 1..39: mol_type = genomic DNA
agcgcctggagctgccggctccgccggaggcagccggtg

SEQ ID NO: 76072 - DNA, 30 bp, Homo sapiens
  misc_feature 1..30: note = chr13:57861015-57861045
  misc_feature 1..30: note = hypo
  source 1..30: mol_type = genomic DNA
tgtcagctgcctgctcggaatgcggggcca

SEQ ID NO: 76073 - DNA, 881 bp, Homo sapiens
  misc_feature 1..881: note = chr13:58203571-58204452
  misc_feature 1..881: note = hyper
  source 1..881: mol_type = genomic DNA
ttgattgctgttgctcgcggcatgttcgtaccagcgcgggcagaaacgggctcacgagcgccctcgaattcacacacactcaccgaaatacacatctcagcccgtggaagcgcattcacacacacccacgtacactcctccgcacctcattcagatgggtccacgcggagtcagggctgcgcttcccttggcatgggcgtgtgtgcggcgagggcgtgtgtgcgtgcgtgtgtgagagtgtgtgtagagaaaccctttaggcagaccgcagctacgttattctgcaagcatactgcgattcccgattccgtgtatgtaggaccacaaaaaaattaaatcgctgttaaacttttttttgtaaattctcttttccgaaggaaggcgctggaagagctactcccggtggttaaaggcccgggagacctggtggcgaatcctggggcgcgtccgctttggcggagcgctgggctccgctagccggactggttccccatctaactgatctaatcaatgactccgaagagccggggctcctggccccgcccccgccatcctcttctccgcctcccattggacgcgggccgagaaggcagggccttgctcctcgctcggattggctgacagggaatcagtatcaatgtttaagcggcggcgtgaggtgaatagagtcagtcagcaagagacgctggggagagagcagggatcgcgagcccggcggatgcggcagcggcggaaggcggctggggagacgctactccaactgttgaattgaattttcacctttcctttcatccgctgctttgcttgcggagatggatttatttgctttgaaatccgcatatctttctcagactgtggggtgatcccggcagacaccagac

SEQ ID NO: 76074 - DNA, 63 bp, Homo sapiens; identical to SEQ ID NO: 34953
  misc_feature 1..63: note = chr13:58204937-58205000
  misc_feature 1..63: note = hyper
  source 1..63: mol_type = genomic DNA

SEQ ID NO: 76075 - DNA, 437 bp, Homo sapiens
  misc_feature 1..437: note = chr13:58205795-58206232
  misc_feature 1..437: note = hyper
  source 1..437: mol_type = genomic DNA
ggggagagccttttccgaggaagagagggaggagcctggtggggagaggaaactacaaatcgggacactagttctttacgctgcatttcctcccctccctttggctgctcggaaaggagagagaggaaaaaaaaaatacgcttggctggtagatgcagtccgccgccgccgctgcctcagccagcaatgcaagattagatctctaaatgcagcaaaacactgcctgaaaacagaccggcccgcgcagcaagcagacatttcacggtgcgctggggaagcttcaaaatatatctgtgactctgtcttcgttgctcttcatccccatcaatttcatcacgggaggcgagcagcaagtaagaatttcactttcggatctgcctagagacacacctccctgctccctcccccactcgatgtgaagagtattccggagtctc

SEQ ID NO: 76076 - DNA, 320 bp, Homo sapiens
  misc_feature 1..320: note = chr13:58206452-58206772
  misc_feature 1..320: note = hyper
  source 1..320: mol_type = genomic DNA
cgcagcttctcacccagtgcggatgctgtagatcaacaggttcagggaacttgagcagaataaggagagaccaccgggtgccgcagctcgggtgcagagggaaaaaaggacccatagacttgtggctcgcgtcgcgcgcgcacgctgcgccagggccccaggctggcgcgcactccctctctggctcctccagtccgattgctcctgcccccaccttacaggtctgggatgtacctttccatctgttgctgctttcttctatgggcccctgccctcactctcaagaacctcaactactccgtgccggaggagcaaggggc

SEQ ID NO: 76077 - DNA, 151 bp, Homo sapiens
  misc_feature 1..151: note = chr13:58206861-58207012
  misc_feature 1..151: note = hyper
  source 1..151: mol_type = genomic DNA
cgggtagctaccgggtgctggagaactccgcaccgcacctgctggacgtggacgcagacagcgggctcctctacaccaagcagcgcatcgaccgcgagtccctgtgccgccacaatgccaagtgccagctgtccctcgaggtgttcgccaa

SEQ ID NO: 76078 - DNA, 86 bp, Homo sapiens
  misc_feature 1..86: note = chr13:58207315-58207401
  misc_feature 1..86: note = hyper
  source 1..86: mol_type = genomic DNA
gctgactgccctggacggtggcgagcctccacgttccgccaccgtacagatcaacgtgaaggtgattgactccaacgacaacagcc

SEQ ID NO: 76079 - DNA, 247 bp, Homo sapiens; identical to SEQ ID NO: 11627
  misc_feature 1..247: note = chr13:58207567-58207814
  misc_feature 1..247: note = hyper
  source 1..247: mol_type = genomic DNA

SEQ ID NO: 76080 - DNA, 1155 bp, Homo sapiens
  misc_feature 1..1155: note = chr13:58207891-58209046
  misc_feature 1..1155: note = hyper
  source 1..1155: mol_type = genomic DNA
cgggcccgggggttccgtccccttcaagcttgaggagaactacgacaacttctacacggtggtgactgaccgcccgctggaccgcgagacacaagacgagtacaacgtgaccatcgtggcgcgggacgggggctctcctcccctcaactccaccaagtcgttcgcgatcaagattctagacgagaacgacaacccgcctcggttcaccaaagggctctacgtgcttcaggtgcacgagaacaacatcccgggagagtacctgggctctgtgctcgcccaggatcccgacctgggccagaacggcaccgtatcctactctatcctgccctcgcacatcggcgacgtgtctatctacacctatgtgtctgtgaatcccacgaacggggccatctacgccctgcgctcctttaacttcgagcagaccaaggcttttgagttcaaggtgcttgctaaggactcgggggcgcccgcgcacttggagagcaacgccacggtgagggtgacagtgctagacgtgaatgacaacgcgccagtgatcgtgctccccacgctgcagaacgacaccgcggagctgcaggtgccgcgcaacgctggcctgggctatctggtgagcactgtgcgcgccctagacagcgacttcggcgagagcgggcgtctcacctacgagatcgtggacggcaacgacgaccacctgtttgagatcgacccgtccagcggcgagatccgcacgctgcaccctttctgggaggacgtgacgcccgtggtggagctggtggtgaaggtgaccgaccacggcaagcctaccctgtccgcagtggccaagctcatcatccgctcggtgagcggatcccttcccgagggggtaccacgggtgaatggcgagcagcaccactgggacatgtcgctgccgctcatcgtgactctgagcactatctccatcatcctcctagcggccatgatcaccatcgccgtcaagtgcaagcgcgagaacaaggagatccgcacttacaactgccgcatcgccgagtacagccacccgcagctgggtgggggcaagggcaagaagaagaagatcaacaaaaatgatatcatgctggtgcagagcgaagtggaggagaggaacgccatgaacgtcatgaacgtggtgagcagccc

SEQ ID NO: 76081 - DNA, 30 bp, Homo sapiens
  misc_feature 1..30: note = chr13:59118670-59118700
  misc_feature 1..30: note = hypo
  source 1..30: mol_type = genomic DNA
tttctactgcacaagcggggtgcaattccc

SEQ ID NO: 76082 - DNA, 30 bp, Homo sapiens; identical to SEQ ID NO: 43809
  misc_feature 1..30: note = chr13:60614880-60614910
  misc_feature 1..30: note = hypo
  source 1..30: mol_type = genomic DNA

SEQ ID NO: 76083 - DNA, 23 bp, Homo sapiens
  misc_feature 1..23: note = chr13:60710775-60710798
  misc_feature 1..23: note = hypo
  source 1..23: mol_type = genomic DNA
tataaacaattctgccgggcgcg

SEQ ID NO: 76084 - DNA, 21 bp, Homo sapiens
  misc_feature 1..21: note = chr13:60860933-60860954
  misc_feature 1..21: note = hypo
  source 1..21: mol_type = genomic DNA
tatgcaaatgccagccgttgg

SEQ ID NO: 76085 - DNA, 38 bp, Homo sapiens
  misc_feature 1..38: note = chr13:61791028-61791066
  misc_feature 1..38: note = hypo
  source 1..38: mol_type = genomic DNA
gaggattatattacttccaacatcgcagggggtgtaca

SEQ ID NO: 76086 - DNA, 30 bp, Homo sapiens
  misc_feature 1..30: note = chr13:61988304-61988334
  misc_feature 1..30: note = hyper
  source 1..30: mol_type = genomic DNA
actttctatcccctccgcccccgccttccc

SEQ ID NO: 76087 - DNA, 110 bp, Homo sapiens
  misc_feature 1..110: note = chr13:61989219-61989329
  misc_feature 1..110: note = hyper
  source 1..110: mol_type = genomic DNA
cgggtgccaggtcgccgggcaccagctcactcccagggcctgtgagctgcgcgcattccctcggccgcgcattccctgggaggctgcagtcagagcgctcttgaagggag

SEQ ID NO: 76088 - DNA, 30 bp, Homo sapiens
  misc_feature 1..30: note = chr13:61989554-61989584
  misc_feature 1..30: note = hyper
  source 1..30: mol_type = genomic DNA
ggttgggcacagtagcgcttacctaccagc

SEQ ID NO: 76089 - DNA, 94 bp, Homo sapiens
  misc_feature 1..94: note = chr13:64311539-64311633
  misc_feature 1..94: note = hypo
  source 1..94: mol_type = genomic DNA
actttggaatgttcacggcacataatacaatcggtatatttactgattgtgtattggtgaattggtgctggctctcagttcccgcctcgcggcg

SEQ ID NO: 76090 - DNA, 30 bp, Homo sapiens
  misc_feature 1..30: note = chr13:65360861-65360891
  misc_feature 1..30: note = hypo
  source 1..30: mol_type = genomic DNA
ggaaaagccagcctgcggcagactgcacca

SEQ ID NO: 76091 - DNA, 30 bp, Homo sapiens
  misc_feature 1..30: note = chr13:65499779-65499809
  misc_feature 1..30: note = hypo
  source 1..30: mol_type = genomic DNA
cctgggctgtgacagcgccaatcccgcttc

SEQ ID NO: 76092 - DNA, 48 bp, Homo sapiens
  misc_feature 1..48: note = chr13:65904937-65904985
  misc_feature 1..48: note = hypo
  source 1..48: mol_type = genomic DNA
gggttctcctccgatcgccctggccaaactctgcgctgttcctccagc

SEQ ID NO: 76093 - DNA, 20 bp, Homo sapiens
  misc_feature 1..20: note = chr13:65937832-65937852
  misc_feature 1..20: note = hypo
  source 1..20: mol_type = genomic DNA
gttgctttatttgtccggtg

SEQ ID NO: 76094 - DNA, 303 bp, Homo sapiens
  misc_feature 1..303: note = chr13:67804228-67804531
  misc_feature 1..303: note = hyper
  source 1..303: mol_type = genomic DNA
cataccatttccatccgatgccaatactgcttaagtctctaacttcttgtaggaaacgtcagagttgcggtgatgatgattctctgacagctatccgggtgacagttgcccgaaaaattcctaatcggttatctcttgcgtgcttcagagactctgaggcgctcctttccgtctcgcgtgctctccctctctcccttcccctctgcccctctctccttctccctctcctctctctgaactgaatttcttgatataactctcaataagcccagagggagggcgtgactgcccaggccccgcccc

SEQ ID NO: 76095 - DNA, 100 bp, Homo sapiens; identical to SEQ ID NO: 34961
  misc_feature 1..100: note = chr13:67804644-67804744
  misc_feature 1..100: note = hyper
  source 1..100: mol_type = genomic DNA

SEQ ID NO: 76096 - DNA, 23 bp, Homo sapiens
  misc_feature 1..23: note = chr13:67804745-67804768
  misc_feature 1..23: note = hyper
  source 1..23: mol_type = genomic DNA
cgctggcgctccccaggcccggg

SEQ ID NO: 76097 - DNA, 423 bp, Homo sapiens
  misc_feature 1..423: note = chr13:67804863-67805286
  misc_feature 1..423: note = hyper
  source 1..423: mol_type = genomic DNA
cgcggatccggggaaccagggccaccgctgcgggcggatgggggtcaccgaggcggctcgtctccaggcgcacacttcgcacatctctttgctaagtgaaggggccaaaatgcacagatgggggagtctacccaggaacagaggcgcgagacgtatagccacccctgggttgggagcacgagccagcagatccccggagcgcgttaaacggacaacatgcccggtgctgcaaatagaggcttttgctggcagggacattggaaagaagggcggagagggagtacagcgaaaggtggggaccgcagaatttggaatctctgcggagaccggaaagaaaattaatcggagcacttcctacatgcagagccacggaaactgccttggaaagagaaagtggcagcgtctgggtcccctcggtcagcc

SEQ ID NO: 76098 - DNA, 59 bp, Homo sapiens
  misc_feature 1..59: note = chr13:67805379-67805438
  misc_feature 1..59: note = hyper
  source 1..59: mol_type = genomic DNA
cgcgcctggaaacctgagcccggactcgcggctgctgcaaaacccgcttccagcccacc

SEQ ID NO: 76099 - DNA, 51 bp, Homo sapiens; identical to SEQ ID NO: 43812
  misc_feature 1..51: note = chr13:68343951-68344002
  misc_feature 1..51: note = hypo
  source 1..51: mol_type = genomic DNA

SEQ ID NO: 76100 - DNA, 73 bp, Homo sapiens
  misc_feature 1..73: note = chr13:68488541-68488614
  misc_feature 1..73: note = hypo
  source 1..73: mol_type = genomic DNA
tcccctacaaaattgcgaataatattgaagggtgtacaacccctgctactttagcagccgcatcttgctagaa

SEQ ID NO: 76101 - DNA, 83 bp, Homo sapiens
  misc_feature 1..83: note = chr13:69619398-69619481
  misc_feature 1..83: note = hypo
  source 1..83: mol_type = genomic DNA
cactacagcatcatacaggtagtttcattgccctaaaaatcctgcgttctgtctcttcatccctctgtcgcttaacttctcac

SEQ ID NO: 76102 - DNA, 208 bp, Homo sapiens
  misc_feature 1..208: note = chr13:70681570-70681778
  misc_feature 1..208: note = hyper
  source 1..208: mol_type = genomic DNA
agaggaggaagaggacggggaggacgatgaagaggaagaggaggaaggcttcttccagaaagtgctcacaccgcttctctcttggcttttgagcaggcgactctggctgggtccccagtgctcaaagctgccactgccgtcctgttgcaggcagcctccccccgccgggccgccggtggaaggagacgggtggctgaagagtttccag

SEQ ID NO: 76103 - DNA, 432 bp, Homo sapiens
  misc_feature 1..432: note = chr13:70681866-70682298
  misc_feature 1..432: note = hyper
  source 1..432: mol_type = genomic DNA
cgcaggagtaggctggtcagcaggtgggggaggacagcggggcccgggggcggaggaagaggcgggatgcgccctctgcacccctagagccagaagacgctaggtgggctgcgcgctctgccaggcgaaggctggagcgcagacggcaaagccgcgcgtttcagccgtggtcgggtccgcaggacctgggcgtggggacaccaccaggcaggagcagaggcaggactgggacgccaaaagctgagaatcctcgatgcccgcgcgagagccccgtgttatggcgaggtgggacaacccttaggctggagatgcgcgagggagggaggtctgagcgctccgaagctccggaggcggctgcagctggatacacctcactgggatgcgcttgtggcagagccttagtagggaaggtggtggcgttcttgtccttgc

SEQ ID NO: 76104 - DNA, 30 bp, Homo sapiens
  misc_feature 1..30: note = chr13:71068811-71068841
  misc_feature 1..30: note = hypo
  source 1..30: mol_type = genomic DNA
cattttacttaacaacgggaaccttgagaa

SEQ ID NO: 76105 - DNA, 30 bp, Homo sapiens
  misc_feature 1..30: note = chr13:71158391-71158421
  misc_feature 1..30: note = hypo
  source 1..30: mol_type = genomic DNA
ttcagtttgtattttcgattgagaatggtt

SEQ ID NO: 76106 - DNA, 30 bp, Homo sapiens
  misc_feature 1..30: note = chr13:72408836-72408866
  misc_feature 1..30: note = hypo
  source 1..30: mol_type = genomic DNA
tacttaaattggtttcgttttcccatttca

SEQ ID NO: 76107 - DNA, 93 bp, Homo sapiens
  misc_feature 1..93: note = chr13:72438470-72438563
  misc_feature 1..93: note = hyper
  source 1..93: mol_type = genomic DNA
aattcgaatctttttcgtttcacagccttcccgggcactaacagagaagaagtctttctccatggaaaaaagagctagcgctttttcaaccca

SEQ ID NO: 76108 - DNA, 259 bp, Homo sapiens
  misc_feature 1..259: note = chr13:72438769-72439028
  misc_feature 1..259: note = hyper
  source 1..259: mol_type = genomic DNA
gaacttttgcctctgcgcttccttgcagagaaccgtggggacaaagcggcgctgtgaaagggggtggaatgatcatctctaccccgaaactgacaagttgccccactcccgccccctcttggtagatcctcccccactgagcgttcattagcataaaactggtctggctggggaccggtcccgccgcctcctccgtgcgcgcgctttgctgggctggggaagccaaggcacagagtatcagggccgctgagcatcccag

SEQ ID NO: 76109 - DNA, 30 bp, Homo sapiens
  misc_feature 1..30: note = chr13:72439538-72439568
  misc_feature 1..30: note = hyper
  source 1..30: mol_type = genomic DNA
gctccccgagccctgcggagcaggtcacga

SEQ ID NO: 76110 - DNA, 113 bp, Homo sapiens
  misc_feature 1..113: note = chr13:72439959-72440072
  misc_feature 1..113: note = hyper
  source 1..113: mol_type = genomic DNA
gcgcagagcgagcggcgccgggaaaggagcgagggcaggcgagcaggctggtgggaaggggcgcgggcggcgggggctatcccccccgactcaccttgcgttggtgcagtcat

SEQ ID NO: 76111 - DNA, 37 bp, Homo sapiens
  misc_feature 1..37: note = chr13:72440704-72440741
  misc_feature 1..37: note = hyper
  source 1..37: mol_type = genomic DNA
gccgccgccgccgccgccgaagcgatgggctccgggc

SEQ ID NO: 76112 - DNA, 191 bp, Homo sapiens
  misc_feature 1..191: note = chr13:72441499-72441690
  misc_feature 1..191: note = hyper
  source 1..191: mol_type = genomic DNA
tcggagcagagactccgagagcgcgagacactggagagggagcgtgcgaggaaaggaggaggggagggggaggatacggaaagaaactgtgggagggacggagaggaaaagccggggacacagaagtggcgatcggaaaaggagagggagatcatctacttctcttctactactaccgttagattgcatgt

SEQ ID NO: 76113 - DNA, 29 bp, Homo sapiens
  misc_feature 1..29: note = chr13:72469378-72469407
  misc_feature 1..29: note = hypo
  source 1..29: mol_type = genomic DNA
acataatacatttcacgcattttttaaaa

SEQ ID NO: 76114 - DNA, 21 bp, Homo sapiens
  misc_feature 1..21: note = chr13:73253695-73253716
  misc_feature 1..21: note = hypo
  source 1..21: mol_type = genomic DNA
aggcgcagtggctcacgcctg

SEQ ID NO: 76115 - DNA, 30 bp, Homo sapiens
  misc_feature 1..30: note = chr13:73545132-73545162
  misc_feature 1..30: note = hypo
  source 1..30: mol_type = genomic DNA
tattccatgtatatacggttgttttgctat

SEQ ID NO: 76116 - DNA, 30 bp, Homo sapiens
  misc_feature 1..30: note = chr13:73619593-73619623
  misc_feature 1..30: note = hypo
  source 1..30: mol_type = genomic DNA
tccctcatacatacacgctgtgggcaattt

SEQ ID NO: 76117 - DNA, 30 bp, Homo sapiens
  misc_feature 1..30: note = chr13:73636816-73636846
  misc_feature 1..30: note = hypo
  source 1..30: mol_type = genomic DNA
tagaaggagtaaccccgatttggagaaacg

SEQ ID NO: 76118 - DNA, 30 bp, Homo sapiens
  misc_feature 1..30: note = chr13:73653014-73653044
  misc_feature 1..30: note = hypo
  source 1..30: mol_type = genomic DNA
ggaaacatgcaagtccggagcatcctgtag

SEQ ID NO: 76119 - DNA, 207 bp, Homo sapiens
  misc_feature 1..207: note = chr13:73664304-73664511
  misc_feature 1..207: note = hypo
  source 1..207: mol_type = genomic DNA
aagcccatcagaatccgggaattaaggaaacaagacatgaagggaactctcagctcatctagagggctccccaggctccctttagggcgggagtctgttccaaggtgcagccagcctgagcctgccaagagtagcaggtgagccctgttaagaccatggtaagtggattcacctgcccagagagagatgcgccgatcttgactgtct

SEQ ID NO: 76120 - DNA, 153 bp, Homo sapiens
  misc_feature 1..153: note = chr13:74707261-74707414
  misc_feature 1..153: note = hyper
  source 1..153: mol_type = genomic DNA
agttacacatcattacgaccagagacaataatgaatgtagcaccaggagcactattcatgccagcagtgtcatctccgccttaaccccttcccctccactctctccagcgcgcacacacagcccacacggtcccggtgcggagctattcatcc

SEQ ID NO: 76121 - DNA, 43 bp, Homo sapiens; identical to SEQ ID NO: 34971
  misc_feature 1..43: note = chr13:74707625-74707668
  misc_feature 1..43: note = hyper
  source 1..43: mol_type = genomic DNA

SEQ ID NO: 76122 - DNA, 30 bp, Homo sapiens; identical to SEQ ID NO: 43813
  misc_feature 1..30: note = chr13:74987640-74987670
  misc_feature 1..30: note = hypo
  source 1..30: mol_type = genomic DNA

SEQ ID NO: 76123 - DNA, 211 bp, Homo sapiens
  misc_feature 1..211: note = chr13:75149904-75150115
  misc_feature 1..211: note = hyper
  source 1..211: mol_type = genomic DNA
acaattagatgctggcgcggcccggagaggctcgcggatgcctggccgcgcgcctccgcgggacgtcagcgcccgcggcacgatctgctgctgtcactatcagtatccggcaggagcccgcccgccccggcccggccccaggccgtggaggaggggggagggtgcggcgcaggaagctgaagataagtctccaaatcgggctaagctggga

SEQ ID NO: 76124 - DNA, 261 bp, Homo sapiens
  misc_feature 1..261: note = chr13:77459367-77459628
  misc_feature 1..261: note = hyper
  source 1..261: mol_type = genomic DNA
tgctgctggcaaaggcgcaggtgcccgtggagctgcacgccaccatgtggaagcccgactcggacagcttgtcgaaggcctgctccaggaagttgaacttgaggtaatagcgcgaggtgtagcgctccgggggacggtcggggtcccggctttcgttcagggtgtccccaaacacctccttggccagcgacgtctttccgcaaacggtgatgcgcgccactcgccggaacttggcgtccgcctgcgcgtcccgcccgatgg

SEQ ID NO: 76125 - DNA, 105 bp, Homo sapiens
  misc_feature 1..105: note = chr13:77553641-77553746
  misc_feature 1..105: note = hypo
  source 1..105: mol_type = genomic DNA
tcgctggagatccagcggagtgtgcggagggaggcgtgttggataccttttaaaaatgagaagccccaggccgggcgcggtgactcacgactgtaagtcgcggcc

SEQ ID NO: 76126 - DNA, 120 bp, Homo sapiens
  misc_feature 1..120: note = chr13:77935896-77936016
  misc_feature 1..120: note = hypo
  source 1..120: mol_type = genomic DNA
gatgggactacaggcccacgccaccatgcgtggctaatttaaaaacatgttttttttatttgtttgtttgttttttgatagagatgggggtctatgttgtccaggctgatctcgaactcc

SEQ ID NO: 76127 - DNA, 23 bp, Homo sapiens
  misc_feature 1..23: note = chr13:78081911-78081934
  misc_feature 1..23: note = hypo
  source 1..23: mol_type = genomic DNA
attacaggcgtaactcatagtaa

SEQ ID NO: 76128 - DNA, 161 bp, Homo sapiens
  misc_feature 1..161: note = chr13:78271464-78271625
  misc_feature 1..161: note = hyper
  source 1..161: mol_type = genomic DNA
aagggagcaaaccagcgggccggtggtgcactactcgagggccagcacctgcagctgcttctttgggaaccccctggtccccgcaaccgcctcagagacccgcgcagttcactgtcccaccaagcggcaggaggaggtgcttgtggcgggaaagttcaggc

SEQ ID NO: 76129 - DNA, 338 bp, Homo sapiens
  misc_feature 1..338: note = chr13:78271894-78272232
  misc_feature 1..338: note = hyper
  source 1..338: mol_type = genomic DNA
ggtgctgatgcgaaccgccggctcggcctcagcccgcgcgtggtcggccccccaggccggggcgacagggaaggagccgtagcctccccgtggcccgaggagccggcgcggcggcgcgcactccccggcggccgcggcgccctcggggcccacgatgatggcggagcaggtgaaatgcgcctcggcaggggtcagctctggagcgggctccgggccggtggtgaacgcggagctggaggtgaagaagctgcaggagctggtgcgcaagctggagaagcagaacgagcagctgcggagtcgagcggccagcgcggccgccgccccgcacctgctgctgc

SEQ ID NO: 76130 - DNA, 44 bp, Homo sapiens
  misc_feature 1..44: note = chr13:78273206-78273250
  misc_feature 1..44: note = hyper
  source 1..44: mol_type = genomic DNA
tttgaattttgcagtcgtgtgcccttttgcgttgcattttcatt

SEQ ID NO: 76131 - DNA, 30 bp, Homo sapiens
  misc_feature 1..30: note = chr13:78335732-78335762
  misc_feature 1..30: note = hypo
  source 1..30: mol_type = genomic DNA
gaaaaatgtgtcaggcgtatgtgcacacgc

SEQ ID NO: 76132 - DNA, 1223 bp, Homo sapiens
  misc_feature 1..1223: note = chr13:78492801-78494024
  misc_feature 1..1223: note = hyper
  source 1..1223: mol_type = genomic DNA
ctgcccgagccaagtcgctgcaaacgctaataccgcccgcagcctcttcgccagtatccacgctcaaaagtaactcaagtttgcgcgccagtgggaaacttggcgctcatgactcgccagcgcgggtcgaaactccttcctgatgccctctcagctgtttttcttcccccgcgtggccaggaggggtaaataatatgcagtggggcggggcgttctggaaggggtgtgccagggagggaatgatgggggtcccaggcaaagctccgaactctttcacgtaacgggaggaatacagacacgtcttagttaagcgtgcgtgggaaccgcggaattaaggcacctagaggccaagggcttgtgtcaagctctgcattttgccccgcaggggaacctctataccccgcgattgaactcgaaagactcctcccggcggatgaaagccgctactccctggctggctgagctacagctcccgcagcgcgcccaggagtgcgccggagattcggaaacccgcagagacttctcaagtcagcaggaacttggaaaccgctgttccctccaaacggcttcaaacactcgcgctccttcctttacccaacctaattttaatttgccctctctataggcttaatttttatttttttaaaatcccaaactagtaagccaaaccgaagccccagaataaggttcaatcaatgattttaattcaacaccaagcccgaatgtttacctctcggatctgacaaaccagatgcagagcgacgaatggagaccaccttcccgggaggcggaacccagctgggttccagcctgctctgggagaggagcacgcctcccttgagctgcaggcgggtccggctctgacgaaacgctgcgagaatgccagacagtgtagcctccaccgtttgctcggggtctctgctgccatcagacaagtacttttattcattcatcccttcccatcaatcaccgccagactcctcccgcgccttccgaccccgctgcaacctttccccttgggcgatgcctggacagcatcagtagtagttgcccgagggaggggggcagtcctcgtccggggacaggtcccaaaaggctgtttatttgttagagttctacgctcttcaaatgaacccaaatcaagggcaagttatcacgcaccatgtgacacccggcagctccagactagaacaaggctctgcactgaacgtgataattgaact

SEQ ID NO: 76133 - DNA, 16 bp, Homo sapiens
  misc_feature 1..16: note = chr13:78567988-78568004
  misc_feature 1..16: note = hypo
  source 1..16: mol_type = genomic DNA
gcgcctggcatgtagt

SEQ ID NO: 76134 - DNA, 149 bp, Homo sapiens
  misc_feature 1..149: note = chr13:79160947-79161096
  misc_feature 1..149: note = hyper
  source 1..149: mol_type = genomic DNA
tgtgctgctcactagcgacccctctaggtcttagagagaagagagctcatgcagaagagtactcgggaccattgccgggacgagaagcccatcaggctgactgctccattagggagcatcgcaagctcggggtgcgaaagcttccccgc

SEQ ID NO: 76135 - DNA, 43 bp, Homo sapiens
  misc_feature 1..43: note = chr13:79169673-79169716
  misc_feature 1..43: note = hyper
  source 1..43: mol_type = genomic DNA
ggactgggacacgggcgcttcttctctccagcccttggttcgc

SEQ ID NO: 76136 - DNA, 265 bp, Homo sapiens; identical to SEQ ID NO: 34975
  misc_feature 1..265: note = chr13:79169849-79170114
  misc_feature 1..265: note = hyper
  source 1..265: mol_type = genomic DNA

SEQ ID NO: 76137 - DNA, 37 bp, Homo sapiens; identical to SEQ ID NO: 1112
  misc_feature 1..37: note = chr13:79170347-79170384
  misc_feature 1..37: note = hyper
  source 1..37: mol_type = genomic DNA

SEQ ID NO: 76138 - DNA, 777 bp, Homo sapiens
  misc_feature 1..777: note = chr13:79170467-79171244
  misc_feature 1..777: note = hyper
  source 1..777: mol_type = genomic DNA
cgccacccggagaaccgcggctggtgcccttgaaggccctgggatgcctgggttgggtgggtgagtgaacgagaaccctgagtgagtgaggggagggcgggtcccctcctggcttcaaattcaacccaatcagctctgccgatggtttgaaactgcacacgccgacccacccgccccgaagtctgaaagttatgccctggagacctgcgagctgcggagtgcagctggagagggagctgccccacgaggaggcctccagaataactcccggagtcggaacagcgctgggctgctgaagtttgcagcctccggatccgcgccccgccctgcagatccaccggatttcggggagggaatcggggggctgcccgtcctcccgtaaagctgacttgacaacaattacgaaagtttttaattagctccttgttataattcattttatttccagaactctccgaccataaattattcaaagagtaagccaacccgagcggggcggccgcgcgccttccccacgcgcgccgggctggctctggccgctcagctcacccgatgccccgtgagccagccccgcgccagaagccgcggtggcaggaaggtttgatcaaacattaaataacgtaatgtttgcgacaaggcttatctcacaagtggaaaagaggacctcgcgagaattagaattcggctgctattttaaaaaatcaattaagcttgcggtcttttttgaaacagctcgaaaggactgcgtggctatcatcgtggcgctaagactgagat

SEQ ID NO: 76139 - DNA, 220 bp, Homo sapiens
  misc_feature 1..220: note = chr13:79171448-79171668
  misc_feature 1..220: note = hyper
  source 1..220: mol_type = genomic DNA
gctatcaggagaggccggggcggcggggcagaggcagagggcagggatcgctgagtgagtcctgcgggcttggggcgccctgttctctcacgtgcgctgccacgtgtaggaggaactggaccgaagtagtctcagtatcacaagaaaacaaaaatcgatacaatcacggcagtgggtgcctacagtttatttatgaaactgtaatcgaagttgagagcaa

SEQ ID NO: 76140 - DNA, 349 bp, Homo sapiens; identical to SEQ ID NO: 34978
  misc_feature 1..349: note = chr13:79175595-79175944
  misc_feature 1..349: note = hyper
  source 1..349: mol_type = genomic DNA

SEQ ID NO: 76141 - DNA, 49 bp, Homo sapiens; identical to SEQ ID NO: 1115
  misc_feature 1..49: note = chr13:79176077-79176126
  misc_feature 1..49: note = hyper
  source 1..49: mol_type = genomic DNA

SEQ ID NO: 76142 - DNA, 145 bp, Homo sapiens; identical to SEQ ID NO: 1116
  misc_feature 1..145: note = chr13:79176276-79176421
  misc_feature 1..145: note = hyper
  source 1..145: mol_type = genomic DNA

SEQ ID NO: 76143 - DNA, 577 bp, Homo sapiens; identical to SEQ ID NO: 34981
  misc_feature 1..577: note = chr13:79176608-79177185
  misc_feature 1..577: note = hyper
  source 1..577: mol_type = genomic DNA

SEQ ID NO: 76144 - DNA, 318 bp, Homo sapiens; identical to SEQ ID NO: 1119
  misc_feature 1..318: note = chr13:79177305-79177623
  misc_feature 1..318: note = hyper
  source 1..318: mol_type = genomic DNA

SEQ ID NO: 76145 - DNA, 378 bp, Homo sapiens
  misc_feature 1..378: note = chr13:79177885-79178263
  misc_feature 1..378: note = hyper
  source 1..378: mol_type = genomic DNA
cgtgggagccgctcttatagtgaccaccagcaaggacagcgcaggtgatgcacctgtagctacccgggcatgcgcactgcccgcctcacctttcccaccgtggtctggaaagatcagaaggtccagctattgtctaagggtgggcaccttttagaataaaaaagacgagatgcgcgcacgcccctctatgtgtgtgtgtgtgtgtgtgtgtgcgtgcgtgtgtgtgtatgtgtgtatgtttcttctccctgatagcaagccttgaatatatgagcattacttaggcattcctcctcttcgggatgcctaacaagctgttgtataatgtatacagctggacatttctacgttaaattatgcccgcgcattcctctgtat

SEQ ID NO: 76146 - DNA, 216 bp, Homo sapiens
  misc_feature 1..216: note = chr13:79179534-79179750
  misc_feature 1..216: note = hyper
  source 1..216: mol_type = genomic DNA
tcaacggggagtggacgatgagcaggacgtcgctagagggaaagagtgagtcctacggtagtcatcacaccgggagtccgggcttaacctagtccttcctgacacccctggtggccgttccctgcgctctctcttgacgggaaagaaaaggcccccacagagggtgagggcctggaacctgcccctcccctctcaaggaagcgctggtctttaggg

SEQ ID NO: 76147 - DNA, 740 bp, Homo sapiens
  misc_feature 1..740: note = chr13:79182684-79183424
  misc_feature 1..740: note = hyper
  source 1..740: mol_type = genomic DNA
caggaggagcagagacgtccccgccccgcctgggccctgccgcattcaaagctggaagaaggcgctgatcagagaaggggcttccaggtcctgggttagaacaacaacaaacaaacgaaactccacaacagacacgcctgcccatgaccccacgcaaggacataggaagttctgtcgccttcctgctccgcggatagccgcctgccgtctgctgccaccagaacgcacggacgctcggggtggaggtagtcaatgggcagcaggggacccccagcccccacaagcgcggctccgaggacctggaagcgggtgcctgtcgctctccgcaggctccgctctgcctccaggagcaagatccccaaaagggtctggaagctgtggagaaaaccgcaaggacgcgagtccaaacccgagagtgcggagctgggtcctgtcacccggctccaacgctcgccggcgccgccgccagccgcccctccttcccgccgcccgcacaaatcaaagccccttgcgagggactgggaaatagttgccttgtcatgtaacacattgccctgatttattataaaattttaacgaaatcatgcatattttaacagcctttaatcactgcatgaaaatttaattcatgaactgtagcgcgtttaaataaatgaagtgttaattcattaggattaattaatttgttaaaggattgtgtgcaaggttaaggtggaaagaaaactctttgttggtttcgc

SEQ ID NO: 76148 - DNA, 150 bp, Homo sapiens
  misc_feature 1..150: note = chr13:80015563-80015713
  misc_feature 1..150: note = hypo
  source 1..150: mol_type = genomic DNA
agtttcccattggaccggcctgaaagcagtgtcctaatgagactacatccttgctaagctttttcctcctgcactctcttacctcccaccccaacttctccgagagcattttctcaactaatcatttaaataagaatccccattttgggc

SEQ ID NO: 76149 - DNA, 65 bp, Homo sapiens
  misc_feature 1..65: note = chr13:80914079-80914144
  misc_feature 1..65: note = hyper
  source 1..65: mol_type = genomic DNA
gacccaggctgaccacgaagaacggaagagagagagctgcacttccgaaccgcagagacccggcg

SEQ ID NO: 76150 - DNA, 32 bp, Homo sapiens
  misc_feature 1..32: note = chr13:80914581-80914613
  misc_feature 1..32: note = hyper
  source 1..32: mol_type = genomic DNA
cgggcgaggcaggtccgcggggagcgccccgg

SEQ ID NO: 76151 - DNA, 41 bp, Homo sapiens
  misc_feature 1..41: note = chr13:80915541-80915582
  misc_feature 1..41: note = hyper
  source 1..41: mol_type = genomic DNA
tcacactccagcgcccgccagcgctccgagccgcaggaggc

SEQ ID NO: 76152 - DNA, 30 bp, Homo sapiens
  misc_feature 1..30: note = chr13:81279635-81279665
  misc_feature 1..30: note = hypo
  source 1..30: mol_type = genomic DNA
cgacccccatcacagcgtgggggaggcaac

SEQ ID NO: 76153 - DNA, 19 bp, Homo sapiens
  misc_feature 1..19: note = chr13:82399492-82399511
  misc_feature 1..19: note = hypo
  source 1..19: mol_type = genomic DNA
actccgtctaaaaaaaaag

SEQ ID NO: 76154 - DNA, 30 bp, Homo sapiens
  misc_feature 1..30: note = chr13:82646591-82646621
  misc_feature 1..30: note = hypo
  source 1..30: mol_type = genomic DNA
agagttgggcgagtgcgctccagcattcac

SEQ ID NO: 76155 - DNA, 30 bp, Homo sapiens
  misc_feature 1..30: note = chr13:82797186-82797216
  misc_feature 1..30: note = hypo
  source 1..30: mol_type = genomic DNA
gggcatggtggctcacgcctgtaatcccag

SEQ ID NO: 76156 - DNA, 17 bp, Homo sapiens
  misc_feature 1..17: note = chr13:84382511-84382528
  misc_feature 1..17: note = hypo
  source 1..17: mol_type = genomic DNA
gggtgcggtggcttacg

SEQ ID NO: 76157 - DNA, 196 bp, Homo sapiens; identical to SEQ ID NO: 34986
  misc_feature 1..196: note = chr13:84455560-84455756
  misc_feature 1..196: note = hyper
  source 1..196: mol_type = genomic DNA

SEQ ID NO: 76158 - DNA, 369 bp, Homo sapiens
  misc_feature 1..369: note = chr13:84456111-84456480
  misc_feature 1..369: note = hyper
  source 1..369: mol_type = genomic DNA
ctgtgcatggctgtgcgtcggactgaccttgcctctctgatacaaagcagggttttccgcggcttctgttgttgaggctgctggtggagttcttgctgtggttgcgggttgcccagaagtccccccgaggtgctgtccagttcccccggtgctgaaatcacgcccgaccgaaggactcacgctgcccagccaatggcgctggaaaatttccgcaatcgctgcgttttgtggttgtccatccttttcctttcctccccttcggtcctcttaaggcttttttttttcttttctgtgctctcgctctcgcttactagctcttcttttcctgttctccttctctttcttctgctctttcggaattacgtggag

SEQ ID NO: 76159 - DNA, 77 bp, Homo sapiens
  misc_feature 1..77: note = chr13:84456706-84456783
  misc_feature 1..77: note = hyper
  source 1..77: mol_type = genomic DNA
ggcataaaaggctgacgatctacatagatgcttattttaaatggattatttgattatttttgcgtgctggaaacttt

SEQ ID NO: 76160 - DNA, 30 bp, Homo sapiens
  misc_feature 1..30: note = chr13:85406594-85406624
  misc_feature 1..30: note = hypo
  source 1..30: mol_type = genomic DNA
ctagtagccagaccccgcactccctcaccc

SEQ ID NO: 76161 - DNA, 24 bp, Homo sapiens
  misc_feature 1..24: note = chr13:87738892-87738916
  misc_feature 1..24: note = hypo
  source 1..24: mol_type = genomic DNA
tttatttttttgagacggagtctc

SEQ ID NO: 76162 - DNA, 489 bp, Homo sapiens
  misc_feature 1..489: note = chr13:88323342-88323831
  misc_feature 1..489: note = hyper
  source 1..489: mol_type = genomic DNA
ttaacagtaagtacacgagacagcagcattctgaatggcaggaggaaggcaggcgatcagcacagggctggaatcatctgttcctgaccaccagcaagcctggcactgccggggttatttccactcctccctttcccaatccgagaattgcacagtcccacgctcgaattacacacatggtccaagacttctctctcttcctacgaatgtgacatccaagggggccccggttgcgccgccctagcccagggacgccttcgccctcggctgccatctatcggccaccgagcgcccgcttcgccccgggcccatcatgtctgctgcagcttggctcgcaccagaggcgcgacaataaacaagtgcactggactgggccctgcacccgctccggagcagctgtctcagagacccggtgttgcttaccgcgttgccacctcctcggcgcccgggaggaagacgcaactttctcggagttttttttagagccac

SEQ ID NO: 76163 - DNA, 302 bp, Homo sapiens
  misc_feature 1..302: note = chr13:88323867-88324169
  misc_feature 1..302: note = hyper
  source 1..302: mol_type = genomic DNA
cggttgctgcccgccccccccttcccccagaaaccccaaaggatgtcggtgatagagagttccaactaatgacgattgtgcgccgcatctggggaagggatacagaaaaaaaccctgcaaacaccgtgaggatgaaactgccaaagggatgcaagagcctctcaaatactaattaggggccgcggcggcggcgggctcggcgcggagacagcgtcggcgggatcccagcgcggtggtcgccgctgcgctggggggcggaggacagcgcaggagctgcagccgccgccttcgctggagcagcc

SEQ ID NO: 76164 - DNA, 349 bp, Homo sapiens
  misc_feature 1..349: note = chr13:88324170-88324519
  misc_feature 1..349: note = hyper
  source 1..349: mol_type = genomic DNA
aggggccggtgccacctttgctcgccccctcactaccatgtacagtgtgcgctgcaagaagaaggcgggagatgcatgcacacccccgcgacccgctccctctggctcgtcccccggcgtgcgccactgaccaggggggaatgtggtgaagacggcgaggaggagagccgaggggggaggggagggccggccggcgcgaacccaggccggagggtgcgaggagccagaggaggctggagggggcggcggccacagctgggtcggagaaagttgccccctatgcagatggcaactgtgagtacccctgtgggggggagggtgcagcgaaggctgccagggaccccgcgat

SEQ ID NO: 76165 - DNA, 53 bp, Homo sapiens
  misc_feature 1..53: note = chr13:88324920-88324973
  misc_feature 1..53: note = hyper
  source 1..53: mol_type = genomic DNA
gggcgcctctttcctccagcctctgggactgcgctgctcgcagtctcctcgcc

SEQ ID NO: 76166 - DNA, 863 bp, Homo sapiens
  misc_feature 1..863: note = chr13:88325198-88326061
  misc_feature 1..863: note = hyper
  source 1..863: mol_type = genomic DNA
ctccccttcttcctccgttttcccttccttctctttggggcggggtgggggagggggagcctcgcgtcctggaactccgggtgcttctgcctgggctgctgcttgagcagctgtgcccggagcctccggtgcggcctgggtgctgggctccagtccgagaggctccatgctgcttactgcagggacgtacagggcggtgatccagtatctaaattctttgggagaaaatgaatagttcccccgcccccgccctccaggaaaaaaaaaaatctgagaatctgagaatgttcagcgcacccgcgaatttgcatcggaggtgcgtttccccgtcagaatgtcagcctccccaggctcattcaactttattttctcaaatttttggtctcctttgctagcaaggaggagggggaagggagtgggttgagaggaagctcttcgacccttgctaactagaactgaattaaagttgtaaacgctggagtttaatactggctggactgaatttgcaatgggctttcagatggggtgggaggtgaatgggggcggggaagcacagggagggagggggaggggacccaacctcgctgaatggatgtgcggatttgatccagcggagaactgaaatttcaaggtaaacgttttgctttcactggggtggggatgtttttgccgcttttaagccgggagacgtttaccgttgcgttgggaggtcggggatacttgcgaggtttatgcactgtggttccaattcatctcgacacgtctgggtggccacacgtgaatgattcgcaggcacactgatacatgtgcgtttgaatgcaggggcgtttaataacgcgggctggagtcgacttggggatcag

SEQ ID NO: 76167 - DNA, 396 bp, Homo sapiens
  misc_feature 1..396: note = chr13:88326312-88326708
  misc_feature 1..396: note = hyper
  source 1..396: mol_type = genomic DNA
tccttcctttaagagtgctgctgttgatcagaagtaggaagtggaaggaagccttcaaggggacaaaaagagagcaagaaaaaaaagggggagggggtcatattgattcctgtgggagatgaaattcggatattaaacaactgacctaagtcgcttacagttcttcctcccacctttctattttgcctcttaatcagcccaggcgtcctttccctgagattaaaaaaaagagagaggggagcgttaacaattaaatgtaataagcaactccaaagatggggatgctgtcgaggtggtagttccgtgcaaaccttgctattaccgttgcaaatagacgcggagcccaaggtaagggaggctttcgtgctgatccttggtgtactgattcccggtaag

SEQ ID NO: 76168 - DNA, 188 bp, Homo sapiens; identical to SEQ ID NO: 34994
  misc_feature 1..188: note = chr13:88326936-88327124
  misc_feature 1..188: note = hyper
  source 1..188: mol_type = genomic DNA

SEQ ID NO: 76169 - DNA, 32 bp, Homo sapiens
  misc_feature 1..32: note = chr13:89253759-89253791
  misc_feature 1..32: note = hypo
  source 1..32: mol_type = genomic DNA
gcgtgagccaccgcgcccggcctatttattaa

SEQ ID NO: 76170 - DNA, 27 bp, Homo sapiens
  misc_feature 1..27: note = chr13:90047527-90047554
  misc_feature 1..27: note = hypo
  source 1..27: mol_type = genomic DNA
ccacaacaggccaggcgcggtggctca

SEQ ID NO: 76171 - DNA, 101 bp, Homo sapiens
  misc_feature 1..101: note = chr13:90685501-90685602
  misc_feature 1..101: note = hypo
  source 1..101: mol_type = genomic DNA
gctgtgtgcagtggctggacccttgactctctcactcacactcccctcaccgctctgcaccaagttttcaggagccacttggctcccggctcacccttggt

SEQ ID NO: 76172 - DNA, 30 bp, Homo sapiens; identical to SEQ ID NO: 43817
  misc_feature 1..30: note = chr13:91948489-91948519
  misc_feature 1..30: note = hypo
  source 1..30: mol_type = genomic DNA

SEQ ID NO: 76173 - DNA, 87 bp, Homo sapiens
  misc_feature 1..87: note = chr13:92050679-92050766
  misc_feature 1..87: note = hyper
  source 1..87: mol_type = genomic DNA
tgggagagcgaggtccgggtttccttctatttatttgcatcgatgtcgctccgagtcttcagcactgggccgcgtatgacagcatct

SEQ ID NO: 76174 - DNA, 425 bp, Homo sapiens
  misc_feature 1..425: note = chr13:92050975-92051400
  misc_feature 1..425: note = hyper
  source 1..425: mol_type = genomic DNA
cagtggtggccagagcggatgcttgcgggctccctgcggctccactagttttcttcgccccgcccagccgcccactcttctcggctagggaagaagaccagagggtgctcagctggaaaactctggtgtctcagcttagggcctcctccgggaagagctaactgctcccaggtgaagccggtgcccgcgggcggtccgtacaccccgcagccggctcgcaccgctcgagagcctcggccgctgtgtcttccacgtctgcagctcagccagggcgcgcagggcgagtggggtccactggcgggtaaaggggaccaggacggcgaggatggacgcacagacctggcccgtgggctttcgctgcctcctccttctggccctggttgggtccgcccgcagcgagggcgtgcagacctgcgaagaagttc

SEQ ID NO: 76175 - DNA, 113 bp, Homo sapiens; identical to SEQ ID NO: 11658
  misc_feature 1..113: note = chr13:92051401-92051514
  misc_feature 1..113: note = hyper
  source 1..113: mol_type = genomic DNA

SEQ ID NO: 76176 - DNA, 30 bp, Homo sapiens
  misc_feature 1..30: note = chr13:92345893-92345923
  misc_feature 1..30: note = hypo
  source 1..30: mol_type = genomic DNA
actgccaaggcctggcgctcactaagcctt

SEQ ID NO: 76177 - DNA, 30 bp, Homo sapiens
  misc_feature 1..30: note = chr13:92857981-92858011
  misc_feature 1..30: note = hypo
  source 1..30: mol_type = genomic DNA
tttggaacagtgatacgtttataaaacaac

SEQ ID NO: 76178 - DNA, 95 bp, Homo sapiens
  misc_feature 1..95: note = chr13:93879208-93879303
  misc_feature 1..95: note = hyper
  source 1..95: mol_type = genomic DNA
catccccaagaacctcgagctcacaccaacagacacacgcgcgcatacacactcgctctcgcttgtccatctccctcccgggggagccggcgcgc

SEQ ID NO: 76179 - DNA, 472 bp, Homo sapiens
  misc_feature 1..472: note = chr13:93879304-93879776
  misc_feature 1..472: note = hyper
  source 1..472: mol_type = genomic DNA
ctcccacctttgccgcacactccggcgagccgagcccgcagcgctccaggattctgcggctcggaactcggattgcagctctgaacccccatggtggttttttaaacacttcttttccttctcttcctcgttttgattgcaccgtttccatctgggggctagaggagcaaggcagcagccttcccagccagcccttgttggcttgccatcgtccatctggcttataaaagtttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcaccatgccttcttggatcggggctgtgattcttcccctcttggggctgctgctctccctccccgccgggg

SEQ ID NO: 76180 - DNA, 299 bp, Homo sapiens
  misc_feature 1..299: note = chr13:93879918-93880217
  misc_feature 1..299: note = hyper
  source 1..299: mol_type = genomic DNA
cgtcccactggccgcccggcgtccccttccttccccctgttgctgagttggtgctcactttctgccaccgctatgggactccgcgtctccgtgttgggcggcggatgctcctgcggcttcttcggcgggggaaggtgtgcgtctccgccgcctcattgtgtgcacacgcgggagcaccctggctcccgcctcccgctgctctcgcgcccttctaccccttagttgatggctcaggcccggctggccagggagcccgggtcactccggggcggctgcaaggcgcagacggagagccgagc

SEQ ID NO: 76181 - DNA, 205 bp, Homo sapiens; identical to SEQ ID NO: 35001
  misc_feature 1..205: note = chr13:93880533-93880738
  misc_feature 1..205: note = hyper
  source 1..205: mol_type = genomic DNA

SEQ ID NO: 76182 - DNA, 49 bp, Homo sapiens; identical to SEQ ID NO: 35002
  misc_feature 1..49: note = chr13:93880793-93880842
  misc_feature 1..49: note = hyper
  source 1..49: mol_type = genomic DNA

SEQ ID NO: 76183 - DNA, 183 bp, Homo sapiens; identical to SEQ ID NO: 35003
  misc_feature 1..183: note = chr13:93880843-93881026
  misc_feature 1..183: note = hyper
  source 1..183: mol_type = genomic DNA

SEQ ID NO: 76184 - DNA, 79 bp, Homo sapiens
  misc_feature 1..79: note = chr13:95201260-95201339
  misc_feature 1..79: note = hyper
  source 1..79: mol_type = genomic DNA
gcagaccctggccaacgttctttagtctgatgcgtcggggagctgtaaagctgccatccttcaccggtgggcaagtaac

SEQ ID NO: 76185 - DNA, 36 bp, Homo sapiens
  misc_feature 1..36: note = chr13:95201626-95201662
  misc_feature 1..36: note = hyper
  source 1..36: mol_type = genomic DNA
gtcgttcgcgtcttccggcgccgagggtgcctctgg

SEQ ID NO: 76186 - DNA, 21 bp, Homo sapiens
  misc_feature 1..21: note = chr13:95201891-95201912
  misc_feature 1..21: note = hyper
  source 1..21: mol_type = genomic DNA
tttaaaagtagctgccgaaac

SEQ ID NO: 76187 - DNA, 30 bp, Homo sapiens
  misc_feature 1..30: note = chr13:95202314-95202344
  misc_feature 1..30: note = hyper
  source 1..30: mol_type = genomic DNA
gtagccccttcccttcgatctgcccctgcc

SEQ ID NO: 76188 - DNA, 81 bp, Homo sapiens
  misc_feature 1..81: note = chr13:95354293-95354374
  misc_feature 1..81: note = hyper
  source 1..81: mol_type = genomic DNA
gtgtgcatatgagagcggagagacagcgacctggaggccatgggtgggggcgggtggtgaagctgccgaagcctacacata

SEQ ID NO: 76189 - DNA, 56 bp, Homo sapiens
  misc_feature 1..56: note = chr13:95355963-95356019
  misc_feature 1..56: note = hyper
  source 1..56: mol_type = genomic DNA
ctgtctcaggctctccgtgcgtcctttcactcgtcttcacccggccagtctatgca

SEQ ID NO: 76190 - DNA, 1528 bp, Homo sapiens
  misc_feature 1..1528: note = chr13:95357026-95358554
  misc_feature 1..1528: note = hyper
  source 1..1528: mol_type = genomic DNA
tttcctccagtcaagcgtgagtgatggggcggccgcgcaagggcaacggagtccagcggacaaagcttgcagagaggggcagtggcccggaggcaagggtggcggtggggggggtggggggatgggtcacaaaagtagagcaactgagcttgctgcctagcggtgccacttccctgctctgcgctaaggctatcgtcgaaggcccagagacaccttgaccctggaaacccaatccagcacgtcctgcctccccacaaatatccctcaccccaaatcgctgtgcgttttgtctcctcaaagcgactcccaatggatttggatttattcagatagaactcttcggaagtttttcagatttttcaatttcaagaatttgcatgttttaagtgaagctgaaaccgcgaaggctcaggttacactttaaaatatgcaaggcttccgtgcggccccgacatttggtaaggctcaattgcttaagaaaaaagaaaaaaaaaagaacattgctttgagaatttggggtgccccccccccacttttgtcacaattcagagcttcattccctccggccgtccaggacgtcgagagagcggctggccagagctcagccccggcgcattcgcagggacgtgtcagctgggcaggctataatttgcattattccattaagttaggagcagcgctgataacgactggaaagttcgacggctgggtgggcccgcgacccgcaggcctggcgagcaaccatcgaaaataaaacaattgctgtccttggcggcaaaggcctctatggacgcctccagggcagcgcagggaaccaaagggcaccccagatctctgcgggttcgcgccttgcctcgtgggggacaggaggttctctgtcccatgaggttcagtcaaggacaaggagccgggaggggaaaggggcaggagccaaggagagaaacctgaaagaggcaaactttaaatatatcgtaattctttaagggggtgggctctgtgtttctttgcaacttcacagtctcaccatcctcggctttggagtggatttggcagtgaggacaaggacggaacgccggtaggggagtagttgcttgtctcttgtttattcttctcctcttttccagcggcccagataggctgaaggcaaaactctcagcaagggggaagcgaccatcctgcgtggacctttctcccaggggtgggatgatgaaaaaagaaatcctcctggggaagcccctaggtatcccccagcccctacctttattaggaggcccgggtttcccccattaaacttatattcattcattcattcattcattcattcgttcattcattcataccacgactattcagtgagcacctaccatgtgccagacacagtattagactctcaaaaacgcggcataaatggaaactaggccctgaagccagagcctcaggactggctcccgggaatgtttgaagatcatcgcgtatcttggaattgccaggcttcctgctccacagattccagcgctgggcaaatgga

SEQ ID NO: 76191 - DNA, 787 bp, Homo sapiens
  misc_feature 1..787: note = chr13:95359626-95360413
  misc_feature 1..787: note = hyper
  source 1..787: mol_type = genomic DNA
ttaataaagtttggacggctccctcggcctccgctgggccgcgggcgcaagaaagacgcggaccctcgaggcggacgagttgcgggaacttcgcttgcctggaggacacggcggcccaggcggccgggagcgccggcgccgagccgcgctctgattggctggcgcgaccgtccctatctgctccggggagagtggaatcttctctccatcttctgcgccccgagcctggggtgagagggagatccgcggtgctttctcctatcttcttgggggagggggaggaggaaattgtcaagggaagtaacaatcgcggccagcaaccctgctctcccaaagccaccccctcgcgcgacagcgtccccagcaccagttcttactgcttacacagcgcaattccacctgtttgcacaaagcccgaagcaacatgcctggccccttggatacgaggcttgcttcaagttttgggacaacggtgaataccaaagaaattgcatcatggctttaaaaaaaaccttgaaaagaaacgaaaatagaagaataaaaggaagggaaagaagaaagatggaaggaaggaaggagagagaaggaaagaaagaaaaatggagaaacagggagagagacggagatagataaagagatggagatagagatcgcgagccagcagcagctctctgcccaatcacagcgctgcatttgtgggccactttcagacgcttacaccacccacccccgggcctttctctacgccctcttgccccggagccgctccccccgctccaacccctta

SEQ ID NO: 76192 - DNA, 30 bp, Homo sapiens
  misc_feature 1..30: note = chr13:95360897-95360927
  misc_feature 1..30: note = hyper
  source 1..30: mol_type = genomic DNA
ttagttttgcataatcgctcagaaccatat

SEQ ID NO: 76193 - DNA, 644 bp, Homo sapiens
  misc_feature 1..644: note = chr13:95362808-95363452
  misc_feature 1..644: note = hyper
  source 1..644: mol_type = genomic DNA
acaaaaggccagattcgagccggtcactggtcaagaatggatctggttgggagttctgcttgagagaacagagatctgcaaagttcaaatagtacaaacagggaggcgaggctgctcagagccatcccactcccagaaacgaatgacacaagcagcttttcccgtgtgccagccatttcagacctcacatttgaacagcgtgcatgcaacacggaccgggagggggttgggggttggggggctgaggggcgaggaagaagaatgagaaacaaaaacaaaaccgaccatgaaacttccaacaaaactggaaaggccaacatgtcaaaaagttactcctccacctccgtgggtcaaaacgcaacaggttccgaagtgcaaagcaaacgccaactgctgccgcacacaaccgcctgctttcgagttggctgccgaagtgcgggtctgaaatgatcctgcgaattcacaggcctgctcgcccgcgcccttgcgcgcttggccactcctgccccgcctggcctctctgcctctacctggcacctatacattctatgtacatacaaaccgggcccccggtcgcgggagggcgcacggggaggccgcagcgctcgtacctatacatatgtacacgtgtgcacaccggtcct

SEQ ID NO: 76194 - DNA, 467 bp, Homo sapiens; identical to SEQ ID NO: 35010
  misc_feature 1..467: note = chr13:95363493-95363960
  misc_feature 1..467: note = hyper
  source 1..467: mol_type = genomic DNA

SEQ ID NO: 76195 - DNA, 227 bp, Homo sapiens
  misc_feature 1..227: note = chr13:95364064-95364291
  misc_feature 1..227: note = hyper
  source 1..227: mol_type = genomic DNA
cgcggccggtacttgtagtcggggtgctccttcatgtgcatggcgcgtagacgcttggcctcgtcgatgaacggccgcttctccgactctgtgagcagtttccactcggcgcccaagcgcttgctgatctccgagttgtgcatcttggggttctcctgggccatcttgcgccgctgagcccgcgaccacaccatgaaggcgttcatgggccgcttgacgtggtccac

SEQ ID NO: 76196 - DNA, 346 bp, Homo sapiens
  misc_feature 1..346: note = chr13:95364329-95364675
  misc_feature 1..346: note = hyper
  source 1..346: mol_type = genomic DNA
cgccgcctcccgggccctcgccctcggcccggaggaaatcaatgttggctgcccgcggagacccgctcggccggccggggctcgtcgcgccccggcgtcgctcccgccccggaggagggggctgggggaccagcccagggccacgccgcgccccgggccgccttagtgtctccggccgagcgctcgagcaggttgtctctgggacactctaacttctcggcggtgccccctccccgcggcggcagtttgccctttacgttctttgggtccttcgtctgcagtggcgtttgctggtgagctccccgcaggtagcggcggccgggcagagcgctcctcctcctcggtc

SEQ ID NO: 76197 - DNA, 781 bp, Homo sapiens
  misc_feature 1..781: note = chr13:95364676-95365457
  misc_feature 1..781: note = hyper
  source 1..781: mol_type = genomic DNA
ttctctcttaaatgcaaagcgtccccaaaagttgcgtcgcggagactcctcgaagttgagccgaggagcccgccgccgcgtgctgccaagtgccaaagggggctctcagcggctggagtgtttgggttctcctcggtgactttctcatttgacagaagcagatgggggtggggaaggcggggaggtggccctggaggaggaagaggagggggaggcggaggagtgtccaggcgtgccacgagaacgcagagcgcagcaatggatataaatacaaatacagcagcaccagcctgtcttcttggctccgggcagggtgcgccgatgggaaacccccaatcggctgggtgattttttttttttggaggggggagctgtcccccgcagcacctgcctctcgagtcttcctctcccgctgctggactgacgggtggggcgaggaaggagggtggatgaggcttgagcaagcgttggtcgcccggcctcagaggaagttctcccggctcgccgaggagccgcgtccggccgtcccctgggccatgccggctctgttcgctccgagccccttcaggcgcgcctgccgacttagggctcccggagctcgccggccgcggagggcagcgcagcctccacgcggcgccgcaggcctggcaccggccgcgtccccgcctcgctcttctcggcagccgcctggcacttgcaactaacttcgcccaagtttcctgcgccgcggcgcccctctcggcgcgctcctgggagcgtgcgcccgcgagtccgccgcgcc

SEQ ID NO: 76198 - DNA, 279 bp, Homo sapiens
  misc_feature 1..279: note = chr13:95365497-95365776
  misc_feature 1..279: note = hyper
  source 1..279: mol_type = genomic DNA
cggcgcaggggcggaggtgctgcaggagagttaaggaaaacgggccatcacctcagttcgcaggtccgcgctgtggcacctcccgctctccccactcccgcggcgcagggggccccttcccagcccaggccgccctctgcaccggctcaggtgagtgtggctacctgcatgtgtgcgcgcccggagccggcactgggtgtgcatgtccagccgcggctgtgtgtgtatatctgggggcctgcggaggaggtggagcccaggactcggggagggaggagg

SEQ ID NO: 76199 - DNA, 30 bp, Homo sapiens
  misc_feature 1..30: note = chr13:95451825-95451855
  misc_feature 1..30: note = hypo
  source 1..30: mol_type = genomic DNA
gcatataacccagtacggttttgaatgtgg

SEQ ID NO: 76200 - DNA, 23 bp, Homo sapiens
  misc_feature 1..23: note = chr13:95476305-95476328
  misc_feature 1..23: note = hypo
  source 1..23: mol_type = genomic DNA
ttaaaaattcttggccgggcacg

SEQ ID NO: 76201 - DNA, 545 bp, Homo sapiens
  misc_feature 1..545: note = chr13:95619761-95620306
  misc_feature 1..545: note = hyper
  source 1..545: mol_type = genomic DNA
cttactgcagtgcagcgtttatgacacttgaaaacagattggagagtgggttttgctcgggcgacttgattgtctttcaagttggcgttaagagttttcaacaggtctccttccctgccagccgggaccccgggggtccctcggagcagggcgggtgggaccgctcggcctccttctctcgcccgcacgggcgccgccgcagacccggagcaggcacccggcggccgccgcgtgggctgcagcttagcctcctctgcgggcgcccggcagggctgcgcggccgagactcggggcgccggcgccggggcggccgggagctctgtcatttggcaactccctgcagactgatgacacggcgctttccatggtcgagccccacaaagtgtagggctgcggggcgcacctggctgggctcctaattacccggcctgggacgcacggggcagccgcggagggtggcgcctggggtcgggccggggtccccttcgccgcagtcccgcccacccgcagcctccgaggggtcccggccagggcgttctccacac

SEQ ID NO: 76202 - DNA, 475 bp, Homo sapiens; identical to SEQ ID NO: 11674
  misc_feature 1..475: note = chr13:95620307-95620782
  misc_feature 1..475: note = hyper
  source 1..475: mol_type = genomic DNA

SEQ ID NO: 76203 - DNA, 221 bp, Homo sapiens; identical to SEQ ID NO: 35017
  misc_feature 1..221: note = chr13:95620853-95621074
  misc_feature 1..221: note = hyper
  source 1..221: mol_type = genomic DNA

SEQ ID NO: 76204 - DNA, 355 bp, Homo sapiens
  misc_feature 1..355: note = chr13:95655055-95655410
  misc_feature 1..355: note = hyper
  source 1..355: mol_type = genomic DNA
tcaggactttagacccggtggctaccacgtggccatggctagctgtgtccacacggcccctccgaagcgccttggccccagctgcactctcctcgcccccttcctcccagtgggaacgagccagccagcgagccctctccccacgggtggcgcccgcacccctccttgcccccgggccccggcctgtgatcgctttccagggggcaggcgagctcccgggccggcggcagagggcgggcgcctgtgatccgtggccagggagcgcgtgcgcgccgagcatctgggggcgccctcctgtgatcccccgccaggcccagctctgtggcagaggccgtacactcggcctcccgcccgg

SEQ ID NO: 76205 - DNA, 135 bp, Homo sapiens
  misc_feature 1..135: note = chr13:95711256-95711391
  misc_feature 1..135: note = hypo
  source 1..135: mol_type = genomic DNA
tagaaaatatcagggcgcagaagcatggagtaatatcgtgttgtgagacttttgtttctgtgcgtgtgtgcgcacctgcacaagcccacactaaatcatgttgcaaagcagagttctgatcggggactgcgccag

SEQ ID NO: 76206 - DNA, 70 bp, Homo sapiens
  misc_feature 1..70: note = chr13:95718405-95718475
  misc_feature 1..70: note = hypo
  source 1..70: mol_type = genomic DNA
atcaaatcacggcatcgagccttggcatatgccatcgtgcctttcacatgcatttcgacctgctgaaatc

SEQ ID NO: 76207 - DNA, 30 bp, Homo sapiens
  misc_feature 1..30: note = chr13:95725531-95725561
  misc_feature 1..30: note = hypo
  source 1..30: mol_type = genomic DNA
ccaaaccaacctgcccggcatccagagcta

SEQ ID NO: 76208 - DNA, 85 bp, Homo sapiens
  misc_feature 1..85: note = chr13:95775589-95775674
  misc_feature 1..85: note = hypo
  source 1..85: mol_type = genomic DNA
atgcttgtttgatgtcgctctggagtgttttttgtttttttgcgggggacgaagtctcactctgttgcccaggctgaagcacact

SEQ ID NO: 76209 - DNA, 30 bp, Homo sapiens
  misc_feature 1..30: note = chr13:95780731-95780761
  misc_feature 1..30: note = hypo
  source 1..30: mol_type = genomic DNA
ctcctatgcacagggcgtctgcaagtcctt

SEQ ID NO: 76210 - DNA, 50 bp, Homo sapiens
  misc_feature 1..50: note = chr13:95843472-95843522
  misc_feature 1..50: note = hypo
  source 1..50: mol_type = genomic DNA
aaatttacctggaaacgacttaatggtcacatatccgaataatcacaaat

SEQ ID NO: 76211 - DNA, 73 bp, Homo sapiens
  misc_feature 1..73: note = chr13:95858839-95858912
  misc_feature 1..73: note = hypo
  source 1..73: mol_type = genomic DNA
gaagaagagggtaaccgtcagccgcacagccccatacagcgtcactgccacgaacacgcggctggctgtgatc

SEQ ID NO: 76212 - DNA, 30 bp, Homo sapiens
  misc_feature 1..30: note = chr13:95870024-95870054
  misc_feature 1..30: note = hypo
  source 1..30: mol_type = genomic DNA
agttcatcaccttcacgatgcaaattcctc

SEQ ID NO: 76213 - DNA, 105 bp, Homo sapiens
  misc_feature 1..105: note = chr13:95888741-95888846
  misc_feature 1..105: note = hypo
  source 1..105: mol_type = genomic DNA
cccaaacaactagcacgggatcaggatatttacagaagacattcccatccctcagatgggtcatgatattaaatcccaacaagcctgtctcggcatgtgaacgcg

SEQ ID NO: 76214 - DNA, 91 bp, Homo sapiens
  misc_feature 1..91: note = chr13:96031634-96031725
  misc_feature 1..91: note = hypo
  source 1..91: mol_type = genomic DNA
ttttgaaatacatatcgtcaggtttttctggactggatactaactgatacagtgtttggtaccagaatggtataaaaagaaatgaccggcc

SEQ ID NO: 76215 - DNA, 30 bp, Homo sapiens; identical to SEQ ID NO: 35019
  misc_feature 1..30: note = chr13:96056313-96056343
  misc_feature 1..30: note = hyper
  source 1..30: mol_type = genomic DNA

SEQ ID NO: 76216 - DNA, 30 bp, Homo sapiens
  misc_feature 1..30: note = chr13:96135326-96135356
  misc_feature 1..30: note = hypo
  source 1..30: mol_type = genomic DNA
cttgggagaaagtgacgctgcccgtcctca

SEQ ID NO: 76217 - DNA, 441 bp, Homo sapiens; identical to SEQ ID NO: 35020
  misc_feature 1..441: note = chr13:96204922-96205363
  misc_feature 1..441: note = hyper
  source 1..441: mol_type = genomic DNA

SEQ ID NO: 76218 - DNA, 183 bp, Homo sapiens
  misc_feature 1..183: note = chr13:96296373-96296556
  misc_feature 1..183: note = hyper
  source 1..183: mol_type = genomic DNA
gcctcaagtcccaggcgcatggcaccgccgggcagccgaaccagcagacaaaagccgagagacgcgggttccaggggaacctcggcgcccttccttggaaggcaaacaggcagtgggggcagcggcggctactccagctggatctgcagaggctcggctcgcagcctggagaggcaggagggc

SEQ ID NO: 76219 - DNA, 110 bp, Homo sapiens; identical to SEQ ID NO: 4038
  misc_feature 1..110: note = chr13:96296840-96296950
  misc_feature 1..110: note = hyper
  source 1..110: mol_type = genomic DNA

SEQ ID NO: 76220 - DNA, 247 bp, Homo sapiens; identical to SEQ ID NO: 35023
  misc_feature 1..247: note = chr13:96296991-96297238
  misc_feature 1..247: note = hyper
  source 1..247: mol_type = genomic DNA

SEQ ID NO: 76221 - DNA, 66 bp, Homo sapiens; identical to SEQ ID NO: 43823
  misc_feature 1..66: note = chr13:96409578-96409644
  misc_feature 1..66: note = hypo
  source 1..66: mol_type = genomic DNA

SEQ ID NO: 76222 - DNA, 919 bp, Homo sapiens
  misc_feature 1..919: note = chr13:96742194-96743113
  misc_feature 1..919: note = hyper
  source 1..919: mol_type = genomic DNA
atctctccttgctcccggccgaagggattcccacccccagctgcctcctccgagccccgcggagcagcggactcctcccctggaaactcctccggggctgggggaggctttggcgcatgctccgtacctagggcaggtttttgctgcgggtagcagggctcctgtcacaccggctggcgggttgtggcggtgccagcctgtgtgtgcgagtgtgtctgcgtgcctgcgcctgggcggacagcccggagcggcagtgcgactcgccgggagaggcgtctccgcagaggcgcctcgcccgctgccgctgcgctgcgggggccgctctgcaaacttgcggcgagcgccgtcagccctcgcggctccacagccccgcgacctgccggcaaaggcgccgggcgcgcgtgccgggcgcggtgcccgcggccggccggggcggcgggagcgggccgcgccttcgcccttggccggcgccctggcgagcctcatgcagccccggcgctcgcggccgcagctacccggctgcccggctgcgcgcggcaggtccaggacccgaaccccgctccccagcgcctgagcgcctgcaagccgccggcgggatgccgcgcgtcgcctgagagagccgcgccggggcgggagcagggagcgggccggcccgggcgcacccgggagcgcagggcgccccacgccgcagccgcagccgagcgcgccggcgcccgcctcccccgcccggctcgcaggccccggctcctcaagccccgagggccgcggggccgccagccagccacacgcctcggcgtcaggggcatggaggaacggcgggctccgagccgcgccccggagtccgcgaaacttccgagcgggcgcccgtccgccctgccgccgccgccgccgccgcttcgcctgccggcctgagagcggg

SEQ ID NO: 76223 - DNA, 548 bp, Homo sapiens
  misc_feature 1..548: note = chr13:96743347-96743895
  misc_feature 1..548: note = hyper
  source 1..548: mol_type = genomic DNA
ccccccgagggacctcggggggccgcggcgccggaggaggaggacgaggagcccggagacccccgggagggggaggaagaggaggaggaagacgagccggaccccgaggccccggaaaacggctccctgccccgattcgtgccgcgcttcaacttcagcctgaaggacctgacccgcttcgtggatttcaacatcaaagggcgcgacgtgatcgtgttcctccacatccagaagacggggggcaccactttcggccggcacctggtgaagaacatccggctggagcagccttgtagctgcaaagcgggtcagaagaagtgcacctgccaccggcctggcaagaaggagacgtggctcttctcccgcttctccaccggctggagctgcgggctgcacgccgactggacggagctcaccaactgcgtgccggccatcatggagaagaaggactgtccccgcaaccacagccacaccaggtactgtcgcccgctgggtctctgttcttcccccccaccccccatccctcttcctcagtcctgacccagagc

SEQ ID NO: 76224 - DNA, 220 bp, Homo sapiens
  misc_feature 1..220: note = chr13:96743896-96744116
  misc_feature 1..220: note = hyper
  source 1..220: mol_type = genomic DNA
accccgcgctccctgcccctgccgatggtttcctggcgtcttcagcggttggcgccgtggctttggggagggatgagaaacctccggatagtgcctaggtcctgaactcgttcttcccccagcccccaccgcttcccgccacccctctgccttcaccctctaagatgtgcggagccaccgtgtggatcctgcctgttgcctagcacggcctggcctccct

SEQ ID NO: 76225 - DNA, 30 bp, Homo sapiens
  misc_feature 1..30: note = chr13:96958800-96958830
  misc_feature 1..30: note = hypo
  source 1..30: mol_type = genomic DNA
gcctgtatgaaggtgcgttagattctgtcc

SEQ ID NO: 76226 - DNA, 18 bp, Homo sapiens
  misc_feature 1..18: note = chr13:97599727-97599745
  misc_feature 1..18: note = hypo
  source 1..18: mol_type = genomic DNA
tctcgcctcactgcaacc

SEQ ID NO: 76227 - DNA, 16 bp, Homo sapiens
  misc_feature 1..16: note = chr13:98426774-98426790
  misc_feature 1..16: note = hypo
  source 1..16: mol_type = genomic DNA
tgcctgatctcagctc

SEQ ID NO: 76228 - DNA, 30 bp, Homo sapiens
  misc_feature 1..30: note = chr13:98702848-98702878
  misc_feature 1..30: note = hypo
  source 1..30: mol_type = genomic DNA
aaaatggagctttcacgtaaattaggctcg

SEQ ID NO: 76229 - DNA, 30 bp, Homo sapiens
  misc_feature 1..30: note = chr13:98795810-98795840
  misc_feature 1..30: note = hyper
  source 1..30: mol_type = genomic DNA
gggcggcaacttgtgcgagtccaggctccc

SEQ ID NO: 76230 - DNA, 39 bp, Homo sapiens
  misc_feature 1..39: note = chr13:98866341-98866380
  misc_feature 1..39: note = hypo
  source 1..39: mol_type = genomic DNA
ctcagcagctggagccgttggagccgctggaacctctgg

SEQ ID NO: 76231 - DNA, 48 bp, Homo sapiens
  misc_feature 1..48: note = chr13:98870050-98870098
  misc_feature 1..48: note = hypo
  source 1..48: mol_type = genomic DNA
cctcttgttcttgttcgtcatcatatcctacgccgcagcggtgcctgt

SEQ ID NO: 76232 - DNA, 325 bp, Homo sapiens
  misc_feature 1..325: note = chr13:99083172-99083497
  misc_feature 1..325: note = hypo
  source 1..325: mol_type = genomic DNA
ggaaattaaacaaatcgtgaaatagagagtgcaggagcgcttcatttccccaagtgaaactgggcagaacacaggtgcatcccattcagctgaacaggaccctcctcctctgttgcctcccaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacac

SEQ ID NO: 76233 - DNA, 30 bp, Homo sapiens
  misc_feature 1..30: note = chr13:99136257-99136287
  misc_feature 1..30: note = hypo
  source 1..30: mol_type = genomic DNA
caagtgcggaaacctcgaatgatgtgtctg

SEQ ID NO: 76234 - DNA, 30 bp, Homo sapiens
  misc_feature 1..30: note = chr13:99176587-99176617
  misc_feature 1..30: note = hypo
  source 1..30: mol_type = genomic DNA
agcctcaagggaccccgcagtgttcgctct

SEQ ID NO: 76235 - DNA, 187 bp, Homo sapiens
  misc_feature 1..187: note = chr13:99189615-99189802
  misc_feature 1..187: note = hypo
  source 1..187: mol_type = genomic DNA
tgctttgaacagcagcgggctcattcacaacagcacagtgcccggcacacgggagacctcaaccccatcagctgaataaacaagtgaggcgagtgcagctgaggagctgaggccccagccgccagctgtggcacgagaggcagacagaccttccagactaaggaccgggccacgcactggccagggt

SEQ ID NO: 76236 - DNA, 46 bp, Homo sapiens
  misc_feature 1..46: note = chr13:99328589-99328635
  misc_feature 1..46: note = hypo
  source 1..46: mol_type = genomic DNA
ccacgcacgcacgcacgcacgcacactctctcgctcctgctgtagg

SEQ ID NO: 76237 - DNA, 384 bp, Homo sapiens
  misc_feature 1..384: note = chr13:99404616-99405000
  misc_feature 1..384: note = hyper
  source 1..384: mol_type = genomic DNA
cctcggcggagtcggcgcctctgggcacctctggcttccgcgccccggccgcacggtgaccacccgggaggggatcccgggcgccccgcaacctcccggcccccgtgggccttcgggtcgccccgcttcccgccgccgcgtacccttcgcgcctcccggccctcggtgccggcccccgccccgcgtagctccgagtctttagcccggccggccccccacccgccgagcgtacccatggcggcggctcccagggctcctgcgacctgccggcgggacgtgctcctggcaggtgctactcctccgacctgacgtccaggcccggccccgttgccccaggtacagccccagctctgcgaggcggggccgccggctccacccgggggg

SEQ ID NO: 76238 - DNA, 213 bp, Homo sapiens
  misc_feature 1..213: note = chr13:99428504-99428717
  misc_feature 1..213: note = hypo
  source 1..213: mol_type = genomic DNA
tgtggaggttttacacgatgactcagtgcacatcagagtcagagacaggacggccgaacactgattccagagataggcatgtgggccccgcccgggaaggagagctgcctgggagatggggagctgcaagagagcacccagaggggtaaatttgcacaaggccactgcgtacactggtacgtgcttccttgaaaatgtgacattttcaggcag

SEQ ID NO: 76239 - DNA, 24 bp, Homo sapiens
  misc_feature 1..24: note = chr13:99851628-99851652
  misc_feature 1..24: note = hypo
  source 1..24: mol_type = genomic DNA
tggggagagcgagactccgtctca

SEQ ID NO: 76240 - DNA, 85 bp, Homo sapiens
  misc_feature 1..85: note = chr14:100111198-100111283
  misc_feature 1..85: note = hyper
  source 1..85: mol_type = genomic DNA
aggcctctggccctgcgcctccctggctaaagagcgccctgtggggaggaagcagggccccaggcggaaccgggaaaacacaccg

SEQ ID NO: 76241 - DNA, 54 bp, Homo sapiens; identical to SEQ ID NO: 35524
  misc_feature 1..54: note = chr14:100111503-100111557
  misc_feature 1..54: note = hyper
  source 1..54: mol_type = genomic DNA

SEQ ID NO: 76242 - DNA, 265 bp, Homo sapiens
  misc_feature 1..265: note = chr14:100111764-100112029
  misc_feature 1..265: note = hyper
  source 1..265: mol_type = genomic DNA
cgtgcgccggctacgcgagggacctgctgtgccaggtgagcgggcgcgcggccaccgggcggggcggggcgcgggaggccgagtcctggagcagagatcggaaccccgcgggggcgagggccaagagtgggcggcggactcgggaactctaagccccaacagggagtcatttggcacggggcggggagaccgcgcatcccaggacgactcttggctttgccattcattagttttgtgacttgggccttctcggggcctcagtttc

SEQ ID NO: 76243 - DNA, 483 bp, Homo sapiens
  misc_feature 1..483: note = chr14:100125656-100126139
  misc_feature 1..483: note = hyper
  source 1..483: mol_type = genomic DNA
ctgcacctggctcagcggtcagccggcgccccagcacctgccccgcggagcccgtgagccctggctcagggcgaccccgagccgcgccctctcccaccccgcccgcaggtcggcgctgctgggcaaggtgctgcgcatcgacgtggaccgtaaggagcgcggcctgccctacggcatcccgcccgacaacccgttcgtgggcgaccccgcggcgcagcccgaggtctacgccctgggcgtgcgcaacatgtggcgctgctccttcgaccgtggcgacccctcctcgggcactggccgcgggcgcctcttctgcggcgacgtgggccagaacaagttcgaggaggtggacgtggtggagcgcggcggcaactatggctggcgcgcgcgcgaagggttcgagtgctacgaccgcagcctgtgcgccaacacctctctcagtgagtgcccgcgccccggggaccccggccccgaatccgcccccac

SEQ ID NO: 76244 - DNA, 120 bp, Homo sapiens
  misc_feature 1..120: note = chr14:100148288-100148408
  misc_feature 1..120: note = hypo
  source 1..120: mol_type = genomic DNA
cagcccgccccaagggaagaatcaggggcgaagagagatgcaaccccccgggagcatgccaacctacaaaaccccgagtcaaaggtcaagccacacacttgcctctctcaagtcacctgc

SEQ ID NO: 76245 - DNA, 36 bp, Homo sapiens; identical to SEQ ID NO: 44101
  misc_feature 1..36: note = chr14:100209839-100209875
  misc_feature 1..36: note = hypo
  source 1..36: mol_type = genomic DNA

SEQ ID NO: 76246 - DNA, 30 bp, Homo sapiens
  misc_feature 1..30: note = chr14:100223391-100223421
  misc_feature 1..30: note = hypo
  source 1..30: mol_type = genomic DNA
taaggctgggcatggcggctcacgcctgtc

SEQ ID NO: 76247 - DNA, 32 bp, Homo sapiens
  misc_feature 1..32: note = chr14:100259369-100259401
  misc_feature 1..32: note = hyper
  source 1..32: mol_type = genomic DNA
cttggtctttgtccccgcgcccccgcaagggc

SEQ ID NO: 76248 - DNA, 582 bp, Homo sapiens
  misc_feature 1..582: note = chr14:100259680-100260262
  misc_feature 1..582: note = hyper
  source 1..582: mol_type = genomic DNA
accggcagcagcagccgccacagcagggccggccccagcgccagcgccggtcgcggtcgggctcagctcagtgtgtggtgagcggcggcggcgcggccgggccggggagcgggcgcggcccggcggcctcagcatggaggacggcttctccagctacagcagcctgtacgacacgtcctcgctgctccagttctgcaacggtgaggggcggccgcgcggggccggggcggcgagcggctggtggcgggcggcggcgacggcgacggcggggaccaagccgaggggccgaggcccggcggccgcgggcgaggccgcgcaaagttgttgcggaggggcgcgcggtccccgttcccgccgccggcgcattgtgttggagccgcggggccgcgcctcgctccgggccgccccgggctccccgccgccaccccggctcccggcactggcgcgcggaccccgccggctccagcacccgcggagcgcgcccgggcggaggcgcgtggggcacagggcggcggggaggcccgggcagcctccgcgttccggggaacgtgttgcttttttgcttcccgacccacatctgtt

SEQ ID NO: 76249 - DNA, 30 bp, Homo sapiens
  misc_feature 1..30: note = chr14:100406078-100406108
  misc_feature 1..30: note = hypo
  source 1..30: mol_type = genomic DNA
actgagcatatctctcggctgagggcggtc

SEQ ID NO: 76250 - DNA, 507 bp, Homo sapiens
  misc_feature 1..507: note = chr14:100437443-100437950
  misc_feature 1..507: note = hyper
  source 1..507: mol_type = genomic DNA
agagagggaatcagtcgccggtgacctcgacggccctcggatcagggatgccccgagtccgagcgggcagggtgctcagcagggccaggtgatgggaatcatggggccatcgagcacggaccctggctcccccggtggcctctgtgagctctggggtcaggcggggactggaggagcgtccgcgccgggagggagcgcaccgcgccacgtgcccgcccggcgccccgcccccaccccggccacgcccctcgcgcttccctcaaagccccgcccctcagccccgccactctcgtccgccccgcccctcgcagcctcaagctcagcgctcccggaggcgcggacggtggggccccgcgccttttgtgtcgggctttgaccgccgcgcgcgctcattcacctcagcggccgcgggcggaggggcgcacgcgcgcgcagtcccctcggagggcggtggggcgaacagcaacgcgcgtaccctagctcttggctgctgtgctgagactagcc

SEQ ID NO: 76251 - DNA, 204 bp, Homo sapiens; identical to SEQ ID NO: 35529
  misc_feature 1..204: note = chr14:100438017-100438221
  misc_feature 1..204: note = hyper
  source 1..204: mol_type = genomic DNA

SEQ ID NO: 76252 - DNA, 749 bp, Homo sapiens; identical to SEQ ID NO: 35530
  misc_feature 1..749: note = chr14:100438222-100438971
  misc_feature 1..749: note = hyper
  source 1..749: mol_type = genomic DNA

SEQ ID NO: 76253 - DNA, 290 bp, Homo sapiens
  misc_feature 1..290: note = chr14:100591008-100591298
  misc_feature 1..290: note = hypo
  source 1..290: mol_type = genomic DNA
ccacccacaaaagggcgtgaaggagtgagccaccagacgccaggtgtaagcgtacaggcgtggatggctaaatgggtacttcatttctctcgaaactgcttcatcacccgcagtgctgaattctgtaccccagggcccaatccaagctgtgtggggtcactggccgtccgggaatgggcataccgcctggcggtcggggtgtgaacagcaggggacacacacacaagcacatacacttgtcccaaggcaggaccacacacatagctgcccccagacgagaccacgtacgg

SEQ ID NO: 76254 - DNA, 30 bp, Homo sapiens
  misc_feature 1..30: note = chr14:100597146-100597176
  misc_feature 1..30: note = hypo
  source 1..30: mol_type = genomic DNA
gatccgcagcacgggcgtctccggagcctc

SEQ ID NO: 76255 - DNA, 30 bp, Homo sapiens; identical to SEQ ID NO: 15860
  misc_feature 1..30: note = chr14:100611919-100611949
  misc_feature 1..30: note = hypo
  source 1..30: mol_type = genomic DNA

SEQ ID NO: 76256 - DNA, 115 bp, Homo sapiens
  misc_feature 1..115: note = chr14:100613268-100613383
  misc_feature 1..115: note = hypo
  source 1..115: mol_type = genomic DNA
ggggctggttctcctcggggccgcacccgcgagcacacacgcagacacctgagcacacgcggtgggcatgcacatgcatattcatgtacgaacatgtttgcgcgcgcgcacaccc

SEQ ID NO: 76257 - DNA, 458 bp, Homo sapiens
  misc_feature 1..458: note = chr14:100625468-100625926
  misc_feature 1..458: note = hyper
  source 1..458: mol_type = genomic DNA
ctccgcgccagggagcgcgtgcgcctcgtagcgcgtcccggggccgcccctgcgccctcgcgtcccagcatcccagagccccggccctggccccgggagtggctcgcgaggaacagctgggacgcgctccctggcgctcggacccgtactggggtcctcggaatcctcaggtcccagggagtttcagacccggccagggtgggggaccctcggggagccggccggggaccccagggaggggagcggcaatggcggaacgcccactggaatttgggccagagctggagcggcccgtctgggctcgaccccacgacgcgactccagacgggccaacggggcggtccccaccggggtgggccccgcgcggcgctcacccagtatctccttgcgccgctgcgtgtgcggctggtcggtgtagacccactcgaagtcgctgcggctcgcgctgttgcccatgg

SEQ ID NO: 76258 - DNA, 92 bp, Homo sapiens
  misc_feature 1..92: note = chr14:100637026-100637118
  misc_feature 1..92: note = hypo
  source 1..92: mol_type = genomic DNA
acaggcgtgagccaccgcgcccggcccaaaggcattaaaattaactccaccccagtcaacaaccatgaagtattttgcgctgacagctttgg

SEQ ID NO: 76259 - DNA, 368 bp, Homo sapiens
  misc_feature 1..368: note = chr14:100643113-100643481
  misc_feature 1..368: note = hypo
  source 1..368: mol_type = genomic DNA
cagttcagcggctcacgtctgacttctctccttggcctcatgcccagggcaccttcctgaatcccagaggtgagcaaaactccacctccacaaccccagggcaccccattgccaccacccctcagccttggaaatggagtcaccaggcatgaagtttagatgtgcacaacctggcaccgagtccctacggtgggaccatgcccgcagcggcagtgtggaagatgggacagacacagcgaaatgcctccagggcgtggtgggaggggccggaacagggagatggcgcgtgagtagcatctgttcttacagcaaaacctgtaaaagtaaaatatacgtaggtttgtcactaaagacgtgtctgcataaat

SEQ ID NO: 76260 - DNA, 30 bp, Homo sapiens
  misc_feature 1..30: note = chr14:100644084-100644114
  misc_feature 1..30: note = hypo
  source 1..30: mol_type = genomic DNA
tgtgagccaccgggccggtataaaaagata

SEQ ID NO: 76261 - DNA, 297 bp, Homo sapiens
  misc_feature 1..297: note = chr14:100644399-100644696
  misc_feature 1..297: note = hypo
  source 1..297: mol_type = genomic DNA
agcccagcccagtgccgcgcctgtcctcgaacctggcccaacgctcgccgggagcagggacctgcgtgcagctatggaaccgaggcgcgggctgcgggatcccgccctacctcccataaaccagggcccgagataagggagtcccagagggccaggggagtcgcgggcccagcgtctcagtgggcacgaatttcttactttaacctcttttctgtcgaccccatctgtccccacctgggaggagggggagcaacaggccccttcccggtcgagttcagggctcggtacaaaggctgc

SEQ ID NO: 76262 - DNA, 36 bp, Homo sapiens
  misc_feature 1..36: note = chr14:100747273-100747309
  misc_feature 1..36: note = hypo
  source 1..36: mol_type = genomic DNA
gaagcctgataatttcgggaggctgaggcaggagaa

SEQ ID NO: 76263 - DNA, 30 bp, Homo sapiens
  misc_feature 1..30: note = chr14:100749445-100749475
  misc_feature 1..30: note = hypo
  source 1..30: mol_type = genomic DNA
cagccctggaagctccggagctaactggga

SEQ ID NO: 76264 - DNA, 35 bp, Homo sapiens; identical to SEQ ID NO: 44108
  misc_feature 1..35: note = chr14:100780162-100780197
  misc_feature 1..35: note = hypo
  source 1..35: mol_type = genomic DNA

SEQ ID NO: 76265 - DNA, 30 bp, Homo sapiens
  misc_feature 1..30: note = chr14:100801423-100801453
  misc_feature 1..30: note = hypo
  source 1..30: mol_type = genomic DNA
ggctccttcctgcctcgggcaccagctcag

SEQ ID NO: 76266 - DNA, 104 bp, Homo sapiens
  misc_feature 1..104: note = chr14:100843537-100843641
  misc_feature 1..104: note = hypo
  source 1..104: mol_type = genomic DNA
attatttgcagtgcacggttccattagtttataattagtctttcatattatattagttccattggagatgagctggctggctggctttagaagttgttgttgtt

SEQ ID NO: 76267 - DNA, 163 bp, Homo sapiens
  misc_feature 1..163: note = chr14:100843941-100844104
  misc_feature 1..163: note = hypo
  source 1..163: mol_type = genomic DNA
cggtcgttttatttaaactctggctttgcgtgtggaagttgttacctgcctggaatgggctgcgaacgggggcggcattactagaggaggctgactacagacatttatggaatgatgacctgacttgtagaccagtggaaccctcaggcgaatgatgccactt

SEQ ID NO: 76268 - DNA, 204 bp, Homo sapiens
  misc_feature 1..204: note = chr14:100938536-100938740
  misc_feature 1..204: note = hypo
  source 1..204: mol_type = genomic DNA
ggagccctggagccccggctgggcagggaaccctgtcctccttcctgtgcatgggccggctctcctgatgtgcgctggctcctctgagccatctgtgcagtgccacctgggtctacctcccagatcctggaggcagcacgcgtgagagggcacatagacagggtacaggtgttggctcttctgcctccccgaaccaggcctctt

SEQ ID NO: 76269 - DNA, 690 bp, Homo sapiens
  misc_feature 1..690: note = chr14:101033483-101034173
  misc_feature 1..690: note = hyper
  source 1..690: mol_type = genomic DNA
cgcctcggctcaggctccggaaggaaaacacgggaggggtgttcccaaagtaggggtcagggtgccaggggaagtcgtggaggaagtggcaaatattcaaactggctgatcccaggcctgccgcgcaggtggtcccgtgaagtctaccaaggcttaaagtttggcaccgggagggaggccgcgggggacactccccagaagctgtcgcgggattcccccaaaatggctccaagacgcggctgcctggtccagccgcgaggactccatcccccacccccgccccccagaggcggacacttaaaagctcagagccaggcaactggcagcccgggggctggggcgggtggtggttgggggtggggtggggtcgggggagagagcgccggggcagtgcggaacggcacgaacggaacccggagggtccccggggaccagcgagagtccagggcagggagccagaggggcgctgaggaccgcacaggaccaggcggccccgggtagggggcagcccggccctcagtggcgctagccccagcccccgccgcagcggcccgggccggcggaggagccccgcgcgaggctccccagcgcctcgcggcgcgcacacacgcaccacacacacgcacctggcccgcagccccgccgaggccgcccgcgggccctgggggatgcgctcgggtggagccccct

SEQ ID NO: 76270 - DNA, 59 bp, Homo sapiens
  misc_feature 1..59: note = chr14:101034412-101034471
  misc_feature 1..59: note = hyper
  source 1..59: mol_type = genomic DNA
cccagcttccagtcccggccgcggcccccgtgactcagtgggcgcgccgggccgcggcc

SEQ ID NO: 76271 - DNA, 676 bp, Homo sapiens
  misc_feature 1..676: note = chr14:101034860-101035536
  misc_feature 1..676: note = hyper
  source 1..676: mol_type = genomic DNA
ctggcttgcccctcccgggccccagggattaacccgtgagcgcccggctcgccggcggggctccctgccttgcttgcgcagacccgcccgcgcgcggcttggagaccctccctgcccagccccgctcagccgggcagcccctccgcgcgccgggcagggggacccacccgccgccgttaaccttgtgggcgcgggcgagcgacggggaccgcgagcggcccgggcgggatcgcacttcctgcgtggagctgggggcgccgggcgggctctctatcacccgggagaggccgctccccggggctttgcccgtctttctgtgccgtgactggcactcaagggggacaggggtccgagctcagggaccacgcgacagacctgggaagactgatgactgcccatcccggcccctcgcgccgggcgccgccgccgcgtccgccgggagcgcgctccgctcgggtccgggccccacgccgcctcccccaccgccccgccgggcgagggcgcagcccggccgcagcgccaagctagaaggcccggccccggggcctcggccaggctcggccaccaacttcccgggtgctcgggccggccttccggcgctctcccggcctcagtttcctcacctgaaagctggggggaagggggaggcagctggacgaggcgctccactgccctt

SEQ ID NO: 76272 - DNA, 30 bp, Homo sapiens
  misc_feature 1..30: note = chr14:101038620-101038650
  misc_feature 1..30: note = hypo
  source 1..30: mol_type = genomic DNA
tctgaccccattgcacggctgcccactgcc

SEQ ID NO: 76273 - DNA, 30 bp, Homo sapiens
  misc_feature 1..30: note = chr14:101052393-101052423
  misc_feature 1..30: note = hypo
  source 1..30: mol_type = genomic DNA
cagagccacccccaacggccagttgcccct

SEQ ID NO: 76274 - DNA, 42 bp, Homo sapiens
  misc_feature 1..42: note = chr14:101052723-101052765
  misc_feature 1..42: note = hyper
  source 1..42: mol_type = genomic DNA
tgctccctatccatccggccccgctcccgggtgcccactctg

SEQ ID NO: 76275 - DNA, 56 bp, Homo sapiens
  misc_feature 1..56: note = chr14:101121187-101121243
  misc_feature 1..56: note = hyper
  source 1..56: mol_type = genomic DNA
ccggggtctcctctgcggcgaagagcgtgggtgcaggaccccggcgcgcagcgcag

SEQ ID NO: 76276 - DNA, 30 bp, Homo sapiens
  misc_feature 1..30: note = chr14:101155496-101155526
  misc_feature 1..30: note = hypo
  source 1..30: mol_type = genomic DNA
aaggtggctctgcctcggtttacgcctttg

SEQ ID NO: 76277 - DNA, 40 bp, Homo sapiens
  misc_feature 1..40: note = chr14:101192480-101192520
  misc_feature 1..40: note = hypo
  source 1..40: mol_type = genomic DNA
gtccgtctgtttatacgtgtgtttgcgtgtttgggtgtgc

SEQ ID NO: 76278 - DNA, 39 bp, Homo sapiens
  misc_feature 1..39: note = chr14:101192920-101192959
  misc_feature 1..39: note = hyper
  source 1..39: mol_type = genomic DNA
tctgcggcccaggttcgattcctgcgacttgtcctaggc

SEQ ID NO: 76279 - DNA, 201 bp, Homo sapiens
  misc_feature 1..201: note = chr14:101193397-101193598
  misc_feature 1..201: note = hyper
  source 1..201: mol_type = genomic DNA
gcccagagatgaccgcgaccgaagccctcctgcgcgtcctcttgctcctgctggctttcggccacagcacctatggtgagttccccggcggcccggctcgcgccccctctggggaagcctgcgactccccgccggccgcccggtgccccgcacgccccgtctcgtgagccccaactccgcccgtcccgcctagccctaagc

SEQ ID NO: 76280 - DNA, 32 bp, Homo sapiens; identical to SEQ ID NO: 44110
  misc_feature 1..32: note = chr14:101198835-101198867
  misc_feature 1..32: note = hypo
  source 1..32: mol_type = genomic DNA

SEQ ID NO: 76281 - DNA, 60 bp, Homo sapiens
  misc_feature 1..60: note = chr14:101199827-101199887
  misc_feature 1..60: note = hypo
  source 1..60: mol_type = genomic DNA
accgtagacagacctcgtattgctttctctttgagagtccccaagcgcttcctgcacaat

SEQ ID NO: 76282 - DNA, 186 bp, Homo sapiens
  misc_feature 1..186: note = chr14:101200566-101200752
  misc_feature 1..186: note = hypo
  source 1..186: mol_type = genomic DNA
ctcaggcaatttctgcgagatcgtggccaacagctgcacccccaacccatgcgagaacgacggcgtctgcactgacattgggggcgacttccgctgccggtgcccagccggcttcatcgacaagacctgcagccgcccggtgaccaactgcgccagcagcccgtgccagaacgggggcacctgcct

SEQ ID NO: 76283 - DNA, 44 bp, Homo sapiens; identical to SEQ ID NO: 44112
  misc_feature 1..44: note = chr14:101201633-101201677
  misc_feature 1..44: note = hypo
  source 1..44: mol_type = genomic DNA

SEQ ID NO: 76284 - DNA, 30 bp, Homo sapiens
  misc_feature 1..30: note = chr14:101244707-101244737
  misc_feature 1..30: note = hypo
  source 1..30: mol_type = genomic DNA
agattcatgctaacccgtaaccaaggctgc

SEQ ID NO: 76285 - DNA, 248 bp, Homo sapiens
  misc_feature 1..248: note = chr14:101250082-101250330
  misc_feature 1..248: note = hypo
  source 1..248: mol_type = genomic DNA
ggggagctggggtggcgacccatgaattagggtccattgacccggaggtcgaggcttccagagcgggccagccggcagccccaacgtgtgaggctgtgcacctgctggggagggtttttttgatggcgacggcgtgaggtgagcgggtttgctctgggcggtcgaggattagcgccgactgagagggtcaggtgcaccggggctttgttcagacctgtttgccttttgtcccccgcctgcagaaagcc

SEQ ID NO: 76286 - DNA, 30 bp, Homo sapiens
  misc_feature 1..30: note = chr14:101280064-101280094
  misc_feature 1..30: note = hypo
  source 1..30: mol_type = genomic DNA
atttctgcattgagccgtgtacaccagaga

SEQ ID NO: 76287 - DNA, 30 bp, Homo sapiens
  misc_feature 1..30: note = chr14:101301191-101301221
  misc_feature 1..30: note = hypo
  source 1..30: mol_type = genomic DNA
tgtgtgagcagcttccgacccctgccccat

SEQ ID NO: 76288 - DNA, 70 bp, Homo sapiens
  misc_feature 1..70: note = chr14:101347653-101347723
  misc_feature 1..70: note = hypo
  source 1..70: mol_type = genomic DNA
tggtgtttgcacctacgagagcgggcatctgggtgagcagctgggtgatggctgtcgtgatgctgctgcc

SEQ ID NO: 76289 - DNA, 48 bp, Homo sapiens
  misc_feature 1..48: note = chr14:101349702-101349750
  misc_feature 1..48: note = hypo
  source 1..48: mol_type = genomic DNA
agagccagacaggctcgttgccaatcagcgagccgtccacggattgga

SEQ ID NO: 76290 - DNA, 30 bp, Homo sapiens
  misc_feature 1..30: note = chr14:101531739-101531769
  misc_feature 1..30: note = hypo
  source 1..30: mol_type = genomic DNA
gaggctggggcacctcggggaaggacgccg

SEQ ID NO: 76291 - DNA, 45 bp, Homo sapiens
  misc_feature 1..45: note = chr14:101532265-101532310
  misc_feature 1..45: note = hypo
  source 1..45: mol_type = genomic DNA
tgtctgtgatgagttcgcttttattaatgacgaatataacacaga

SEQ ID NO: 76292 - DNA, 34 bp, Homo sapiens
  misc_feature 1..34: note = chr14:101532812-101532846
  misc_feature 1..34: note = hypo
  source 1..34: mol_type = genomic DNA
atgacacacaagacacgagcggcctctcttcagt

SEQ ID NO: 76293 - DNA, 344 bp, Homo sapiens
  misc_feature 1..344: note = chr14:101543828-101544172
  misc_feature 1..344: note = hyper
  source 1..344: mol_type = genomic DNA
gggatgcaatttccccggtgtttttcaggcccagagctattgaataaatgaagtgcgcgccggcggagtcagtaactcactgcgcggctcccggcaggcgggggcggagtgggggccgcagaaccggacgtgcctggcgaggttcagaggcgctagcggtgtggtgggtgggcagcgccgggatggctggagggaggggctacggggggaggcgctgccgatcccacactgatctggcggggaggagggaggggcggatggggtttgctggagaacttgaccttgcttcgctcccctcaaggggcagctgctgggagaccaagtgtcaccggctggcaatcagg

SEQ ID NO: 76294 - DNA, 34 bp, Homo sapiens
  misc_feature 1..34: note = chr14:101576586-101576620
  misc_feature 1..34: note = hypo
  source 1..34: mol_type = genomic DNA
caagggtctccagtgcggccgtgaccagtaagag

SEQ ID NO: 76295 - DNA, 105 bp, Homo sapiens
  misc_feature 1..105: note = chr14:101591942-101592047
  misc_feature 1..105: note = hypo
  source 1..105: mol_type = genomic DNA
tccagccgtgcagaacgacatgcaattgaaaacttagggattgtttctttctgggatttctgtttaatatttttggacctcagtggaccacgggtaagggactca

SEQ ID NO: 76296 - DNA, 30 bp, Homo sapiens
  misc_feature 1..30: note = chr14:101665450-101665480
  misc_feature 1..30: note = hypo
  source 1..30: mol_type = genomic DNA
tgtctctggatgggccgtgttgtttgtgcc

SEQ ID NO: 76297 - DNA, 62 bp, Homo sapiens
  misc_feature 1..62: note = chr14:101694557-101694619
  misc_feature 1..62: note = hypo
  source 1..62: mol_type = genomic DNA
ggggtctgtgcgaaccgcggggtctgtgagaaccgcggggtctgtgccgcctggtggggagc

SEQ ID NO: 76298 - DNA, 173 bp, Homo sapiens
  misc_feature 1..173: note = chr14:101713576-101713749
  misc_feature 1..173: note = hypo
  source 1..173: mol_type = genomic DNA
ctttcctctccacttcgtcctgtggatccaatcatccctgtggaaggacgatgggaaaatctgcctcttggggcctcagatttccagatctaagttccagctgccaagaggacacaacacagggttctcagagccgccgcaccctaatttcatctccccgcactgcccccacc

SEQ ID NO: 76299 - DNA, 30 bp, Homo sapiens
  misc_feature 1..30: note = chr14:101797233-101797263
  misc_feature 1..30: note = hypo
  source 1..30: mol_type = genomic DNA
ttcaggtgatccagacggttctggatccaa

SEQ ID NO: 76300 - DNA, 30 bp, Homo sapiens
  misc_feature 1..30: note = chr14:101864688-101864718
  misc_feature 1..30: note = hypo
  source 1..30: mol_type = genomic DNA
gcctagtagaataaacgtctccttgcaaag

SEQ ID NO: 76301 - DNA, 30 bp, Homo sapiens
  misc_feature 1..30: note = chr14:101908354-101908384
  misc_feature 1..30: note = hypo
  source 1..30: mol_type = genomic DNA
acctgcgtctcctgtcgtcagcaaaatgca

SEQ ID NO: 76302 - DNA, 103 bp, Homo sapiens
  misc_feature 1..103: note = chr14:101915704-101915807
  misc_feature 1..103: note = hypo
  source 1..103: mol_type = genomic DNA
ggaatcccaagaggccgctcaggcaagccagatagagccacccatgtgatcaagcattcagggcatgagggcccccactaccatggcccggaaaatacatgca

SEQ ID NO: 76303 - DNA, 190 bp, Homo sapiens
  misc_feature 1..190: note = chr14:101923096-101923286
  misc_feature 1..190: note = hyper
  source 1..190: mol_type = genomic DNA
gttactatattaaagcgcttcaagttttcatagcgctcgtcaaacagagacctcggaacgctctgcagacattaattaatgttcgctccggccctggaagccatttcaccaatggaaattccgatgagaaaggaagaaacgaggggttcaaggccgcgccgttgtgagtccgctgcggaactaggaactg

SEQ ID NO: 76304 - DNA, 166 bp, Homo sapiens; identical to SEQ ID NO: 35537
  misc_feature 1..166: note = chr14:101923521-101923687
  misc_feature 1..166: note = hyper
  source 1..166: mol_type = genomic DNA

SEQ ID NO: 76305 - DNA, 214 bp, Homo sapiens
  misc_feature 1..214: note = chr14:101924030-101924244
  misc_feature 1..214: note = hyper
  source 1..214: mol_type = genomic DNA
gacgccctggcccggtgtccccgacgcgcctggagcccgggagggaggcgcgggcctggcctgggcccaggaggatggagcccgactcagggccgtctctccccgcttgggggtgctcaggagggcccagggtacctgcgcgggcaccttggcggcgggtcaccctccctccgagccactccgtccgtgggcagcggccttaccaggtccgagc

SEQ ID NO: 76306 - DNA, 143 bp, Homo sapiens
  misc_feature 1..143: note = chr14:101924295-101924438
  misc_feature 1..143: note = hyper
  source 1..143: mol_type = genomic DNA
cgggagccccaggtgcacacacgcaggcctgggccgggcctccaggcctctgtccttcgggcgggctgggaggtggcctggcgatgcccgccgaggggtggagagggcgaagccagggcggcgtcggcgaggccatcaaaggc

SEQ ID NO: 76307 - DNA, 122 bp, Homo sapiens
  misc_feature 1..122: note = chr14:101924457-101924579
  misc_feature 1..122: note = hyper
  source 1..122: mol_type = genomic DNA
cgttgcccatgaccaggccgagggcatgaaaggatctttatcctccagtgacattgccaggccggcgcttttctgcggcctccccctcccgcggccctaattggggccggctgctaatgtga

SEQ ID NO: 76308 - DNA, 214 bp, Homo sapiens; identical to SEQ ID NO: 12051
  misc_feature 1..214: note = chr14:101924858-101925072
  misc_feature 1..214: note = hyper
  source 1..214: mol_type = genomic DNA

SEQ ID NO: 76309 - DNA, 50 bp, Homo sapiens
  misc_feature 1..50: note = chr14:101925655-101925705
  misc_feature 1..50: note = hyper
  source 1..50: mol_type = genomic DNA
cggcagagtctctggggcactcggggcgggcggcagcaggtgggacccgc

SEQ ID NO: 76310 - DNA, 302 bp, Homo sapiens
  misc_feature 1..302: note = chr14:101925706-101926008
  misc_feature 1..302: note = hyper
  source 1..302: mol_type = genomic DNA
gcccgacccgcgctagggccgcccaccccctcggaccccggccgggtctctccacagcctccgtgcgcgtcccagaaggaaaatgctagcaaaccggaaggccgcacggggccgagccggcctcagcccggccaggagaggccgtcggtgccccgaggaggaaggggacccggcccgggacggccgccccgcggtacccaggaaggacgcccgccgttcccagcaccccagcgtctgaaaaatgaatgtgaactccgcaagcgtgctcccgcggacattttacatgtcggttgttcacattt

SEQ ID NO: 76311 - DNA, 863 bp, Homo sapiens
  misc_feature 1..863: note = chr14:102026178-102027041
  misc_feature 1..863: note = hyper
  source 1..863: mol_type = genomic DNA
tttcgcggctggtcccggggcggcaggcgcacgggacgctggcggcggcggcggcttccgacttgggctcagaccccgccgctccagacaagtccccgcgactgcgacagtgtctcgggcagttcagctccccagacgggagacagaccctcgcgacctggttcaggccttgccctgggggacactgcagtccaaggcgaaaggagacttgctcccggcctctgggtccctaggtcaaggcacctccccgccccgccgcccctgagcccaagtcgccaaccccgcgccgcgcgcagcgagggatcagaaggtctcggacgccgcggcagggccggccagggccccacgagttagggagttgccccgcacccctaaacgctcagcacccatttacggttgaaagtacgcacttgacgcgtccgggcgcctccgcggtgagtcgcgccgccgctctcggggtccgcgaaggtggctcagttcgggcgctccagtctcgacgttcccggggtagagagcaacgtccggggacgaacgggacgggtgcgcccagcggccggggctgcgctgggcgaggcaagcggcgagaggggagcgctccggcgttcaggcaacagctacccctagtgggagagccgcccggggccggcgccgccccgcgcccgctgccccgcgccccacgcccgtggcgccccgcgcccgggtcggctgggggcgcagggccggcgccgctttccccagctctccggtctccggcgcccggcggtaacccgcccgcgggctctgccctccgcacctctcagcccggccccggcggccgctgacccaggaaccgcggcgccccgctggaacgagatgggacgggg

SEQ ID NO: 76312 - DNA, 30 bp, Homo sapiens
  misc_feature 1..30: note = chr14:102029131-102029161
  misc_feature 1..30: note = hyper
  source 1..30: mol_type = genomic DNA
cccgcgcgccctgagcgcagctgggttcca

SEQ ID NO: 76313 - DNA, 507 bp, Homo sapiens
  misc_feature 1..507: note = chr14:102029818-102030325
  misc_feature 1..507: note = hyper
  source 1..507: mol_type = genomic DNA
tttccctctgaatagcggcaggaattaaacacaaatccctccctcgcgtccccatagtgaccttgggaagcgggacgggaaggagcctaggctggcaggggcgctggaggaggatggaggaggaagagggtctgcggcggtgcccggggcgctcctacaaccgcacgcacccacctggacggggaacttagctgcgggagaagagcgaggtagcggagcgccgcgggatcctggaaagcggcgggagaggcaagggggccctctcttgctcccgcgcgcgcacacacagaccgaacagatgcagctgcccctgcagccgccgatccaacttaactgagtatccggcggtgtgtggagggggttgggtgaggtggagggcgagaggggctttggacccggtacagcctggctcccgaccgctgcaggcaccactgcgcacctgactcctccctggcccccttccggcacctgcaaccttgcctcttgcccacccgctccaggcagctg

SEQ ID NO: 76314 - DNA, 354 bp, Homo sapiens
  misc_feature 1..354: note = chr14:102030555-102030909
  misc_feature 1..354: note = hyper
  source 1..354: mol_type = genomic DNA
attccagggctggggcggggattcggggccttaggcacaggtcccctcttgcagtcacggccaggggctcgctctcgcgcaatccccgccctcactgtctcgcctgttgcgcccggagtgagggcgacccgggggacgcgggattagcttagcccgcagcccctgtgccagcgaaaccttgaacattaagtgaaaggtgggggacacagtgaaagccgctgaggcgggagtgtacggatccaggtgaggggactgggcacggcaacttccctggcgcgccaggacaatgcctgggaacccaggattgtcagggtcgccgggggtgggggtgagtagtgtcggtttgcgcgcttg

SEQ ID NO: 76315 - DNA, 21 bp, Homo sapiens
  misc_feature 1..21: note = chr14:102031173-102031194
  misc_feature 1..21: note = hyper
  source 1..21: mol_type = genomic DNA
acccctacctacctccgcgaa

SEQ ID NO: 76316 - DNA, 36 bp, Homo sapiens
  misc_feature 1..36: note = chr14:102031235-102031271
  misc_feature 1..36: note = hyper
  source 1..36: mol_type = genomic DNA
cgcggcagggacgcggcccggcgcctgggagagtcc

SEQ ID NO: 76317 - DNA, 54 bp, Homo sapiens
  misc_feature 1..54: note = chr14:102031526-102031580
  misc_feature 1..54: note = hyper
  source 1..54: mol_type = genomic DNA
gcgccagccactccccgcacgggccgcactcgctctggtcgcagctccagggaa

SEQ ID NO: 76318 - DNA, 76 bp, Homo sapiens
  misc_feature 1..76: note = chr14:102094052-102094128
  misc_feature 1..76: note = hypo
  source 1..76: mol_type = genomic DNA
agagctagccaggggcgttggccggctgtggatctgtccagacccaggccgccctcctacgcgggcctgctgcaac

SEQ ID NO: 76319 - DNA, 542 bp, Homo sapiens
  misc_feature 1..542: note = chr14:102247672-102248214
  misc_feature 1..542: note = hyper
  source 1..542: mol_type = genomic DNA
ccgccctgcgcctcccggtggcacagcgaccttggcggctttggcccctgagccgctaggctgccaaggcgcgctgtgcgcgtggggccaggctcgacctcactcctgttgtcgctgcagacccgcgtgggctcccgccgggccctcctgccgccccccagcctccccgcccctgcccttgccagcctgcgccttcctgggcgcctgacgcacccctctgccccaaccacgttttctcaagagtgttgtctgtcccggccttccaaggagacccttagctcccgccggccgcctccggagcctccggcatgggccccaggccggggtcccgcctttgccccggcctccgctgcctcgccccggagcccggaggaggggagccggccacccggggaagaagcggaggacgccgatctggcctcctgcgttgcgcgctccaaccctctgcttggccgcccgcgaaccgcgctctcccgtttcctttccgtcccgtctcgggggcttcatcctccagccgtggccgtggccgtggccaggtgtac

SEQ ID NO: 76320 - DNA, 30 bp, Homo sapiens; identical to SEQ ID NO: 44120
  misc_feature 1..30: note = chr14:102325042-102325072
  misc_feature 1..30: note = hypo
  source 1..30: mol_type = genomic DNA

SEQ ID NO: 76321 - DNA, 51 bp, Homo sapiens; identical to SEQ ID NO: 15865
  misc_feature 1..51: note = chr14:102335848-102335899
  misc_feature 1..51: note = hypo
  source 1..51: mol_type = genomic DNA

SEQ ID NO: 76322 - DNA, 30 bp, Homo sapiens
  misc_feature 1..30: note = chr14:102356167-102356197
  misc_feature 1..30: note = hypo
  source 1..30: mol_type = genomic DNA
gaaatacagcaaaaacgtaagatggattaa

SEQ ID NO: 76323 - DNA, 78 bp, Homo sapiens
  misc_feature 1..78: note = chr14:102397345-102397423
  misc_feature 1..78: note = hypo
  source 1..78: mol_type = genomic DNA
cctgaggcttttgtttttaggtaagtttagattttataaaacgtcagcatttttttaaacaaacgtgctaaatttcag

SEQ ID NO: 76324 - DNA, 54 bp, Homo sapiens
  misc_feature 1..54: note = chr14:102399668-102399722
  misc_feature 1..54: note = hypo
  source 1..54: mol_type = genomic DNA
ccccgtggagccctgcggcgcgctggcttctcctggtgacggtgtgcaccagct

SEQ ID NO: 76325 - DNA, 141 bp, Homo sapiens
  misc_feature 1..141: note = chr14:102418526-102418667
  misc_feature 1..141: note = hypo
  source 1..141: mol_type = genomic DNA
ggcccaggagttgctcgcatgagccaccacgcccagtgtattcagattttcttcgtgtttcttttctcttccgggatcccatgcaggacaccacgtcgcatttagttgtccaccacggtttttttgtttgtttgttttttt

SEQ ID NO: 76326 - DNA, 46 bp, Homo sapiens
  misc_feature 1..46: note = chr14:102422726-102422772
  misc_feature 1..46: note = hypo
  source 1..46: mol_type = genomic DNA
caggctcccattccacgactccgcaattccacggccagcacatccc

SEQ ID NO: 76327 - DNA, 93 bp, Homo sapiens
  misc_feature 1..93: note = chr14:102467269-102467362
  misc_feature 1..93: note = hypo
  source 1..93: mol_type = genomic DNA
atcttatgtttctctcgacagcttcgacaaaatttggatgccctcctgaaccagctgaaaagcttccctgcccggttgcgacagtatgcgtcc

SEQ ID NO: 76328 - DNA, 30 bp, Homo sapiens; identical to SEQ ID NO: 44123
  misc_feature 1..30: note = chr14:102474565-102474595
  misc_feature 1..30: note = hypo
  source 1..30: mol_type = genomic DNA

SEQ ID NO: 76329 - DNA, 38 bp, Homo sapiens; identical to SEQ ID NO: 44124
  misc_feature 1..38: note = chr14:102493613-102493651
  misc_feature 1..38: note = hypo
  source 1..38: mol_type = genomic DNA

SEQ ID NO: 76330 - DNA, 117 bp, Homo sapiens
  misc_feature 1..117: note = chr14:102500433-102500550
  misc_feature 1..117: note = hypo
  source 1..117: mol_type = genomic DNA
cgttcattgcctacgcgggttactttgaccagcagatgcgtcagaacttgttcactacctggtcccatcacctacagcaagccaacatccaggtgagaatcacggggagttcaaaaa

SEQ ID NO: 76331 - DNA, 156 bp, Homo sapiens
  misc_feature 1..156: note = chr14:102521602-102521758
  misc_feature 1..156: note = hypo
  source 1..156: mol_type = genomic DNA
ctcctcctgcatcagcgccccacccaacagagccgaccaggctgggaacaccgagaccgagagcgcgtggctgtgtctacaaaggcctcctctttgagggagacacgcgaggcacgggtggggcgatgagacaggatcggccggtccttgacagtc

SEQ ID NO: 76332 - DNA, 97 bp, Homo sapiens
  misc_feature 1..97: note = chr14:102529446-102529543
  misc_feature 1..97: note = hypo
  source 1..97: mol_type = genomic DNA
aaaataaataaagaaagaaagaaaagaaaatagaatggaaacgttagggagtagcaaagcaactctgaccagccctcggttccgccccttgttagtg

SEQ ID NO: 76333 - DNA, 94 bp, Homo sapiens
  misc_feature 1..94: note = chr14:102529981-102530075
  misc_feature 1..94: note = hypo
  source 1..94: mol_type = genomic DNA
ccagccctgtcaccccgcccctgcagccacgcctgggggagcggcggccggtagggccgggcggctgcgaggccagaaacgcctccaagagctc

SEQ ID NO: 76334 - DNA, 81 bp, Homo sapiens
  misc_feature 1..81: note = chr14:102530479-102530560
  misc_feature 1..81: note = hypo
  source 1..81: mol_type = genomic DNA
gctccttctccccagcgtggttcctaagagccttagcgtgagctgagactcagaccccttcattcccgggcaatactgaaa

SEQ ID NO: 76335 - DNA, 136 bp, Homo sapiens
  misc_feature 1..136: note = chr14:102564366-102564502
  misc_feature 1..136: note = hypo
  source 1..136: mol_type = genomic DNA
caacattatcccttccggatgccttccctccctgccacctccagggagagggagtgttggcttctttattcctccttgactgacctgggggcaagtctcttctctttaagcctcgggtttgtttttctttttcttt

SEQ ID NO: 76336 - DNA, 34 bp, Homo sapiens
  misc_feature 1..34: note = chr14:102593144-102593178
  misc_feature 1..34: note = hypo
  source 1..34: mol_type = genomic DNA
gtgagccactgcgcccggccgactagattctttt

SEQ ID NO: 76337 - DNA, 30 bp, Homo sapiens
  misc_feature 1..30: note = chr14:102654008-102654038
  misc_feature 1..30: note = hypo
  source 1..30: mol_type = genomic DNA
tggcagagtgtagggcgaattgcatgtgat

SEQ ID NO: 76338 - DNA, 35 bp, Homo sapiens
  misc_feature 1..35: note = chr14:102659542-102659577
  misc_feature 1..35: note = hypo
  source 1..35: mol_type = genomic DNA
tctttccctgccatccgagccgctcagaagctgcc

SEQ ID NO: 76339 - DNA, 61 bp, Homo sapiens; identical to SEQ ID NO: 44129
  misc_feature 1..61: note = chr14:102673269-102673330
  misc_feature 1..61: note = hypo
  source 1..61: mol_type = genomic DNA

SEQ ID NO: 76340 - DNA, 180 bp, Homo sapiens
  misc_feature 1..180: note = chr14:102682077-102682257
  misc_feature 1..180: note = hypo
  source 1..180: mol_type = genomic DNA
tgtagacaccaggcccgtcgtcggtgcagagcgcttcctacacagggcagtgggggacgttccatttgggatgagaagaactcatgatttacattgtcttactatgaaataccatccctcactcttgacagacgacgtagctgatctgagcagcgccctggcacccgcaggcctaccccc

SEQ ID NO: 76341 - DNA, 30 bp, Homo sapiens; identical to SEQ ID NO: 44131
  misc_feature 1..30: note = chr14:102909162-102909192
  misc_feature 1..30: note = hypo
  source 1..30: mol_type = genomic DNA

SEQ ID NO: 76342 - DNA, 30 bp, Homo sapiens
  misc_feature 1..30: note = chr14:102948168-102948198
  misc_feature 1..30: note = hypo
  source 1..30: mol_type = genomic DNA
agctcttgcatcccccgtcccccattcccc

SEQ ID NO: 76343 - DNA, 30 bp, Homo sapiens
  misc_feature 1..30: note = chr14:102959193-102959223
  misc_feature 1..30: note = hypo
  source 1..30: mol_type = genomic DNA
aaggctgttaatgggcggaggctcacatta

SEQ ID NO: 76344 - DNA, 30 bp, Homo sapiens
  misc_feature 1..30: note = chr14:102977854-102977884
  misc_feature 1..30: note = hypo
  source 1..30: mol_type = genomic DNA
ggatgcctctgagtacgatggtggggagag

SEQ ID NO: 76345 - DNA, 30 bp, Homo sapiens
  misc_feature 1..30: note = chr14:102983823-102983853
  misc_feature 1..30: note = hyper
  source 1..30: mol_type = genomic DNA
gcggcccgcggactgcgggtgacagggtcc

SEQ ID NO: 76346 - DNA, 161 bp, Homo sapiens
  misc_feature 1..161: note = chr14:103007079-103007240
  misc_feature 1..161: note = hypo
  source 1..161: mol_type = genomic DNA
gcggacacctgcctccgggatgagcgcattgggcaacactgcatgctttgcattgggaacatgtttgtgtgtgtgcgttgggggtgtgtgtgcggtggggggctatgggctgggatgtcccttgaggtgatcagctctctacgttccgcacacacaaacac

SEQ ID NO: 76347 - DNA, 32 bp, Homo sapiens
  misc_feature 1..32: note = chr14:103018826-103018858
  misc_feature 1..32: note = hypo
  source 1..32: mol_type = genomic DNA
tgttttgttttgagacgaagtctcactgtcac

SEQ ID NO: 76348 - DNA, 803 bp, Homo sapiens
  misc_feature 1..803: note = chr14:103021316-103022119
  misc_feature 1..803: note = hyper
  source 1..803: mol_type = genomic DNA
gccacttggctggggcgaggccacctcgctttgggtcttgtcgcgcccaggccagcgccagcccaggcttgccatggactggctcctgggcgttagatgaatgaatcgactcaacccgggccgccacgttgtgttcagaacaccgacagtcgctcccaggcaaccagcacctgctgcgccccgtttccagcgacctccccaaccgcgtggactcgcatccacgtgcccggcggggccgcagcagaaaggctcggaccccccaggacgatcggccggtgggggccggtggggccgcagactcggggggcggggggcgccaggcttccgggtcctgcccccgccccgtggggaacagcaggacggcgccgaggccgtttcgctttcctccgcgcccatttgccgggaggggaccccgtgctccgacctgaaggtgacggcagagcctgcgggaggcctaggccggtcccgccctacgggtcccgggggcgaccctcgcgctgacattggcgtccaggccgcggcccctgcctccgcgcccacccacgccgggcctggccctcgctcccccgggaaaagccccgccggcggccgcgagagcgcggaagcgcagccgtagtgaccgcgagacaaagacccggcggcgggggaggcggcggagagaccccgccagcgcggagaccccagggaagcttctctggaagacctggtgctggtccgctctcccgggacctcattttccttatgtggacaacgggggcggggtcacagcagcccctcgggcttatagccgggttgttctttcc

SEQ ID NO: 76349 - DNA, 133 bp, Homo sapiens
  misc_feature 1..133: note = chr14:103216392-103216525
  misc_feature 1..133: note = hypo
  source 1..133: mol_type = genomic DNA
ctgcagccgcagtggcgcctgcatggagggggccccctaatcatggtgcctcggctgtggaatgttctgggagctagtcagaacggacatggctgccgcagctgaccctcccgcctggcgaactctttctggc

SEQ ID NO: 76350 - DNA, 30 bp, Homo sapiens
  misc_feature 1..30: note = chr14:103229680-103229710
  misc_feature 1..30: note = hypo
  source 1..30: mol_type = genomic DNA
agtggacggagtgaacgaacgaattttttt

SEQ ID NO: 76351 - DNA, 177 bp, Homo sapiens; identical to SEQ ID NO: 44136
  misc_feature 1..177: note = chr14:103277520-103277697
  misc_feature 1..177: note = hypo
  source 1..177: mol_type = genomic DNA

SEQ ID NO: 76352 - DNA, 171 bp, Homo sapiens
  misc_feature 1..171: note = chr14:103389118-103389289
  misc_feature 1..171: note = hyper
  source 1..171: mol_type = genomic DNA
acccagggccgaggtcgctctaggcctggagggtgaagatcttccgaggagtgggcagggagggctttggagggttgggggcgtgaaactcggccctgcctccctcgtctggcgagtgcgcagcccggaagtgcgcggccagtgcatcgggcggtgcgggagaggagagga

SEQ ID NO: 76353 - DNA, 401 bp, Homo sapiens
  misc_feature 1..401: note = chr14:103389502-103389903
  misc_feature 1..401: note = hyper
  source 1..401: mol_type = genomic DNA
cttccctaaacccctcgcggctccctcaggacaaccccacccaccacattcagggccggcctgacctggtcctgccgcccccagccccttcttacttctcataccgggttgcgctctgtcgcagctcttcccggcccaggtaggactcctccgggaagccttcctgattccaaggccgagaagaggtctgtgctgccccatcctcctccatgccccagttgtcactgtccttaacaacgctgtcctctgctccagcgccaggcaaactgggggcagtgccgggaggctatctaggcaggcgtcctgcagggcgcgtttgagcgggctctgcaggtatcagtagaagtccgttggagagcgcccgggcagggcgcccacagtctggccgggagggaccaggg

SEQ ID NO: 76354 - DNA, 85 bp, Homo sapiens
  misc_feature 1..85: note = chr14:103390113-103390198
  misc_feature 1..85: note = hyper
  source 1..85: mol_type = genomic DNA
gccagaaccggaccccgtgcgccggcggcgccgttgagttcccggcggacaaggtgcctgggagcgccggcggggtcggtgatgg

SEQ ID NO: 76355 - DNA, 775 bp, Homo sapiens
  misc_feature 1..775: note = chr14:103394683-103395458
  misc_feature 1..775: note = hyper
  source 1..775: mol_type = genomic DNA
ccaggggactgggggcggggtgggcgcggagcaggcccggacccccgcgtggcgccgcctcagcccgtgtctcttgcagctcctgccgctggatggggaactcgtcctggcttcaggagccggattcggcgtctcagacgtgggctcgcacctggactgtggcgcgggtgaggcggtcgggcaggggcggggctctggaaaggcatgttcaggggcggggactggagggaaggcgcgtcgaggggggcgaggaccggagggagggcgcctccgggggcgtggtttagggagtggcggaagtgtcccgaagcggggcttgggaggtcgtgctcagacgcgtggcgtggcgtggcgtggcgtggtgtggcgcggcgcttgttccgtggagctcagggatgtgctccggctcaggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccgggtgagcactgaggggagggaggctcgggtcccctctccccacctcggcccgaccccgcccctcctggtctgcacacgttgggtctgagcactcaggtgaagtctcttcctcgggctggctccggtggggacccggctgcccgcaga

SEQ ID NO: 76356 - DNA, 56 bp, Homo sapiens
  misc_feature 1..56: note = chr14:103406559-103406615
  misc_feature 1..56: note = hypo
  source 1..56: mol_type = genomic DNA
ttaccctccgcaggccgatggtctgcacccactccatggtgcgcacatcaaagacg

SEQ ID NO: 76357 - DNA, 30 bp, Homo sapiens
  misc_feature 1..30: note = chr14:103416858-103416888
  misc_feature 1..30: note = hypo
  source 1..30: mol_type = genomic DNA
gcctcttggactgctcgggaggtattgggc

SEQ ID NO: 76358 - DNA, 42 bp, Homo sapiens
  misc_feature 1..42: note = chr14:103456666-103456708
  misc_feature 1..42: note = hypo
  source 1..42: mol_type = genomic DNA
gagatgggggagaaccgcaaacaaacccggaatgcctgcggg

SEQ ID NO: 76359 - DNA, 216 bp, Homo sapiens
  misc_feature 1..216: note = chr14:103459583-103459799
  misc_feature 1..216: note = hypo
  source 1..216: mol_type = genomic DNA
acgttatatatactacgttcacttcccaacagactccaccagtgttgggaagaaaggcaggtatctgcaactctgaaggctgtgtgcacagggcatgccgcaggtgggttctcaatgagccgctccacatgggatgcgaggcttctggccaagagcacgtctattaacagcacttttggggacatctaacagactctcccacgtccaccagttttt

SEQ ID NO: 76360 - DNA, 49 bp, Homo sapiens
  misc_feature 1..49: note = chr14:103477626-103477675
  misc_feature 1..49: note = hypo
  source 1..49: mol_type = genomic DNA
ctaggcaaagccaaccggacccagagccacaccgcgtgtgtcaacagca

SEQ ID NO: 76361 - DNA, 22 bp, Homo sapiens
  misc_feature 1..22: note = chr14:103533487-103533509
  misc_feature 1..22: note = hypo
  source 1..22: mol_type = genomic DNA
gccaccgcgcccagccaatatt

SEQ ID NO: 76362 - DNA, 212 bp, Homo sapiens
  misc_feature 1..212: note = chr14:103550430-103550642
  misc_feature 1..212: note = hyper
  source 1..212: mol_type = genomic DNA
ctggagctgggagggcgcgggcgctgaggaccggcggccagccccgcggtgggcgtgagtgcgagggaggccgggagagcgcgtgtgggcggggagcgcgagaaggagagcgagccgggagagcgcggagccagcggagcgcggaggccccagcgccagcacccgcgcgggcggtgagcgtgagtgtggcgcagggtcgcccctccccagcc

SEQ ID NO: 76363 - DNA, 131 bp, Homo sapiens
  misc_feature 1..131: note = chr14:103584461-103584592
  misc_feature 1..131: note = hyper
  source 1..131: mol_type = genomic DNA
ctcccctctcctccccgacttccttctccaaacagccccatgaagcagcactgggcttcccaagagaggtcctgccacgtgactggcctctgtcattggcagaaccctgcataggccgtagctctgcagct

SEQ ID NO: 76364 - DNA, 93 bp, Homo sapiens
  misc_feature 1..93: note = chr14:103589787-103589880
  misc_feature 1..93: note = hyper
  source 1..93: mol_type = genomic DNA
gggccaggacagtggcggccaggccgggacacggtaagtgacctccgcttccacacgtccattccccgccgctccgcgcggcttctcgcccgc

SEQ ID NO: 76365 - DNA, 30 bp, Homo sapiens
  misc_feature 1..30: note = chr14:103593974-103594004
  misc_feature 1..30: note = hypo
  source 1..30: mol_type = genomic DNA
accaggggctgggcccgggccggcagggag

SEQ ID NO: 76366 - DNA, 328 bp, Homo sapiens; identical to SEQ ID NO: 35556
  misc_feature 1..328: note = chr14:103655240-103655568
  misc_feature 1..328: note = hyper
  source 1..328: mol_type = genomic DNA

SEQ ID NO: 76367 - DNA, 96 bp, Homo sapiens
  misc_feature 1..96: note = chr14:103655569-103655665
  misc_feature 1..96: note = hyper
  source 1..96: mol_type = genomic DNA
ccgcggggctgcggggtcgaggggaggggactagtgtgcaggggccaccctctccccagccccgccccccgagtccagctccgcccctgatgcgta

SEQ ID NO: 76368 - DNA, 43 bp, Homo sapiens
  misc_feature 1..43: note = chr14:103673852-103673895
  misc_feature 1..43: note = hyper
  source 1..43: mol_type = genomic DNA
ggaccacgctggacacgcagttcgcgtgcggccgctccccgag

SEQ ID NO: 76369 - DNA, 65 bp, Homo sapiens
  misc_feature 1..65: note = chr14:103674215-103674280
  misc_feature 1..65: note = hyper
  source 1..65: mol_type = genomic DNA
gttcccgggggtcacggccaagatccagcggaggatggaccaggtgttcacgctggcggtgcgcg

SEQ ID NO: 76370 - DNA, 717 bp, Homo sapiens
  misc_feature 1..717: note = chr14:103686706-103687423
  misc_feature 1..717: note = hyper
  source 1..717: mol_type = genomic DNA
tccgtcctcttctcccgacctggcgtgcgtctcctgttccccggccccccatcccatgggaccgtccttcctaacggcacttcaccccgcccggcccacgaggtggtcccgggccggtgacaagatctggacgtggcgactccgggaaggggcgaccgggcgcggagagcccctgggacccaggcctcagggacgcatcggggtcggagctgggcccgggggcggggctggggtggggaggctgaggttccttcgccccttccctcccctcgccccccgcagcctcgcggcgcgtttcctgccccgcccgccaggagggagtggcccccgccaagtcccgcgcgtctctgccaagaccccgtgcgggtccgtgccggtcgcgctatccaggcgcccgcccaggcttggggagctctgcgcgcgggagccggcgactcctcggggcaccagggcgtggcgagggcgtcggcctcggcggggaggccttggctgggccgtcggggtggcgccgtgccctggaggtcgtggctggaagcgaggccgcgggggtccaggagcgctcatcggggcgccagatgcagcctgcgggacgtccagtgcccgcgcaggggccgggcgaggccgtggcctccaggcaacgcgcagccgcgttggcgcgagttttaaatcggtgccttcccagctttgcaagttcttatcaatcgttacatgcaagag

SEQ ID NO: 76371 - DNA, 47 bp, Homo sapiens
  misc_feature 1..47: note = chr14:103698810-103698857
  misc_feature 1..47: note = hypo
  source 1..47: mol_type = genomic DNA
ctgagtgagtccagccgagagggctgggaggccggagggcagggctg

SEQ ID NO: 76372 - DNA, 71 bp, Homo sapiens
  misc_feature 1..71: note = chr14:103699549-103699620
  misc_feature 1..71: note = hypo
  source 1..71: mol_type = genomic DNA
cagccaatgccccagcgcccccagcagcccggcccactctctccagactccctgcccggtagaagagcaca

SEQ ID NO: 76373 - DNA, 519 bp, Homo sapiens
  misc_feature 1..519: note = chr14:103739918-103740437
  misc_feature 1..519: note = hyper
  source 1..519: mol_type = genomic DNA
ccagcctgggttgagcggggcggatctgggactccgaggcttcctacgtggggcgggttcccagcggacgcctctgccgcacccctggcggggacccagctgcgccccttcccgcggccctcctagggcctgggtgcttggaggctcgaggccccaagatccatgtcgcccggaatcccggtgcctaggccttgtcgcgggccctgggaccaactcgcgggggtcaggagctgggggttgagagaaagatgatcaggtgggttggagaaaggagacgcttcccgctgggcgagtgagcccaggacgcggcagaagagggcagaccctaggggaccgccgcgtccccaggcgcgcacgcgacccctccccgcgccgaaaatcctctccccgcctcagtctccccgcctccgcctccccacccatagtgtcactccgaccctagccctgggtccaaacgggcaggagaggtcgctggtgcctccgcggtccccgccgcgcgcagaactcggccgagtgcac

SEQ ID NO: 76374 - DNA, 72 bp, Homo sapiens; identical to SEQ ID NO: 35562
  misc_feature 1..72: note = chr14:103740539-103740611
  misc_feature 1..72: note = hyper
  source 1..72: mol_type = genomic DNA

SEQ ID NO: 76375 - DNA, 520 bp, Homo sapiens
  misc_feature 1..520: note = chr14:103745299-103745819
  misc_feature 1..520: note = hyper
  source 1..520: mol_type = genomic DNA
ccgggccaaggctggcgggggtcgccgcggcgcgaccgcctcctccgccccggctccgtgggatgcgcgtccgccctcccaggccccttcctcccgccctcccccgccccccgttttcctcccctcccctcccgacccgccccaggccagacccccgcgcgggtcctcgccctcccaggacccttcctccctcccctcccctccccgccgcgtcccggaccctgcgggctggtcccgcgccccgccagggctgccggggtgtgctgctggggagcgtggagtgggcaggaccacgctggacacgcagttcgcgtgcggccgctccccgagcagtgcgcggcgtgggcggaggagcggctccgcgaggagatcgaggcgaacgcggcgcccgcgttgctggaggtcgtggacgcggcgggcgccgagcacctggtcacgctccaggacctggacatccgccacggcgacggctccgcggtgctcccgggcgtgtgcagcgaggcctcgttccgggccgtga

SEQ ID NO: 76376 - DNA, 30 bp, Homo sapiens
  misc_feature 1..30: note = chr14:103778195-103778225
  misc_feature 1..30: note = hypo
  source 1..30: mol_type = genomic DNA
actttaattaacctacgttcttccctacgc

SEQ ID NO: 76377 - DNA, 30 bp, Homo sapiens
  misc_feature 1..30: note = chr14:103793396-103793426
  misc_feature 1..30: note = hypo
  source 1..30: mol_type = genomic DNA
gggggacagagcacacgtacacctggaggg

SEQ ID NO: 76378 - DNA, 30 bp, Homo sapiens
  misc_feature 1..30: note = chr14:103814512-103814542
  misc_feature 1..30: note = hypo
  source 1..30: mol_type = genomic DNA
tatcactgaatgcaccgatgaaatactctc

SEQ ID NO: 76379 - DNA, 89 bp, Homo sapiens; identical to SEQ ID NO: 15869
  misc_feature 1..89: note = chr14:103820833-103820922
  misc_feature 1..89: note = hypo
  source 1..89: mol_type = genomic DNA

SEQ ID NO: 76380 - DNA, 30 bp, Homo sapiens
  misc_feature 1..30: note = chr14:103977805-103977835
  misc_feature 1..30: note = hypo
  source 1..30: mol_type = genomic DNA
ggagttcagctgcttcggctgcttctgctg

SEQ ID NO: 76381 - DNA, 41 bp, Homo sapiens
  misc_feature 1..41: note = chr14:103988695-103988736
  misc_feature 1..41: note = hyper
  source 1..41: mol_type = genomic DNA
cttggcgcgcagctccgcgtacagctcgggggtcagcacct

SEQ ID NO: 76382 - DNA, 375 bp, Homo sapiens
  misc_feature 1..375: note = chr14:103989154-103989529
  misc_feature 1..375: note = hyper
  source 1..375: mol_type = genomic DNA
gacgcaggcgaacagcggccgctccgcgctcccgcggctcttaaggggcacaacgcgggccgcccattggcggctatttatagcccattcattccattggcccgcgccgcggggtggtgccgccgctttgtccgccgcccgcagcccccaacaccctggccgcccacccgagctgtcccctcgctgggaccccgcgcagcctgcccagtcccccgcccaagacctcgaggccgaaacctcaggtccttggatatctggatcccctcgcacgcccttgcctctgggcgggaaactgaggcggagagcctccgggcactcgaggacgcttgggttcatccgcatcctcgagcctgcccgcctagtccagccagcccc

SEQ ID NO: 76383 - DNA, 60 bp, Homo sapiens
  misc_feature 1..60: note = chr14:103989537-103989597
  misc_feature 1..60: note = hyper
  source 1..60: mol_type = genomic DNA
cggcgaggggccgggcgaaagctttcggggcttccgcagcaggtacggcccccgccccac

SEQ ID NO: 76384 - DNA, 80 bp, Homo sapiens
  misc_feature 1..80: note = chr14:103996379-103996459
  misc_feature 1..80: note = hypo
  source 1..80: mol_type = genomic DNA
atggtgcaatggtggcggtgcgtgtgcagcgtggggcacagacccagacccggcatggtgtcctgcggcactcagttgac

SEQ ID NO: 76385 - DNA, 17 bp, Homo sapiens
  misc_feature 1..17: note = chr14:104006077-104006094
  misc_feature 1..17: note = hypo
  source 1..17: mol_type = genomic DNA
cttttttttggagaccg

SEQ ID NO: 76386 - DNA, 89 bp, Homo sapiens
  misc_feature 1..89: note = chr14:104014163-104014252
  misc_feature 1..89: note = hypo
  source 1..89: mol_type = genomic DNA
cgcctcgctgccccacgcctgcaccctgacatccccagcacgttttttaattttttttttccattttttattttttgcgtgtgatagtc

SEQ ID NO: 76387 - DNA, 70 bp, Homo sapiens
  misc_feature 1..70: note = chr14:104048912-104048982
  misc_feature 1..70: note = hypo
  source 1..70: mol_type = genomic DNA
ggctcccagttcctccgcagaacctgcaggagtgtgcgtgatgaaacccgtcactcgttgtgtatggtag

SEQ ID NO: 76388 - DNA, 57 bp, Homo sapiens
  misc_feature 1..57: note = chr14:104061854-104061911
  misc_feature 1..57: note = hypo
  source 1..57: mol_type = genomic DNA
ctggtggatgtgggccgcacccctccagctggtcccacctgccgaccagctgttctg

SEQ ID NO: 76389 - DNA, 27 bp, Homo sapiens
  misc_feature 1..27: note = chr14:104062202-104062229
  misc_feature 1..27: note = hypo
  source 1..27: mol_type = genomic DNA
ttttttttttgagaccgagtctcgctc

SEQ ID NO: 76390 - DNA, 26 bp, Homo sapiens
  misc_feature 1..26: note = chr14:104062469-104062495
  misc_feature 1..26: note = hypo
  source 1..26: mol_type = genomic DNA
gcttgagccaccgtgcccagcctatt

SEQ ID NO: 76391 - DNA, 30 bp, Homo sapiens
  misc_feature 1..30: note = chr14:104083385-104083415
  misc_feature 1..30: note = hypo
  source 1..30: mol_type = genomic DNA
tctgcaccttgtgggcggggctgtggccga

SEQ ID NO: 76392 - DNA, 30 bp, Homo sapiens; identical to SEQ ID NO: 44144
  misc_feature 1..30: note = chr14:104121128-104121158
  misc_feature 1..30: note = hypo
  source 1..30: mol_type = genomic DNA

SEQ ID NO: 76393 - DNA, 120 bp, Homo sapiens
  misc_feature 1..120: note = chr14:104159317-104159437
  misc_feature 1..120: note = hypo
  source 1..120: mol_type = genomic DNA
agttttcatccactccgccctttggtgtggctgtcagtgggtggccgggtgcctgtggctgctctagaacctgtttctcaggtgcctggggcccacccggcagctcgagctgttgggact

SEQ ID NO: 76394 - DNA, 37 bp, Homo sapiens
  misc_feature 1..37: note = chr14:104160021-104160058
  misc_feature 1..37: note = hypo
  source 1..37: mol_type = genomic DNA
cgccctgcccggaggcgccagccgcactccttggctt

SEQ ID NO: 76395 - DNA, 39 bp, Homo sapiens
  misc_feature 1..39: note = chr14:104194452-104194491
  misc_feature 1..39: note = hypo
  source 1..39: mol_type = genomic DNA
tgttggtgctgactccgctgggcacgtccatcaggtggg

SEQ ID NO: 76396 - DNA, 55 bp, Homo sapiens; identical to SEQ ID NO: 44145
  misc_feature 1..55: note = chr14:104194695-104194750
  misc_feature 1..55: note = hypo
  source 1..55: mol_type = genomic DNA

SEQ ID NO: 76397 - DNA, 68 bp, Homo sapiens
  misc_feature 1..68: note = chr14:104195247-104195315
  misc_feature 1..68: note = hypo
  source 1..68: mol_type = genomic DNA
ccaccttcctcgtcacgtttggaaactcagagaaacctgaaactatgacttgtcgtctttccaataac

SEQ ID NO: 76398 - DNA, 42 bp, Homo sapiens
  misc_feature 1..42: note = chr14:104199986-104200028
  misc_feature 1..42: note = hypo
  source 1..42: mol_type = genomic DNA
actattttgaacatacggacaaggcctcgccttcctgtgtcc

SEQ ID NO: 76399 - DNA, 136 bp, Homo sapiens; identical to SEQ ID NO: 44147
  misc_feature 1..136: note = chr14:104202705-104202841
  misc_feature 1..136: note = hypo
  source 1..136: mol_type = genomic DNA

SEQ ID NO: 76400 - DNA, 36 bp, Homo sapiens
  misc_feature 1..36: note = chr14:104335400-104335436
  misc_feature 1..36: note = hypo
  source 1..36: mol_type = genomic DNA
gcgaagtcggccgggcgcggtggctcacgcctgtaa

SEQ ID NO: 76401 - DNA, 30 bp, Homo sapiens
  misc_feature 1..30: note = chr14:104346851-104346881
  misc_feature 1..30: note = hyper
  source 1..30: mol_type = genomic DNA
cctctgtggcaaccccgtgtgtggttttgg

SEQ ID NO: 76402 - DNA, 26 bp, Homo sapiens
  misc_feature 1..26: note = chr14:104355130-104355156
  misc_feature 1..26: note = hypo
  source 1..26: mol_type = genomic DNA
gtgtttgatttgacacgccctccccg

SEQ ID NO: 76403 - DNA, 30 bp, Homo sapiens
  misc_feature 1..30: note = chr14:104367439-104367469
  misc_feature 1..30: note = hyper
  source 1..30: mol_type = genomic DNA
catctcagcatgttccgacagaaggggcct

SEQ ID NO: 76404 - DNA, 98 bp, Homo sapiens
  misc_feature 1..98: note = chr14:104386144-104386242
  misc_feature 1..98: note = hypo
  source 1..98: mol_type = genomic DNA
caatacataataaaacgagggccccccctttttttttttagacagagtttcagttggtcatcaggctggagtgcaatggtgcgatcgcggctcactgc

SEQ ID NO: 76405 - DNA, 38 bp, Homo sapiens
  misc_feature 1..38: note = chr14:104387082-104387120
  misc_feature 1..38: note = hypo
  source 1..38: mol_type = genomic DNA
aggcgtgaaccaccgcgcccggccggcccctttcttga

SEQ ID NO: 76406 - DNA, 30 bp, Homo sapiens
  misc_feature 1..30: note = chr14:104486789-104486819
  misc_feature 1..30: note = hypo
  source 1..30: mol_type = genomic DNA
gggaggatgcagcttcgaggagaagacgct

SEQ ID NO: 76407 - DNA, 30 bp, Homo sapiens
  misc_feature 1..30: note = chr14:104503586-104503616
  misc_feature 1..30: note = hypo
  source 1..30: mol_type = genomic DNA
acagctcctgcgagccgctgccccgccatg

SEQ ID NO: 76408 - DNA, 30 bp, Homo sapiens
  misc_feature 1..30: note = chr14:104547888-104547918
  misc_feature 1..30: note = hypo
  source 1..30: mol_type = genomic DNA
ctggagcggaggccacgctctgagcaccct

SEQ ID NO: 76409 - DNA, 36 bp, Homo sapiens
  misc_feature 1..36: note = chr14:104560644-104560680
  misc_feature 1..36: note = hypo
  source 1..36: mol_type = genomic DNA
tcactgccctctgtccgtccccgcccagttggagtc

SEQ ID NO: 76410 - DNA, 30 bp, Homo sapiens
  misc_feature 1..30: note = chr14:104561546-104561576
  misc_feature 1..30: note = hypo
  source 1..30: mol_type = genomic DNA
gctgccatggagaggcgctctcccgccctt

SEQ ID NO: 76411 - DNA, 34 bp, Homo sapiens
  misc_feature 1..34: note = chr14:104567474-104567508
  misc_feature 1..34: note = hypo
  source 1..34: mol_type = genomic DNA
cctgagtgtttcccacgtgcgtgtgggtgtggga

SEQ ID NO: 76412 - DNA, 44 bp, Homo sapiens
  misc_feature 1..44: note = chr14:104568268-104568312
  misc_feature 1..44: note = hypo
  source 1..44: mol_type = genomic DNA
gctcctctctgcccccgggtgtggggtcacgattcccctggcct

SEQ ID NO: 76413 - DNA, 131 bp, Homo sapiens
  misc_feature 1..131: note = chr14:104571985-104572116
  misc_feature 1..131: note = hypo
  source 1..131: mol_type = genomic DNA
gcaggaagggccaggcggtgggcacacagcagggaggccttctgactggcggcgctgccttagtgcggggctgcctcgggagctgcctgtccagaagaagggcgggtgagtgggggcggtgcttgctctgg

SEQ ID NO: 76414 - DNA, 33 bp, Homo sapiens
  misc_feature 1..33: note = chr14:104572793-104572826
  misc_feature 1..33: note = hypo
  source 1..33: mol_type = genomic DNA
gtgaccattccgtcccgacggcggtgggagcag

SEQ ID NO: 76415 - DNA, 161 bp, Homo sapiens
  misc_feature 1..161: note = chr14:104573825-104573986
  misc_feature 1..161: note = hypo
  source 1..161: mol_type = genomic DNA
ggcccagtaagaccccggcccagagttcctagaaaacaaaaatgttgtggacaaagctgggaggacacggtgcatctctgtgcacctgtgggtatggggggctggggtggaggtggggcagaaggtcctggcccagcagccagacgcggtcaataaaaagc

SEQ ID NO: 76416 - DNA, 30 bp, Homo sapiens
  misc_feature 1..30: note = chr14:104576414-104576444
  misc_feature 1..30: note = hypo
  source 1..30: mol_type = genomic DNA
ccagcctgggctgcccgaggccaggacgac

SEQ ID NO: 76417 - skipped

SEQ ID NO: 76418 - DNA, 30 bp, Homo sapiens; identical to SEQ ID NO: 44151
  misc_feature 1..30: note = chr14:104600477-104600507
  misc_feature 1..30: note = hypo
  source 1..30: mol_type = genomic DNA

SEQ ID NO: 76419 - DNA, 136 bp, Homo sapiens; identical to SEQ ID NO: 35566
  misc_feature 1..136: note = chr14:104601737-104601873
  misc_feature 1..136: note = hyper
  source 1..136: mol_type = genomic DNA

SEQ ID NO: 76420 - DNA, 1412 bp, Homo sapiens
  misc_feature 1..1412: note = chr14:104601963-104603375
  misc_feature 1..1412: note = hyper
  source 1..1412: mol_type = genomic DNA
cgaggctggggcagcccacaggaggagcgcgggacccgggcttgagtttgcacccaggcagagcgcccacccccgcccctagcttcggaccctgaaagtaaagtcgtcgtgcccggcagccagcccgaatcttccagccctcagggagtcggggtcggggcagggaaggccacgggtggcggcacaatcgggatcctggagtggaggcgcagactgcgggtcccgctgcgcacgctccgtggtccggttggggtgggccttggaggtccataggccaaggttgaacgggggctctggagcgtgggcggggtggagtgcacaggtcactgggctctgagcgtttccatgggccaggaccccaacgcgccgtgtcctcaggacagattggagggggaaggggctgcgattatgccccagtcggaagggttttacagcagccgcgctgccctctccctgccggatacccggcagtagacaccgacgtctgggggctagcgaggcaggtgggcgcggaccgcgacccgattctggcttccaacctccgcccagtggcgcgcggggccgtcgccccacacctccagtccgcgtggctggtgtctggctcgccgccggggcggaaggggcgctgtcggcgcaggcgggcggggccggagcgcgggggcgcgcggcgcggagcgagcgcagggctcgggggcgcggggcgcggaggaccgggggcttgacgggcggccctgcgcggtgcggggcgcggcggcggcgggcgcgcggccagtgaacgcgcgggcggggcggcggtggcgggaggcactaggggccgctccccgcgcttccctcttccatggcgctgccccagccgcccgagccgccccgcggcgcgccccgcaaggctcccagcctgctggagatgggggcgctctgcctggactcggagatcatcctgggcttcaccagccacctcctgcggcgacgaggcaaggtgagggctgtcgggaggggggcgggcggcgtaggcgccgtcccgttactttgccgcgcggctcgcgcggccgggggtgctgcgccgggaaggagacggcaggtccggagccgcgtcccgcagcccgggctgggactcgctgccgcactttcccccattagcgttgtccaagtctccctctgccttcaaggctgtgtcccaaccggacccacccggaggctgtggctagggcggagagcgcagcgcagggattctcgggctcaccttgcgccttgctaggatgggcgaagtagggggtcggggcccctgactgatcgtgagcccccgaggtgactccagccttgtgcaccccgtgttctgcggatatgggatgtgagcttgtgcttcccgaagcgccgcggcggtagaagcgctgaagttgcgggtgtggctggcc

SEQ ID NO: 76421 - DNA, 38 bp, Homo sapiens
  misc_feature 1..38: note = chr14:104603715-104603753
  misc_feature 1..38: note = hyper
  source 1..38: mol_type = genomic DNA
aggtcatcaacgacccggaaagccgggaggggatcacc

SEQ ID NO: 76422 - DNA, 1513 bp, Homo sapiens
  misc_feature 1..1513: note = chr14:104604105-104605618
  misc_feature 1..1513: note = hyper
  source 1..1513: mol_type = genomic DNA
gcgacatttggggcccggctaggcacagagcaactggtcgccagggaagggcgggggggcggcctcccagccggagacaaacaagcaattaattccggagctgagttcccatctgccaggcctgctgacaacaggtccggcgcacgcccgcaggacctcccgcttcccgggcggcacggcgcgcacacccacttgcgggcacacgcgcggctgtaaagacacgtgccgttcgcagacgcgccgaggcacagatacgccggcgcggtcgctgcccggctcgaggcgcacaccgcggcgacactaacccacgcgcgacagttagacctaaagtggcccgcgacacgcagagtacgctgggcttgctggaaaggcgcctgggagtctcggggccggggtcccgccccttcctcggcccacctcgccgtgggccttgggcaagagcgtcccctccgcagcctcagttttcccgcctgtagagggaggggcgtcggcgcctcctgggagacgcgcagccctggtgtcccgggagaggggcgggaggcgcatgcgcgcgcgcaactagatcctcgccgccgcccccagcgcccctccccggggcagggactcacctaacaggttggggtccttggagtgcgcggggccgcgtggggaagcggggaccctaccccccccacgcgccgcccagcactgggcaagggcggggcactctctgggctcccgcccctcgccgcccgccccgggagcccgagccccgcccttccccggccccgccctcgcctcccgagcgcgcccaccggagccaccgcgctcctcgcgacactcgcaggctctgcgaacttccgagcggctgggccgggccatgggggcgcctcggggccggatcacgtagccgcggcgcccccggagagccagcgtggccgggagcgcctgccgggctcttcccgcgccccggccatggtcggccgcggcgtccctctgtgcgctgcgcagcccgcggtacgcgcggcccggcctggagagggaggcgggcggcgggggcccgggacggcgaagatactcgcggtgtgcgctggatccctgggggccgggcctcctgctgagggtagcggacccgcaggcgggacctccggggatggagggagtgggtgagcgccagggtcgtgcccagggctcctaactttggcaagagcgtcacgctggggcagggcgcgcaggggtctggatccgacggacgtcccaggctcactgtccgcttccgcccccacaccctgcaggtggccgagggcggcccggcccgcgagccgccgccgctgctggaggtgtccccccgaaagaggctacccgccgggcccgaccaggacccatgcggcagccgccctgctcccgaaggcgccggggccggcccagagcagggccactcggccggcggaggcggctggtgccgccactgccacacgaagctggtggagctcaagcgacaggcgtggaagctggtcagcgggcccgggaccac

SEQ ID NO: 76423 - DNA, 30 bp, Homo sapiens
  misc_feature 1..30: note = chr14:104608088-104608118
  misc_feature 1..30: note = hypo
  source 1..30: mol_type = genomic DNA
ctctttagcaacacccgatgcctgcatggt

SEQ ID NO: 76424 - DNA, 30 bp, Homo sapiens; identical to SEQ ID NO: 44152
  misc_feature 1..30: note = chr14:104609469-104609499
  misc_feature 1..30: note = hypo
  source 1..30: mol_type = genomic DNA

SEQ ID NO: 76425 - DNA, 858 bp, Homo sapiens
  misc_feature 1..858: note = chr14:104617582-104618440
  misc_feature 1..858: note = hypo
  source 1..858: mol_type = genomic DNA
gctcttgtttttagccgtttctagaacccagtctcagggttctagagaaacctgtgtgtccccccagttcagggaagggggcagtcaccaaacagggtgcatcccagcgtacagctcagacctgggtgggggagctggtggagtgtgcggcggggggtggggccctgggctgtacccgatcctgcggctcttgcgccccttcggtgagctcatgtgccctctaggagcgtctccgagggaggccttcgcttctgttgacacctttacagcagcactgatttgattttccacctgccccaccggggctggagacctgaagaggaagggagagggtctcctgcccctggctctgccttgagtgagtgtgggtgagggaggccctcgtggctctgaagagacgttgcttttaaggggccctgcttcttgccagtctcctgcgtgtccccggccaggcggccttagctgacagtggtccggttgtccgggagccgcaaacctgccttgttagccgcaggccggggcgcttaatgacggctggggaaggtggacagttaacaaggacattgtgagcctcacgatgaagcccgatcattattttcctgctgggcttgtgtgggtgaaagtgtttgggcttattaatctgttacggatggtgcggtggccaggcgggagctcgcagcgtcatggacggtgagagtgctggtgggctctgggtgccggccctccctccccaggcactgaccctgcctttgtcccttgctgtcctcaggatccttgcctctctgccctgcttctcgacaagctaccagcacctggggccctgccagcctgtcgcccagaggccgagcgccgctgtga

SEQ ID NO: 76426 - DNA, 154 bp, Homo sapiens
  misc_feature 1..154: note = chr14:104618676-104618830
  misc_feature 1..154: note = hypo
  source 1..154: mol_type = genomic DNA
tgtctgtagcacctgcgggtcttggaggggcgctgagcacggtcaccatccaggcccagcagtgcctggagggcatgtggagtgtctcgcgggtcaacagcttcctcccgccggcgtgcctggtgagtgtcttgctcagcggatgggagctgct

SEQ ID NO: 76427 - DNA, 295 bp, Homo sapiens
  misc_feature 1..295: note = chr14:104619085-104619380
  misc_feature 1..295: note = hypo
  source 1..295: mol_type = genomic DNA
cagcacagggcttggcgatgcacagggcaccgtgtgtagatcggggctcacgaggcagatggagtaggagggcccttgtggcagagcgagggcctgtgtggaggcctgggggtgtgaggcgtccatggacgtcgggcgggggaccggcagttgcaattgctggagatgcgttgcctgcccctgtggcaccctgggggcagagggacatgtgggtggctgtgaagagccgtgtttctgcctggtacactgtctagtcaccacacagcgaccagcacaagctcgcccttctcccttg

SEQ ID NO: 76428 - DNA, 193 bp, Homo sapiens; identical to SEQ ID NO: 44156
  misc_feature 1..193: note = chr14:104620411-104620604
  misc_feature 1..193: note = hypo
  source 1..193: mol_type = genomic DNA

SEQ ID NO: 76429 - DNA, 847 bp, Homo sapiens
  misc_feature 1..847: note = chr14:104622914-104623761
  misc_feature 1..847: note = hypo
  source 1..847: mol_type = genomic DNA
cctggaagctggtaccggccatgggttgggcagggtgagccggccatgggttgggcagggtgagccctccatggtggtgaggagggatactgtctgggatggcagggcctctgtctggagtgtccctcctgggtcccggggcggcttgttctgctgacgtgccgtgcctggcctctggcctgtgccacttgggacaccctgaggacgctgggccttccagaccagcccacgtcccctcagcacggggaccccagtcctctgctagcctgggtacaaaggacgcctcgggcagtggttatcgactggacacttggggccgaatgacgcttggcacctgggtgaccgtgacctgaccaggccacggtgcccaagggggtccttggagagcttggggcactgggcccttggggaaggggccggggcgaggggtggccaggctgaagcaggctgccttccctgccttgcctggggttgcatccccccacgccgcccaggaccaggtttggcctgagggttcggggtcccacgtgtctgggaatggaacgtgcggaggtggagctcacgtttgctgggctgtcccgggcgtttaattacgtttgtgcttcattatgaggaggcctccctttctgggatttatttgagctaatgagttggaaatgccagggtagtatttcagatgagggagcgccacacatcaccgtacgtggggcaattagtgttcctgccaaatagttatcgtggtttcttctctaattacgccgctgggtgctcccaggaggctcaggggtgagagggtggggggtctgtgtccatcggtcttgaccagtgtggtcgctgcgattctgga

SEQ ID NO: 76430 - DNA, 291 bp, Homo sapiens
  misc_feature 1..291: note = chr14:104626758-104627049
  misc_feature 1..291: note = hypo
  source 1..291: mol_type = genomic DNA
gatcccatgggtgcccgggtacccgagtttcgttaatgctaacaggggcatagatagagcaggggctgagccccatgccctcaccccctgggtggggcctggggaagctgcagggattgaggcagcgcagctgtgacagagcttggcatgctggcccagcaagtgttcgggagggtggggcgcgtgggccgggtggccccggggttaggagttctccgaaggctctggtgacccccagggttaggagttccctgaaggttctggcaactctgatgacgctgtctgaggccc

SEQ ID NO: 76431 - DNA, 184 bp, Homo sapiens
  misc_feature 1..184: note = chr14:104627651-104627835
  misc_feature 1..184: note = hypo
  source 1..184: mol_type = genomic DNA
gggagggtggggctccgtccaccagcctcgcacggcccagtgtggaagctctgggttggccataagtgattcctgcacgcgacagaacaggctcgtgtgtctccttggggtaattaagggcctcaccatcaaggccaactgcctgtgaaattaccctcttgtttggaagcggtgatttttctct

SEQ ID NO: 76432 - DNA, 159 bp, Homo sapiens
  misc_feature 1..159: note = chr14:104628609-104628768
  misc_feature 1..159: note = hypo
  source 1..159: mol_type = genomic DNA
ggtggagatgtggggcgaacaaccttccagacttccagggctgatggaaccacagaggacgcccggtcccagcctctgtctaggcggcctgggccctgggtgtgcccgctgtggcccaggcatacctgagatctgtgctgcggacgctgctcctgggag

SEQ ID NO: 76433 - DNA, 150 bp, Homo sapiens
  misc_feature 1..150: note = chr14:104630025-104630175
  misc_feature 1..150: note = hypo
  source 1..150: mol_type = genomic DNA
aaccccgagcatgcgcggcacggggcggccatgggccccgacccctgctctgactcacacctgcatcctggggcccaggcccgtgtgcctgagacccctggacctcacccggcatcgccagcatttacccaataccgtgccagctgtggg

SEQ ID NO: 76434 - DNA, 64 bp, Homo sapiens
  misc_feature 1..64: note = chr14:104630660-104630724
  misc_feature 1..64: note = hypo
  source 1..64: mol_type = genomic DNA
caccacacccttcgccgggtggcatcctggcctctggcccgcgtgggagcgcctcctgttggga

SEQ ID NO: 76435 - DNA, 45 bp, Homo sapiens; identical to SEQ ID NO: 44163
  misc_feature 1..45: note = chr14:104630962-104631007
  misc_feature 1..45: note = hypo
  source 1..45: mol_type = genomic DNA

SEQ ID NO: 76436 - DNA, 282 bp, Homo sapiens
  misc_feature 1..282: note = chr14:104636842-104637124
  misc_feature 1..282: note = hypo
  source 1..282: mol_type = genomic DNA
acttacaattaaatccgtgaaaaatattggctctgaaatgagtctcgggtaatttgatttacgctgtagtggagaaatcagagatttcagcgcagagtggactgtggtgtcctccagcaggaaatggggcctgtctctggctctgcgttggagccctggttcagggtggccctcgtgtgcgcagcctctgccgggtcagagccgccgcctcctggcatcgacgcaccagacccacctgtgtggggtgtccctgctgtggatgggtttcggagtgtttgcagt

SEQ ID NO: 76437 - DNA, 33 bp, Homo sapiens; identical to SEQ ID NO: 44165
  misc_feature 1..33: note = chr14:104638185-104638218
  misc_feature 1..33: note = hypo
  source 1..33: mol_type = genomic DNA

SEQ ID NO: 76438 - DNA, 837 bp, Homo sapiens
  misc_feature 1..837: note = chr14:104639050-104639887
  misc_feature 1..837: note = hypo
  source 1..837: mol_type = genomic DNA
ctcccatcctcatcacggtggttgctggcagcttctgatgggaaaggaggctggtcctacacatgggccgtggtgggcatatggggtgaggggcttgtggagaggaagctgaacccctgccgaactgaaaggcagagggcttaggatggatccaaagaggcccctgagatctcggtgcccctggttggcccccggggacgccagtagccataaaggctccttgcgtggtgtgtggtggggcctgacgcctgcgtggcccccaggcaagtcgtacaccatgatcgggaaggacagctcaccccagagcctgggcatcgtgccctgcgccatctcctggctcttcaggctcatcgaggagcgcagggagaggacgggcacccgcttctccgtccgggtctcagccgtggaggtgtgcgggcgcgaccagagcctgcgggacctgctggccgaggtggcccctggcagcctccaggacacccagtctccgggagtgtacctgcgggaggaccccgtgtgtggggcgcaggtgcgcctgcctactgtcccaccttgggggaggggggctgcacttggccctgagccactgaagacgccgctgcctctgcctttcctgcagctccagaaccaaagcgagctgcgggcacccacggccgagaaggcggctttctacctggatgcggccctggcggcccgcagcaccagccgagcgggctgtggcgaggacgcccgacgcagctcccacatgttgttcacgctgcacgtctaccagtaccgcatggagaagtgcggccggggaggaagtaggtgccacacccgcactcccgggcccctgtggga

SEQ ID NO: 76439 - DNA, 399 bp, Homo sapiens
  misc_feature 1..399: note = chr14:104640183-104640582
  misc_feature 1..399: note = hypo
  source 1..399: mol_type = genomic DNA
gagccaagcatgtgccgtatcggtgagtgtagggcctgggcaggtgccgaccagggtggccccttggtgacctggtaaatccgtgtctggtgtgcccggtgctgctgtggcccccagctcctcagggctttgctcctccaccacctgacaggcctcgctgcccgtgggctgcctggggccccacgctgggctggtgccggagctgggtgggaaccagactgatcccagggctgcccttggccagcctgtccccgaagctcccttcccaaggccttggcatctgaaccgcctcgacccgcagggaccacaggctcaccatgctgctgcgtgaatccctggccaccgctggctgccgcaccaccatgatcgcccacgtgtcggatgcgccagcccagcacg

SEQ ID NO: 76440 - DNA, 532 bp, Homo sapiens
  misc_feature 1..532: note = chr14:104641305-104641837
  misc_feature 1..532: note = hypo
  source 1..532: mol_type = genomic DNA
tttcttcccccagtacgcctccagctcctctggcggggagagctcctgtgaggaaggccgggcccgtcggcccccgcacctgcggcccttccacccacgcactgtggccctggaccccgaccgcacgcctccctgcctgcccggtgaccccgattactcctccagcagcgagcagtcctgtgacacggtcatctacgtggggcccggtggggcggcgctgtcagaccgggagctcaccgacaacgaaggtccgcctgacttcgtgcccatcatccctgccctgagccgccaccggccctccaagggtccccgagacgcagaccacttccgctgcagcaccttcgcggagctgcaggagcggctggaatgcatggacggcaacgagggtccctcaggaggtccaggtggcaccgacggagctcaggccagccccgcccgagggggccggaagccctcgccaccagaggctgcatcccccaggaaggccgtgggcaccccgatggctgccagcacccctcgaggcagttctggt

SEQ ID NO: 76441 - DNA, 202 bp, Homo sapiens
  misc_feature 1..202: note = chr14:104642041-104642243
  misc_feature 1..202: note = hypo
  source 1..202: mol_type = genomic DNA
actgatggagtggcacggacccctcccgtgggcatgagtgggcaggtggctgggtccccgatgcttcctggggccacctgcccccgcctggctgctggcagtcgctgtccggagcggggcctgctcaccaccacagtgaccctgcagcggccagtggagctcaacggcgaggacgagctggtgttcacggtggtggaggagc

SEQ ID NO: 76442 - DNA, 288 bp, Homo sapiens
  misc_feature 1..288: note = chr14:104642454-104642742
  misc_feature 1..288: note = hypo
  source 1..288: mol_type = genomic DNA
cagctcctggctcagcgaggtcagcgtctgcactgccgacagccgtgaccccacgccgcagccccgcttcagccccgactcgctggcagggcttgaccctgggggcccccctgccctggatggttccctgggggatggaagctctgggttcctggggccagacagacctgacagtcctgggccaacctggggtccgtgccctggggaagtggctgcagtggccccatcccgacccggcagggagccccaggccgggccctcgcggtgggcatccgcagcccagaccat

SEQ ID NO: 76443 - DNA, 1271 bp, Homo sapiens
  misc_feature 1..1271: note = chr14:104643013-104644284
  misc_feature 1..1271: note = hypo
  source 1..1271: mol_type = genomic DNA
ccagaggctgtggctcggatcccaccgctgcggaggggtgccaccacgctgggtgtgacaacgccagctgtgtcctggggagatgctcccacggaggtggtggcctgctcggggagcctgaaggcctcccccaccagcaagaagggtctggctcccaaggcgggcttcctcccgaggcccagtggggcggcccccccggccccacccacgcggaagtccagcctggagcagaggagcagcccggcctcggcccctccgcatgctgtgaacccggcgcgggtcggggctgctgctgtccttcgaggggaggaggagcccagacccagcagccgggctgaccactctgtccccagggccacgtccagcctgaaggcccgggccagcaaggtagaagcagcacaccgtcttgccggacacgcgtctctggagcggtacgaaggcctggcgcacagcagcagcaagggccgggaagcccctgggcggcctccccgggctgtacccaagctgggtgtgccaccctccagccccacacacggtccagctcccgcctgtaggagcggcgcagccaaggctgtgggggcccccaagccccctgttggtggaggcaagggccgtggcctagtggctggtgggtcgcgggctctggggccttcggtgaagctgtctacggcctctgtgacgggcaggagccctggcggccctgtggccggtcccagagcagccccacgggccgggcccagtgtcggggcgaaggctggccggggtaccgtcatgggcacaaagcaggcgctccgggctgctcacagccgcgtccatgagctgtcagccagtggagccccgggccgaggtggctcctcgtggggctcggcggactcagacagcggccatgacagcggcgtgaacgtgggggaggagcggccacccacgggcccggccctgccctccccctacagcaaggtgaccgccccacggcggccccagcgctacagcagcggccatggcagcgacaacagcagcgtgctgagtggagagctgccgcccgccatgggccgcaccgcccttttccaccacagcggtggcagcagtggctatgagagcctgcggcgcgacagcgaggccaccggcagcgcctcctccgcccctgactccatgagcgagagtggggctgcctccccaggcgcccgcacccgcagcctcaagtcccccaagaagagggccacaggtgggtgcagaggtgcacagccctctacagtttacgggctttctgtgtg

SEQ ID NO: 76444 - DNA, 382 bp, Homo sapiens; identical to SEQ ID NO: 44172
  misc_feature 1..382: note = chr14:104645126-104645508
  misc_feature 1..382: note = hypo
  source 1..382: mol_type = genomic DNA

SEQ ID NO: 76445 - DNA, 990 bp, Homo sapiens
  misc_feature 1..990: note = chr14:104645716-104646706
  misc_feature 1..990: note = hypo
  source 1..990: mol_type = genomic DNA
gagcagtgtgagtcccgcccgcccacggacccagcccggcccaccgtgtgccctgacagctgccctcccctcccagagccctgttgctctcctgtacctcgtggtgggaaggctggaaggcagggtcggccgggccaagatgcctttcctggggcctctggggggccaggtggctgcccccagcctcgggcctgacgcaggtgcccctcccctctcctcccctccccagttgaggtggacccggagctggagcccgagtcggccgagtacctggcggccctggagcgagccacggcggccctggagcagtgcgtgaacctgtgcaaggcgcacgtcatgatggtcacctgcttcgacatcagcgttgcagccagtgctgccatcccggggccgcaggaggtggacgtctgaggctgggcgccggacaagaggagggggcgtgcagcgggctggaggacgggacgtgggacggagcgaggatgtggtgggggctgcggggggaggatgcggaggggtttctgtgcaggacgggagtctcagagaggagacggagtgtgggggagggagggccggccacgcggtggacagagcgagggtgccagggtgaccagaagaccgtcaccacccgacagcaacgcaagtgcctttgaccttgatttggacttttctcccttttgcatttggtgctacagacttgagacaccagcagaagttgtgttcagcccggccccgctgcgcctgtccgggccggggctggcgccggttgtgtttgtgtccaccttgccttctttgcagccaagcagtttttgtggagtggagtgggacttacctgcacgccccaggggtctttcaggattcaggatgacttttcttttacaatggtttcctctcggcagagcccgggttgtgggggatctgtgtggggttctcaacgcagatccatcctggggtctcccgggcagggatggctgacctcgagtcccctccctt

SEQ ID NO: 76446 - DNA, 207 bp, Homo sapiens; identical to SEQ ID NO: 44175
  misc_feature 1..207: note = chr14:104647208-104647415
  misc_feature 1..207: note = hypo
  source 1..207: mol_type = genomic DNA

SEQ ID NO: 76447 - DNA, 30 bp, Homo sapiens; identical to SEQ ID NO: 44176
  misc_feature 1..30: note = chr14:104647924-104647954
  misc_feature 1..30: note = hypo
  source 1..30: mol_type = genomic DNA

SEQ ID NO: 76448 - DNA, 283 bp, Homo sapiens
  misc_feature 1..283: note = chr14:104648592-104648875
  misc_feature 1..283: note = hypo
  source 1..283: mol_type = genomic DNA
ggccacagggtcacccgcacccaggcccctagtgtccatcgcaggtggcccttgggactccagcctctgggattggggttgcaggccagcctgggaggctgctggggcccctgatcctccagccccagccctgcttttgttggaggccagcgctgcgtcccagcagaaactcagactaatgtggagggcagggttgttcccgagaagccgagggccacgcatgccggctctgtgctgggtttggagaacttggcgagggggtcgggtccgggtggggtgtgat

SEQ ID NO: 76449 - DNA, 30 bp, Homo sapiens
  misc_feature 1..30: note = chr14:104674208-104674238
  misc_feature 1..30: note = hypo
  source 1..30: mol_type = genomic DNA
ccctttccgtggcaacgacccaatgactat

SEQ ID NO: 76450 - DNA, 172 bp, Homo sapiens
  misc_feature 1..172: note = chr14:104676826-104676998
  misc_feature 1..172: note = hypo
  source 1..172: mol_type = genomic DNA
aggtttcagttgctgcgtgtgtgaaccgaattggcgccttctccttttccagccatcagtatgccttttgtgcgattttgtgttagcacccagcaggatggggtgtcagagcctcagagtccccagggagtgtccccgtcccagcccagaggggaagcggcactggggccca

SEQ ID NO: 76451 - DNA, 30 bp, Homo sapiens
  misc_feature 1..30: note = chr14:104679828-104679858
  misc_feature 1..30: note = hypo
  source 1..30: mol_type = genomic DNA
ccggtgagaactcaccgcagctgacacccg

SEQ ID NO: 76452 - DNA, 189 bp, Homo sapiens
  misc_feature 1..189: note = chr14:104682484-104682673
  misc_feature 1..189: note = hypo
  source 1..189: mol_type = genomic DNA
actggagcctcaggtcggggtggacacgaagggcttccgtggactcaagtcgctgccccttggggtgcctggggctcggagccctgccgtgagcacgcacactatgccccagtgaatttctgattgcaaaagacatcgggcatcgggcgggggcactcggctcccatctgcagccgccccttttgtcag

SEQ ID NO: 76453 - DNA, 30 bp, Homo sapiens
  misc_feature 1..30: note = chr14:104682881-104682911
  misc_feature 1..30: note = hypo
  source 1..30: mol_type = genomic DNA
ctttagagcctccctcgtgtggggcagtcg

SEQ ID NO: 76454 - DNA, 87 bp, Homo sapiens
  misc_feature 1..87: note = chr14:104696332-104696419
  misc_feature 1..87: note = hypo
  source 1..87: mol_type = genomic DNA
agtgatggctgaggacgaacaagggtgcgaactgtcactgacatttccgtggggcgtggacgtgacacatcccgaatgccatacctg

SEQ ID NO: 76455 - DNA, 186 bp, Homo sapiens
  misc_feature 1..186: note = chr14:104705204-104705390
  misc_feature 1..186: note = hypo
  source 1..186: mol_type = genomic DNA
agaaagactgccagacgtgcggctgaggaggagccaggctacgcctgccctcaggcccccgagagtgtggaggcccctggccatgcaccggaggagcctctgatggatgcttcataagagtggtgcccacactgcagccacctccgctgccagggacccctccggtgaacacgttggctcctcctc

SEQ ID NO: 76456 - DNA, 58 bp, Homo sapiens
  misc_feature 1..58: note = chr14:104719866-104719924
  misc_feature 1..58: note = hypo
  source 1..58: mol_type = genomic DNA
cgcgttctccagcaccggtggagagaaagccccgctgtccagccgagttctgatggag

SEQ ID NO: 76457 - DNA, 32 bp, Homo sapiens
  misc_feature 1..32: note = chr14:104735865-104735897
  misc_feature 1..32: note = hypo
  source 1..32: mol_type = genomic DNA
tccctttggttttaacgcgtccttattttctg

SEQ ID NO: 76458 - DNA, 32 bp, Homo sapiens
  misc_feature 1..32: note = chr14:104759084-104759116
  misc_feature 1..32: note = hypo
  source 1..32: mol_type = genomic DNA
cagcgttttggctcccgcgtgttggggcgggg

SEQ ID NO: 76459 - DNA, 30 bp, Homo sapiens
  misc_feature 1..30: note = chr14:104760897-104760927
  misc_feature 1..30: note = hypo
  source 1..30: mol_type = genomic DNA
acatttggtggactccgatttggggtgtgt

SEQ ID NO: 76460 - DNA, 310 bp, Homo sapiens
  misc_feature 1..310: note = chr14:104768148-104768458
  misc_feature 1..310: note = hypo
  source 1..310: mol_type = genomic DNA
ggatccgccccaggccgcatgggcggggaaggggagctgagccggagccactccacctggtgccgggcctgtgccctttccagggcaaccgatgtctcagagtcctggccccagagcagagagcctctgcaccctggaaggtcctgcttgctggagtgaggggcctgcgaggaccggccctgttctcaagcccagccgtggacctgcgtgggctgcctggcgggcctcattctctctgcagtgggagaaatgtgcagtcaaccctgagcgaacgtctaaacctccaaacacaccacgactttcaaagcct

SEQ ID NO: 76461 - DNA, 103 bp, Homo sapiens
  misc_feature 1..103: note = chr14:104770277-104770380
  misc_feature 1..103: note = hypo
  source 1..103: mol_type = genomic DNA
cccgggtctggccagcgggcactagtgtgggagttcagctggcaacccccgacagccttctgagcacggcccccttaccaggtgccgccgcttcccagcctcc

SEQ ID NO: 76462 - DNA, 30 bp, Homo sapiens
  misc_feature 1..30: note = chr14:104773160-104773190
  misc_feature 1..30: note = hypo
  source 1..30: mol_type = genomic DNA
gcttcacctgggagccggctggtcagaggt

SEQ ID NO: 76463 - DNA, 30 bp, Homo sapiens; identical to SEQ ID NO: 44181
  misc_feature 1..30: note = chr14:104798505-104798535
  misc_feature 1..30: note = hypo
  source 1..30: mol_type = genomic DNA

SEQ ID NO: 76464 - DNA, 38 bp, Homo sapiens; identical to SEQ ID NO: 44182
  misc_feature 1..38: note = chr14:104800605-104800643
  misc_feature 1..38: note = hypo
  source 1..38: mol_type = genomic DNA

SEQ ID NO: 76465 - DNA, 37 bp, Homo sapiens; identical to SEQ ID NO: 44183
  misc_feature 1..37: note = chr14:104801369-104801406
  misc_feature 1..37: note = hypo
  source 1..37: mol_type = genomic DNA

SEQ ID NO: 76466 - DNA, 30 bp, Homo sapiens
  misc_feature 1..30: note = chr14:104812509-104812539
  misc_feature 1..30: note = hypo
  source 1..30: mol_type = genomic DNA
gggggcacccggcaccgtgggaggcgtgca

SEQ ID NO: 76467 - DNA, 62 bp, Homo sapiens
  misc_feature 1..62: note = chr14:104820337-104820399
  misc_feature 1..62: note = hypo
  source 1..62: mol_type = genomic DNA
ggaagcgtgcagaggcgcagcagagcctggtgtgctggaggaacagacgtgtggtcgggggg

SEQ ID NO: 76468 - DNA, 121 bp, Homo sapiens
  misc_feature 1..121: note = chr14:104821569-104821690
  misc_feature 1..121: note = hypo
  source 1..121: mol_type = genomic DNA
gaccagtgcagcacccgcaagctgcactccagcttggggctcccttccctgtcctcccgtccactgtcaccttgcacagccttcgactcgctctcctgactgggaccggcctctcccagcc

SEQ ID NO: 76469 - DNA, 30 bp, Homo sapiens
  misc_feature 1..30: note = chr14:104841778-104841808
  misc_feature 1..30: note = hypo
  source 1..30: mol_type = genomic DNA
cggggagacagggtgcgggaggagcccctt

SEQ ID NO: 76470 - DNA, 201 bp, Homo sapiens
  misc_feature 1..201: note = chr14:104842214-104842415
  misc_feature 1..201: note = hypo
  source 1..201: mol_type = genomic DNA
agcagatgcacagcccgtatagatgcccaggacttgcttcatttgtgttaattaccttcttttgattttcctgatcaataaattatcccgacgtaattggattatttgcatggctggcaagaggtcgctgtgatttagcgcctggcatcctggcagctgcgtggggtcccattctctctgagctgtcggcctggtcctgtc

SEQ ID NO: 76471 - DNA, 36 bp, Homo sapiens
  misc_feature 1..36: note = chr14:104854637-104854673
  misc_feature 1..36: note = hypo
  source 1..36: mol_type = genomic DNA
agatggatgaaaaatcgctggcgaaggtcactacag

SEQ ID NO: 76472 - DNA, 30 bp, Homo sapiens
  misc_feature 1..30: note = chr14:104858976-104859006
  misc_feature 1..30: note = hypo
  source 1..30: mol_type = genomic DNA
gagctggtccttccacgtggaacaccctgg

SEQ ID NO: 76473 - DNA, 166 bp, Homo sapiens
  misc_feature 1..166: note = chr14:104862860-104863026
  misc_feature 1..166: note = hypo
  source 1..166: mol_type = genomic DNA
attccccagtgagcacggagcagcagcccgcccggctcagcagtgccttgccctggccctttctctcctcgctggttcatctgcattaaagaaacagaaagcttccttcgctggcccgctcattgcctgtcttctctccctgcctcagctgcggtcaggctccagg

SEQ ID NO: 76474 - DNA, 30 bp, Homo sapiens
  misc_feature 1..30: note = chr14:104889841-104889871
  misc_feature 1..30: note = hypo
  source 1..30: mol_type = genomic DNA
ggtggggcctgagcacgggctggtgtgggg

SEQ ID NO: 76475 - DNA, 263 bp, Homo sapiens
  misc_feature 1..263: note = chr14:104897587-104897850
  misc_feature 1..263: note = hypo
  source 1..263: mol_type = genomic DNA
ttcatccgtcccactgcgggcgcagcaccatatctgttcattcatctcactgcggaggcagcaccatatccattcactaattccactgcggtggcagcaccctatccattcatcgtcccactgcgggctcatctgggtcttcgtggagccacggtcctgcttcagtagatccaattttccaaagctgctctgtggattttcagcccctcccaccgtgtgtgggggccactgccttctctgtcctaaagcggccctgccatcgc

SEQ ID NO: 76476 - DNA, 257 bp, Homo sapiens
  misc_feature 1..257: note = chr14:104899274-104899531
  misc_feature 1..257: note = hypo
  source 1..257: mol_type = genomic DNA
ctaatctgcaagctgcggcccgaggcgcacctggctgtcccagccctcccagcagcacctggcggctccctgagcttgtccacagcagcagtcgtcttcagggtggctctgcactggcaggccccgggtgcccttcccacgggggtggcagggagccggctactccagacgggccccgcactgtggacaggcgctgatgcttcggtttccgtggttgccccggccccgttgtttgagggccccgagcctggcccacc

SEQ ID NO: 76477 - DNA, 37 bp, Homo sapiens
  misc_feature 1..37: note = chr14:104917379-104917416
  misc_feature 1..37: note = hypo
  source 1..37: mol_type = genomic DNA
aggccaaggtacccccggcagccgatgggaaatcccc

SEQ ID NO: 76478 - DNA, 30 bp, Homo sapiens
  misc_feature 1..30: note = chr14:104937788-104937818
  misc_feature 1..30: note = hypo
  source 1..30: mol_type = genomic DNA
gggggtactcagtggcgaagggagagacaa

SEQ ID NO: 76479 - DNA, 38 bp, Homo sapiens; identical to SEQ ID NO: 44188
  misc_feature 1..38: note = chr14:105026775-105026813
  misc_feature 1..38: note = hypo
  source 1..38: mol_type = genomic DNA

SEQ ID NO: 76480 - DNA, 30 bp, Homo sapiens
  misc_feature 1..30: note = chr14:105052447-105052477
  misc_feature 1..30: note = hypo
  source 1..30: mol_type = genomic DNA
ggtgactttcagtgacgggacctcggccca

SEQ ID NO: 76481 - DNA, 68 bp, Homo sapiens
  misc_feature 1..68: note = chr14:105055027-105055095
  misc_feature 1..68: note = hypo
  source 1..68: mol_type = genomic DNA
gcactggaggacctgcgggcccggctcctcggccttgtcctgcacctgcggcacgtggccctcacctg

SEQ ID NO: 76482 - DNA, 30 bp, Homo sapiens
  misc_feature 1..30: note = chr14:105059531-105059561
  misc_feature 1..30: note = hypo
  source 1..30: mol_type = genomic DNA
ccaaggggccctgtgcgaggcctggaggtg

SEQ ID NO: 76483 - DNA, 114 bp, Homo sapiens
  misc_feature 1..114: note = chr14:105063222-105063336
  misc_feature 1..114: note = hypo
  source 1..114: mol_type = genomic DNA
actcaggatgggcttcgtgagggaagatcacccacagcagggcagggtgtcaagggatcttccggggaggtgggcggaggccgaggcgggtggggcgggcgcacctgtggggta

SEQ ID NO: 76484 - DNA, 332 bp, Homo sapiens
  misc_feature 1..332: note = chr14:105070904-105071236
  misc_feature 1..332: note = hyper
  source 1..332: mol_type = genomic DNA
ctcgcgctcctgcaccgtgaggttggcgctcagccacatgccctcggtgaagagcaggcagcggccgcggaagtcgtggccgttctcggacagcgggaccaccaccacgaagctgaacaggaaggccaagaagtagcaggcgcactgagcgaaaaggaaattgttgagcgccatggccggcccgggcgagagcggcggcgggaaggccgcgggaggctgcgccgggcggggaggccgcgggaggctgcgcagtggcggcgccggcaggtcccgcgcgcccctcccgggacgcgtgcgcatcggccgagcgcgggaagcgcctgcggtcagca

SEQ ID NO: 76485 - DNA, 30 bp, Homo sapiens
  misc_feature 1..30: note = chr14:105084500-105084530
  misc_feature 1..30: note = hypo
  source 1..30: mol_type = genomic DNA
ggtatgggctttcctcggaagttgagcaag

SEQ ID NO: 76486 - DNA, 48 bp, Homo sapiens
  misc_feature 1..48: note = chr14:105101539-105101587
  misc_feature 1..48: note = hypo
  source 1..48: mol_type = genomic DNA
ccaagctgcctgaatcggggaggggctgggggtcggcacacacaggag

SEQ ID NO: 76487 - DNA, 30 bp, Homo sapiens
  misc_feature 1..30: note = chr14:105103478-105103508
  misc_feature 1..30: note = hypo
  source 1..30: mol_type = genomic DNA
tcacccactgaggaacgggcaccacccgtc

SEQ ID NO: 76488 - DNA, 33 bp, Homo sapiens
  misc_feature 1..33: note = chr14:105103792-105103825
  misc_feature 1..33: note = hypo
  source 1..33: mol_type = genomic DNA
acagagaaacaagggcgtcggggatgctaagtc

SEQ ID NO: 76489 - DNA, 159 bp, Homo sapiens
  misc_feature 1..159: note = chr14:105132631-105132790
  misc_feature 1..159: note = hypo
  source 1..159: mol_type = genomic DNA
caaccagcccccacccgccgaggtgacactggagctgggagagtggcagcctccatggcggccacagtggctcccagctcccctgcagcagggcctccctcctcccccagggccgggcagagggcacctgcagggcatcttccccggcaccccctggct

SEQ ID NO: 76490 - DNA, 99 bp, Homo sapiens
  misc_feature 1..99: note = chr14:105157485-105157584
  misc_feature 1..99: note = hypo
  source 1..99: mol_type = genomic DNA
ttgtggaggagctgacggctgtcaagcgaatgacacacaccgcacatgtggggacgtggaagctcctacctgaaatagactctgcgccttccatcaaag

SEQ ID NO: 76491 - DNA, 30 bp, Homo sapiens
  misc_feature 1..30: note = chr14:105173303-105173333
  misc_feature 1..30: note = hypo
  source 1..30: mol_type = genomic DNA
ctggagcccaccctccgctccagccagctg

SEQ ID NO: 76492 - DNA, 143 bp, Homo sapiens
  misc_feature 1..143: note = chr14:105174251-105174394
  misc_feature 1..143: note = hypo
  source 1..143: mol_type = genomic DNA
tgggtccccagccatcggcgggtgaacccacccacactgcgcatgaagaagctgaactggcagaagctgccatccaacgtggcacgtggtgagggtccccagacccccaagggaagcttcccctaggacgggggctggtctct

SEQ ID NO: 76493 - DNA, 43 bp, Homo sapiens
  misc_feature 1..43: note = chr14:105194951-105194994
  misc_feature 1..43: note = hypo
  source 1..43: mol_type = genomic DNA
ccccttgctctgtgccgggcacagtcgtcgtacaaactgccat

SEQ ID NO: 76494 - DNA, 80 bp, Homo sapiens
  misc_feature 1..80: note = chr14:105195803-105195883
  misc_feature 1..80: note = hypo
  source 1..80: mol_type = genomic DNA
gcagcatggcgtcggcgtgggagggaggaggtagcgtcggcgtgggggaggagcgtggcgtcggcgtcgtggggaggagc

SEQ ID NO: 76495 - DNA, 273 bp, Homo sapiens
  misc_feature 1..273: note = chr14:105196272-105196545
  misc_feature 1..273: note = hypo
  source 1..273: mol_type = genomic DNA
gtgggcagaggcccacgaacctggccctgaccctcagctcgtccccagctcacagcacagccctcccctggctgcctccaaggagtctccagttactgagtggccactccgtgccagctcagcccacccctcaccttcccagtgcctgtggaggcccaactagggtgacgctgggagaggagagggcttggaggagccacgggtcaaatgcaggaggccacacctgcctgcccaggaggactgcaggagccggatccttaacacctggagggg

SEQ ID NO: 76496 - DNA, 38 bp, Homo sapiens
  misc_feature 1..38: note = chr14:105218308-105218346
  misc_feature 1..38: note = hypo
  source 1..38: mol_type = genomic DNA
ccagagtgggcgccgagagcgagcgagggctgccagca

SEQ ID NO: 76497 - DNA, 43 bp, Homo sapiens
  misc_feature 1..43: note = chr14:105235762-105235805
  misc_feature 1..43: note = hypo
  source 1..43: mol_type = genomic DNA
aatgttgtaaaaaaacgccgtggtgcagcggcagcggcagcgt

SEQ ID NO: 76498 - DNA, 240 bp, Homo sapiens
  misc_feature 1..240: note = chr14:105240937-105241177
  misc_feature 1..240: note = hypo
  source 1..240: mol_type = genomic DNA
ctgcaggacagagcccgggcctcaacaaaagcctggcaggcagggctgcagggcatggggagctggggcctcctggagcctcggcagagtgcaaggaagaccagggccacctgccccacccacctgcccgcacacgggagcagcgagcacagcccctagcccacactgggcacctccacagcctgaccctccagggcaggcctgtctcaccagcggcggagtccacggtgtgtaaagccc

SEQ ID NO: 76499 - DNA, 30 bp, Homo sapiens; identical to SEQ ID NO: 44194
  misc_feature 1..30: note = chr14:105254641-105254671
  misc_feature 1..30: note = hypo
  source 1..30: mol_type = genomic DNA

SEQ ID NO: 76500 - DNA, 143 bp, Homo sapiens
  misc_feature 1..143: note = chr14:105268653-105268796
  misc_feature 1..143: note = hypo
  source 1..143: mol_type = genomic DNA
tcccacaacctgagccggcacaccgtagtgcacactcgagagaagccgcatgcctgccggtggtgtgagcgccgtttcacgcagtccggggacctctaccgccacgtccgcaagtttcactgtggcctcgtcaagtcccttct

SEQ ID NO: 76501 - DNA, 108 bp, Homo sapiens
  misc_feature 1..108: note = chr14:105292310-105292418
  misc_feature 1..108: note = hyper
  source 1..108: mol_type = genomic DNA
cttggatgttcactccgagtgcgatgggagctgcaggaaggtttgatccccggagagaccagatcgggcttgagctctgaccgcaacccctggcgctggttggagggc

SEQ ID NO: 76502 - DNA, 746 bp, Homo sapiens
  misc_feature 1..746: note = chr14:105309697-105310443
  misc_feature 1..746: note = hyper
  source 1..746: mol_type = genomic DNA
tcaccccgggatgcccgcccagcgcgccaagccccccacgctcacctgtaagtgcaggtggtgctggaggccaggccggggccctgcaggggcaggcacacagtggggctccgtcgccgcagcgccccggcggcctcctcctggccgctggccctcccctaaggcttcctcatcctaaacagcaagtgaagccaaacgaaaaccctgtctctcccgccgttccctccctcctggcctccgtcccccgggctcgcctgccccgccgcccggcggaccggtcccttcctgctttccctggcgggtgctttccgctgctctgttacccggagccaggacgcgcatatattcccagaatccgcgctcagtgcgttcggtcccccgggacacctgttctctgcacaggcgcgtctgggcgcagcgggggcagacacgcgttcccgggcagcgactccggaaggcccgagggagtaaatctggccctcccggttcagcacaaagctcccctggccgcctttcaaaaccgaccgcctcccaactctccgcggacacgagtggcggctgcctcccctcccctcccctagggccgcgcacgcctcccgcagggtctcagtgcctcctgggcgggggataattcctgtccccaccggtgtcctgtactcgcggggtcccgggtgtaagttctgggtcccgggctggctccctggtgagcaaagccgcatcgctcgaattccagaaacccttctcgc

SEQ ID NO: 76503 - DNA, 349 bp, Homo sapiens; identical to SEQ ID NO: 35575
  misc_feature 1..349: note = chr14:105310485-105310834
  misc_feature 1..349: note = hyper
  source 1..349: mol_type = genomic DNA

SEQ ID NO: 76504 - DNA, 231 bp, Homo sapiens
  misc_feature 1..231: note = chr14:105433929-105434160
  misc_feature 1..231: note = hyper
  source 1..231: mol_type = genomic DNA
cccaccctcagccaccgcactgggagcggctgttcctacactgcctgtagtggggatggagtgcagaggctcagcgagcggcagacctgcctctggccacagagctgcgcagtggggacccctccagtcactgggctggcaggagcctggcccaggaacacaaacaggaagggggaaatcctgcccgcctcgggataaggctgcgcagccaggctaccggcctcggacccg

SEQ ID NO: 76505 - DNA, 19 bp, Homo sapiens
  misc_feature 1..19: note = chr14:105434286-105434305
  misc_feature 1..19: note = hyper
  source 1..19: mol_type = genomic DNA
cgcccggcctccggttctc

SEQ ID NO: 76506 - DNA, 182 bp, Homo sapiens
  misc_feature 1..182: note = chr14:105444452-105444634
  misc_feature 1..182: note = hyper
  source 1..182: mol_type = genomic DNA
cggcgcgcgccctcgcgcgtagcccacccgccccaggggagcgggctgcaggcggggaggggcgcaccgctgccgggggttccgggccaggtgggcagcaccatgtggaagcagtcgcacatcgcggcggccaggcggtgcgggcctggcggcccgtcgcgtccagtcgctggtcccggctc

SEQ ID NO: 76507 - DNA, 20 bp, Homo sapiens
  misc_feature 1..20: note = chr14:105444788-105444808
  misc_feature 1..20: note = hyper
  source 1..20: mol_type = genomic DNA
cggagcgcgctcgcgggcgg

SEQ ID NO: 76508 - DNA, 81 bp, Homo sapiens
  misc_feature 1..81: note = chr14:105457696-105457777
  misc_feature 1..81: note = hypo
  source 1..81: mol_type = genomic DNA
gcctcttggcttgtgcgcgtctcggcttgcgggtaaaggccaggcgccccgctgcgtgcctcgggccgtgcctcatgatct

SEQ ID NO: 76509 - DNA, 99 bp, Homo sapiens
  misc_feature 1..99: note = chr14:105479261-105479360
  misc_feature 1..99: note = hypo
  source 1..99: mol_type = genomic DNA
gggtatgtgtgtgtccggggcagggggggtgggttcctcaccagtgtgttgtggcagcccagagctggccaaggcagtgtttctcggcgtatgcctcag

SEQ ID NO: 76510 - DNA, 393 bp, Homo sapiens
  misc_feature 1..393: note = chr14:105511966-105512359
  misc_feature 1..393: note = hyper
  source 1..393: mol_type = genomic DNA
cacacaaggcagtatcgcgtattttccacgagtgcctgtgcaggcaggtaaggatttaggaaaggtctggaaggatgtgcaaaatgttccgcctgcgaaggttccgcggtggcggggacactgctccggctccgctcccgcccgcccgagcgctcggatggggccgcctctgcactgcgtggccacaggcgcggcccggctgcccacgggcgccctttgcagctgctgccccctggcggccgcgggcggctactagcgggaaagcgaaacccgcccggtccattcaagccccgctgcctggcgccctctagggtcgttcttgggaacgggcggacctttcgtcaacactttgcctgcaagatcccccattgggggaaccgaggaggaagttaa

SEQ ID NO: 76511 - DNA, 393 bp, Homo sapiens; identical to SEQ ID NO: 76510
  misc_feature 1..393: note = chr14:105511966-105512359
  misc_feature 1..393: note = hypo
  source 1..393: mol_type = genomic DNA

SEQ ID NO: 76512 - DNA, 30 bp, Homo sapiens
  misc_feature 1..30: note = chr14:105523817-105523847
  misc_feature 1..30: note = hypo
  source 1..30: mol_type = genomic DNA
tcacattagccactgcgactacatacgatt

SEQ ID NO: 76513 - DNA, 30 bp, Homo sapiens; identical to SEQ ID NO: 44196
  misc_feature 1..30: note = chr14:105538919-105538949
  misc_feature 1..30: note = hypo
  source 1..30: mol_type = genomic DNA

SEQ ID NO: 76514 - DNA, 34 bp, Homo sapiens
  misc_feature 1..34: note = chr14:105590655-105590689
  misc_feature 1..34: note = hypo
  source 1..34: mol_type = genomic DNA
atgaggccatcaccacgttcgagcccagtcttgt

SEQ ID NO: 76515 - DNA, 76 bp, Homo sapiens
  misc_feature 1..76: note = chr14:105658349-105658425
  misc_feature 1..76: note = hypo
  source 1..76: mol_type = genomic DNA
cttcctcctccacctcggctcccgagtgctgcttctcctgggacttccgacatggctccctcgtccatccccatct

SEQ ID NO: 76516 - DNA, 111 bp, Homo sapiens
  misc_feature 1..111: note = chr14:105662505-105662616
  misc_feature 1..111: note = hyper
  source 1..111: mol_type = genomic DNA
tcagatggtcaggagcgccgcagggcccccgtgaaggagggatgaaccctggccgcatcactcccctcccaggcctcagcccctcttcccagcccacggtcctgggtgggc

SEQ ID NO: 76517 - DNA, 183 bp, Homo sapiens
  misc_feature 1..183: note = chr14:105662937-105663120
  misc_feature 1..183: note = hyper
  source 1..183: mol_type = genomic DNA
gaccccaggctgggccggcctcctcgtctgggcctcggctcggagggtttcctgcccgcccgctcctagcctggcaggaagcggacacctcagaacaaagggaccggcggacaatggccattgaattgggccggggcgctcgcgcagggacaggccgccagctgcccgcgctgataagaccct

SEQ ID NO: 76518 - DNA, 186 bp, Homo sapiens; identical to SEQ ID NO: 35579
  misc_feature 1..186: note = chr14:105714232-105714418
  misc_feature 1..186: note = hyper
  source 1..186: mol_type = genomic DNA

SEQ ID NO: 76519 - DNA, 186 bp, Homo sapiens; identical to SEQ ID NO: 35579
  misc_feature 1..186: note = chr14:105714232-105714418
  misc_feature 1..186: note = hypo
  source 1..186: mol_type = genomic DNA

SEQ ID NO: 76520 - DNA, 146 bp, Homo sapiens
  misc_feature 1..146: note = chr14:105715247-105715393
  misc_feature 1..146: note = hyper
  source 1..146: mol_type = genomic DNA
cggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctgg

SEQ ID NO: 76521 - DNA, 47 bp, Homo sapiens
  misc_feature 1..47: note = chr14:105715982-105716029
  misc_feature 1..47: note = hypo
  source 1..47: mol_type = genomic DNA
gtacagtgatgagatcgatctggaagccgacacggtgctggccactc

SEQ ID NO: 76522 - DNA, 129 bp, Homo sapiens
  misc_feature 1..129: note = chr14:105723744-105723873
  misc_feature 1..129: note = hypo
  source 1..129: mol_type = genomic DNA
cagcccactcatccacgccctgggctggaggcccctgacctctcttgcaactccatgcagaacagcaaggcctcccaccctaagaaggtgccagggctgggtacaggggcattccgacacagagcagaa

SEQ ID NO: 76523 - DNA, 30 bp, Homo sapiens; identical to SEQ ID NO: 44200
  misc_feature 1..30: note = chr14:105739229-105739259
  misc_feature 1..30: note = hypo
  source 1..30: mol_type = genomic DNA

SEQ ID NO: 76524 - DNA, 202 bp, Homo sapiens
  misc_feature 1..202: note = chr14:105739460-105739662
  misc_feature 1..202: note = hypo
  source 1..202: mol_type = genomic DNA
ttaggctctgagtggcgtgtgcggtgtggctgaatgtgcctctctccagggctctgaggtgcggcgtgtctggcaagggcttggtttgggctggctggcaggtgctatgcccctgactgccctgggctacagtgggaatgccccttttcctacagccacatgccccagcgccaccgccttccccaaccgcacagagtctggg

SEQ ID NO: 76525 - DNA, 30 bp, Homo sapiens; identical to SEQ ID NO: 44202
  misc_feature 1..30: note = chr14:106334145-106334175
  misc_feature 1..30: note = hypo
  source 1..30: mol_type = genomic DNA

SEQ ID NO: 76526 - DNA, 38 bp, Homo sapiens
  misc_feature 1..38: note = chr14:20707559-20707597
  misc_feature 1..38: note = hypo
  source 1..38: mol_type = genomic DNA
agagctggtttcggccgggcgcggtggctcatgcctgt

SEQ ID NO: 76527 - DNA, 125 bp, Homo sapiens
  misc_feature 1..125: note = chr14:20928177-20928302
  misc_feature 1..125: note = hypo
  source 1..125: mol_type = genomic DNA
atttttattgagaaacgagaaagacagctataacattcctgaggcacatgcttcaaagccttttctcctaaataaacactaggctctctcacctttacattctctgtatacgctcatcctttttt

SEQ ID NO: 76528 - DNA, 30 bp, Homo sapiens
  misc_feature 1..30: note = chr14:20936882-20936912
  misc_feature 1..30: note = hypo
  source 1..30: mol_type = genomic DNA
taacagaattttcttcgtgggaggagtcct

SEQ ID NO: 76529 - DNA, 77 bp, Homo sapiens
  misc_feature 1..77: note = chr14:21093454-21093531
  misc_feature 1..77: note = hyper
  source 1..77: mol_type = genomic DNA
aattttgcacttgtacgctggggcaaaatgctgacagaatgaagaaggtaattgcaaactcctataacgtgtgtggt

SEQ ID NO: 76530 - DNA, 196 bp, Homo sapiens
  misc_feature 1..196: note = chr14:21093591-21093787
  misc_feature 1..196: note = hyper
  source 1..196: mol_type = genomic DNA
tcgaatcccaccactgccagtggtacgttttagcacaacaaggatcctgaagtactaacactttctaactagtaaaataattaaatcttcctttcccaggattctcccggattacacagcatcagttcctctgaattctgcattcgtaattaaaatcctgatttccaattggcatttctttcggttaggcagggag

SEQ ID NO: 76531 - DNA, 283 bp, Homo sapiens
  misc_feature 1..283: note = chr14:21098864-21099147
  misc_feature 1..283: note = hyper
  source 1..283: mol_type = genomic DNA
cagagcagaagccaccggcttggggtgaatctgcatagcttctgaactaggctgccctcagagtaatctgcgagccagttttcgccccaggagcgcaggaagggaccaccaggcaggctacaagtggagaagtgcgcaggactccgggagtcatggctatcagcagattagattagatctgttccccacaaacacagaggtatggaccaagtgtaacatttttctcccagagacgtgaacagtctagtttcttcctcgcttactgcagcgtacaaacacctat

SEQ ID NO: 76532 - DNA, 381 bp, Homo sapiens
  misc_feature 1..381: note = chr14:21100626-21101007
  misc_feature 1..381: note = hyper
  source 1..381: mol_type = genomic DNA
acagcaacttttccccgacggcacctcctgggcgcccttgaaagacgccttaaatctaaacctataatacataggtaatcaactaaagctgaaagggaatggccaaagcacccacgtggagtgctgggtgctgtaggcgagaggtctgaggtagtggcttttagagctcaacatcttggtaatgttggttcgaccttttcccctgccagtcccgcggtgacctttatctttcggtgagtgaaatcggtcgttcgtgtttttcgtgggtcttccaaccacaggccgcctgagatggttctagtccctttgagtatacagacccttcctgtgcattgaccgacacagctcggcccggatcccgaaatgaacgtttctaccttc

SEQ ID NO: 76533 - skipped

SEQ ID NO: 76534 - DNA, 19 bp, Homo sapiens
  misc_feature 1..19: note = chr14:21101037-21101056
  misc_feature 1..19: note = hyper
  source 1..19: mol_type = genomic DNA
cgcacgttgactttcctgg

SEQ ID NO: 76535 - DNA, 60 bp, Homo sapiens
  misc_feature 1..60: note = chr14:21121400-21121460
  misc_feature 1..60: note = hyper
  source 1..60: mol_type = genomic DNA
ccttgcaactctagtcgtccaataagctttaagttggttggaactcgccttagagagata

SEQ ID NO: 76536 - DNA, 15 bp, Homo sapiens
  misc_feature 1..15: note = chr14:21121902-21121917
  misc_feature 1..15: note = hyper
  source 1..15: mol_type = genomic DNA
ctcatcccccacccc

SEQ ID NO: 76537 - DNA, 17 bp, Homo sapiens
  misc_feature 1..17: note = chr14:21141354-21141371
  misc_feature 1..17: note = hypo
  source 1..17: mol_type = genomic DNA
ggcgtgagccaccgcac

SEQ ID NO: 76538 - DNA, 68 bp, Homo sapiens
  misc_feature 1..68: note = chr14:21172544-21172612
  misc_feature 1..68: note = hypo
  source 1..68: mol_type = genomic DNA
tcactctctcaaaaacgccctggagaccgcttccacactagcactccccgactcgtcccattcttttt

SEQ ID NO: 76539 - DNA, 117 bp, Homo sapiens
  misc_feature 1..117: note = chr14:21190395-21190512
  misc_feature 1..117: note = hypo
  source 1..117: mol_type = genomic DNA
agttctggctgctgccgttaactgacgccatctttctggcacggatgtcacagccaaatcacgcaaagtggaaggtggtggtaaggagggatggggtgatgccggcagacagaggaa

SEQ ID NO: 76540 - DNA, 24 bp, Homo sapiens
  misc_feature 1..24: note = chr14:21265229-21265253
  misc_feature 1..24: note = hypo
  source 1..24: mol_type = genomic DNA
gcacctggccgtagcttctaattc

SEQ ID NO: 76541 - DNA, 23 bp, Homo sapiens
  misc_feature 1..23: note = chr14:21282035-21282058
  misc_feature 1..23: note = hypo
  source 1..23: mol_type = genomic DNA
atgtttctggctgggcgcagtgg

SEQ ID NO: 76542 - DNA, 37 bp, Homo sapiens
  misc_feature 1..37: note = chr14:21287757-21287794
  misc_feature 1..37: note = hypo
  source 1..37: mol_type = genomic DNA
actgcaggccgggcgcggtggctcatgccggtgatcc

SEQ ID NO: 76543 - DNA, 18 bp, Homo sapiens
  misc_feature 1..18: note = chr14:21289138-21289156
  misc_feature 1..18: note = hypo
  source 1..18: mol_type = genomic DNA
agcactttgagaggccga

SEQ ID NO: 76544 - DNA, 20 bp, Homo sapiens
  misc_feature 1..20: note = chr14:21297174-21297194
  misc_feature 1..20: note = hypo
  source 1..20: mol_type = genomic DNA
aagagcgagaaaaaaattaa

SEQ ID NO: 76545 - DNA, 209 bp, Homo sapiens
  misc_feature 1..209: note = chr14:21341988-21342197
  misc_feature 1..209: note = hyper
  source 1..209: mol_type = genomic DNA
ggaactgggagaccacgaaggctctgggcctgcggagttgcccaagctcctccggcttctccggaaacggctttttccggtgacacccctggagccacagtgatttgtttccctaaaggaagcggtttcccgccagggtatcgtccctaataccctccgaaggagcccattgaggagaaaggcatagaatgtcccgcagaaggcagaag

SEQ ID NO: 76546 - DNA, 132 bp, Homo sapiens
  misc_feature 1..132: note = chr14:21439185-21439317
  misc_feature 1..132: note = hyper
  source 1..132: mol_type = genomic DNA
aagaaccaggagacacggctttggtgcctctcggcccgctgggtctcggcggcgcagcgtcccctgccggccactgtggcggcggctggaatcagcctcagcacttaaggggccgcgcgggaggagttgccc

SEQ ID NO: 76547 - DNA, 130 bp, Homo sapiens
  misc_feature 1..130: note = chr14:21492900-21493030
  misc_feature 1..130: note = hyper
  source 1..130: mol_type = genomic DNA
cggaacccgtccctacgagtccctacgcagcccgtccgcgtggagactgacacccttgcgtggccggtgccaagcgccccggaccttgcacacaacctcgcgcgcaccccaaacacgccctgcagctctt

SEQ ID NO: 76548 - DNA, 251 bp, Homo sapiens
  misc_feature 1..251: note = chr14:21493570-21493821
  misc_feature 1..251: note = hyper
  source 1..251: mol_type = genomic DNA
tctggctccttccttcgcccccagactcagtggtgggaaccggtagtggggagacgaacccgggatactgacaccccacgagttcgactccccccgcccgaacacagagaactagattaagaaaggaggaggtgggcgggaccgccgctgaggaggcgggggtctcgccggctggcaggggcaggtgtgctggcgccgaaagggggcacgggggaacgtcgagggcgcaggagttccgactccctcgtgcc

SEQ ID NO: 76549 - DNA, 28 bp, Homo sapiens
  misc_feature 1..28: note = chr14:21609905-21609933
  misc_feature 1..28: note = hypo
  source 1..28: mol_type = genomic DNA
tggaaagctaacaaccgtcaggccggga

SEQ ID NO: 76550 - DNA, 32 bp, Homo sapiens; identical to SEQ ID NO: 43943
  misc_feature 1..32: note = chr14:21657875-21657907
  misc_feature 1..32: note = hypo
  source 1..32: mol_type = genomic DNA

SEQ ID NO: 76551 - DNA, 30 bp, Homo sapiens; identical to SEQ ID NO: 43944
  misc_feature 1..30: note = chr14:21721854-21721884
  misc_feature 1..30: note = hypo
  source 1..30: mol_type = genomic DNA

SEQ ID NO: 76552 - DNA, 30 bp, Homo sapiens
  misc_feature 1..30: note = chr14:21766806-21766836
  misc_feature 1..30: note = hypo
  source 1..30: mol_type = genomic DNA
atctgcaggattggccgggcgtggtggctc

SEQ ID NO: 76553 - DNA, 349 bp, Homo sapiens
  misc_feature 1..349: note = chr14:21769030-21769379
  misc_feature 1..349: note = hyper
  source 1..349: mol_type = genomic DNA
tattatagatcaattcgtgattatatgtcccaaataacccgtagaaataataactgtcatgaaaggagaagccacgtgctctatttgtccacaggctgaggaccaccttgctgcggttgaccgctgctggccgggacctgcgggtcgcggaggaggcggcgccgctctcggagaccgcaaggcgcgggcagaaggcgggatggcggcagcgcctctccatgcaccagcgcccccagatgcaccgactgcaagggcatttccactgcgtcggccctgccagcccccgccgcgcccagcctcgcgtccaagtgggacacagacagctccacacagccggtgcaccggtgcc

SEQ ID NO: 76554 - DNA, 30 bp, Homo sapiens
  misc_feature 1..30: note = chr14:21943010-21943040
  misc_feature 1..30: note = hypo
  source 1..30: mol_type = genomic DNA
attttgtactctcaccgtatcccagatttg

SEQ ID NO: 76555 - DNA, 174 bp, Homo sapiens
  misc_feature 1..174: note = chr14:21980230-21980404
  misc_feature 1..174: note = hypo
  source 1..174: mol_type = genomic DNA
gaggtgaggagggggcggtggtgggtgcgggcatgcttctttgtgttgacgaggcgtggggaagtggggagggctgatgaaggaaaaatccgagaggtcttcaaatacgtgatctctctcttaggctaaatttacaaagtacgtgtaatctattaaaatcgggttccgacacta

SEQ ID NO: 76556 - DNA, 233 bp, Homo sapiens
  misc_feature 1..233: note = chr14:21994155-21994388
  misc_feature 1..233: note = hyper
  source 1..233: mol_type = genomic DNA
cgcccccacccctgcccagcccgaccgaccctaccgcacctccgagctctgccggctccccgcagggcaccccgagacgagagctcctctcggattcgtgcgccatggttgtgggggaagtggagggccaggtggggtgggagacaatggatattgggattgagggaggcgatggccgctgggtctgcggcagcctctgcacccagcggcccagactgcggagatggagatcg

SEQ ID NO: 76557 - DNA, 30 bp, Homo sapiens
  misc_feature 1..30: note = chr14:21994769-21994799
  misc_feature 1..30: note = hyper
  source 1..30: mol_type = genomic DNA
ctcagtggagcaaggcgataggcttctctt

SEQ ID NO: 76558 - DNA, 183 bp, Homo sapiens
  misc_feature 1..183: note = chr14:22004998-22005181
  misc_feature 1..183: note = hyper
  source 1..183: mol_type = genomic DNA
gggaccttcgcagtccgagattaactgttggggtttccgctgctttcgccgagacattcccgggtagagagttgggagagggaggggcaacgctcacttggtcttaaccggggtgacctggtctcgtctcccccttgggtccgaagccaattgatgcctctcccccagcgcaaatcactgtga

SEQ ID NO: 76559 - DNA, 38 bp, Homo sapiens; identical to SEQ ID NO: 43946
  misc_feature 1..38: note = chr14:22551269-22551307
  misc_feature 1..38: note = hypo
  source 1..38: mol_type = genomic DNA

SEQ ID NO: 76560 - DNA, 95 bp, Homo sapiens
  misc_feature 1..95: note = chr14:22763687-22763782
  misc_feature 1..95: note = hypo
  source 1..95: mol_type = genomic DNA
ttttaaacttacaggcgaaaattttttggaaatgcatttcttaagaaaatcactggggtcggcccggcgcagtggctcatgcctgtaatcccagc

SEQ ID NO: 76561 - DNA, 32 bp, Homo sapiens
  misc_feature 1..32: note = chr14:22812323-22812355
  misc_feature 1..32: note = hypo
  source 1..32: mol_type = genomic DNA
gcctaagattaatctcggctattggggaaacc

SEQ ID NO: 76562 - DNA, 31 bp, Homo sapiens
  misc_feature 1..31: note = chr14:23028684-23028715
  misc_feature 1..31: note = hypo
  source 1..31: mol_type = genomic DNA
aatatttgatgttgtcgggcacggtgctcac

SEQ ID NO: 76563 - DNA, 176 bp, Homo sapiens
  misc_feature 1..176: note = chr14:23183874-23184050
  misc_feature 1..176: note = hypo
  source 1..176: mol_type = genomic DNA
tacacccctcccccccgtgatatagttcctaatatccaggaggagagaagatgatattactctcaatacctcaatatcgcagggaatgtaaacacccctgtgatattgttcctactacccaggaggaggggataaaattatattactcccaatatcgcaggcgctgtacaccccac

SEQ ID NO: 76564 - DNA, 232 bp, Homo sapiens
  misc_feature 1..232: note = chr14:23291733-23291965
  misc_feature 1..232: note = hyper
  source 1..232: mol_type = genomic DNA
tccctgtccgctcctcgctcccgcacagctggattactgcggggaaatgaaaatgaccgcggatacccttagagactggtcctccaccccatgaacgctcagcttcctcttccctccctcccaaccctgcataagctggcggccagacaggagtctgggcgagcgccccaacccctgaccacaactgcctccggccccgagatgcttggctgaatctcggtagtgcccccag

SEQ ID NO: 76565 - DNA, 23 bp, Homo sapiens
  misc_feature 1..23: note = chr14:23293758-23293781
  misc_feature 1..23: note = hypo
  source 1..23: mol_type = genomic DNA
actgcgcccggtttttgttgttg

SEQ ID NO: 76566 - DNA, 120 bp, Homo sapiens
  misc_feature 1..120: note = chr14:23339352-23339472
  misc_feature 1..120: note = hypo
  source 1..120: mol_type = genomic DNA
atcgcaccactgcactgcagcctgagcaagactctgtctcaaatatacatataggaatagtcaatatactttattgtttagggaataatgacagggaaataaattatgtacatattcaaa

SEQ ID NO: 76567 - DNA, 94 bp, Homo sapiens
  misc_feature 1..94: note = chr14:23355390-23355484
  misc_feature 1..94: note = hypo
  source 1..94: mol_type = genomic DNA
cgttggaaacaagagcgacttggcccgctcccgggaggtatcactggagggtgtgtatcctgaacagattccatacttgcgatctcaggggaat

SEQ ID NO: 76568 - DNA, 43 bp, Homo sapiens
  misc_feature 1..43: note = chr14:23355778-23355821
  misc_feature 1..43: note = hyper
  source 1..43: mol_type = genomic DNA
tcccgtacagcccagcgggcgcctgagccggtgccttcctgca

SEQ ID NO: 76569 - DNA, 56 bp, Homo sapiens
  misc_feature 1..56: note = chr14:23399557-23399613
  misc_feature 1..56: note = hyper
  source 1..56: mol_type = genomic DNA
atggagaggagaacacggtacaagagaccccacgcaggcgccgctggcagaactta

SEQ ID NO: 76570 - DNA, 206 bp, Homo sapiens
  misc_feature 1..206: note = chr14:23426887-23427093
  misc_feature 1..206: note = hypo
  source 1..206: mol_type = genomic DNA
cgtgagctaccgccctcggccaggcctcgtttagttcttaaagcgtcctgtgagaaagtcaccattatactcattttacagagggggagaactgaggcacaaagggttaagttcgaggtcgccatttggggggtctaaacctgtcccaatagctctcggaaggaaccttcccagacctgccacccaagccgcgtcctgcgagtctc

SEQ ID NO: 76571 - DNA, 318 bp, Homo sapiens
  misc_feature 1..318: note = chr14:23450428-23450746
  misc_feature 1..318: note = hyper
  source 1..318: mol_type = genomic DNA
tgacgggtcccttcccgtccctaaccacttctctcactcaccgaagtagtcctccctggcctctggctcccgcatccgggcccgggcggcctccggaacgaaaggacctggtggctcctccagacccgacggctcaatccccgagggttctccgcgggctccggcttctcgcccaccggtgcccaccgtcaggcgaagcaaagctgttagctcgtcctggtaccgggcgcccacggcgcagtccccgtagccggtcacagagtgtcgtccgggttgcgccccccgtctctccaagggccccgccgctcccactccggc

SEQ ID NO: 76572 - DNA, 30 bp, Homo sapiens
  misc_feature 1..30: note = chr14:23537948-23537978
  misc_feature 1..30: note = hypo
  source 1..30: mol_type = genomic DNA
accggcccccacccccgcaacacacaccag

SEQ ID NO: 76573 - DNA, 30 bp, Homo sapiens
  misc_feature 1..30: note = chr14:23545233-23545263
  misc_feature 1..30: note = hypo
  source 1..30: mol_type = genomic DNA
tagcattgttgattacgctttcaaaattgg

SEQ ID NO: 76574 - DNA, 34 bp, Homo sapiens
  misc_feature 1..34: note = chr14:23577687-23577721
  misc_feature 1..34: note = hypo
  source 1..34: mol_type = genomic DNA
acgctccccacctcccagacggacacccatctct

SEQ ID NO: 76575 - DNA, 188 bp, Homo sapiens
  misc_feature 1..188: note = chr14:23652713-23652901
  misc_feature 1..188: note = hyper
  source 1..188: mol_type = genomic DNA
ttcttttcccttccccgtcttctgcttccgcctttcccaggtgtcctcttctttctcgctggtcttcgtgcccttgttttcctcttttcgatccccgttctactgcacagccggccccatccctctggtttcgggagagtggcttctccacacactaacgtgcttctctttagcgaggggttttattc

SEQ ID NO: 76576 - DNA, 100 bp, Homo sapiens
  misc_feature 1..100: note = chr14:23706665-23706765
  misc_feature 1..100: note = hypo
  source 1..100: mol_type = genomic DNA
ttttaattgaaatttgttagttctcaattaatatcacactgttctttgtccgcatcatttttaaattttcctgtttccgattttacgctattctttcaaa

SEQ ID NO: 76577 - DNA, 156 bp, Homo sapiens
  misc_feature 1..156: note = chr14:23707497-23707653
  misc_feature 1..156: note = hypo
  source 1..156: mol_type = genomic DNA
aaagttagtgtatcacgatcgaacaaataggacaacgaagctcgtggcactgtgggatgcgtttgcgttgagctgtttattcagtacattttttatcgtaaatcttacgaagtttgtatccctcagcggttacacacacacacacatcctacgaaa

SEQ ID NO: 76578 - DNA, 285 bp, Homo sapiens; identical to SEQ ID NO: 43952
  misc_feature 1..285: note = chr14:23776954-23777239
  misc_feature 1..285: note = hypo
  source 1..285: mol_type = genomic DNA

SEQ ID NO: 76579 - DNA, 192 bp, Homo sapiens
  misc_feature 1..192: note = chr14:23821384-23821576
  misc_feature 1..192: note = hyper
  source 1..192: mol_type = genomic DNA
cagcgggggcgccagcgtgaagatggggtccgaggccatgcccagagccacgaagagcaccggcaggcagcagaggccgagctgcagctgctggccgccgcccagcgcccccacctgggcgagcagcgcctcaaagctgagggggcctgggggcacggccagcgacaggctgctgcccagtccgtcgccgcc

SEQ ID NO: 76580 - DNA, 592 bp, Homo sapiens; identical to SEQ ID NO: 35141
  misc_feature 1..592: note = chr14:23821601-23822193
  misc_feature 1..592: note = hyper
  source 1..592: mol_type = genomic DNA

SEQ ID NO: 76581 - DNA, 94 bp, Homo sapiens; identical to SEQ ID NO: 43953
  misc_feature 1..94: note = chr14:23884288-23884382
  misc_feature 1..94: note = hypo
  source 1..94: mol_type = genomic DNA

SEQ ID NO: 76582 - DNA, 49 bp, Homo sapiens
  misc_feature 1..49: note = chr14:23939668-23939717
  misc_feature 1..49: note = hypo
  source 1..49: mol_type = genomic DNA
gaaaacctcataagtcgaaatttaggcttgatgccgctgcccagcatca

SEQ ID NO: 76583 - DNA, 93 bp, Homo sapiens; identical to SEQ ID NO: 43954
  misc_feature 1..93: note = chr14:24021398-24021491
  misc_feature 1..93: note = hypo
  source 1..93: mol_type = genomic DNA

SEQ ID NO: 76584 - skipped

SEQ ID NO: 76585 - DNA, 30 bp, Homo sapiens
  misc_feature 1..30: note = chr14:24608282-24608312
  misc_feature 1..30: note = hypo
  source 1..30: mol_type = genomic DNA
ttggtccagtcctgccggatgtcatcaagg

SEQ ID NO: 76586 - DNA, 91 bp, Homo sapiens
  misc_feature 1..91: note = chr14:24682617-24682708
  misc_feature 1..91: note = hyper
  source 1..91: mol_type = genomic DNA
tcccgaagagcctgccgagaccactcatcgcgagctcgcctctcccgcctccgcccctcagcgtcctccagacttccgccttgctcctggg

SEQ ID NO: 76587 - DNA, 454 bp, Homo sapiens
  misc_feature 1..454: note = chr14:24803463-24803917
  misc_feature 1..454: note = hyper
  source 1..454: mol_type = genomic DNA
aagtctgtcagaacccggacagaaacgagaagcatccaggactcagctttctccctgagcagacccagaagggtagagtgacttgcccagggtcactgcagttcctagccaggctcaatggtcctttctttctctgctcccagcaacgaaaacacatcgaaaagaagaccccacaaaccccaaccccgaaaatgctccccaggtagagaccctcccgcagcagaggctcggctcaccctgccgctggcccaggccactgcgagcagcgccgcgagcgcacagagcacgatccccagcagcagcagcagcagcgggtactgctggctcaggctgtagtaggtctcgtagaagaggtcttcgctggggggcggccgggggctgaagaggcgggccatgatctccccagccccgagccccggggctggctagggccgggcgccgggttacctccttc

SEQ ID NO: 76588 - DNA, 205 bp, Homo sapiens; identical to SEQ ID NO: 1132
  misc_feature 1..205: note = chr14:24803918-24804123
  misc_feature 1..205: note = hyper
  source 1..205: mol_type = genomic DNA

SEQ ID NO: 76589 - DNA, 70 bp, Homo sapiens; identical to SEQ ID NO: 35144
  misc_feature 1..70: note = chr14:24804424-24804494
  misc_feature 1..70: note = hyper
  source 1..70: mol_type = genomic DNA

SEQ ID NO: 76590 - DNA, 152 bp, Homo sapiens
  misc_feature 1..152: note = chr14:24808711-24808863
  misc_feature 1..152: note = hyper
  source 1..152: mol_type = genomic DNA
cccggaacactgtgccgaacccgcctttgccgacgagctcctggttctccagttcctcgatggacaccaagggggcgggggcaccgctgggcctgagagaggggtgtcgcccactagccggccgtgccgtgcctcagcgctgctccccgcgc

SEQ ID NO: 76591 - DNA, 80 bp, Homo sapiens
  misc_feature 1..80: note = chr14:24837744-24837824
  misc_feature 1..80: note = hyper
  source 1..80: mol_type = genomic DNA
gagggagtcagaggtcgaagggagtcggggggactcgttggcctgcggaagtgaggctgggggcccgggcaccactttct

SEQ ID NO: 76592 - DNA, 30 bp, Homo sapiens
  misc_feature 1..30: note = chr14:24860993-24861023
  misc_feature 1..30: note = hypo
  source 1..30: mol_type = genomic DNA
gggcgcggtggctgacgcctgtaatcccag

SEQ ID NO: 76593 - DNA, 153 bp, Homo sapiens; identical to SEQ ID NO: 15809
  misc_feature 1..153: note = chr14:24862082-24862235
  misc_feature 1..153: note = hypo
  source 1..153: mol_type = genomic DNA

SEQ ID NO: 76594 - DNA, 45 bp, Homo sapiens
  misc_feature 1..45: note = chr14:24868518-24868563
  misc_feature 1..45: note = hyper
  source 1..45: mol_type = genomic DNA
cgggtgcagcggcagcggctgcaagtgcagcgcatctttagggtc

SEQ ID NO: 76595 - DNA, 66 bp, Homo sapiens
  misc_feature 1..66: note = chr14:24901940-24902006
  misc_feature 1..66: note = hypo
  source 1..66: mol_type = genomic DNA
cactacttctccagccggggcattgccattgctgtgcagtacttctgggaccgtggtcaccgtgac

SEQ ID NO: 76596 - DNA, 30 bp, Homo sapiens
  misc_feature 1..30: note = chr14:25156087-25156117
  misc_feature 1..30: note = hypo
  source 1..30: mol_type = genomic DNA
aggctggaagagttccgtgtgtctcttggt

SEQ ID NO: 76597 - DNA, 250 bp, Homo sapiens
  misc_feature 1..250: note = chr14:25518419-25518669
  misc_feature 1..250: note = hyper
  source 1..250: mol_type = genomic DNA
agccacgttgcccggcggtgttggtgaggctcgatgccggcgtgcacggcaagcgcgaattcggaacctggcgcccttgaccaagcctgagatcggaaagggggcatcgcccagggccagcgccctgggggcagggtgccgtgcccgccagaaaagctcgcctcagttttggcagtaatgattttcctagaagatgccagagttcgcgaagatcggagtgattcgcggatttctgcgctcaagctagagg

SEQ ID NO: 76598 - DNA, 634 bp, Homo sapiens
  misc_feature 1..634: note = chr14:25518982-25519616
  misc_feature 1..634: note = hyper
  source 1..634: mol_type = genomic DNA
ggacggagcgccaggcgccccaacagccgtggcggctgcaaccgcatctcccgggcttggcctccgccctgaccgcctggctcccctcgccccggtcctaccgtgcagcctggctcgcgcccctgccgtgccagtgcgcggcacgcgtcccagagcacgaggctcctccccggggggctgccccgcgcggggctccgggctccggacaaggcttagccggcccgggtgctggctcgccgccgctcgcggctcccgcgccggctcctgctgccgcgcgcgaaaagggaggggttggggggaaactcccggcaactccaactccgggcgctggagctccagctgcagccgcgcgcccgcccgccgccgagtgcgagcgcctgcgaagcaaacctgcccgcgcggccgcctctgagcatgctcagtgccgccgtgggcgagcccgagcgccctggcccggggcaaagagcagcggctaggggctgggggctgggggccgggacccgcgacccgccccaggcctcggagcgcggaggtggcagaggaagggaaaggccaatgtaggggcgggggccctgagccaaagacccgggagaaaccgatctgggtgcaagagccggtgcgactttcacggctt

SEQ ID NO: 76599 - DNA, 309 bp, Homo sapiens
  misc_feature 1..309: note = chr14:26674308-26674617
  misc_feature 1..309: note = hyper
  source 1..309: mol_type = genomic DNA
ccgcccgccgcagcccgactctggggcgtttgggaggtgggcctgaggtttgcctaggactcgagttcctttcaaaggaaggcgagagggagatggggagaaggagactcggagacttctctattaaagccgcgctgaactctagccttctggcaagccgcggcaagccgccaatttgaagtgtgtgagctttaatctgctcctagcctgatgggctcccgtgtccacagggagctgggaggcatccattacgccggaccaaggagatggagcgtctaggaaatatgttaatgccggagccctccccgc

SEQ ID NO: 76600 - DNA, 30 bp, Homo sapiens
  misc_feature 1..30: note = chr14:26960497-26960527
  misc_feature 1..30: note = hypo
  source 1..30: mol_type = genomic DNA
cactggggttttattcgttgagttttagga

SEQ ID NO: 76601 - DNA, 124 bp, Homo sapiens
  misc_feature 1..124: note = chr14:27066218-27066342
  misc_feature 1..124: note = hyper
  source 1..124: mol_type = genomic DNA
ggtcaacctctggaccgattaaatggaaagataggtctattccgaaaaactggtcgccattttgatgaatgataaacacagaaatggaaatgtgtcggggacacctaggcgcggggcaggtgca

SEQ ID NO: 76602 - DNA, 85 bp, Homo sapiens
  misc_feature 1..85: note = chr14:27066596-27066681
  misc_feature 1..85: note = hyper
  source 1..85: mol_type = genomic DNA
ccccagtgtgggtcccgttctgctggatgggagctgccgccatcatgtttgcagttcctgccgctgctaccgggagaaggttctc

SEQ ID NO: 76603 - DNA, 60 bp, Homo sapiens; identical to SEQ ID NO: 11772
  misc_feature 1..60: note = chr14:27067097-27067157
  misc_feature 1..60: note = hyper
  source 1..60: mol_type = genomic DNA

SEQ ID NO: 76604 - DNA, 95 bp, Homo sapiens
  misc_feature 1..95: note = chr14:27067604-27067699
  misc_feature 1..95: note = hyper
  source 1..95: mol_type = genomic DNA
ggaggggtgaaaggtcgctggtccccggcaacacggctcaggcaaacgtaagcggcttgtcgcagaaaccaaggggtccacgaaacgcgctaggc

SEQ ID NO: 76605 - DNA, 205 bp, Homo sapiens
  misc_feature 1..205: note = chr14:27068077-27068282
  misc_feature 1..205: note = hyper
  source 1..205: mol_type = genomic DNA
cgcactgtgtgacaccgttaggggacttagagtgtcactcgccgccttaaatcctttcgggaacaagccaggatataaataaataaagctaggtgtgggtcttcccttcacaaggcgctggtaggcagactaaagacaggcaacagctgagtgtgcacacagaactaaatattgaacgaaatacgagtgtcggaataaaattcat

SEQ ID NO: 76606 - DNA, 96 bp, Homo sapiens
  misc_feature 1..96: note = chr14:29224711-29224807
  misc_feature 1..96: note = hyper
  source 1..96: mol_type = genomic DNA
tgagcatttttgttgcgttaagtggccggcattagcagcctaaacacgtaggggaaggctaacatcgccgttaatataatgcgggagaggaatgat

SEQ ID NO: 76607 - DNA, 237 bp, Homo sapiens; identical to SEQ ID NO: 35156
  misc_feature 1..237: note = chr14:29225531-29225768
  misc_feature 1..237: note = hyper
  source 1..237: mol_type = genomic DNA

SEQ ID NO: 76608 - DNA, 534 bp, Homo sapiens
  misc_feature 1..534: note = chr14:29226033-29226567
  misc_feature 1..534: note = hyper
  source 1..534: mol_type = genomic DNA
gagatctcagatcttcgcgtttggggtggggagtgggggcgctggggaaaagtcgggaatagccccgcggtacctggggatcccagttgttttttctaagaaagcccggggttaaaaaatgcattggaatgtggcgatgcctccatcagccgtcactttataagttcccaagtcacgctgctctagaccattgtggatgaaagtggattgtctctccagaaccaaatattccctgacctgcttccccaacgcgccctcacgctttcctgggagagcacagcgctgccggagacgcggcgcttctgtcaattgtgcagagcaattactaagaaaatattgtgacgatgttgtagggcgaaaggggacgtgaggaggaaagggagggggagttagtttggagagcaatttgcaaaggaatattaactttgattcccgaggtcaccgcgggaaaaggggttctgggctgcagagctcttcctctaggtggcggactttggcaccaaacaaccgctagatgagcgctgacttcaaaca

SEQ ID NO: 76609 - DNA, 1598 bp, Homo sapiens
  misc_feature 1..1598: note = chr14:29227651-29229249
  misc_feature 1..1598: note = hyper
  source 1..1598: mol_type = genomic DNA
cagcaagcagacagacgatatgatatgatcttaagggaccatctccaaaactgaaggagcagagaatgtgtaattcttttcccagtaaatccttccagttcctaggacaagactcaaacgtcccgctaggagctgcagctgcgaggtggagccaaaggctctgacaagtggcttgtgtatgacccaatatttatcaataacaacaacaaaatcaagtgaaaccaaggctgcggattttgaaatgcttctgcagccctggcgtggatatgcacgtgagcgaagtaaaagtcgctggagatgagttggctccacttgtccgccctggggagcaatcctggggcaaaatccagtgctaattgatcccaaccagccacattatcagctgtaaatgttcaaggggacaaagaatgagcattgtgtactaaagatactccaagcattttttcaagtaaatagggacgtgtaatcagtagcgtgtgtatgcatataaataggaaaagagaattatttttaattaattaggaaaataatgtttcatgtgtaattccagaattctctagcgtctcccactgtccgactgttttgtgattgggacttcctctaggaaaacctgcgggccctgttttgtgtttcgagcgggagagcagacactcagctcaaatagaggcctttctctcgtctttcggggtgtttattctatggccaaaaggtaagatggccaaggcagcgatctgagcgtgatgtctggccccgcggggggcccaggaggcccaagttgggacagctccggagctaccccggtgcccctcagctgggggagggcgcgcggcagccgcctgccagccccacaggctgctctccaaaggagctgggctttttcagcgtttctgtttccttgtagcctcatctatcttatctaacaagttcacgctccgggagaaaagaagagggtgagaaaaaaaaaaaagaaagaaaaaagaaaacctcttcaccgcggtgattcatagttcataggctccggagccaaacttgccgacccagcttttttctcgaacattactttctctcctacgtgccttaggacaaacccagaaggaagacactaaaattgccgaacaagaatctaggattgttttaaaaataaaagtgaccccccacagacacctttgatgttgttgattctgacacagaggagtcgagttgttttgtttacacatgctaacggtaacttgctcctgatgccgctctacgcgcagcttagtctgtcttctcctctcctccccgcaggcgactccttccaaagagcgagagagaaatacgggtattactgttatcccccactgggttcaataccccttacatgtaattgaatattcgaattaacgtcacctgcatgcaccccagtcttttaactctgaaatgtgctttatagcaatacagacttgaaacctttaactgttttctatatccccgcgtttaccgtggcagatgacctcttagcccaaaattgatttggtgtgtatccggtcttatgtgccaaaaaaagagatacctaggctgaaaaggcaactttaaggggggacatctagagagatgac

SEQ ID NO: 76610 - DNA, 603 bp, Homo sapiens
  misc_feature 1..603: note = chr14:29229250-29229853
  misc_feature 1..603: note = hyper
  source 1..603: mol_type = genomic DNA
cctagaatcaaggcctctggctcgattgcgttcggcaagcgtctgcaacaaaggagcgtcgggcaagctcgcgggtatgcgcagggagcagcggcgcgcagacctgggagccccagctccgcgaagctcctcgaagggaaccctcgcagttacagcctcaagaggcaaggcaggggagggagaaaagctggacctcttgagaaacgctcctccaacagattttccatggcctcgtgttggagaaggggcgcgggggaggagcgagggttggggtaggaagacctactggaaccgactccggagagtgagggccaggtgggtgtaagatgagcacaaagtaaaaacttgcccattggtttgtccacgcaggtttcttgaaagaagcagatagatctgattagtagatactactttccccacgcaaagggagactttggggtgaagggttctctgcgtgcttcctggcttgcttaccccactcatgaagttttctctcctctcattccttcagacctttagtgggtgcaagcatttcctataagatacttattaatctcatatacggaccttgaactgttcaatgttttccgtgtacatttaaat

SEQ ID NO: 76611 - DNA, 335 bp, Homo sapiens
  misc_feature 1..335: note = chr14:29230851-29231186
  misc_feature 1..335: note = hyper
  source 1..335: mol_type = genomic DNA
ttttgctgaagatcacgggacttttcttttggctgcgtacgtacttggcttcagagagcctggaacacctggcagcgtcacagagacttgcctggagagtcccaggggtctctgtcaaggccttctcctcatccttgtcctcttcctcctcctgctcctcttcttcgccttggactttctcccttttaaagtggctccctagcttacacaagctaaacatttccactctcatagacgaggctctcccatagatttttttactcgaggttctcaagcaaaattgccggtgccacaatgttatgatggaaggatgctgaaatgacaggcctagtaga

SEQ ID NO: 76612 - DNA, 437 bp, Homo sapiens
  misc_feature 1..437: note = chr14:29231289-29231726
  misc_feature 1..437: note = hyper
  source 1..437: mol_type = genomic DNA
cggggacgttgagggtgcgcgtgcgcgcgctgagagcagccactgacaacctgcagctccctaatgagtgacgaggcagggctgctgcagaaaagtaacacttccctggtgtgaagacctcttactgagaagtttagttcactactgttctcgcaaacctaatcgtataacctgtaaccaaaacccacagaacgaggatacaacacgctaaagagtaacttctaatcactaaatgttagcaccattacctgctgttaggaagatattatagacgagttggctccagcgagggcagacctcacctgccacaggatctctggaaatacctggatgcctctgtatgggatctcctcactcccaaacgtcacaaggtcagaaattctctgtgcatctgcaggaagagaactttagctagagcttggcgctgggtgccactc

SEQ ID NO: 76613 - DNA, 754 bp, Homo sapiens
  misc_feature 1..754: note = chr14:29234555-29235309
  misc_feature 1..754: note = hyper
  source 1..754: mol_type = genomic DNA
tccttttaaagcccccgattcgcaatttccccattcacttcaacctccaaccgaaccttcccagttccaaagcccaagaagctgggactgtgagatccacgttcccaaggctccccggtgctttccagcagcactcagggttggcaagagctggcttcagtatactgttatttcaggaatgaggcccgcacaaaataaaagcatttgagaaacggaaaggaaaaaaaaggagtgaaaataggaaggcttaaaaaaaaaaccggaaagaaatagacgcccacccttattttccctccaatgtcaacaagcaaaacgaaaatatttccagggtgatcgctcgcagctacccgcttccaattcggattagaagctgaggctggagcggcgaggagaaaacgacatcgagtcaccccgcgcgtgagcgacgctctggagcaggagagaaggaaaaggaagagacacacgtatatagcatgtgttacctgatttatttcgagattgtttggtactgttttctctctgggcacctctcatttcggaaggccatcagaggcgcccactactgagcggccccggccgccgcagcagcacccggagccccagtcccggtttccccgcggtgccggagcccggagctcgccgccgcccaggcctcaggaatcgagtaagtaacccctgtttggccccgcgctcctctgcccacttcctcctcctcatctcatcgctcccaaagctctcccacaccctcctcccc

SEQ ID NO: 76614 - DNA, 298 bp, Homo sapiens
  misc_feature 1..298: note = chr14:29235341-29235639
  misc_feature 1..298: note = hyper
  source 1..298: mol_type = genomic DNA
cggtgggccttatctccccccttatccaaagctgcgctagactattacctacaaagggcacaattttcctgctggctcagaaatgccagacactggcctgcaaggccgactcggaaaagtagtgcctcgcctctacctcctccatttcctgccctctcgcatcctctccctgcactcccactcttcccactaccaccaccacccccgctttcaaaaataaaattggatacaaactttaatcactaaggacaaatattgacgcttaaacgaaaatgacccagtacaatgaggaggaagc

SEQ ID NO: 76615 - DNA, 368 bp, Homo sapiens
  misc_feature 1..368: note = chr14:29235826-29236194
  misc_feature 1..368: note = hyper
  source 1..368: mol_type = genomic DNA
cggcagccggcgggcggggcgggggtgggtgggcccggcccctccgattggtcgacggcgagagagacgctcccgcacgccgccagctctgattggcccagcggtaggaaaggttaaaccaaaaatttttttacagccctagtgtgcgcctgtagctcggaaaattaattgtggctatagccgcctcgatcgctgtctccccagcctcgccgcggccgctccgggacgcgcccgcccgccgcccggctctccccccctttgggctgctgctgctgctgctgtgactgctgctgcgagaggaggaggaggaggaggaagcagcgggggggggagcggggggtggggggggagaccaagaagtacagttg

SEQ ID NO: 76616 - DNA, 81 bp, Homo sapiens
  misc_feature 1..81: note = chr14:29236254-29236335
  misc_feature 1..81: note = hyper
  source 1..81: mol_type = genomic DNA
cttttcctttttttttttttttctaattcctgaggggtggttgctgcttttgctacatgacttgccagcgcccgagcctgc

SEQ ID NO: 76617 - DNA, 201 bp, Homo sapiens
  misc_feature 1..201: note = chr14:29236413-29236614
  misc_feature 1..201: note = hyper
  source 1..201: mol_type = genomic DNA
ggtcgccgccgcccgccgcgccgctgtcccgctcccgcgccgccgccgccgtttccccccgacgactgggtgatgctggacatgggagataggaaagaggtgaaaatgatccccaagtcctcgttcagcatcaacagcctggtgcccgaggcggtccagaacgacaaccaccacgcgagccacggccaccacaacagccac

SEQ ID NO: 76618 - DNA, 149 bp, Homo sapiens
  misc_feature 1..149: note = chr14:29236674-29236823
  misc_feature 1..149: note = hyper
  source 1..149: mol_type = genomic DNA
caaccgccgccgccgccgcagcagcagcagccgccgccgccgccgcccccggcaccgcagcccccccagacgcggggcgccccggccgccgacgacgacaagggcccccagcagctgctgctcccgccgccgccaccgccaccaccggc

SEQ ID NO: 76619 - DNA, 208 bp, Homo sapiens
  misc_feature 1..208: note = chr14:29236859-29237067
  misc_feature 1..208: note = hyper
  source 1..208: mol_type = genomic DNA
cggcaagggcgagccgggcggcgggccgggggagctggcgcccgtcgggccggacgagaaggagaagggcgccggcgccgggggggaggagaagaagggggcgggcgagggcggcaaggacggggaggggggcaaggagggcgagaagaagaacggcaagtacgagaagccgccgttcagctacaacgcgctcatcatgatggccatc

SEQ ID NO: 76620 - DNA, 128 bp, Homo sapiens
  misc_feature 1..128: note = chr14:29237139-29237267
  misc_feature 1..128: note = hyper
  source 1..128: mol_type = genomic DNA
cgcgagaacaagcagggctggcagaactccatccgccacaatctgtccctcaacaagtgcttcgtgaaggtgccgcgccactacgacgacccgggcaagggcaactactggatgctggacccgtcgag

SEQ ID NO: 76621 - DNA, 162 bp, Homo sapiens
  misc_feature 1..162: note = chr14:29237282-29237444
  misc_feature 1..162: note = hyper
  source 1..162: mol_type = genomic DNA
cggcggcaccacgggcaagctgcggcgccgctccaccacctcgcgggccaagctggccttcaagcgcggtgcgcgcctcacctccaccggcctcaccttcatggaccgcgccggctccctctactggcccatgtcgcccttcctgtccctgcaccacccccg

SEQ ID NO: 76622 - DNA, 320 bp, Homo sapiens
  misc_feature 1..320: note = chr14:29237573-29237893
  misc_feature 1..320: note = hyper
  source 1..320: mol_type = genomic DNA
cgtggaccggctggtcaacggggagatcccgtacgccacgcaccacctcacggccgccgcgctagccgcctcggtgccctgcggcctgtcggtgccctgctctgggacctactccctcaacccctgctccgtcaacctgctcgcgggccagaccagttactttttcccccacgtcccgcacccgtcaatgacttcgcagagcagcacgtccatgagcgccagggccgcgtcctcctccacgtcgccgcaggccccctcgaccctgccctgtgagtctttaagaccctctttgccaagttttacgacgggactgtctgggg

SEQ ID NO: 76623 - DNA, 102 bp, Homo sapiens
  misc_feature 1..102: note = chr14:29242506-29242608
  misc_feature 1..102: note = hyper
  source 1..102: mol_type = genomic DNA
ctcttgtctccctcccgatttctactgtgttttgtttttgtttttccccaccacctaaggctctgcctgaggttgtccgaaggatgccgaggaaaaggatat

SEQ ID NO: 76624 - DNA, 114 bp, Homo sapiens
  misc_feature 1..114: note = chr14:29243157-29243271
  misc_feature 1..114: note = hyper
  source 1..114: mol_type = genomic DNA
ccagagctggccctccgcccccagctccttggcctgggtcacaccagggtcccggtcggatttagccgggctgctccgggtcgggtgaggcactgggtgcgtgtgggagtcttc

SEQ ID NO: 76625 - DNA, 157 bp, Homo sapiens; identical to SEQ ID NO: 35176
  misc_feature 1..157: note = chr14:29243513-29243670
  misc_feature 1..157: note = hyper
  source 1..157: mol_type = genomic DNA

SEQ ID NO: 76626 - DNA, 562 bp, Homo sapiens
  misc_feature 1..562: note = chr14:29243730-29244292
  misc_feature 1..562: note = hyper
  source 1..562: mol_type = genomic DNA
cgatccccgcagagggtgaagccgggcgctgcgcagggagcagcaacatgagggcgctcttgcccaggacaagcagagctgtacgtttgggtagctcatattggctgatgccaagaaaagtgacttcagaaccttggctggcgcgcttccctaccttttccctttcttcttaatcttctgtgtgccaccacctccccccaaccttttttcccctcccaaagttgtttccttttgtttacccggtgcggtttcagatctcagcacttctcagctagtagataaaattatttgctctgtaatggacatctcttctcctctccacttgttaccccactcgcccttcgctttctaccccattttgcttctctctgcccaagcctgtggtccaaggtgcagggatctcacaggaaaacaggtagcctcggggtgggaattcccagagcactgaaggcgccggttgttggccagagggaggccgggactccggtgggcagagtaccccgcgagtgcggagattttcaggctgtaatcttcagtctgggaaaggcgatgggaaggaagg

SEQ ID NO: 76627 - DNA, 645 bp, Homo sapiens
  misc_feature 1..645: note = chr14:29247097-29247742
  misc_feature 1..645: note = hyper
  source 1..645: mol_type = genomic DNA
atcttctcaccctggcgagttttcctgaaactacttatccttagcgtcagcgctgtaagaggtggagccgctcagtcccgcgggtggctgcagacagaaggtgggcgagtcctgggacttaaaaagttttgcagaaggttgaaaagaggagcagagggagagttttgagtttatttattttattttcctttttttttttttgtcttgtgccaagcccttgaagttaacgtagcgacgacgtggtccttgtaggaccaagcattcttggcattctgtcgagattgagattccagagcatcggatgaacgggacttatagctaaggcgtactcacccacccctcccttcgtctttttacgcacgcagcaactcgtcctcacgtgcataggggtagtggacagtgttgacttgaattgctgtccctcgttccaagcctttcctgtgaatgaacccgaaaacactcgacaggtcgtgaataatcgttttaatgagtgtgcaaagcgtgcgacggggtgcaccgagctgtcgggttaaacaaacaacttgtaccctgaccaaatccgattgttaaagtgcaaagtgatgtcagtaccatttccattgcctttcggaaatccacagatctgacacgcgggagtccaatttt

SEQ ID NO: 76628 - DNA, 353 bp, Homo sapiens
  misc_feature 1..353: note = chr14:29254087-29254440
  misc_feature 1..353: note = hyper
  source 1..353: mol_type = genomic DNA
agtggctcatatggtcgttctgtgttttgtagaatacgtaggggactcctgaaatgtgtgggatgtaggtaggggcgggagcgactctgtggggagagaagggagaaaaagattgagagaaggaaagagaagtgtatttgcaaggcaggctgacaatttctcaattaatttggggcagagacagaaagactccgagtttctagcttcttttctatacctcagataaaaaactgaagacagccttattctaacaactcaatttaaaaagagcccccctgcgtacgtccccgcacccctttcgccccagcggccgctcacaaagcgccacccgcgcctcgggcgcccgcagaagc

SEQ ID NO: 76629 - DNA, 522 bp, Homo sapiens; identical to SEQ ID NO: 35180
  misc_feature 1..522: note = chr14:29254611-29255133
  misc_feature 1..522: note = hyper
  source 1..522: mol_type = genomic DNA

SEQ ID NO: 76630 - DNA, 30 bp, Homo sapiens
  misc_feature 1..30: note = chr14:30066780-30066810
  misc_feature 1..30: note = hypo
  source 1..30: mol_type = genomic DNA
taaatgggaatgtgccgcttaggcttacat

SEQ ID NO: 76631 - DNA, 23 bp, Homo sapiens
  misc_feature 1..23: note = chr14:30126794-30126817
  misc_feature 1..23: note = hypo
  source 1..23: mol_type = genomic DNA
gggcgcagtggctcacggctgta

SEQ ID NO: 76632 - DNA, 30 bp, Homo sapiens; identical to SEQ ID NO: 35181
  misc_feature 1..30: note = chr14:30396081-30396111
  misc_feature 1..30: note = hyper
  source 1..30: mol_type = genomic DNA

SEQ ID NO: 76633 - DNA, 128 bp, Homo sapiens
  misc_feature 1..128: note = chr14:30396380-30396508
  misc_feature 1..128: note = hyper
  source 1..128: mol_type = genomic DNA
gcggagagggccagccgggcagcgccccctgcgccgcggggaggcgccgggctggcagcggtgcggcgacttaccttctggtcgacaatggagcaagccatctcgcggacgtgcgccaggctgtagtc

SEQ ID NO: 76634 - DNA, 478 bp, Homo sapiens
  misc_feature 1..478: note = chr14:30396920-30397398
  misc_feature 1..478: note = hyper
  source 1..478: mol_type = genomic DNA
aggagggaaaatggccgaggcgggaggactctgaggcccggaacgcggcagccggctcggggccgccggcactggggaggcgccgccgccgccaagaatctgccgcctggcgcgctcggaaggacggggcgacgggtcggcgcggcccgagcgccgggcgggggccggggcgggaagggggcgtgaggggcggggaaggggagctgggggcgggcactggggagccaccacccggcgggcgcgggagtcgcaggagcagcggccgcagtggccgcagggtgcccggtcgccgccccctccgcccgcagttcccggggcctgagcctccgcgagccgggataggaccgagtggcggggctcggagccgcctcggcaggcgcggcccttccctccctgcagggattcccgtcctctcgggtcccgctgccccgccccgactgcggacggagtggatggggtgcaccgcctcagacccgct

SEQ ID NO: 76635 - DNA, 57 bp, Homo sapiens
  misc_feature 1..57: note = chr14:30739946-30740003
  misc_feature 1..57: note = hyper
  source 1..57: mol_type = genomic DNA
gttcacatcagcagtcgtcagcggcgatgtcaggcgccgtgtcgttcttcaaaccct

SEQ ID NO: 76636 - DNA, 142 bp, Homo sapiens
  misc_feature 1..142: note = chr14:31027434-31027576
  misc_feature 1..142: note = hypo
  source 1..142: mol_type = genomic DNA
acaaaggctaaaggtatgctgtcatggtttggtttgtactgatccgtttaggtaattcaatgttattagatgtgaggatgatctggtggcaacatcaatcacagccataaaggtcagagttatttagcgcccctcaccccct

SEQ ID NO: 76637 - DNA, 34 bp, Homo sapiens
  misc_feature 1..34: note = chr14:31309552-31309586
  misc_feature 1..34: note = hypo
  source 1..34: mol_type = genomic DNA
ggtataactgccccattgacgctgtgcatgagag

SEQ ID NO: 76638 - DNA, 1298 bp, Homo sapiens
  misc_feature 1..1298: note = chr14:31343340-31344638
  misc_feature 1..1298: note = hyper
  source 1..1298: mol_type = genomic DNA
ccaagttgagaagttcggttctcaggccgcgtggacctgacagctctcagaagctccaggcctcgctgggtggggcgggtagcggccgccgctgcctcagcagccctggtcccggcagagcagggctggcgaggccgctgctgccgccgtcggggccgccggccctccacactcgttgagacgccggcacggggaccttcgtgcccctctagggactggcgccgcgtccaggtggccgagcctgcgctgctggaggaggcgcctccgcgccggcctcaccccggggccggcagggggcgaaggcggagctggaagtcgccgccgggccccgggggaccggctcccgcgcttcctcccgcgccccccgcacagtgctcatgcgcacggcccagcctttatagcggccgcgggggccttgccttccgcactcgggcgcagccgggtggatctcgagcaggtgcggagccccgggcggcgggcgcgggtgcgagggatccctgacgcctctgtccctgtttctttgtcgctcccagcctgtctgtcgtcgttttggcgcccccgcctccccgcggtgcggggttgcacaccgatcctgggcttcgctcgatttgccgccgaggcgcctcccagacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcggtgggtgcgcgcccctcacgaccccggccccttgctccgctgggtggaggctggagccagccctcacgcttctctcttcgcaggtgtgtgtctgctgctgctgccggggcccgcgggcagcgagggagccggtgagtgggggagctggggtgcgtccaggcggtcgcaggggctgagcaccagcgggtacaagcgggactcagatccagccccttgggcttcagccctaccgcctgaggaggaaggcgcgaaggttgagccgccgcgtggcgcgcccgcgttaacccctgcagccgatctgctcctgctcacctgtttctcccatggtagggggcccctggggtccagtggggggacgttctccaagagcactaggaagaaggcctcctccaggcccacccacagccccagaccccgggcccgctgagcgccggcagcaggaggtcgaggaaggaggact

SEQ ID NO: 76639 - DNA, 157 bp, Homo sapiens
  misc_feature 1..157: note = chr14:31534496-31534653
  misc_feature 1..157: note = hypo
  source 1..157: mol_type = genomic DNA
gtagctcattcttcacgacctcacatcagtgccccttctccgggaagcagttcttcactctcctgtgatgttccttgtccctcccttctgtacacctatggaagcggacctgtcccagttataactcatcaccttgtactgccgttgtttacctacc

SEQ ID NO: 76640 - DNA, 40 bp, Homo sapiens
  misc_feature 1..40: note = chr14:31713750-31713790
  misc_feature 1..40: note = hypo
  source 1..40: mol_type = genomic DNA
ctgggattactggcatgaaccaccacgcctgtcaaggaca

SEQ ID NO: 76641 - DNA, 100 bp, Homo sapiens; identical to SEQ ID NO: 43959
  misc_feature 1..100: note = chr14:31925624-31925724
  misc_feature 1..100: note = hypo
  source 1..100: mol_type = genomic DNA

SEQ ID NO: 76642 - DNA, 172 bp, Homo sapiens
  misc_feature 1..172: note = chr14:32597712-32597884
  misc_feature 1..172: note = hypo
  source 1..172: mol_type = genomic DNA
tggctctgctatctgcgtgtcggctatcggtgctgaggctggcccgcctctgcgtgggcaggatcttggcattccttttgctccatggacgctgcctccctgggctcgccgcgcctggccgcccggcaggcagccccaggccccggctgctccatcccgctgccctgatttt

SEQ ID NO: 76643 - DNA, 82 bp, Homo sapiens
  misc_feature 1..82: note = chr14:32671453-32671535
  misc_feature 1..82: note = hyper
  source 1..82: mol_type = genomic DNA
cccagtagacacctacgatgctgtccgggcctcccaccagtcctgtcgcacagtgggcacacttcctcgacagcctccatct

SEQ ID NO: 76644 - DNA, 16 bp, Homo sapiens
  misc_feature 1..16: note = chr14:33163277-33163293
  misc_feature 1..16: note = hypo
  source 1..16: mol_type = genomic DNA
gtccatggggccaggc

SEQ ID NO: 76645 - DNA, 244 bp, Homo sapiens
  misc_feature 1..244: note = chr14:33401981-33402225
  misc_feature 1..244: note = hyper
  source 1..244: mol_type = genomic DNA
cacagatgctcattacgattctttttacgtgcaacacgtgggggacgaagcagtttcatatctcctggtattatctgccgtccaaagcattttctttgaaaggaaaatggaaacgcagctgcgccgtgggcccggccagcgagagctggggctccctccctctgtttcccagcggctgccgggtgcaggaggcgcctccggaaactgacttgggttaggggagttcagaggttgccccagcagg

SEQ ID NO: 76646 - DNA, 145 bp, Homo sapiens; identical to SEQ ID NO: 35189
  misc_feature 1..145: note = chr14:33402367-33402512
  misc_feature 1..145: note = hyper
  source 1..145: mol_type = genomic DNA

SEQ ID NO: 76647 - DNA, 404 bp, Homo sapiens; identical to SEQ ID NO: 35190
  misc_feature 1..404: note = chr14:33402513-33402917
  misc_feature 1..404: note = hyper
  source 1..404: mol_type = genomic DNA

SEQ ID NO: 76648 - DNA, 1208 bp, Homo sapiens
  misc_feature 1..1208: note = chr14:33403210-33404418
  misc_feature 1..1208: note = hyper
  source 1..1208: mol_type = genomic DNA
tccattgcacaaaagcggcttctttttttctctccgtctttgcacaccatccctcctcgataagtatcaagttctcgaggagcccaacttgcgcttggcagccctcgcgctgcctgatgtgcataagacgggcagagaggggttccggccaggaagggaggctctacgtccccattcctgcacacgcgggctggcttccaggttgctggaagccgcgggaggcgcgagcttgcctggatggtggttatttctctagagaaaggaggagagagagagcgcgcctgagtcttgcactttgggtcggaagtgcgcggcgtgtgtgtgtgtgtgtgtgtgtgtgtgtgtagaggggggcgggaaagaaacgcaccctccgctgccggtcattcccttgcaccggccaagtcctcgccaagcctcccggtgcatccttcctccgccaccccctccccttcttccctcagctgggctcgcgcggcgcagccggagcagccagtgagagcaacatcctggaaagaggggggagcaccgccgccccccaaaagggaaaaaaggccccaccctgacacgttttgctgtttgcaagtccctcgcacgccccccgcacctcctcctcgcgcttgcggccccccccacccccagcccgctgcgcgcacatcaaagctcctctccgccgcgcacagtggccgcggctcactaatgggattgcaggctggtgcctggctccgctgctgccgccgccgctgctcgcgctgctgctgctgccgccgcccgagcccgagcccgagcccccgccagccagagcccagagccgccgcgcccgggggccgaagccgcggcgatgatccgaatctttccggatttcagcgtgcaggtgacggccgcggcggccggcggggcggccgcgggggtgccggccggcgcgggcatggggagggccggcgccgcggccaacggcaccccgcagaacgtccagggcatcacctcctaccagcagcggtgagtagtcccgcctgggctgggatagtgcccccgccccggggtgctggggtgggactcactttgcctcctgttttgtgtcttacaacacacatgcacattgccagggctcactttgcctgcccctcgttctacagatgaggaagaaaaacacacttcactttggtggattgaaaagcactccagtgcgctggcgaagtgaaatcatc

SEQ ID NO: 76649 - DNA, 88 bp, Homo sapiens
  misc_feature 1..88: note = chr14:33407604-33407692
  misc_feature 1..88: note = hyper
  source 1..88: mol_type = genomic DNA
actgcaactgagtggcgttgttgcgccggcagccgagcctcccagtcccccaacgagaaagagagagagagagagagagagagaaatt

SEQ ID NO: 76650 - DNA, 27 bp, Homo sapiens
  misc_feature 1..27: note = chr14:33407752-33407779
  misc_feature 1..27: note = hyper
  source 1..27: mol_type = genomic DNA
cgtacgagagagcgctctggagcaaag

SEQ ID NO: 76651 - DNA, 98 bp, Homo sapiens
  misc_feature 1..98: note = chr14:33408303-33408401
  misc_feature 1..98: note = hyper
  source 1..98: mol_type = genomic DNA
cccacctcagcagcacggccgccgccgccgccgccgccgccgccacggccacggccacggccccggccccggccaccgcccgccgggcagcccagagc

SEQ ID NO: 76652 - DNA, 204 bp, Homo sapiens
  misc_feature 1..204: note = chr14:33408623-33408827
  misc_feature 1..204: note = hyper
  source 1..204: mol_type = genomic DNA
cgccgcctccgccgccgagggcccctctccgcagcccgcccgcctcctgggccgcgagcccgcggggacctcgtctgggcgcagcgctcgcccggggccccgcgcattgtccccgcggcggctgcggcagcgagaggctctggcggcggccgggctctctgagcagtcgcacctcctcggctcggcgaatagagtgactcactg

SEQ ID NO: 76653 - DNA, 84 bp, Homo sapiens
  misc_feature 1..84: note = chr14:33408887-33408971
  misc_feature 1..84: note = hyper
  source 1..84: mol_type = genomic DNA
agatgcgaaggcgctgccgtgtgacgggagcagcagcgagggtggggggccggggatccccggggccgccgcaggtcccctagc

SEQ ID NO: 76654 - DNA, 30 bp, Homo sapiens
  misc_feature 1..30: note = chr14:33801361-33801391
  misc_feature 1..30: note = hypo
  source 1..30: mol_type = genomic DNA
taaacaaaattattacggtagtaaaattcc

SEQ ID NO: 76655 - DNA, 20 bp, Homo sapiens
  misc_feature 1..20: note = chr14:34408709-34408729
  misc_feature 1..20: note = hypo
  source 1..20: mol_type = genomic DNA
ccggccgaaacaatcttaaa

SEQ ID NO: 76656 - DNA, 177 bp, Homo sapiens; identical to SEQ ID NO: 35196
  misc_feature 1..177: note = chr14:34419561-34419738
  misc_feature 1..177: note = hyper
  source 1..177: mol_type = genomic DNA

SEQ ID NO: 76657 - DNA, 367 bp, Homo sapiens
  misc_feature 1..367: note = chr14:34420004-34420371
  misc_feature 1..367: note = hyper
  source 1..367: mol_type = genomic DNA
agggaacgatctacacgagcgcgaagccgaggcgcggggagcgtggcccggggttcagaaacctgcggctgccacggtacccgagccgctgcagcgtcggggacaagggaaagtttctcgcaactctcgggagaagggatctgccttcgggaaccagcgggagtggtgcggagctccacgacccgtttccggactggcccggcgagcagtgcggcgcaaggagtcggagggcgccttttggggatgggaagccaccactgccgcgactgcggccagactccgggagacgctgaggtccggcccttaagccggccgactccgcgcgtcacgggctccgccccgggaccgcctccgggaccgccctttc

SEQ ID NO: 76658 - DNA, 53 bp, Homo sapiens
  misc_feature 1..53: note = chr14:34499201-34499254
  misc_feature 1..53: note = hypo
  source 1..53: mol_type = genomic DNA
agcagttactttctgcgctttccagcacaaggaggcagcggttgtagcctgct

SEQ ID NO: 76659 - DNA, 213 bp, Homo sapiens
  misc_feature 1..213: note = chr14:34529691-34529904
  misc_feature 1..213: note = hyper
  source 1..213: mol_type = genomic DNA
ctcgccttccctgggcggagtccccatcggtgcctgcccgcccggaagtaggggcgcgagggtgacgggcaagaccgagcccggcccgtgattcttcctcagccggagctcgaccttctccttgtcccttgcgtttcctttctttgaaccacacactcgctcgctcacgtttgtcccgactaagttgcccccggcccccgcagctgtcatgaa

SEQ ID NO: 76660 - DNA, 19 bp, Homo sapiens
  misc_feature 1..19: note = chr14:34554235-34554254
  misc_feature 1..19: note = hypo
  source 1..19: mol_type = genomic DNA
gaactcagccaggtgcggt

SEQ ID NO: 76661 - DNA, 23 bp, Homo sapiens
  misc_feature 1..23: note = chr14:34920639-34920662
  misc_feature 1..23: note = hypo
  source 1..23: mol_type = genomic DNA
caattctaggctgggcgcggtag

SEQ ID NO: 76662 - DNA, 16 bp, Homo sapiens
  misc_feature 1..16: note = chr14:34921211-34921227
  misc_feature 1..16: note = hypo
  source 1..16: mol_type = genomic DNA
tagcgtggtggctcac

SEQ ID NO: 76663 - DNA, 80 bp, Homo sapiens
  misc_feature 1..80: note = chr14:35009476-35009556
  misc_feature 1..80: note = hypo
  source 1..80: mol_type = genomic DNA
acatgctacatgcagcgtctcatcacctacgaagcaggaatctagacgctgagggacacacagcccgaaatccaataagt

SEQ ID NO: 76664 - DNA, 180 bp, Homo sapiens
  misc_feature 1..180: note = chr14:35017114-35017294
  misc_feature 1..180: note = hypo
  source 1..180: mol_type = genomic DNA
cttttaggagagtctcgtgacagcctctgtacatgtccccaggaggaaacaagagactctgatgttcagggccaccatcctgacatggacctttcctccagttataatgttgccattttgctgtcttaagacccttatgtccaagccttcccagacctcagcacccccgggatatgtgta

SEQ ID NO: 76665 - DNA, 461 bp, Homo sapiens
  misc_feature 1..461: note = chr14:35023150-35023611
  misc_feature 1..461: note = hypo
  source 1..461: mol_type = genomic DNA
ataaataataaataaataaatacttaataacaataaagaagaattcgtccattcaacaaccgttcactgagcgcatagcctgtgcccagacactgttccaggcctctgggagcaaaaaggcctcggtgcccgtattctagttagacaacgagaagcgcggggaggtggggggcgggggtgggagagagaaaatctacaccgggctgcataggtaaattcgtaggttaggtgctaagtgctttgaaaaagcaaacaaacacagggaaagtgagataaggagttgcggcaaggggcaggtggctgtgttaaatcgagtggttggaagaagctgctatgagaaggtaccgtatgagcaaaggacttgaagcaggtgaagggagttggtcacggggcatccccagcacaaacatcagctacagcaaaggcccaggtaggactgggtttggcgaacagcaaggagg

SEQ ID NO: 76666 - DNA, 92 bp, Homo sapiens
  misc_feature 1..92: note = chr14:35024362-35024454
  misc_feature 1..92: note = hypo
  source 1..92: mol_type = genomic DNA
gacagaatgcacattcggactcagcagatacagcaaaggtggggcctaagagtctgcactctttaattaattaatttatttatttatttatt

SEQ ID NO: 76667 - DNA, 30 bp, Homo sapiens
  misc_feature 1..30: note = chr14:35032127-35032157
  misc_feature 1..30: note = hypo
  source 1..30: mol_type = genomic DNA
cacagtgcggcatcacggcacacagactgg

SEQ ID NO: 76668 - DNA, 43 bp, Homo sapiens
  misc_feature 1..43: note = chr14:35133216-35133259
  misc_feature 1..43: note = hypo
  source 1..43: mol_type = genomic DNA
tgggattacaggcgtgagccacggtgcccggcccagtataatt

SEQ ID NO: 76669 - DNA, 35 bp, Homo sapiens
  misc_feature 1..35: note = chr14:35507693-35507728
  misc_feature 1..35: note = hypo
  source 1..35: mol_type = genomic DNA
cctcctcaagacttacgaatagagcgccgcccggg

SEQ ID NO: 76670 - DNA, 30 bp, Homo sapiens
  misc_feature 1..30: note = chr14:35838869-35838899
  misc_feature 1..30: note = hypo
  source 1..30: mol_type = genomic DNA
ggcctccggaggcaccggggatcatatgtc

SEQ ID NO: 76671 - DNA, 107 bp, Homo sapiens
  misc_feature 1..107: note = chr14:35866805-35866912
  misc_feature 1..107: note = hypo
  source 1..107: mol_type = genomic DNA
actggaatatgagctcgggtcccgtctctcccacctgcactccgcgctggtgcctgggctcagctcccgtgctatgggctttcatctcatcacgcctttccatgcag

SEQ ID NO: 76672 - DNA, 404 bp, Homo sapiens
  misc_feature 1..404: note = chr14:36002600-36003004
  misc_feature 1..404: note = hyper
  source 1..404: mol_type = genomic DNA
agaagcacttaagagcgcagacgcccaggacccagccgcgctcgggcgtcccgactcggaggctggcggcgggcaggcacgctctcccgcgctgagagcccttctgcggagatgaactctcgagtgtcgccgccgcgcgcgggcccgatcgataccggcgggcggacgtgctcccgccgccgacagcagccacagggcggtgcagtcagctgtccggccgctcggtcgcacttctcatcagctcaatacccgcagaggacgtgcaccggttccctcccggacacccaccccgtggtctccgccgcaccttctgcccaccgccccttccgctcggccgtccggcgcagagcgggagcttttcagccagacgccctcgcgttgggggcagccgggtcccggcccga

SEQ ID NO: 76673 - DNA, 411 bp, Homo sapiens
  misc_feature 1..411: note = chr14:36003546-36003957
  misc_feature 1..411: note = hyper
  source 1..411: mol_type = genomic DNA
ggccccagggggcgccgcccttcttggaggaggctcccagcgcctccttgcccggcgcggagcgggcgacaccccccacccgagaggaaccaggaaaggggttgacggcggaggcggcccgggaacagtcggggtcgccatgtcgggcggctggggtgagcccggggacgggcgggcgggaaggcgcggagtggcgggcgggtggcagggaaggtcccgggcccagccccagccccagccccagtccagcgaagccggcaggcgcagagctgcgtcgggcgttcctggagcgctgcctcagctcgcccgtctccgccgagtctttccccgggggcgccgccgccgtggccgctttctcctgctccgtggcgccagcagccgcaccgaccccgggggagcagtttctgctgc

SEQ ID NO: 76674 - DNA, 655 bp, Homo sapiens; identical to SEQ ID NO: 4075
  misc_feature 1..655: note = chr14:36004080-36004735
  misc_feature 1..655: note = hyper
  source 1..655: mol_type = genomic DNA

SEQ ID NO: 76675 - DNA, 101 bp, Homo sapiens; identical to SEQ ID NO: 4076
  misc_feature 1..101: note = chr14:36004821-36004922
  misc_feature 1..101: note = hyper
  source 1..101: mol_type = genomic DNA

SEQ ID NO: 76676 - skipped

SEQ ID NO: 76677 - DNA, 93 bp, Homo sapiens
  misc_feature 1..93: note = chr14:36458302-36458395
  misc_feature 1..93: note = hypo
  source 1..93: mol_type = genomic DNA
gccatcaccattctacgccatttcactccacagcagctggaatggctgacagtgttccaataattgtcttagttttggcgagtgttccacact

SEQ ID NO: 76678 - DNA, 30 bp, Homo sapiens
  misc_feature 1..30: note = chr14:36790254-36790284
  misc_feature 1..30: note = hypo
  source 1..30: mol_type = genomic DNA
attggaaaactcacacggaattatcatgat

SEQ ID NO: 76679 - DNA, 516 bp, Homo sapiens
  misc_feature 1..516: note = chr14:36972706-36973222
  misc_feature 1..516: note = hyper
  source 1..516: mol_type = genomic DNA
ctgactttattcttacggaattaaacacaataatttttttaaaatatcttctttgaggcaagtgaccacgagagcacctgttatttaaaagtttattgggtagtttaaaaagcggtgtctccctcttcccccttcaaaaataaatggcattgaagtcctccgtttctcttgtttagatcctgcggttggctcgctcatgaatattaactgagaaaggtgaagcagtaatttagggaatcgaatcaaactcactaggagcaaagaagtggtcctgaatcaaaatggaataaacgataacccagagtcattgtcaagtctcccaaatgaagagatgttctgggtaaataaaagtgacaaagtcgtaccacataaacaaatgtagaagatagatgccccagatcaagaaatactactaaagtgacctgacttgacagtaattgcaggcagcttttgagaactgcatcggggttaaacggcagagatcctgacgacctgggcgaccgtccctgcgcagcc

SEQ ID NO: 76680 - DNA, 412 bp, Homo sapiens; identical to SEQ ID NO: 35203
  misc_feature 1..412: note = chr14:36973454-36973866
  misc_feature 1..412: note = hyper
  source 1..412: mol_type = genomic DNA

SEQ ID NO: 76681 - DNA, 293 bp, Homo sapiens
  misc_feature 1..293: note = chr14:36974507-36974800
  misc_feature 1..293: note = hyper
  source 1..293: mol_type = genomic DNA
gagatgaaacaaattcgcccaaaagatagaaatctttgcctcggaaattatcggagaatattaacggagagggaggggagcgcgcgggtcgccgaggaaggacgcgggtacggccccttgctttggggtggcagagccgggctcaggagccagccaagctgacttcgcgaggtggcgcctgggcctttcgggggaaagccccgacggcggagccgcggctgggcggggactcaaatgctggcggcctctgggctggggccgagcagggggtgccgaccgcgggaagtctgggc

SEQ ID NO: 76682 - DNA, 127 bp, Homo sapiens; identical to SEQ ID NO: 35205
  misc_feature 1..127: note = chr14:36974801-36974928
  misc_feature 1..127: note = hyper
  source 1..127: mol_type = genomic DNA

SEQ ID NO: 76683 - DNA, 262 bp, Homo sapiens; identical to SEQ ID NO: 35206
  misc_feature 1..262: note = chr14:36974967-36975229
  misc_feature 1..262: note = hyper
  source 1..262: mol_type = genomic DNA

SEQ ID NO: 76684 - DNA, 252 bp, Homo sapiens
  misc_feature 1..252: note = chr14:36975280-36975532
  misc_feature 1..252: note = hyper
  source 1..252: mol_type = genomic DNA
cggggagccgggatccgccttccatcctgggaaacgactcgggttagggaagcgggatgggctccgctcggagttcccaggcagctggggcgccctccaagtgacgcctttgtccaggctgcgctcgcggagaataaagggggcgctgtccaacctcaggttcggggaaaaccaaggaaccaagggactctttttctaaaatgccctctccaaactacagggaggaggaatgggacacgtgtgcagaaaaag

SEQ ID NO: 76685 - DNA, 30 bp, Homo sapiens
  misc_feature 1..30: note = chr14:36976704-36976734
  misc_feature 1..30: note = hyper
  source 1..30: mol_type = genomic DNA
tgtcctcccattttgcggaaccagggagcc

SEQ ID NO: 76686 - DNA, 587 bp, Homo sapiens
  misc_feature 1..587: note = chr14:36977343-36977930
  misc_feature 1..587: note = hyper
  source 1..587: mol_type = genomic DNA
caaagaaagattgtgcgttaagatcttttttaaaaatccctgcaagttagagtttgcatcatcgtcgtgacctagtgaactaatatttgtatattctgggatcgaaattccgaggaagtttctgctcttccgcacaccagacttgccggtgtggtctccaggaggggttgggggccgcgtcctcagggggcgcgcggccgaggctgttcccagcgcgggaacgggagggagaacctgggcaggggcggggcggggcggggcgcggggacctgggtacgcggagacgcggggcgggcgggggccgagagcgaggctgccggctgggtgttgggagagaggccgcgggtggacggggtaaggactgggactggggagactgagagctggggggtgcggggaggatgaggctgcggacaggaaacgaagggcctgggacagctgcttctcttggtcctagaaaccaaactttcgtagcgagagaccctaagacagctcgagatttcaagtgtccacacttctagtttagacatttggcaaccaattcggaacagccgggccgcgaggggcccccaggtctttggcggcgt

SEQ ID NO: 76687 - DNA, 714 bp, Homo sapiens
  misc_feature 1..714: note = chr14:36977974-36978688
  misc_feature 1..714: note = hyper
  source 1..714: mol_type = genomic DNA
cgcagactccccgccagtcccggccacacccagccagggctttgcagctccagcctgagaatgttagccccggcaaccccttctggcggttgttcctttaaaaaccaattcattttttccatcaagtcttctacccaatgggtagactcttcgttaaatgactgttaaccagtactgaggagaagcacaatcaacatagtttctctgtcacctttcttgccggttttttcctcccaaccatggagtctccattttctaagcaattaaattatatattcaacaggaacattccatttaaaatggttcgggacagaagactgatgcacaaggtctgaagctggaagaaaatatttagtgcttgcctacagattctgtcacccatcatctgctcggaatgcgctccgtatctttcagcgtgtccggctcttatgattgcaaatggccctgttttcaaatggaaataagacttgcaaactgattatgtgtattgaatcagaatcactcgctagatcctcttgtttaaaatgtattgaaaaaaggatgatgggtgcagacctctgtaaccagctctgtctcttctctgggaggtcgatctattttgcaactttttgccatttgagcgtgtttcagccagataattacgttgccattgtgttaccggcccaaagctcagacagggtacacacaccaccacccagccgtctcccaggccct

SEQ ID NO: 76688 - DNA, 67 bp, Homo sapiens; identical to SEQ ID NO: 35211
  misc_feature 1..67: note = chr14:36979742-36979809
  misc_feature 1..67: note = hyper
  source 1..67: mol_type = genomic DNA

SEQ ID NO: 76689 - DNA, 857 bp, Homo sapiens
  misc_feature 1..857: note = chr14:36981839-36982696
  misc_feature 1..857: note = hyper
  source 1..857: mol_type = genomic DNA
gaacatggtgtccagcgtctcctaaccaggatctagccgagcagagaaaacattcagcctcctccctcccaatacccgtgtctgtcactttctttccattcaaaaagaaagtcctagttgaactaaacaagccagtaacccatgcctaagaatcatatcatctcagattctcatctcccaatgggctttctagttctccacaaataaaatcgtctactctgcttcctcgcgctaataattggggggtggggagcagggaagggagagcgatgtctggagacatatgatcagaattcaaggcagcttctcacaactctcttgtttatagaaaatgaatgtctgcctggcttgcttttagttcagaaaaggggtcagtctttatcagcacggttcacacagatcctggattttttttcccttatcttaaattgacccgcttttaagataaagacataatagagaaagcattgaccttacctggtccctaatgagttggaagtcagaaaacccggctctcatttcctcttatctggatcgcctgagaagagactcgcgctaccttttgtgcactcgcgcctcgagatagcccctcactgacgcctggacgcggtgagcgcgctgaaggctgtgcggcctctaaagtctcagaattcctccctgcggcctcaaaattggagagttggattccagaccaagacactgtcactagagctccctagccctggcccaggaagatttaaaatcccttaaaatcccttagacttgctcccgagcaagtctttccctatgaaaggccaaactctaagcttcgtgaagaagcctcctacaaggacactggtctggagcgcccgggcctc

SEQ ID NO: 76690 - DNA, 673 bp, Homo sapiens
  misc_feature 1..673: note = chr14:36982869-36983542
  misc_feature 1..673: note = hyper
  source 1..673: mol_type = genomic DNA
cgcagtgtgtacccttgttggtagcggcagcagcccgggatccctgtctcccctgctcagagcatctctgtctcgctcttctccccgcttctgagcttggcccagtccctgaccccctcgctagctgagagagctgctttccttcctctcctgcccacagctcccagttcccaggctggggccagggtggggagcagctttgggatgctaaacatcaaaaaagcccagcctggggtttcagggcccgaagccactagagcggctctccaaggctctcgagaaagtcctagtgtttacatggcgaagtgggggtggggagaggaggaaggggggtgcagtgtgcaaaatctcccccactcctctcagccgttggggcctagggatgggtagggtactttggcggaggcaaagcttcgcggtgatctcggggtgaaccgtacttgctcccaaacctcggaagcttccaagcacctcagcgccaggggcatcctcagaatgctgatttctccgagaggggaggccagaaattgggcacgagttgatgcaggagattcccagaaaggaggactgtcggctttccagaagccgacggtgctgtaggggcggagggtgtccccaggttgcggaaccctcttgcactgctcccagcgcgcacctatttccctaatgaaac

SEQ ID NO: 76691 - DNA, 57 bp, Homo sapiens
  misc_feature 1..57: note = chr14:36983543-36983600
  misc_feature 1..57: note = hyper
  source 1..57: mol_type = genomic DNA
cttcagattgcgttctaggtctcttcccgcagctgcgacaattcccccagccgggag

SEQ ID NO: 76692 - DNA, 940 bp, Homo sapiens
  misc_feature 1..940: note = chr14:36983673-36984613
  misc_feature 1..940: note = hyper
  source 1..940: mol_type = genomic DNA
cgattgagttcacctttccccgggacaagtaaacagacttcaaactatgccgactgtagacggcgaggagaagaatgtatttgatggaaactccatccaatgcaaagatgataaggccgagggtgccacagcctactaaaattgtgactcccaaaggcttcctcccagctagaatggggtgcggggcagccgccagaaccacagccgggcaccgccagccaggtccccgcccgggcttgggctaggctggggcaggttaagcgaagctccaattccgtgggatccggacctagagccaaacagcagctgcagtatccatgtcccctgcccggccggcctgagctgggtgccttagccacctacactcccggtcccggaaccacagctgaccattccaacgcaagtggtcaaatttgtttgttttccaaaacgtgagacctgttaaaatctcccttccccgccttccaacaagcactctcactagacccaaccatcctcttgggaatcttcgagtccctctggctgttggaaactgtgtctcagcagtgaggcccaggtttctgagggagaaagcccggcctagcccacagtcttaaggcaccacgccagaggaggctccaggaagttaacaaagaggactgctgggcccggagcgaggactccggccagtctgctttcctcacaagctcttggtgggggagcgggagagagggattgggaagagatgcagacgaataacgaaatgagagaggggaagagaggaagaaaaagaaagttgaaaacctgggcgagaagtgagtacatgccaaataagaatcaattgcccataatccaatacttccaggcctagaggaaagtgctgggaggggcgtctgcccgcagctggctcagctgcctttcgaccggagatttggcaagggtgacccggaagggctacagc

SEQ ID NO: 76693 - DNA, 98 bp, Homo sapiens
  misc_feature 1..98: note = chr14:36985841-36985939
  misc_feature 1..98: note = hyper
  source 1..98: mol_type = genomic DNA
tccaacttttgacagcgttttacagctacaagttcacattaaacaaactattttcgcggagggcggtcgccgctgagcctaggcggccagagggtgcc

SEQ ID NO: 76694 - DNA, 332 bp, Homo sapiens
  misc_feature 1..332: note = chr14:36986140-36986472
  misc_feature 1..332: note = hyper
  source 1..332: mol_type = genomic DNA
tgtgccccgccctagcgtggaaaacccatttgaatcaccaaaaaaagacaccccaaagctgttttatgcccttctctgcttaaagattccttgagattggatgcgcttggttgtttttcattttctttttttaaaaaaaaaaacccacaaattttagggggggaaaaaaagaaagacgtccagcagtttggcctttgtggtttttttgttccttggtctaaacgcggccaggttgttaagaaaagtcgaagcgcgtggagcagcggtggatggtggtctgtgtggcgggcaggagggaagcggtgaggcagagcgctgggctagggccggcc

SEQ ID NO: 76695 - DNA, 852 bp, Homo sapiens
  misc_feature 1..852: note = chr14:36987301-36988153
  misc_feature 1..852: note = hyper
  source 1..852: mol_type = genomic DNA
gcccggcccgccccaaccgacggcgccctcctgacccaggcagcctagcgctggggcccaagaggcccatccgcggggaactgccagcgcctgccccaggccgtaccgtcgagggggctgtactggagcgctcacagccccaaccctggctgccctccctcagtctcagttccctctttcgaaccaaaagacgcagtgggggaaaggccgcttctgctcctttcgtgcccagcccgggtcagagcattaggattagctggccacaggcggcgaactgggctcaggccgggagctggggtcctacggtagaccccagtttggagaggttaggagagggggtgttgacttccaaaagctggagcccccagacgctttgcctcttggcttctctcctgtcaggccccagtgagggcacctgctcggacccttagagtcccctctggaactgcgagtcctcccacctgcccagactccgctggagagagggccgggccgggcgctcgagtgcctcccaacagggcagcctccctcctggcccggtctagcctctccgcgctctgctcgcccctgctccttgagctcggggtcgcttcccttggctccccgaggtcttctgcgccgagcagagctgccagtccaccgcgcctaggagacgccgagtacccgcatctgaccgcaggaccccagcgctaccaagtgcctgttcttggacccccagccgagcagggggaagcatccccagctcccgcacccaagtccctggcgccgctgccgggccgccctccctgatgcccagcgcgcagcctgccggcgccgcgccttctggacggctctcgccgcacctcctgagct

SEQ ID NO: 76696 - DNA, 93 bp, Homo sapiens
  misc_feature 1..93: note = chr14:36988551-36988644
  misc_feature 1..93: note = hyper
  source 1..93: mol_type = genomic DNA
ctcatcgacatgattcggcggcggctggaggaggaaggaagaggaggaaaaaaaagggagagggggaaggcgaagcctcgctgcttttttttt

SEQ ID NO: 76697 - DNA, 155 bp, Homo sapiens
  misc_feature 1..155: note = chr14:36989186-36989341
  misc_feature 1..155: note = hyper
  source 1..155: mol_type = genomic DNA
tcggtcggggttccccgggcacggacaggtctttaggaggagggggctgagggacagggtgggggtttcacctgagcctgccggggctgctcctccctcccgccgcggcctcccagccccgcgccttcccactgcctccggaccacatcgggctt

SEQ ID NO: 76698 - DNA, 1131 bp, Homo sapiens
  misc_feature 1..1131: note = chr14:36989403-36990534
  misc_feature 1..1131: note = hyper
  source 1..1131: mol_type = genomic DNA
cgcactgttggtctacgtgtctgtcagtctgtctgcctctcttctgccgccgtcagagggacacctctgctccccgccccctttccccctaccggagagaatccgagcgggcggagggggcgctgagtaggggatcgactgcctcccggaggctgtcccggatccccgagccacaacccgcccccgcagctcaggggtttttcagtgggccacccccgctaacacgcctcccccaaggtcttccccccccccccccacccccggccgagcaaacacagcactggcccccagagctgggaggatgggaaggggtctcacgggagggtccgtcactgaagttgccccacctcgaacaaacctggtgtccctgaccctcgcccatctcccagacacgcggggatctggggctggagctgactttccgaggacatcacagccccagcacccgagcccagagccacgctgttttcccctctgatgcttcagggagcgcgcgagcagggagcggcgtgagtgcccgtctgtctgttgccgggcggaactgagcctgaaccccggcggctggagcgctggccaggagggggcgaatgccgaggtgcgggcagctcagcgggcgggaggctgggccgaggctcgcctccgcccgcagctcagccatgcaaaagtgctcttgcttcccgggaataaccaaatatctttgtttaaagtggtggcgtaaatggccagtcgctttgtggccacgctggatattagtagatgaggatcattctgcttcaattgggcgcctctcatccgacgagcaagaaactgcttaggaggaagagggtttcctgtctgcgcgttcccaggcttcaagtgtgggccccgcgccttgagggtccttgggcgcctggcgagggggagctgtgggctgcgctccccagcggaatcgggggtgtcccccgcgttgctccggccaggccggggcctgcagccgagtcgactaccgagtggagcactgaacggcgcggattttgagaccgactccggtttttgtccttggattttaaacgtttttatcattgtttttgttttgctttctccttagctgttttagtctcctctgcgcgccaggggctgggagggcggagc

SEQ ID NO: 76699 - DNA, 498 bp, Homo sapiens; identical to SEQ ID NO: 35223
  misc_feature 1..498: note = chr14:36990535-36991033
  misc_feature 1..498: note = hyper
  source 1..498: mol_type = genomic DNA

SEQ ID NO: 76700 - DNA, 243 bp, Homo sapiens
  misc_feature 1..243: note = chr14:36991094-36991337
  misc_feature 1..243: note = hyper
  source 1..243: mol_type = genomic DNA
cgacgccgggcttaagcgaaccacagaggagaactggcaacgctgaatacagaccttgtctgcaggcgcgacctggccgggcctgagtcccgaatggggtctaattgcgaaggcggggtgggtttcccagtcacccagcttctttctctcactcgccattatttcatagttgtttgtaagtttaaggaacaccaagtgtagaatgttgtacatctcttccagtctcaacgccatttagaaatg

SEQ ID NO: 76701 - DNA, 199 bp, Homo sapiens; identical to SEQ ID NO: 35225
  misc_feature 1..199: note = chr14:36991579-36991778
  misc_feature 1..199: note = hyper
  source 1..199: mol_type = genomic DNA

SEQ ID NO: 76702 - DNA, 176 bp, Homo sapiens; identical to SEQ ID NO: 35226
  misc_feature 1..176: note = chr14:36991988-36992164
  misc_feature 1..176: note = hyper
  source 1..176: mol_type = genomic DNA

SEQ ID NO: 76703 - DNA, 280 bp, Homo sapiens; identical to SEQ ID NO: 35227
  misc_feature 1..280: note = chr14:36992221-36992501
  misc_feature 1..280: note = hyper
  source 1..280: mol_type = genomic DNA

SEQ ID NO: 76704 - DNA, 37 bp, Homo sapiens
  misc_feature 1..37: note = chr14:36993177-36993214
  misc_feature 1..37: note = hyper
  source 1..37: mol_type = genomic DNA
aaccccccagtgcctcgagaaacgctgaggaaacaca

SEQ ID NO: 76705 - DNA, 50 bp, Homo sapiens; identical to SEQ ID NO: 11824
  misc_feature 1..50: note = chr14:36993438-36993488
  misc_feature 1..50: note = hyper
  source 1..50: mol_type = genomic DNA

SEQ ID NO: 76706 - DNA, 1316 bp, Homo sapiens
  misc_feature 1..1316: note = chr14:36993693-36995009
  misc_feature 1..1316: note = hyper
  source 1..1316: mol_type = genomic DNA
cgcgggagcccggggcgtgcagacaggcggctttcacagacgcagcgggaggaaggatccctctactgctccctttcccgatttgaccgtctagggcctttgagaggactttccttttgggaaagcttttctcaattcgtggcctgtgggcaggctggggggtggggcgccaagtcatccgagcgcggcttctgcttctccctttccctcacaggcatgctctacggagggtatgggaggcgagggcgcgtctatgagggccagagtccgcgaagagagtccggcccttaggcctttggtgttgaagaatctgctcctctgtcgggtcaagccccactagaagttaacacctgtggtctccaaacttgcctattttcctgtcacgcagttcaagccaagattcaactcgtcttgaatttttgtatttagagcccctaccttctccaccgactccaggggcgccctctggcgggaaggggcctggggtaggagggaacctgagggagcgggttacaaagcagagaacagcgggagctcagcagctccctttgaattgcgaggaaaccaagacggagacgggaggtaggagcacgggcctgaagcggtcagccgaccctgtgaggcccgcgctgccgtgctacgccgcgaatccgccagacgcccccgtcggaaggggcagggacaccctcgggggcgctctagggttcgtgctgcgctaaggtaagtttcgcagctgctcctgataattaaaggacagattcccgaagcatccttgtggcggcgcggctgttttcgccccaggacctgtgcagcctcattcagctttaggtagtcgaaacctatagctctttctgccctctgttccccaacaaatctcagtcccaacagtgggagcccgtgggccttgggtgttcgagtttcccgcgggcttgccagcagcgctggggttccctcctccgctcctttcctcctctccaacctcccaccacagcccgtctcccccacatccccaacacttgtcccaggcagtttccggtggccgcagtatcgaccccaggccattggggtgggtgtgagggaagggtggagggggaatctccgaggcccaatgttttctgggacttgagggaggctgaattctccctcgctgcctaggacttggggtctgaaggttgcagaccgaggcgatccgcagcgccctcttccggcggccgtctggagaactgcagctttagagcggtctcggggaagctttgctactagtttccggctagggaaaactggtggtggtcggagactggtagtacatcatccac

SEQ ID NO: 76707 - DNA, 63 bp, Homo sapiens; identical to SEQ ID NO: 35231
  misc_feature 1..63: note = chr14:36995010-36995073
  misc_feature 1..63: note = hyper
  source 1..63: mol_type = genomic DNA

SEQ ID NO: 76708 - DNA, 33 bp, Homo sapiens
  misc_feature 1..33: note = chr14:37050213-37050246
  misc_feature 1..33: note = hyper
  source 1..33: mol_type = genomic DNA
cggcggctggaggggcgccgcacttctcctggg

SEQ ID NO: 76709 - DNA, 39 bp, Homo sapiens
  misc_feature 1..39: note = chr14:37050500-37050539
  misc_feature 1..39: note = hyper
  source 1..39: mol_type = genomic DNA
aggtaccgctgctgccggaagcgccgctccaactccagc

SEQ ID NO: 76710 - DNA, 152 bp, Homo sapiens
  misc_feature 1..152: note = chr14:37051044-37051196
  misc_feature 1..152: note = hyper
  source 1..152: mol_type = genomic DNA
gggtgggggtaaactcgccaacactggccatcccagacggaggcctggagatcgtggccgtgttttcaggcatggagagggggcggggggtggggtgggggcggcaggtggcggcgcgttttaaatttcaattattccgacctctagaaatc

SEQ ID NO: 76711 - DNA, 364 bp, Homo sapiens
  misc_feature 1..364: note = chr14:37051599-37051963
  misc_feature 1..364: note = hyper
  source 1..364: mol_type = genomic DNA
aggaggggaaggaggcgggggcagggcaggctgggaacggaggggcggccgggacgccgctcctacggatgggcgtgggaggcgctcgccatgcgctggcagccgggatattagcgcatttacagcggaatctctgtttatataaacagctcttcccacccaggccgctttgaaagccgaggtccgggtctccagggtgttaagtacctgaatgagcactggaccagagccggggcgagcccggaaggtgccacctccgcccccgccccgccccgcaccccgccccgcaccccgccccttggcgcccagttacctcccagaggctgcaggaagcagcatttggcattagcgattctgtctgatt

SEQ ID NO: 76712 - DNA, 190 bp, Homo sapiens; identical to SEQ ID NO: 4091
  misc_feature 1..190: note = chr14:37116105-37116295
  misc_feature 1..190: note = hyper
  source 1..190: mol_type = genomic DNA

SEQ ID NO: 76713 - DNA, 870 bp, Homo sapiens
  misc_feature 1..870: note = chr14:37116771-37117641
  misc_feature 1..870: note = hyper
  source 1..870: mol_type = genomic DNA
cgtggctgctcttggtgcctcatgggagcgcccggggtagggactcggctagtgacctgtaggacatgaggggcgagctgggagccgattcgcccacggcgtctccttcgccatggaggccccccacccattccactccggggttgcggccacgcaccataagagcaccttcaggtctgagctctttaggggtgggagtaggcagttcgtgagtccgggaaggcctgcggggtttcccgcctgctgcggacttagcgtggggccgaccggggctggcgagggctggcgaggactggcggggacccgcggggctgagccagctctcgcgaagccctcaagtgaggaacggcgcttgtggctgcgcgctctccgcagccaagttgcagggtccagcaggggctcaggtcctgttccctccgcagatcccggatctagggctctagtggtctcggccggagggaaggtgacgcgcagtgggcgcagacgcagagtgcggggcgccgaacgtgggaaggagcgggttcagcgcgctggtgagagtttcaggaaatccgggagagggcggtatttaccagtcccttccccgagagcaaccaggcaaatcggggaaggttagaggtgggggacctgcctgagccgggacaaaaaactttggagctagggccttctaaccctggagacttgccgactccggggcgggctctcgcactcaagtcccgagatgggatgattttccaactttcgtccagcctctccttccgctcccgccgctctgctagcactcccgcactctctccctgggtcacaaccctcgcctgcggaatacctgtctgaagggcgcgtcagtagaagcttcgtttcatactacct

SEQ ID NO: 76714 - DNA, 858 bp, Homo sapiens
  misc_feature 1..858: note = chr14:37123336-37124194
  misc_feature 1..858: note = hyper
  source 1..858: mol_type = genomic DNA
ctagaaagccacagccgctgtggaggaggtaagaggtcagctctttcgttggtcctggtgagggtaaaatttttaggcaggaggagcactgactggcaaagggaagaggaaagggttcgccctggaccccacaaatccgcctcttggagcaaacagcctgcaggtagaggggcctattagagcctgcccagttcccgggagggccaaccccagccagtaagaagacctgaggcgtaggatccctgcgcaggaggttgcaggaatgcccccgctagccgcaaggttcctgctggcctgtagagctttcgtgatccccgccaagatgcgaacagtaaggtcctcgtatggatcgcagtttttgtccgaaacctgaaaacactaacttgggatttcgcagttctggccctcgggcccgcctcggaggcgcacccccaatccccacggaacgaattccgcggctaaaatgcattttcccaaggcagtaaaagtgacccctgcacctaacaacctttgggctttctcttctcctgactaccacctctcgcagggtgcgctgaaatctctttatcgttatcgttttttataaatgaaatgatttatttattcgctgtttgcagggaatgaaaggagttgatcctgactccaagatgcattccaaagaaagaaaacgcaactgtagcccggactccgcggaggaaggccaactgactccactacgtgcacttccgagccacttgggcccagctagctgtgttaattatgggttctaattttattgcaactcggcacctcctggtttgttcccactatagtggtcttaaaaagaaacacacacaggcataccccagaatgaatccc

SEQ ID NO: 76715 - DNA, 279 bp, Homo sapiens
  misc_feature 1..279: note = chr14:37124481-37124760
  misc_feature 1..279: note = hyper
  source 1..279: mol_type = genomic DNA
cgtggactcttggccagcagtgaggaggacaaggttgcagatcctctttgctgcgggttctgggtccggccttgggcggcattctgtcttctaaagtgtggaggtgggtagaagagtgtccactttcagtgtagacacctgaggtatgggggcttctttgggggctccagcgtgagctgctcctgcagattagggaaatggagagaacaacaatggggacatggtggaattcagatttccccctgttaattaacaatatgatttcgcttagtccaagtg

SEQ ID NO: 76716 - DNA, 676 bp, Homo sapiens
  misc_feature 1..676: note = chr14:37124976-37125652
  misc_feature 1..676: note = hyper
  source 1..676: mol_type = genomic DNA
gtagcccctgggggccgcaagagaatccgcccggtagggcatagaagatgggttttcggtgaatcgtgaaaagacatgatcgggtttcccttggagcatggtggagaatgatgcggagccttggggtcaatggagagttgagggtgcagagggatctgaaagggggaaccaaaaatatcgggctttgaaattctgtggattttcaaaggcggttcccaaccttgtcaaaaactacagtgggtgcgcgatctaatctggctcctataggtggcgctgtgacaaggtgcggtggccgggagaggcggctgggggactcgaagactgcgggaaattttctgcgactccgacgctaacccgctgctcccagcctccgcttcctgttttcgagggattagctaggactgtgcaacaccagtctccgctctcggagtcggcacgggggctggtgggtggcgggatgaactcggggaaggcgacaggctggaaacgcagctcctcgactttgcagcgcaccaaccccctatcgccccgtccgctgctcaggtgcgaggattcgccagacgccacaggactgggggcgactcgcaagggcatcatgccacctagaggaaacgcgcagtgagtgagccctgggtcactgaaaatgggagaacgttcgagtcggtcaagatgactc

SEQ ID NO: 76717 - DNA, 951 bp, Homo sapiens
  misc_feature 1..951: note = chr14:37125763-37126714
  misc_feature 1..951: note = hyper
  source 1..951: mol_type = genomic DNA
cgtccggctctgatcagagtacagcgggctgggcctggcagcctgcaggcaacctggaccttgcaataaagctgcattcaacataactcagaccacagtgggagcccccgaagggcttcatgtgagtcccgaaaccagagtttagaggcgcggcctggttctcgtttatcttttccagacagcatttaggccaataaggtctttgaaaggaggcagccccaaagccctcaggccgacacctgagggcagggtctcaaacagctgtgcttgaagaaccggcaatcttgcttttcccacacgcagctgcacctctcctgagcgctgcagctgatggctgtatagtgaccacggactgcgtcctcctcacgaagctgcgcaacttctgctaatgctgcaaccctggcaagacgaaatccccctccctctggctagatcagcccagcctcccctcagggaccttcctgcccctccctacccctccctacccctaggccgctccccccttcctctgttgggatccgatccttgttcgctcttgcaatcccgcagcccggagttttgccccgtgcattaaaacatgttctctttcatttgcagatttaataaacaaacgtaaccatatcacatggagctccacactgtccttctgaaagcaattccgctgttgaaaactgaaaaatgggtgtaatttgctttcagaaagtaatgttagggtcacggcaatttctcgggccgttatttatttttactttaaagtctttaggaaagatttgcttatatgctcggaaaacttccaaatgcgcgaataccagcaatcccgctcgccttcaacgcgtggggtaagggggggtggggaacaattactgagtgacgctaatatggggaaactgaaaagaaatgtcgattgtttttattgtaatagaaggagtgagcaaacagaaaaaccaaccc

SEQ ID NO: 76718 - DNA, 816 bp, Homo sapiens; identical to SEQ ID NO: 35242
  misc_feature 1..816: note = chr14:37126964-37127780
  misc_feature 1..816: note = hyper
  source 1..816: mol_type = genomic DNA

SEQ ID NO: 76719 - DNA, 197 bp, Homo sapiens
  misc_feature 1..197: note = chr14:37128139-37128336
  misc_feature 1..197: note = hyper
  source 1..197: mol_type = genomic DNA
ggccagcgccgagtgtactggttcctcccacccagtgtagccccctccttcacactctcggcccggcttccagtctcccactgagtaaatatttatccagagagcgagtcgcccctcggaggaggcctcgacgcggctagggaaaggctttttggcttctccctggcctgagccagctgcaggccttactggtgttt

SEQ ID NO: 76720 - DNA, 167 bp, Homo sapiens
  misc_feature 1..167: note = chr14:37129080-37129247
  misc_feature 1..167: note = hyper
  source 1..167: mol_type = genomic DNA
aactgctaaagctctcgcagagtccccagaccccccgcgggacatgaggtcttgcctgttcgtatgcgaacatccttgtacccgcctagcagccctgcagactgcaaattttccctgggtgcacggaagtagagcagatttggcgcagaggtcgatactcactgcct

SEQ ID NO: 76721 - DNA, 799 bp, Homo sapiens
  misc_feature 1..799: note = chr14:37130018-37130817
  misc_feature 1..799: note = hyper
  source 1..799: mol_type = genomic DNA
ctgcaaaaaagcatacggtacactttagattagacttacagtgaataaaagtgaaaattcagaagtaggcagaacgacagggcctctggagcttaatggaagacgagggaattacatccatgtgcagcgtcggtgtccactgtcttgggactaagtctctttcatatttaaacaaaactctttcgagagggctcgctggtttggagaaccctcacaaacgctgccaccgagggccaggggcccaggacagtggctgaatgtggcagagccttgggctccgtagtgagtgccccacgcactggcaattggtcgacttggggctgtgcgctagcgttagccgcctgtggttcagttccccgcacacggcgtggcccgtgcctcgagcctgtgtggctagtggttggccggtccacctggactggggggtcgccgcaggaagctggcggtaggaggaacctccctggccttaacagtggcccccacctgtggctcgggctccccgcaacctcctggtttctttggccggcctatcttctcacacctgcgctctcgccacctggcatggactgaagtgaggtagaatcggcaggtgacacagatcctctcctgacagtccccagaggcccgcatgacagattttgctaagacaactccctcacccctgtgcacggtggcgcccgcctcccacctatagccttaacttcaattctgagatgtccatcgttccccggaggaggtctcctcgggccccttctcccttcgagtcattcacattcagaccaaacgctttcatttgttt

SEQ ID NO: 76722 - DNA, 200 bp, Homo sapiens
  misc_feature 1..200: note = chr14:37131143-37131343
  misc_feature 1..200: note = hyper
  source 1..200: mol_type = genomic DNA
ttccttttgccctctcgcctcctcctcctgggaagaagcggaggcgccggcggtcggccgggatagcaacaggccgggccactgaggcggtgcggaaagtttctgtctgggagtgcggaactggggccgggttggtgtactgctcggagcaatgggtgagtggcggcgggggactctgtcagagccgggaagggagggag

SEQ ID NO: 76723 - DNA, 54 bp, Homo sapiens
  misc_feature 1..54: note = chr14:37131834-37131888
  misc_feature 1..54: note = hyper
  source 1..54: mol_type = genomic DNA
acgctcggagaggcccggcatctcaccactttacttggccgtaggggcctccgg

SEQ ID NO: 76724 - DNA, 264 bp, Homo sapiens; identical to SEQ ID NO: 1144
  misc_feature 1..264: note = chr14:37132290-37132554
  misc_feature 1..264: note = hyper
  source 1..264: mol_type = genomic DNA

SEQ ID NO: 76725 - DNA, 780 bp, Homo sapiens
  misc_feature 1..780: note = chr14:37132602-37133382
  misc_feature 1..780: note = hyper
  source 1..780: mol_type = genomic DNA
cggccgccaaggtgcccacgccacccggggtgcctgccatccccggttcggtggccatgccgcgcacctggccctcctcgcactccgtcaccgacatcctgggcatccgctccatcaccgaccaaggtaggggctcagaggctgggcgtgtggatgtgcagcgtctgcccccgcactctcgcggaggtcccagtatctgcagcctcagggacactgtctttcccaccacctgaggctttttcctttggaaacgtaaggagtcttcctagggggtgttctgatctcattaacttgaaactcatgcccctggtttccttgccacacacagtcttctgcctcatctcaaactaccagacccataacatccccccatccccaacacatggttcgcattttccaccctcccccgcctctcgcgccgaggcagcctcagcccggcttgctcacttggagagtgcggccggggctggacttggggcgcagcccgggaggcccgagcctgcttggggctgccggctgcagactccgctgtgggcagagcagcttgcttggggatcactacggccgggagaagtctggccgggaggagtccagcacgccttggaaattgaagtattctccgattctggtaatcaggccaaatttgctcaggcaggaagttcaaatgtcacctaattggtttcgttcttatgcttcacttcattttcctcggaaatggaggtcccgaagttactactagtaacttgcatgtaactcattcccagacgaagtcatattcac

SEQ ID NO: 76726 - DNA, 86 bp, Homo sapiens; identical to SEQ ID NO: 35247
  misc_feature 1..86: note = chr14:37133668-37133754
  misc_feature 1..86: note = hyper
  source 1..86: mol_type = genomic DNA

SEQ ID NO: 76727 - DNA, 36 bp, Homo sapiens
  misc_feature 1..36: note = chr14:37135739-37135775
  misc_feature 1..36: note = hyper
  source 1..36: mol_type = genomic DNA
cgccgccccgcacgcggtgaacgggttggagaaggg

SEQ ID NO: 76728 - DNA, 15 bp, Homo sapiens
  misc_feature 1..15: note = chr14:37136003-37136018
  misc_feature 1..15: note = hyper
  source 1..15: mol_type = genomic DNA
acccccgccaggggc

SEQ ID NO: 76729 - DNA, 324 bp, Homo sapiens; identical to SEQ ID NO: 35249
  misc_feature 1..324: note = chr14:37136294-37136618
  misc_feature 1..324: note = hyper
  source 1..324: mol_type = genomic DNA

SEQ ID NO: 76730 - DNA, 52 bp, Homo sapiens
  misc_feature 1..52: note = chr14:37641710-37641762
  misc_feature 1..52: note = hyper
  source 1..52: mol_type = genomic DNA
ttcgaggcgcagattcgtcgcgcgatctccggcgcgtcggaacctgttcgca

SEQ ID NO: 76731 - DNA, 30 bp, Homo sapiens
  misc_feature 1..30: note = chr14:37641962-37641992
  misc_feature 1..30: note = hyper
  source 1..30: mol_type = genomic DNA
gcgccaagtacaaagcggggacgacacttg

SEQ ID NO: 76732 - DNA, 201 bp, Homo sapiens
  misc_feature 1..201: note = chr14:37666791-37666992
  misc_feature 1..201: note = hyper
  source 1..201: mol_type = genomic DNA
ggtcttgggaaaactcgacgaggccaagtatgaggccacaagacaccgtttttagttccgcgttctccctcttctaatcctattaggttttgtccagacaacgttttgctctttcagaagagaaagagcgttctgcgctcgtcgtcttggattcgacaaccataagcatcccgttagggcaaccaccgcagcagactaagt

SEQ ID NO: 76733 - DNA, 438 bp, Homo sapiens
  misc_feature 1..438: note = chr14:38052765-38053203
  misc_feature 1..438: note = hyper
  source 1..438: mol_type = genomic DNA
cgggacctggtgtcccgcggtccccgcccaggttcctggggcgcttttccgcaatggctggcgtggaagcgagagggggcccagtttttccttgccaggttgcgggtacagccagctccgcgccggggttgggcggcgcggccgggatgctgagagccctgcgtgctcagccaggggcgcagggcggcccttctgcccagcgcgccccgggcaccagggatggcttcccagctggaggccgggagggaggagagtaaatacccattctgcgggggcagccctcgggggatggttgcgaagggagaaacgaaaaataaatcagacaagagagccgtcccgcccctcctcgcccggtcctggcgggcggcgccactggtcctgcagcctcgggcgtgcccgcgcccccccgagcccagggggcgtcgcagcgggccgggc

SEQ ID NO: 76734 - DNA, 249 bp, Homo sapiens
  misc_feature 1..249: note = chr14:38057123-38057372
  misc_feature 1..249: note = hyper
  source 1..249: mol_type = genomic DNA
acccctcccccatctcgggcgaaattcctaagaccagcgagcaggagcaccgcggcgggacggtcagcagcccctttccggccctggtcttcgggagctggcgaggtgaagaaatgtggaaacacccagacgaaaaggggatggggtgggggtcgcaggaaggcggcgccctcaggcagggtctccgcactccctcggaaccacagatgttttcttcctgacccaggggcgcggcgccccagcccgggc

SEQ ID NO: 76735 - DNA, 30 bp, Homo sapiens
  misc_feature 1..30: note = chr14:38057802-38057832
  misc_feature 1..30: note = hyper
  source 1..30: mol_type = genomic DNA
actagaaaatgtctccggcaagtaacagag

SEQ ID NO: 76736 - DNA, 273 bp, Homo sapiens; identical to SEQ ID NO: 35253
  misc_feature 1..273: note = chr14:38060644-38060917
  misc_feature 1..273: note = hyper
  source 1..273: mol_type = genomic DNA

SEQ ID NO: 76737 - DNA, 160 bp, Homo sapiens
  misc_feature 1..160: note = chr14:38061931-38062091
  misc_feature 1..160: note = hyper
  source 1..160: mol_type = genomic DNA
cgagtgaagaagccccggagggcggggttagtggtgggcactggagggcggccgtccgggacctaacccgggggcaagtgcagagcactttgcagaacacgggacgcccccacccggggcaaatggctaagcgccctccccagaccgagcaaagatgtct

SEQ ID NO: 76738 - DNA, 30 bp, Homo sapiens
  misc_feature 1..30: note = chr14:38063973-38064003
  misc_feature 1..30: note = hyper
  source 1..30: mol_type = genomic DNA
gggcagcggtggcaccgagaaggcgccccc

SEQ ID NO: 76739 - DNA, 30 bp, Homo sapiens
  misc_feature 1..30: note = chr14:38064995-38065025
  misc_feature 1..30: note = hyper
  source 1..30: mol_type = genomic DNA
cccaaagttcaaccccgggagactggagaa

SEQ ID NO: 76740 - DNA, 30 bp, Homo sapiens
  misc_feature 1..30: note = chr14:38065668-38065698
  misc_feature 1..30: note = hyper
  source 1..30: mol_type = genomic DNA
ggagagtcttcccaacgcaaagtctcttta

SEQ ID NO: 76741 - DNA, 128 bp, Homo sapiens; identical to SEQ ID NO: 35255
  misc_feature 1..128: note = chr14:38072551-38072679
  misc_feature 1..128: note = hyper
  source 1..128: mol_type = genomic DNA

SEQ ID NO: 76742 - DNA, 175 bp, Homo sapiens
  misc_feature 1..175: note = chr14:38677313-38677488
  misc_feature 1..175: note = hyper
  source 1..175: mol_type = genomic DNA
aaagtacagcagggacgcgggtggagcccttccaagcggcgcagccttatctttcccgagtgaacacctaggtggattcccaacaccgcgcctggcacgtttctggagggagtctcaagctcctccagagctcccagctgcgcgtcctcgtttctgcagtcgatattcctgtggg

SEQ ID NO: 76743 - DNA, 30 bp, Homo sapiens; identical to SEQ ID NO: 35257
  misc_feature 1..30: note = chr14:38678172-38678202
  misc_feature 1..30: note = hyper
  source 1..30: mol_type = genomic DNA

SEQ ID NO: 76744 - DNA, 819 bp, Homo sapiens
  misc_feature 1..819: note = chr14:38678518-38679337
  misc_feature 1..819: note = hyper
  source 1..819: mol_type = genomic DNA
gagggagggcgcaggcggcgggtgcgcgaggagaaagccccagccctggcagccccactggcccccctcagctgggatgttccccaatggcaccgcctcctctccttcctcctctcctagccccagcccgggcagctgcggcgaaggcggcggcagcaggggccccggggccggcgctgcggacggcatggaggagccagggcgaaatgcgtcccagaacgggaccttgagcgagggccagggcagcgccatcctgatctctttcatctactccgtggtgtgcctggtggggctgtgtgggaactctatggtcatctacgtgatcctgcgctatgccaagatgaagacggccaccaacatctacatcctaaatctggccattgctgatgagctgctcatgctcagcgtgcccttcctagtcacctccacgttgttgcgccactggcccttcggtgcgctgctctgccgcctcgtgctcagcgtggacgcggtcaacatgttcaccagcatctactgtctgactgtgctcagcgtggaccgctacgtggccgtggtgcatcccatcaaggcggcccgctaccgccggcccaccgtggccaaggtagtaaacctgggcgtgtgggtgctatcgctgctcgtcatcctgcccatcgtggtcttctctcgcaccgcggccaacagcgacggcacggtggcttgcaacatgctcatgccagagcccgctcaacgctggctggtgggcttcgtgttgtacacatttctcatgggcttcctgctgcccgtgggggctatctgcctgtgctacgtgctcatcattgc

SEQ ID NO: 76745 - DNA, 182 bp, Homo sapiens
  misc_feature 1..182: note = chr14:38679732-38679914
  misc_feature 1..182: note = hyper
  source 1..182: mol_type = genomic DNA
gtaatggcacctgcacgtcccggatcacgacgctctgagcccgggccacgcaggggctctgagcccgggccacgcaggggccctgagccaaaagagggggagaatgagaagggaaggccgggtgcgaaagggacggtatccagggcgccagggtgctgtcgggataacgtggggctaggaca

SEQ ID NO: 76746 - DNA, 30 bp, Homo sapiens
  misc_feature 1..30: note = chr14:38680274-38680304
  misc_feature 1..30: note = hyper
  source 1..30: mol_type = genomic DNA
cccctactggagtcccgggaatgaccgctc

SEQ ID NO: 76747 - DNA, 376 bp, Homo sapiens
  misc_feature 1..376: note = chr14:38724150-38724526
  misc_feature 1..376: note = hyper
  source 1..376: mol_type = genomic DNA
ttgaagggtagacatcgtgctctgtgatccccatcgaggaatctcaggaatagatgttactgaattgtcttgttcagggacaagtggtgtctctcccagcttctcgtcgaccctgattggccatgttctctgcggcacggggctggttgcagtggccggcgggcgcctggtgggcaccccggtccccccaagggtcggctgtccttccccactggtcacacaagagcggccgtccttccccagctcgaagcccgtagcacattcgcaggcaaagcctcccaagtcgtctaggcagttagggagctctgcgcatttgccagcacggaggtacctcccggggcagggacacaacacatcgcccgagagtttgtcccag

SEQ ID NO: 76748 - DNA, 382 bp, Homo sapiens; identical to SEQ ID NO: 1146
  misc_feature 1..382: note = chr14:38724978-38725360
  misc_feature 1..382: note = hyper
  source 1..382: mol_type = genomic DNA

SEQ ID NO: 76749 - DNA, 15 bp, Homo sapiens
  misc_feature 1..15: note = chr14:38725454-38725469
  misc_feature 1..15: note = hyper
  source 1..15: mol_type = genomic DNA
cggagcgctgccagg

SEQ ID NO: 76750 - DNA, 23 bp, Homo sapiens
  misc_feature 1..23: note = chr14:40221669-40221692
  misc_feature 1..23: note = hypo
  source 1..23: mol_type = genomic DNA
cgagagtccgtctcaaaaaaaaa

SEQ ID NO: 76751 - DNA, 382 bp, Homo sapiens
  misc_feature 1..382: note = chr14:42074205-42074587
  misc_feature 1..382: note = hyper
  source 1..382: mol_type = genomic DNA
ttggtgcaactccaccgccctccagtgaagtcccagaagcgatcaagtttaaagtgaaagggggatggaagcattttttctccctatgccttcggagtctgtggcttcagtttgctgcaggttctctccgtggacttctcagaaacctcaactttccacttcgagggacagaaagctacaaggaaaacgctgatggttttggtggagattctcctggacttcagtggtgtcctctggtacatctgtccgcggtgtccctttggtttatttctgtggtcttcctgcgcagtccctcagcggctcggagtttggccttccagctctccaactcagatcctgagcctcctaagctcccgcggagaccctgaagtcccggatctgg

SEQ ID NO: 76752 - DNA, 175 bp, Homo sapiens
  misc_feature 1..175: note = chr14:42074668-42074843
  misc_feature 1..175: note = hyper
  source 1..175: mol_type = genomic DNA
cgtggcttgagtggattcctaagccaaggattggatccggagtaccaggggcagagagggggagcagaggaaagaaaggagatgtgaggagtttccacctaaagcacttcactcctcgtgttcttccccgacagagatagctgtgtggttcttccttacgcgtgggtgcaggtgt

SEQ ID NO: 76753 - DNA, 226 bp, Homo sapiens
  misc_feature 1..226: note = chr14:42075097-42075323
  misc_feature 1..226: note = hyper
  source 1..226: mol_type = genomic DNA
ggtgctctcagtgtccgaagaccacgtgctggtgaacccacaatgagaagcgaaagggtttcaggactctagcagaaaggaagagcaagatttcactcagggtttcttagaagaaagagttaactttgctcactggcttttccaggatggagggagtggggatagggtcggggagagaagcattgggagtcttgtcggagtctcaagcaaaaccaggcgagggctc

SEQ ID NO: 76754 - DNA, 414 bp, Homo sapiens
  misc_feature 1..414: note = chr14:42075396-42075810
  misc_feature 1..414: note = hyper
  source 1..414: mol_type = genomic DNA
cgtctgtgccggtgaccttagagactaggtctggcttatgaagactgttgggctccctttctgcccttcacatagtaaaatgtgaccaactgcagtattcgtaatgtctgatgctgagctgagttgattcccaaatataaatgttcttttcagaatccgctcccatctgattagtaagcaaatcaccacccacaactaaggggacagcggaagccagcctcagatgactgaaacccccaagtcagtagctctcctcaaaatttccggcgggttattatagataatgacttttcccaccgccctaagcagccgaagcttgactcagtgatgattctctctatcccgtaactgcgaggaagtgggcgatcagcaaattgcccttttgcaggaggctggggacgcccctggaagttc

SEQ ID NO: 76755 - DNA, 233 bp, Homo sapiens
  misc_feature 1..233: note = chr14:42075811-42076044
  misc_feature 1..233: note = hyper
  source 1..233: mol_type = genomic DNA
ctttcattctccaggttttctgccttttcccttcccccttcctgcaacgcccccgcgcctcctcagcctggggatttcctggcgcttcgccggccctctccgcaaccccctgataaatcggttcagaaccagtctggctgggaggcccgagggctgacagcagcggagcggccccggccggggtctcacggactctcggggtctggccgacacggccgctcccgtcactgcag

SEQ ID NO: 76756 - DNA, 281 bp, Homo sapiens
  misc_feature 1..281: note = chr14:42076105-42076386
  misc_feature 1..281: note = hyper
  source 1..281: mol_type = genomic DNA
cgcagggctcagttccacgcggccaggaggccgccgttgcccacacgcgacgctttgggaagcccagctcccgggtccgccccggccgcggccgcagccccggacctcggctgcttgcctcgcgcctgaactgcggactcgccccagcgcggtggccagcgggcggggcgctgtgttccgcggcgcgcagggaggcggtgagcgtgtgcagagctgcccgaacggaggactatgtatgtgtgtgcgcgtgtttgcgtgtgtttgagcgtgtttttccttct

SEQ ID NO: 76757 - DNA, 740 bp, Homo sapiens
  misc_feature 1..740: note = chr14:42076628-42077368
  misc_feature 1..740: note = hyper
  source 1..740: mol_type = genomic DNA
ggcccttctgtgttccggaaagatcctggatgttggctaccttttcaagtcatcttggcatgtctctagtgttttgtaagccgctttccagctagctgcgtgtgtgtgtgcgcgcgcgtgtgtacgcgcgcgcctatctgatgcatttgactgtcttttatccaactgcccagaagcaaatgtgttaactcggcgatgccccttcatgcccgggttcttgcagagctctgaggacgcccagacccattttcctggctggatttggagcggctgctgggctgtggacccaggtgtgtggatcgctttacccagaagcttggaaagcgccaatattaacctgcttccaggtacatcacaaggtcaagagagtgtcttgcagccctcttgtttccgtgtatctacaccttcttctcttggccagaaggatatttacgttttggttcacagcatttgaagccaaaagttcagcccttcgaactggtttgctatacaaaacaaaacaaaacaaataaggtaatgaggattgcttattaaactgcttaacaaaatccccgactcttcctcagccctttctcggctccctcctccccaccaaaatgtcaccagctcttgaattacgtggattcgggttggaggagaacttgaaggaaacgtgattaaagggctatgcgagaacgctctctttgctgcccgcggtccggtgggcttcgaagccaatcgtgagaaggaccggttccctc

SEQ ID NO: 76758 - DNA, 231 bp, Homo sapiens
  misc_feature 1..231: note = chr14:42077488-42077719
  misc_feature 1..231: note = hyper
  source 1..231: mol_type = genomic DNA
cgccctgcctctgcccgctccccgggcgcggagccgcgggtttcatggggcgattgcagcgattcccccacccagagcgacctgcgggcagcggcggcagtggcaggagccgcctttccgattccctacgatgcgggtgctgagctatggcaaagggcagcgaagtgacgagcgagacccgcgtacgactgtgaaagccacctggagccaccttgccgggattgtacctgc

SEQ ID NO: 76759 - DNA, 690 bp, Homo sapiens; identical to SEQ ID NO: 35271
  misc_feature 1..690: note = chr14:42078799-42079489
  misc_feature 1..690: note = hyper
  source 1..690: mol_type = genomic DNA

SEQ ID NO: 76760 - DNA, 93 bp, Homo sapiens
  misc_feature 1..93: note = chr14:44004339-44004432
  misc_feature 1..93: note = hypo
  source 1..93: mol_type = genomic DNA
tgggacctttttactttcactctgctcaataaagcctacagctttttctcttttggtctgtgtctctatcactcgccgcggtcagctgccgca

SEQ ID NO: 76761 - DNA, 25 bp, Homo sapiens
  misc_feature 1..25: note = chr14:45382862-45382887
  misc_feature 1..25: note = hypo
  source 1..25: mol_type = genomic DNA
ggtctcgaaacgctagcctccagtt

SEQ ID NO: 76762 - DNA, 30 bp, Homo sapiens
  misc_feature 1..30: note = chr14:45434972-45435002
  misc_feature 1..30: note = hypo
  source 1..30: mol_type = genomic DNA
accctaagaataccccgacaacttttcacc

SEQ ID NO: 76763 - DNA, 25 bp, Homo sapiens
  misc_feature 1..25: note = chr14:45997179-45997204
  misc_feature 1..25: note = hypo
  source 1..25: mol_type = genomic DNA
agtgaaactccgtctcaaaaaaaaa

SEQ ID NO: 76764 - DNA, 81 bp, Homo sapiens
  misc_feature 1..81: note = chr14:46293369-46293450
  misc_feature 1..81: note = hypo
  source 1..81: mol_type = genomic DNA
gcagggagtatacatcgcccaacccccatgatattgttccaaagaaggagaggatgatattactcgcaatattgcaggggg

SEQ ID NO: 76765 - DNA, 182 bp, Homo sapiens
  misc_feature 1..182: note = chr14:46443145-46443327
  misc_feature 1..182: note = hypo
  source 1..182: mol_type = genomic DNA
ctacatcattgtgtgcgccaaatctttatactaaatctctttatatatattgtgtgttctatacaaacacacacacacacgtacgcatgcactcctcaacttatttgatttctcagatatcaccccatcctaagtcaaggagtatgctgaatgcatgtgactgtcaccgcacagaacagtca

SEQ ID NO: 76766 - DNA, 35 bp, Homo sapiens
  misc_feature 1..35: note = chr14:48095553-48095588
  misc_feature 1..35: note = hypo
  source 1..35: mol_type = genomic DNA
attcttcttcctgtccgctacactgtgaggtgaca

SEQ ID NO: 76767 - DNA, 28 bp, Homo sapiens
  misc_feature 1..28: note = chr14:48135049-48135077
  misc_feature 1..28: note = hypo
  source 1..28: mol_type = genomic DNA
caccatggactcctgcgttgcctcagcc

SEQ ID NO: 76768 - DNA, 486 bp, Homo sapiens; identical to SEQ ID NO: 35272
  misc_feature 1..486: note = chr14:48143051-48143537
  misc_feature 1..486: note = hyper
  source 1..486: mol_type = genomic DNA

SEQ ID NO: 76769 - DNA, 102 bp, Homo sapiens; identical to SEQ ID NO: 11855
  misc_feature 1..102: note = chr14:48143617-48143719
  misc_feature 1..102: note = hyper
  source 1..102: mol_type = genomic DNA

SEQ ID NO: 76770 - DNA, 161 bp, Homo sapiens; identical to SEQ ID NO: 35274
  misc_feature 1..161: note = chr14:48143797-48143958
  misc_feature 1..161: note = hyper
  source 1..161: mol_type = genomic DNA

SEQ ID NO: 76771 - DNA, 406 bp, Homo sapiens
  misc_feature 1..406: note = chr14:48144358-48144764
  misc_feature 1..406: note = hyper
  source 1..406: mol_type = genomic DNA
cgaaggtccccggaggggcgtcaagcggcgacagcggcccgcccgcccgcagtccgaagcccccagccctgctgtcttgccttcccccattccatcagttgccattgcaacgccaatcctgttacacgatacagactcgcatcgccgaacggggagaggaggaagaggaggaggaggaagaggaggaggaggaagaggaggagtggggctaggggaacgggggtggggaagagggaagggaggagggggaagaaggaggaggaaagggtccaacagggagcggagtgtgcgtctggagctcgcttgggcacaccagcccagccgccaccgccaccgctctccaaaatagcctttagcgcccggccagcgtagaggtgctctggccggccgcaccaattcccggagc

SEQ ID NO: 76772 - DNA, 126 bp, Homo sapiens; identical to SEQ ID NO: 4104
  misc_feature 1..126: note = chr14:48145236-48145362
  misc_feature 1..126: note = hyper
  source 1..126: mol_type = genomic DNA

SEQ ID NO: 76773 - DNA, 218 bp, Homo sapiens
  misc_feature 1..218: note = chr14:48145469-48145687
  misc_feature 1..218: note = hyper
  source 1..218: mol_type = genomic DNA
cgaggccggcggcatctggcctccaacctcccccgccaaagcgctccctcgcctctcggggagctccgcggtggcgaatgcccgttatgtatttctgatgccgccgtctgcgtttgcacgctgaagggccagctaccaccttagacccagggtaattacatgacacgctatctcctctccgccgcccaaggtcttccaggatccgttatgcttggcta

SEQ ID NO: 76774 - DNA, 30 bp, Homo sapiens
  misc_feature 1..30: note = chr14:48852289-48852319
  misc_feature 1..30: note = hypo
  source 1..30: mol_type = genomic DNA
gagcacacaggtgagcgagtgcgggatccg

SEQ ID NO: 76775 - DNA, 45 bp, Homo sapiens
  misc_feature 1..45: note = chr14:50098049-50098094
  misc_feature 1..45: note = hypo
  source 1..45: mol_type = genomic DNA
cagaagatttgcagccgggcgcggtggctcatgcctgtaatccca

SEQ ID NO: 76776 - DNA, 171 bp, Homo sapiens; identical to SEQ ID NO: 35279
  misc_feature 1..171: note = chr14:50155136-50155307
  misc_feature 1..171: note = hyper
  source 1..171: mol_type = genomic DNA

SEQ ID NO: 76777 - DNA, 180 bp, Homo sapiens; identical to SEQ ID NO: 43975
  misc_feature 1..180: note = chr14:50233117-50233297
  misc_feature 1..180: note = hypo
  source 1..180: mol_type = genomic DNA

SEQ ID NO: 76778 - DNA, 144 bp, Homo sapiens; identical to SEQ ID NO: 43976
  misc_feature 1..144: note = chr14:50233597-50233741
  misc_feature 1..144: note = hypo
  source 1..144: mol_type = genomic DNA

SEQ ID NO: 76779 - DNA, 52 bp, Homo sapiens
  misc_feature 1..52: note = chr14:50287126-50287178
  misc_feature 1..52: note = hypo
  source 1..52: mol_type = genomic DNA
gtcactgcatgacttcgctgaagttccttaccctctccgtttcagattctga

SEQ ID NO: 76780 - DNA, 30 bp, Homo sapiens
  misc_feature 1..30: note = chr14:50316746-50316776
  misc_feature 1..30: note = hypo
  source 1..30: mol_type = genomic DNA
tgccaaagtaaggagcggagcaggaaggaa

SEQ ID NO: 76781 - DNA, 20 bp, Homo sapiens
  misc_feature 1..20: note = chr14:50333655-50333675
  misc_feature 1..20: note = hypo
  source 1..20: mol_type = genomic DNA
caacctcgaatcagccgttt

SEQ ID NO: 76782 - DNA, 120 bp, Homo sapiens
  misc_feature 1..120: note = chr14:50333975-50334095
  misc_feature 1..120: note = hypo
  source 1..120: mol_type = genomic DNA
accgcgcccggccagccgtttgcttttttaacagtgcaaaaaacaaggccgtgtctggctatatggggctttgcttgttcaaaatgtaacctctatacggccgcgcgcagtggctcacgc

SEQ ID NO: 76783 - DNA, 20 bp, Homo sapiens
  misc_feature 1..20: note = chr14:50334335-50334355
  misc_feature 1..20: note = hypo
  source 1..20: mol_type = genomic DNA
gactccgtctcaaaaaaaaa

SEQ ID NO: 76784 - DNA, 39 bp, Homo sapiens
  misc_feature 1..39: note = chr14:50337688-50337727
  misc_feature 1..39: note = hypo
  source 1..39: mol_type = genomic DNA
attacacgtgtgagccaccgcgcccggcctatatgtata

SEQ ID NO: 76785 - DNA, 29 bp, Homo sapiens
  misc_feature 1..29: note = chr14:50434015-50434044
  misc_feature 1..29: note = hypo
  source 1..29: mol_type = genomic DNA
catttatgcataaacgatcacatgacatg

SEQ ID NO: 76786 - DNA, 53 bp, Homo sapiens
  misc_feature 1..53: note = chr14:50474165-50474218
  misc_feature 1..53: note = hypo
  source 1..53: mol_type = genomic DNA
ttcctaaggtgatggcgaggtaggatgaggagtgtaaacggcccaccctgctc

SEQ ID NO: 76787 - DNA, 28 bp, Homo sapiens
  misc_feature 1..28: note = chr14:50681829-50681857
  misc_feature 1..28: note = hypo
  source 1..28: mol_type = genomic DNA
aggcgtgagccaccgcgcccggcaaggt

SEQ ID NO: 76788 - DNA, 77 bp, Homo sapiens
  misc_feature 1..77: note = chr14:50777921-50777998
  misc_feature 1..77: note = hypo
  source 1..77: mol_type = genomic DNA
agcgtagcctcttcttaaaacccttttaaatagcttcccgtggctcttagaataaaagtcaacgtgtggttaaaata

SEQ ID NO: 76789 - DNA, 20 bp, Homo sapiens
  misc_feature 1..20: note = chr14:50828512-50828532
  misc_feature 1..20: note = hypo
  source 1..20: mol_type = genomic DNA
agccctggcagtcctcgctc

SEQ ID NO: 76790 - DNA, 18 bp, Homo sapiens
  misc_feature 1..18: note = chr14:50888271-50888289
  misc_feature 1..18: note = hypo
  source 1..18: mol_type = genomic DNA
gcccggcaacaaaataaa

SEQ ID NO: 76791 - DNA, 469 bp, Homo sapiens
  misc_feature 1..469: note = chr14:51026665-51027134
  misc_feature 1..469: note = hyper
  source 1..469: mol_type = genomic DNA
tttgtttgtgttttccgttgaaaatgttgcggtacgtggtctatcactgtcttcacggtctgggggtggactgaggtagggagggtgtgacgctggtatctgtgtgaactcgggcttgtgatgctgagcttggttcatctgctttctcctcccttttcctccccactccttcccaccagcgccacagcaacatcctcagagtctgagcgaactgcgcccagcgcgggcacggagcctcccaccgccagcaacctgcggccccggagaaggcagcgagcgcagtgacagcgcctcaccgccaccagctcctggaccaccatggccaagaaccgcagggacagaaacagttggggtgagtagcaaatgagaacttctgcagcctgcacggggtcttctggccctccactttctgcttctgtggagacagggagggccaagggctgctaggtgcctgcgtccacggctggga

SEQ ID NO: 76792 - DNA, 36 bp, Homo sapiens
  misc_feature 1..36: note = chr14:51027845-51027881
  misc_feature 1..36: note = hyper
  source 1..36: mol_type = genomic DNA
ggtgggcggtgctcacgcaggcggagaagaacgggc

SEQ ID NO: 76793 - DNA, 35 bp, Homo sapiens
  misc_feature 1..35: note = chr14:51338697-51338732
  misc_feature 1..35: note = hyper
  source 1..35: mol_type = genomic DNA
gtgtgtgtgtgtggccgcgaacagcctgacccggg

SEQ ID NO: 76794 - DNA, 49 bp, Homo sapiens; identical to SEQ ID NO: 35282
  misc_feature 1..49: note = chr14:51410296-51410345
  misc_feature 1..49: note = hyper
  source 1..49: mol_type = genomic DNA

SEQ ID NO: 76795 - DNA, 171 bp, Homo sapiens
  misc_feature 1..171: note = chr14:51410569-51410740
  misc_feature 1..171: note = hyper
  source 1..171: mol_type = genomic DNA
tgtgaagtggacaggcgagaggggcctgggcttttgcccacctggcggtttccaggggcggacggcacagtggtttgggcgggacactggcgggtggcacctcggagacatgagttcggcgtctgttgggaggcctaatctgtcccccaggctgcccgcccacagcctaga

SEQ ID NO: 76796 - DNA, 126 bp, Homo sapiens
  misc_feature 1..126: note = chr14:51411033-51411159
  misc_feature 1..126: note = hyper
  source 1..126: mol_type = genomic DNA
tcttcagctctgccacgttctccacgcccacgatgccgcggatgctgatctgccgccgcttctcctggtccgtcaggggcttcgccatggctggggcggcgggctgcgcggcgggctgcgcagaga

SEQ ID NO: 76797 - DNA, 427 bp, Homo sapiens
  misc_feature 1..427: note = chr14:51560287-51560714
  misc_feature 1..427: note = hyper
  source 1..427: mol_type = genomic DNA
ggtctggcccagagccgggctcatcagtattccgcctgcggcgtctccccgaccctccgccgtgcctcaccaggtccgcctatccagcagcgacagactcccgccgtccgcgcgaccccaccgcccccatcccagtccctccccgagggttcgcagcccgccctgccctcgagcgtgcctagcggccctgggcactggcgcggctctacccagctatgcagtgctttcccacacactggccgcggccactggctgcagacccgccgcggaaagggggcgccctgagtcccgctcgcaggcagcgcgccccgagagacccgctctaaggcatccccgcaacaactctgtgggggcattcaactcccccgtgcgccggttaagattcccccatgcctcctgcaatgcaccagaccagggaggtaaacat

SEQ ID NO: 76798 - DNA, 523 bp, Homo sapiens; identical to SEQ ID NO: 1148
  misc_feature 1..523: note = chr14:51560770-51561293
  misc_feature 1..523: note = hyper
  source 1..523: mol_type = genomic DNA

SEQ ID NO: 76799 - DNA, 718 bp, Homo sapiens
  misc_feature 1..718: note = chr14:51561294-51562012
  misc_feature 1..718: note = hyper
  source 1..718: mol_type = genomic DNA
gggcaccggggccagggccggtgacaagtgggtggccggtggcggcatagccgggggaaacacgcggacgccgttgggggacttctggcacggggtagtgggggcgctggcgaaccccccgtaggagccatagccgctgtccgcctcgctgtataggctcatcttgtccaggtccagatagtcatagtcggagaccccggagcccgcggcccgatggctctggggggattcagactctggggtctgcaccaggatgttgcgggcgcacgcctgacacaaattgtgagagcagggcaggatgatgggctcccgatagaaggagccgcacacggggcatttcaactcctcttccatctcctccatggggaccggtctgggaggagacagcgacggctgcagcgggtgcctgagctggcgaggtggccgacgggcccgtcttgtccagcaccctggccagcggcggcggctgtggtggtggtgccttcccgcgcagcactggcacggacacccagagaggcgctagctctgtgagccgcagccgcgtagccgccgcgccgcgcgccagcccggaccgcccctacctgccctcctagtcccgccccggcccatgagcagcggcccattgggcggggggcaagagatcgaagctctcattggccaccagacccgtccgtctcctcgtctccgcaggccacagggggttcggtagagtctgagg

SEQ ID NO: 76800 - DNA, 425 bp, Homo sapiens; identical to SEQ ID NO: 35288
  misc_feature 1..425: note = chr14:51562235-51562660
  misc_feature 1..425: note = hyper
  source 1..425: mol_type = genomic DNA

SEQ ID NO: 76801 - DNA, 165 bp, Homo sapiens
  misc_feature 1..165: note = chr14:51849769-51849934
  misc_feature 1..165: note = hypo
  source 1..165: mol_type = genomic DNA
cccccgaggactctacgcatgagtgagacctattatttcctctcttctttttcaccatctcaggtgttggaaccggaataaacctgcgttccagttctagctccagaacttggttgccatgtgtcctaattagcaagtacatgatctttccgtgcctcagtttcc

SEQ ID NO: 76802 - DNA, 39 bp, Homo sapiens
  misc_feature 1..39: note = chr14:52119506-52119545
  misc_feature 1..39: note = hyper
  source 1..39: mol_type = genomic DNA
aggtatggacagctgcggtccacccgtgtaagtgtaaag

SEQ ID NO: 76803 - DNA, 70 bp, Homo sapiens
  misc_feature 1..70: note = chr14:52226939-52227009
  misc_feature 1..70: note = hypo
  source 1..70: mol_type = genomic DNA
ggtgatattattccccgaatcgcggggggtgcctcacccccccgtccatgtggatcgtcatatccagggt

SEQ ID NO: 76804 - DNA, 30 bp, Homo sapiens
  misc_feature 1..30: note = chr14:52241137-52241167
  misc_feature 1..30: note = hypo
  source 1..30: mol_type = genomic DNA
caggggcggcgagggcgtggcttttactcc

SEQ ID NO: 76805 - DNA, 17 bp, Homo sapiens
  misc_feature 1..17: note = chr14:52321531-52321548
  misc_feature 1..17: note = hypo
  source 1..17: mol_type = genomic DNA
gccgtggctctttctta

SEQ ID NO: 76806 - DNA, 23 bp, Homo sapiens
  misc_feature 1..23: note = chr14:52395020-52395043
  misc_feature 1..23: note = hypo
  source 1..23: mol_type = genomic DNA
tacaggcgcggtggctcacgcct

SEQ ID NO: 76807 - DNA, 30 bp, Homo sapiens
  misc_feature 1..30: note = chr14:52484814-52484844
  misc_feature 1..30: note = hypo
  source 1..30: mol_type = genomic DNA
atgagccaccatacccgggcaacagttaac

SEQ ID NO: 76808 - DNA, 447 bp, Homo sapiens
  misc_feature 1..447: note = chr14:52534580-52535027
  misc_feature 1..447: note = hyper
  source 1..447: mol_type = genomic DNA
ccgagggcagcgccccgcgcttgacctcctcgtaagcgcctacctgctcccaggtggccaggaaggcgtgggtgggggtaaagcgcgcagagcgcgggaagccagcgcgcacatagcgggcggccaggcccagcactgcgggggaggtgtcctctcggtacaggactcggcctctgccgtggctcgtgtcgatgtccgccagaaaaggggcgatggccgggaagtcggtggggaaatcatagtccacatactgcgtttccctggggaagtcctgagtggagatgatgccgttggtgcccacctgggagaggagagggacaaaaaggtgacagtcgctcaagcccaaggacgctaccctttcgcgcagggagggaagggaactgacttaggcaaaaagcctctctctccttccccactggccagggagtctggattcagggaaacaag

SEQ ID NO: 76809 - DNA, 209 bp, Homo sapiens; identical to SEQ ID NO: 1151
  misc_feature 1..209: note = chr14:52535055-52535264
  misc_feature 1..209: note = hyper
  source 1..209: mol_type = genomic DNA

SEQ ID NO: 76810 - DNA, 91 bp, Homo sapiens; identical to SEQ ID NO: 1152
  misc_feature 1..91: note = chr14:52535334-52535425
  misc_feature 1..91: note = hyper
  source 1..91: mol_type = genomic DNA

SEQ ID NO: 76811 - DNA, 332 bp, Homo sapiens; identical to SEQ ID NO: 1153
  misc_feature 1..332: note = chr14:52535426-52535758
  misc_feature 1..332: note = hyper
  source 1..332: mol_type = genomic DNA

SEQ ID NO: 76812 - DNA, 214 bp, Homo sapiens; identical to SEQ ID NO: 1154
  misc_feature 1..214: note = chr14:52535759-52535973
  misc_feature 1..214: note = hyper
  source 1..214: mol_type = genomic DNA

SEQ ID NO: 76813 - DNA, 92 bp, Homo sapiens; identical to SEQ ID NO: 1155
  misc_feature 1..92: note = chr14:52535974-52536066
  misc_feature 1..92: note = hyper
  source 1..92: mol_type = genomic DNA

SEQ ID NO: 76814 - DNA, 38 bp, Homo sapiens; identical to SEQ ID NO: 1156
  misc_feature 1..38: note = chr14:52536067-52536105
  misc_feature 1..38: note = hyper
  source 1..38: mol_type = genomic DNA

SEQ ID NO: 76815 - DNA, 162 bp, Homo sapiens
  misc_feature 1..162: note = chr14:52536342-52536504
  misc_feature 1..162: note = hyper
  source 1..162: mol_type = genomic DNA
cgcttcgctccacccagagacgccctgaggagaagcgagcctttgtacgaaggcagagggctgactcctaagttctgtccccctcccgaaggccggccgctagggaagacttggccaccctctggaagtaccttcccccgggaaaaccgcagcaggaaagac

SEQ ID NO: 76816 - DNA, 44 bp, Homo sapiens
  misc_feature 1..44: note = chr14:52734481-52734525
  misc_feature 1..44: note = hyper
  source 1..44: mol_type = genomic DNA
gggccctcgcccttccgcagccttcactccagccctctgctccc

SEQ ID NO: 76817 - DNA, 476 bp, Homo sapiens; identical to SEQ ID NO: 35298
  misc_feature 1..476: note = chr14:52734526-52735002
  misc_feature 1..476: note = hyper
  source 1..476: mol_type = genomic DNA

SEQ ID NO: 76818 - DNA, 380 bp, Homo sapiens; identical to SEQ ID NO: 35299
  misc_feature 1..380: note = chr14:52735044-52735424
  misc_feature 1..380: note = hyper
  source 1..380: mol_type = genomic DNA

SEQ ID NO: 76819 - DNA, 34 bp, Homo sapiens
  misc_feature 1..34: note = chr14:52735451-52735485
  misc_feature 1..34: note = hyper
  source 1..34: mol_type = genomic DNA
cggatcgggatggacgcggcgccaggcgagctgc

SEQ ID NO: 76820 - DNA, 96 bp, Homo sapiens
  misc_feature 1..96: note = chr14:52735486-52735582
  misc_feature 1..96: note = hyper
  source 1..96: mol_type = genomic DNA
ccctgggccaggaaggtttgctgctgagttccccaaattggattccttccacagccccgagatataactcagtttgcggagcgaaatgagggaaag

SEQ ID NO: 76821 - DNA, 46 bp, Homo sapiens
  misc_feature 1..46: note = chr14:52780697-52780743
  misc_feature 1..46: note = hyper
  source 1..46: mol_type = genomic DNA
ccgaggtcagactgccgtgcgcttcgagtaccggaccccgaggaag

SEQ ID NO: 76822 - DNA, 30 bp, Homo sapiens
  misc_feature 1..30: note = chr14:52780977-52781007
  misc_feature 1..30: note = hyper
  source 1..30: mol_type = genomic DNA
cgggggcggagacgacggctcccctaggct

SEQ ID NO: 76823 - DNA, 554 bp, Homo sapiens
  misc_feature 1..554: note = chr14:52781428-52781982
  misc_feature 1..554: note = hyper
  source 1..554: mol_type = genomic DNA
gggtgcagcgccggccgcaggagctccctctccttgttccacgtgctggtgaccgagctggtgttcaccgacctgctcgggacctgcctcatcagcccagtggtactggcttcgtacgcgcggaaccagaccctggtggcactggcgcccgagagccgcgcgtgcacctacttcgctttcgccatgaccttcttcagcctggccacgatgctcatgctcttcgccatggccctggagcgctacctctcgatcgggcacccctacttctaccagcgccgcgtctcgcgctccgggggcctggccgtgctgcctgtcatctatgcagtctccctgctcttctgctcgctgccgctgctggactatgggcagtacgtccagtactgccccgggacctggtgcttcatccggcacgggcggaccgcttacctgcagctgtacgccaccctgctgctgcttctcattgtctcggtgctcgcctgcaacttcagtgtcattctcaacctcatccgcatgcaccgccgaagccggagaagccgctgcggaccttccctggg

SEQ ID NO: 76824 - DNA, 89 bp, Homo sapiens
  misc_feature 1..89: note = chr14:52940008-52940097
  misc_feature 1..89: note = hypo
  source 1..89: mol_type = genomic DNA
atataccccagacaacgctgctgctttgatttcatcaataaacatctggtgatgcttgtttatacaaagtgccacgttacatattttgc

SEQ ID NO: 76825 - DNA, 30 bp, Homo sapiens
  misc_feature 1..30: note = chr14:53259141-53259171
  misc_feature 1..30: note = hypo
  source 1..30: mol_type = genomic DNA
ggtttagaaacctttcgttaggagaagaaa

SEQ ID NO: 76826 - DNA, 1018 bp, Homo sapiens
  misc_feature 1..1018: note = chr14:53416802-53417820
  misc_feature 1..1018: note = hyper
  source 1..1018: mol_type = genomic DNA
tcctcattcttttatcgttctgtcagtaaatgttaagaattaacgagttccccggcacacatcccccgtcccgcgtaactacgcaattaaggttataattgggaggctcgaatcattacatatgaaaattcagagaatagcaaaacaaaataagacgcaaaggggaacaggtctatctgcttaaatactgaaagattttacatctccaaaaagcatttgcgagatgccaagatttctcaaatgggcccctcccccgtcgtgagcctctttcctccccctaccaattctgggaagtcattagttggacgcggctgggatgctactcaccgagtttctccaccagcttaagcatcacgcctccaatgtgcacctcgccggtcactctcagggtgacatcgcggttcaggtccgtcacatggacactcagttcccacgtcccgtccgcgtagcagccatctggcatccttatcccgtccagagccatggctccttcctgcgagcgcggaggaaatggctctcgtaagcgtcactcccccaaagaaaggcgaatcccaccgaattcgcagcgccggccacgggctgggaggtggtggaggacccggggctttcggcagaaactcgggagggcggcggcggccggggctgcgggaggaccctacgccccgctcgccccgcagcgttcctcggtcccggcgccgcccgccccacaccgtccccgcctagcggaccgcggagggcttcacctgccggccggccccgagacacagcgcgggctgactccccgttcccctccccgccgcgccccctcgggtcccggcggggtcccgctccctcaccgcgcgctcctagcgctccgggcccgggactcgcgcggcaacaggcgaggggctggaggctcgcggggcggcggtgtccgcgtccggttcctcggctggcgaagcgctgcctgtggccggagcggctaatggagtcccgtcgtcgcggcccctcgcctggctccccgcgctccaccctctcc

SEQ ID NO: 76827 - DNA, 30 bp, Homo sapiens
  misc_feature 1..30: note = chr14:53819535-53819565
  misc_feature 1..30: note = hypo
  source 1..30: mol_type = genomic DNA
ccccaagggaagaatcggggcaaagtaacg

SEQ ID NO: 76828 - DNA, 222 bp, Homo sapiens
  misc_feature 1..222: note = chr14:54421079-54421301
  misc_feature 1..222: note = hyper
  source 1..222: mol_type = genomic DNA
agatcttaatgtggccgaggttttacaactcccgacccggcgcagaaaggaaatcccaccatgttccccggagtcgagaaaacggtgaacagctttcggcctgcgctcgacctctgcgtctgcgtctctctcgcctcggcttcccttattttttaaaccaccaccacactccttcccccgccacttccttcccccacccccttcctccgttgcaccagcagc

SEQ ID NO: 76829 - DNA, 584 bp, Homo sapiens
  misc_feature 1..584: note = chr14:54422341-54422925
  misc_feature 1..584: note = hyper
  source 1..584: mol_type = genomic DNA
cttcaactcacaaaccgcgatccttggaaaccatcctccaaagcagtgcttggaggcctctaaggcccccggaccaactcccgctggaagaagcctgcagggactcgggaatcacgggaacctttcccgtcggttccgggcctggagggccaggaagagccgcgcgtccgcctttcgtcccgccaggaactccccataggacacgacaccgcaggaacaagcgtcctgggagcccctgggatcttggctgtcgtctctagggaccctacaccgtgaaatgatagaggcgaggttccttgggttccgcaagtcgacgaaaatagctcgtggagaaggcgcgtcctgcaactgcagttcgcaagctctcagggcgccccgccagctgggggccagattgggtgacactcccctcgacgcagcctccggagcggcgcgcactctccagaggccagcaggactgcgctctctaccgcagaacctgctccagctaggtgttctctccccatctcgccgtcgctctgccccctcactctctctggacctcagagccggttctctccttcctcctcccgcgctttccgtcc

SEQ ID NO: 76830 - DNA, 45 bp, Homo sapiens
  misc_feature 1..45: note = chr14:54422926-54422971
  misc_feature 1..45: note = hyper
  source 1..45: mol_type = genomic DNA
gggatcgcaacctccagcccgtgggcaacgcgttcagcccaagac

SEQ ID NO: 76831 - DNA, 106 bp, Homo sapiens
  misc_feature 1..106: note = chr14:54423369-54423475
  misc_feature 1..106: note = hyper
  source 1..106: mol_type = genomic DNA
tcgagatagcttggacgggaatcccatcggggagacaagctagatactcagccggagcagcagcggcgtctcaggctcgcgtccctcagctcggatgccacactca

SEQ ID NO: 76832 - DNA, 461 bp, Homo sapiens
  misc_feature 1..461: note = chr14:54430146-54430607
  misc_feature 1..461: note = hyper
  source 1..461: mol_type = genomic DNA
tacttccccgatgtccgctaactaacgtaaagaaacgtccgcgtgctccgctgataccccagggccaccggaggagagcagtggggtgtgagaactaggctgtgtccagtggctggtggtggggggagcggctactgcgccttccccttgggcactcctctcgggtccctgaggcgacgccctagtaagcctccacgcacgtcagcgaagggtgggtggagggtcaccctgaccgcgccccacagctggctcccgcgctctgcccaccgccacgccaccttcaccgcgcgatctcggcactcccgcctttctcttgccctcgttatttttagttcggctgctgcacctccctgcctgcaacagctcgccccactctcagactcgttttgcaggatttgtgcccctggtggctaacctgatccacacttgaataaacagcgagcgcccgggcaacctgggcg

SEQ ID NO: 76833 - DNA, 30 bp, Homo sapiens
  misc_feature 1..30: note = chr14:54687020-54687050
  misc_feature 1..30: note = hyper
  source 1..30: mol_type = genomic DNA
ctcctccggagcccccggctgcattcccgt

SEQ ID NO: 76834 - DNA, 42 bp, Homo sapiens
  misc_feature 1..42: note = chr14:54687254-54687296
  misc_feature 1..42: note = hyper
  source 1..42: mol_type = genomic DNA
tggggagaggggttccgtttcgggtcacggtcctgccttgta

SEQ ID NO: 76835 - DNA, 17 bp, Homo sapiens
  misc_feature 1..17: note = chr14:55370202-55370219
  misc_feature 1..17: note = hypo
  source 1..17: mol_type = genomic DNA
cttaaaatccatttccg

SEQ ID NO: 76836 - DNA, 39 bp, Homo sapiens; identical to SEQ ID NO: 43985
  misc_feature 1..39: note = chr14:55517158-55517197
  misc_feature 1..39: note = hypo
  source 1..39: mol_type = genomic DNA

SEQ ID NO: 76837 - DNA, 233 bp, Homo sapiens
  misc_feature 1..233: note = chr14:55519752-55519985
  misc_feature 1..233: note = hypo
  source 1..233: mol_type = genomic DNA
cattctaagtgggggcgaatagaaactataaatagcttcaggtcacattttgccaccatgtaagttttgtgccaaactagggcagataaagatttatggacctaaaagtaggcatcataaaagctaatatttgttgaggttttgctatattccaggcagcgactaagagatttgtttattaaaagttttacagcaaatctatgatgtgggtacgattccgatcttcctttgcc

SEQ ID NO: 76838 - DNA, 52 bp, Homo sapiens
  misc_feature 1..52: note = chr14:55596101-55596153
  misc_feature 1..52: note = hyper
  source 1..52: mol_type = genomic DNA
gagggttcggctccccgggaccgggccggggcgcgcgcggagagccccacag

SEQ ID NO: 76839 - DNA, 30 bp, Homo sapiens; identical to SEQ ID NO: 15822
  misc_feature 1..30: note = chr14:55664068-55664098
  misc_feature 1..30: note = hypo
  source 1..30: mol_type = genomic DNA

SEQ ID NO: 76840 - DNA, 321 bp, Homo sapiens
  misc_feature 1..321: note = chr14:55765285-55765606
  misc_feature 1..321: note = hypo
  source 1..321: mol_type = genomic DNA
ttggcagggtggaggcggaggagggcgggcgccggagcccagccggagcgggcgttgaaggctggcgcggcgagcgctgttcggggctggagggggtaaggccggcaagggcggcctgaccctccaggaggccatccagcggctgcgggacacggaggagatgttaagcaagaaacaggagttcctggagaagaaaatcgagcagaggcacggcaccaaaaacaagcccgcggccctccaggcactgaagcgtaagaagaggtatgagaagcagctggcgcagatcgacggtacattatcaaccatcgagttccagcagca

SEQ ID NO: 76841 - DNA, 74 bp, Homo sapiens
  misc_feature 1..74: note = chr14:55766010-55766084
  misc_feature 1..74: note = hypo
  source 1..74: mol_type = genomic DNA
gcaggcaggttccatcgctctcgactctcactccaaagcagtagggccgcattgctgctcgctctctgcatagc

SEQ ID NO: 76842 - DNA, 30 bp, Homo sapiens; identical to SEQ ID NO: 43988
  misc_feature 1..30: note = chr14:56077686-56077716
  misc_feature 1..30: note = hypo
  source 1..30: mol_type = genomic DNA

SEQ ID NO: 76843 - DNA, 267 bp, Homo sapiens; identical to SEQ ID NO: 43989
  misc_feature 1..267: note = chr14:57045520-57045787
  misc_feature 1..267: note = hypo
  source 1..267: mol_type = genomic DNA

SEQ ID NO: 76844 - DNA, 232 bp, Homo sapiens; identical to SEQ ID NO: 35308
  misc_feature 1..232: note = chr14:57260863-57261095
  misc_feature 1..232: note = hyper
  source 1..232: mol_type = genomic DNA

SEQ ID NO: 76845 - DNA, 234 bp, Homo sapiens; identical to SEQ ID NO: 1159
  misc_feature 1..234: note = chr14:57261174-57261408
  misc_feature 1..234: note = hyper
  source 1..234: mol_type = genomic DNA

SEQ ID NO: 76846 - DNA, 415 bp, Homo sapiens; identical to SEQ ID NO: 35310
  misc_feature 1..415: note = chr14:57261465-57261880
  misc_feature 1..415: note = hyper
  source 1..415: mol_type = genomic DNA

SEQ ID NO: 76847 - DNA, 262 bp, Homo sapiens
  misc_feature 1..262: note = chr14:57261965-57262227
  misc_feature 1..262: note = hyper
  source 1..262: mol_type = genomic DNA
cgcgaaggaggcctcaaccttaggacaacccgggcgtcccgggcgaaggtctcgatctgccggagccactgcctttcaggcatcgctccattaaagccagggaggagagggtcattggccagcgacccgccctccttacgtccggaggtcaccccacgcctacaggcaggtttttctgtctcctttgcagaacactatgcgtttgttacaacgattaaatgaagaacacagaagtctctggctctgccgggcagaacgcctc

SEQ ID NO: 76848 - DNA, 850 bp, Homo sapiens
  misc_feature 1..850: note = chr14:57263796-57264646
  misc_feature 1..850: note = hyper
  source 1..850: mol_type = genomic DNA
agggcggaaacggggcgactaggggaatcaggttttatcagagcaccctgcgctgacaggctcgggcggtttagaagagaaaatcagaggtgctcagggcacctggtcacaaacctgggcatgcagatgcctgatgggggcttggaccctttcgtggcacgaaaaggagagagactgctgttcatcttaaaagtctcgaaggaggcaaaaacccaggcggaagtcatggctgactctgatcctgcatcttctcattctggttgttttccaccgcgtctgctcccatttgcgtgggatgcgctggtctcctgcccgactcttttgtgttcctcttttgcatgattaaaaacacgtttctatatgcactaaaccatcacctagcactggcacgcctggttttgggttacagctttgtccgtataataacagcgaagttctccctgggtgtgagatgcgggttcgaacatgtggtgtgcgcgccagggctggccgcttccggttaagtggacgcggggacttgactgcgtcccctgccttgcaggtaactggaatgggttgcctggcaagttggccctgcccgggacgccgaagggaccgcttccccattccagagcctgcctctggccttcagggccgctgacaggtccgaaaagaaagagaaggcactcagttttaaaaaaaagagatctagaggactggggaaaaggggatgagccaaggcaaactgggaattgctcgggcttcccccgaaagcctcagctcagtgccgggggagaccccaacggagggccagactcccccaaatccagtggccgaagacctggatttcctgggaggatccccgggggcc

SEQ ID NO: 76849 - DNA, 43 bp, Homo sapiens; identical to SEQ ID NO: 1162
  misc_feature 1..43: note = chr14:57264764-57264807
  misc_feature 1..43: note = hyper
  source 1..43: mol_type = genomic DNA

SEQ ID NO: 76850 - DNA, 209 bp, Homo sapiens
  misc_feature 1..209: note = chr14:57265147-57265356
  misc_feature 1..209: note = hyper
  source 1..209: mol_type = genomic DNA
gccctgggaccggcgcccccgaggcctgagaactacgcccggggggcgcgggctgaggctcaagagaggtcctaggtgcgggccagggatggagccagcccagagagaaaggggaaaacccggcaaggcaagagcctcagtctcgcccctgcctggcccgccaggctgtgagtggggcccattgggcagcgccaacctggggagtccgg

SEQ ID NO: 76851 - DNA, 208 bp, Homo sapiens
  misc_feature 1..208: note = chr14:57265469-57265677
  misc_feature 1..208: note = hyper
  source 1..208: mol_type = genomic DNA
cgcggcggagagcgggccgcccggcaccacgttccttctggcagttccgccccagcctcccagcgtcttgcgcctgtggcggcggcagtacgggcctggggggtcacccacaggaaaggtgagattagcagcaccatgtgggagaggggttgaggaaacccaccattatctaaaacttggaggtttccaaagccggaacttaattgag

SEQ ID NO: 76852 - DNA, 36 bp, Homo sapiens
  misc_feature 1..36: note = chr14:57270936-57270972
  misc_feature 1..36: note = hyper
  source 1..36: mol_type = genomic DNA
agtgccacctcctctcgcatgaagatgtctgggtac

SEQ ID NO: 76853 - DNA, 96 bp, Homo sapiens; identical to SEQ ID NO: 35317
  misc_feature 1..96: note = chr14:57271153-57271249
  misc_feature 1..96: note = hyper
  source 1..96: mol_type = genomic DNA

SEQ ID NO: 76854 - DNA, 37 bp, Homo sapiens
  misc_feature 1..37: note = chr14:57271647-57271684
  misc_feature 1..37: note = hyper
  source 1..37: mol_type = genomic DNA
tggagggaacaactgcgaagcccgagagtgctaagga

SEQ ID NO: 76855 - DNA, 105 bp, Homo sapiens
  misc_feature 1..105: note = chr14:57272009-57272114
  misc_feature 1..105: note = hyper
  source 1..105: mol_type = genomic DNA
agggtgttgcatccccggagggtgggcatggggaagaggggtgcgggagtgcagcagggctcacttacccgggtagcccacggaggggtgcagcaagtccatacc

SEQ ID NO: 76856 - DNA, 200 bp, Homo sapiens
  misc_feature 1..200: note = chr14:57272210-57272410
  misc_feature 1..200: note = hyper
  source 1..200: mol_type = genomic DNA
cgggggtacccagctggaagatcttgatgcgcccggggtggacaggttcagagtccttggtgggtgggtttggagcagtggaactaagggcaaagcaaacaaacaaacagaggggctggtttactgcttcggaggcagcagctcttccacgttccagcactaacttaaaaagagcacggactaggcgaggcagaggcttt

SEQ ID NO: 76857 - DNA, 30 bp, Homo sapiens; identical to SEQ ID NO: 11888
  misc_feature 1..30: note = chr14:57273051-57273081
  misc_feature 1..30: note = hyper
  source 1..30: mol_type = genomic DNA

SEQ ID NO: 76858 - DNA, 322 bp, Homo sapiens; identical to SEQ ID NO: 1166
  misc_feature 1..322: note = chr14:57274417-57274739
  misc_feature 1..322: note = hyper
  source 1..322: mol_type = genomic DNA

SEQ ID NO: 76859 - DNA, 310 bp, Homo sapiens; identical to SEQ ID NO: 1167
  misc_feature 1..310: note = chr14:57274740-57275050
  misc_feature 1..310: note = hyper
  source 1..310: mol_type = genomic DNA

SEQ ID NO: 76860 - DNA, 476 bp, Homo sapiens; identical to SEQ ID NO: 35324
  misc_feature 1..476: note = chr14:57275210-57275686
  misc_feature 1..476: note = hyper
  source 1..476: mol_type = genomic DNA

SEQ ID NO: 76861 - DNA, 1168 bp, Homo sapiens
  misc_feature 1..1168: note = chr14:57276073-57277241
  misc_feature 1..1168: note = hyper
  source 1..1168: mol_type = genomic DNA
gggggttgggaggctgcgtaattacaacccagggtggtttggattttggggggtggtggatatttaaaaacaaaaaggagatctggaagcttttgggagaaacagacaaccgagctgtgctaggctgagggagaggaggccaaagagagcgagcagtgagcgccggggcggacgagaagccagcgctcccagcctcctcggttatccgctccggtttccgctcacgttcaacaggggccgacaggggctcgagcggcggcccccggcccaggccgacccgcaagcgaaccgagcttccggcgcgcgggcccaaggaggcgcctggctttttattattgttgtttcaatccatccatctagttacatctgcatctttttgtctcggactctaaaaaggtccctgggatccatccaaacgaccccaaccaaatctgggggccaaaacgcaaagatcgcgggagaagcccagaacggcgttgacataaaaacaaaaccacaaacaaaaccttccaaaacaccccagattacattcgcagcgtttcgacgacgttttgcagaagcgacgacccccaggagcacgctctctgcctctctcccactaccgctctcatctctagatcacatttttctttttgcaacgatcgttattacacctcaaaatttgtaagagaaaaaatacatccgcctacagaactccacgttcgcagaggggcatcggtcggtctattggaggtactggggtgatggccgacagacacggggacacgtagatatggatatagacaagacagacggacacttaccttacagcctcatgggaggttagaaaaagtcaaatatcctttaaattccaaatagccagctatcctaaaagaaatcaagagtattgagttagaaaccttgcagtcttcacccttccatgaaaagtcaaacacaaccaaaaaaaattttttttaaagaacgaaaatgaggaaggcggctagagttctaaacacgcgtgggcccctctgcaatacatacaaagtagatgtggcgagtgagggctgctctagcaatttttatttttaatcacagtggaggctgtgttggagctgaggccggtcccgctctcagggagatttgctgagaaagcgcctctctggcaactttttgacgcaaactctccaac

SEQ ID NO: 76862 - DNA, 884 bp, Homo sapiens
  misc_feature 1..884: note = chr14:57277879-57278763
  misc_feature 1..884: note = hyper
  source 1..884: mol_type = genomic DNA
cttctctattccctacgcccttataaatatccttacacatataaataaatgatccccgagtgagagaccccggcttctggtaggttcctggggttttttggaattgagaagcccacgacagactgcagggaacacgaaccccggaatctaatctcagggcccatttaggagaagtagctgggaccacatcgggcctcgaggatgcgagtgtgaggtcgacaagatatcgtggaagagagcgaacgagggaggcccccgttggaaacagtttctgtgttagaacaaacgccaccaaacgaccgacactgcgaggcctggagctacctgggctggcgccgcccgagccccgggctgcgagcccagaggctgggaagtgatgggacctgggggcccgagccggagagtgcgacccccagcccaacttttttgcctggcatagaaagcagggaccggacaggtttcaaacggatccgagtccctagaaaagcaaaaacagactgggcggagtgtggggtggggggtggctagtggaactggtgagtgtgtgtgaataagctgggtgggggtgggagcagaagacagctcttgcttcacaacacccagtgcaggaaaagaaaaataaaatctcttcctaaataccccaccccccgccacccacccaccaccaactaccatcaccaccacggccagtgggcccaaagaaacagctcgctgcctttaatttggggacctatgttaatgaagttggtaattaattcgtcgctttgttgtcggttcttatactgtatgtgtactcaaatgtggccgtccttgggatttacagcaattaacgaattacgggagtgcgcacgaggcagcaagctctcggcagccgggctccggct

SEQ ID NO: 76863 - DNA, 728 bp, Homo sapiens; identical to SEQ ID NO: 1171
  misc_feature 1..728: note = chr14:57278837-57279565
  misc_feature 1..728: note = hyper
  source 1..728: mol_type = genomic DNA

SEQ ID NO: 76864 - DNA, 30 bp, Homo sapiens
  misc_feature 1..30: note = chr14:57280814-57280844
  misc_feature 1..30: note = hyper
  source 1..30: mol_type = genomic DNA
acaaaacccatattccgtgagaacatagcc

SEQ ID NO: 76865 - DNA, 126 bp, Homo sapiens; identical to SEQ ID NO: 35328
  misc_feature 1..126: note = chr14:57281138-57281264
  misc_feature 1..126: note = hyper
  source 1..126: mol_type = genomic DNA

SEQ ID NO: 76866 - DNA, 110 bp, Homo sapiens; identical to SEQ ID NO: 1172
  misc_feature 1..110: note = chr14:57283299-57283409
  misc_feature 1..110: note = hyper
  source 1..110: mol_type = genomic DNA

SEQ ID NO: 76867 - DNA, 592 bp, Homo sapiens; identical to SEQ ID NO: 1173
  misc_feature 1..592: note = chr14:57283445-57284037
  misc_feature 1..592: note = hyper
  source 1..592: mol_type = genomic DNA

SEQ ID NO: 76868 - DNA, 624 bp, Homo sapiens
  misc_feature 1..624: note = chr14:57284070-57284694
  misc_feature 1..624: note = hyper
  source 1..624: mol_type = genomic DNA
cgggactgggggacccctgggatcccgccctcgtagcggaaggagtggcagcccttggtgccgggcctggtccttgaggctgccggccctccggggcgccaggactcgaggacgcggtttgcccccgcagtcctaagatccccggggccgtgacagcttggggaaggggcaaactctgtttggtctccacgaagtgcttcgatgttcgcaaaagggtaggcccctcttgcttggggtcctacacccctcggaactggctctgcccctgcctcttccccagcacagtctcccagctaaggctcagacagccggggaaaggggcgcccccatcactattccccacaacccgccccagtgtgagccagggcgcggctgcaggctgacaggcgcaccgtgaccacgccgtcacttcccttcaccaaaggttagatgggaggcgtgcaccctctggggagttcgcaaagcttctcgctttgatcagccgcgcgcagtgccagggagagatattgctggggtctgagtccgtcggaagtgtctagaaaagaagagagaggagcaggtaatcagactttggcggctgccctggagacactttcacacatccagcctcgtggaggaggaagg

SEQ ID NO: 76869 - DNA, 242 bp, Homo sapiens
  misc_feature 1..242: note = chr14:58332163-58332405
  misc_feature 1..242: note = hyper
  source 1..242: mol_type = genomic DNA
tcaccaggtcccctccgcacctccccccaaggctacgactgtttccaaactcctgggcgcacccagccgggccccttgccctctcacggttcagcaccgaggacagcggacatacttttctccccggggggtccccgccgccaggaaggcggtgttgacagcgtccgcagggctgcaggtgtccgtaccgcgcgcccgcccgtccgcatccccgcggcacccctgcgcgcccacctcccttc

SEQ ID NO: 76870 - DNA, 68 bp, Homo sapiens; identical to SEQ ID NO: 11902
  misc_feature 1..68: note = chr14:58332640-58332708
  misc_feature 1..68: note = hyper
  source 1..68: mol_type = genomic DNA

SEQ ID NO: 76871 - DNA, 22 bp, Homo sapiens
  misc_feature 1..22: note = chr14:58404059-58404081
  misc_feature 1..22: note = hypo
  source 1..22: mol_type = genomic DNA
acaggcgcgagccaccgcacct

SEQ ID NO: 76872 - DNA, 41 bp, Homo sapiens
  misc_feature 1..41: note = chr14:58410326-58410367
  misc_feature 1..41: note = hypo
  source 1..41: mol_type = genomic DNA
ctcttcaccaatctgcgacttcccaccgcctccacacaacc

SEQ ID NO: 76873 - DNA, 39 bp, Homo sapiens
  misc_feature 1..39: note = chr14:58599573-58599612
  misc_feature 1..39: note = hypo
  source 1..39: mol_type = genomic DNA
attacaggcgtgagccactgcgcccggccaacccttgtc

SEQ ID NO: 76874 - DNA, 100 bp, Homo sapiens; identical to SEQ ID NO: 35334
  misc_feature 1..100: note = chr14:58618341-58618441
  misc_feature 1..100: note = hyper
  source 1..100: mol_type = genomic DNA

SEQ ID NO: 76875 - DNA, 60 bp, Homo sapiens
  misc_feature 1..60: note = chr14:58797784-58797844
  misc_feature 1..60: note = hyper
  source 1..60: mol_type = genomic DNA
atttatgaaatgaaacgagtatagtcatatgtaatgaagggcatacgctatttctttcct

SEQ ID NO: 76876 - DNA, 40 bp, Homo sapiens; identical to SEQ ID NO: 43992
  misc_feature 1..40: note = chr14:58893188-58893228
  misc_feature 1..40: note = hypo
  source 1..40: mol_type = genomic DNA

SEQ ID NO: 76877 - DNA, 36 bp, Homo sapiens
  misc_feature 1..36: note = chr14:58922879-58922915
  misc_feature 1..36: note = hypo
  source 1..36: mol_type = genomic DNA
gaggctgttggttttcgaggccgccacagagttggg

SEQ ID NO: 76878 - DNA, 30 bp, Homo sapiens
  misc_feature 1..30: note = chr14:59014447-59014477
  misc_feature 1..30: note = hypo
  source 1..30: mol_type = genomic DNA
taaatactcaggttacgcatgttgagctga

SEQ ID NO: 76879 - DNA, 30 bp, Homo sapiens
  misc_feature 1..30: note = chr14:59649485-59649515
  misc_feature 1..30: note = hypo
  source 1..30: mol_type = genomic DNA
catagccagatagcacgggttggcaaacta

SEQ ID NO: 76880 - skipped

SEQ ID NO: 76881 - DNA, 246 bp, Homo sapiens
  misc_feature 1..246: note = chr14:59931193-59931439
  misc_feature 1..246: note = hyper
  source 1..246: mol_type = genomic DNA
ggggcgccccgagcagctcccagggcaaggagaagcccagggccgtcagccaggcgcccgccagcagctgcagcgcgcggcggcggccgatcttctcccgcggcggccgcacgatagcgcagtaacggtccaacgagatgagcgccacgctgagcgtggacacgatgccgaagcacgagctgaagaagcggctggcggcgcagaagccgcgccagggccccgcggcggcggcaggcgccgaacccc

SEQ ID NO: 76882 - DNA, 112 bp, Homo sapiens
  misc_feature 1..112: note = chr14:59931719-59931831
  misc_feature 1..112: note = hyper
  source 1..112: mol_type = genomic DNA
ggacccgccaaggccgccgccaccgggagcggcagctgtgccgcctccgcttgcgtcgctcaggttccccagcgccgcggtcgccacggtgctgaaggagagcacggccgcc

SEQ ID NO: 76883 - DNA, 352 bp, Homo sapiens
  misc_feature 1..352: note = chr14:60043255-60043607
  misc_feature 1..352: note = hyper
  source 1..352: mol_type = genomic DNA
cccgctcagggttcccgctgagtgcctcctaagcgccacctctgaggagacgtcccttccagcgcccgaggggcgtcttacccacaacaaacagctgctccagcgcctcgaccgcgaccgaggagcccagggtggagggtaaggtgcataactccagggaggggccagtggagacggcagccgcctgcaccagcttctcgccagcgcccagccctggggtccaggggctcagggccattttgccgctctacttgagcgcctcctaagccagagccaaggattgccggttgccacgggcaacgaggacaccgaggtcgtggggcgccccctcgtggcccgcacctctagtagg

SEQ ID NO: 76884 - DNA, 54 bp, Homo sapiens; identical to SEQ ID NO: 11904
  misc_feature 1..54: note = chr14:60097193-60097247
  misc_feature 1..54: note = hyper
  source 1..54: mol_type = genomic DNA

SEQ ID NO: 76885 - DNA, 266 bp, Homo sapiens
  misc_feature 1..266: note = chr14:60097406-60097672
  misc_feature 1..266: note = hyper
  source 1..266: mol_type = genomic DNA
ggcagcgaatcagcgcggcgcggccccggagccgcctgcgcgcatggggatgcgggcgccgctccacgcgacagcgttggctgggctgcccaagggtgctaccctggagacgggtaaagcggttctggccgcgaaggcgctgacgcggacagtgggtgggaggtttgggaggaggggaaaaagggctgacggtgggggtgagaggaggaggacttgggctgttcctgggagttcttgactcccagaatatgcgaggtgcatattct

SEQ ID NO: 76886 - DNA, 260 bp, Homo sapiens
  misc_feature 1..260: note = chr14:60336793-60337053
  misc_feature 1..260: note = hyper
  source 1..260: mol_type = genomic DNA
acttgtacccagactcgccagcagccagaatgctgctgtttgcctatgagaacaatttttaaagcggaaataatcatgataatgaaataaaaggatcaaaagcatcttgactttttctgagcctttgggaaaaataaaattgttgttttctaccagcccgcgaatattcccagtcgcccgtggcgacgcgggggtggggtcggcgctcaaggcagaaagcgcgaggcaggtgcccaggagagccgcgcagaaggggactg

SEQ ID NO: 76887 - DNA, 71 bp, Homo sapiens
  misc_feature 1..71: note = chr14:60385979-60386050
  misc_feature 1..71: note = hyper
  source 1..71: mol_type = genomic DNA
cgatcatgggccctgcgagtctgtgggtagcggctcaccctgctggactgcgcagatccagagaacgacac

SEQ ID NO: 76888 - DNA, 686 bp, Homo sapiens
  misc_feature 1..686: note = chr14:60386051-60386737
  misc_feature 1..686: note = hyper
  source 1..686: mol_type = genomic DNA
agacctgcggttgctttggtttgccttttactaagttcatttctcagcctctctgcccactctgaaaagtctcccctttccccccttttaattctactctattttgtaaattactgttgtctcctgaaaattttggaatgcttaaaaggcactcaaaagcctgtccgagatcgactagaagaccctcggaaggtccctctcttctctggacctcactgggcgttcgtttgcccgcgccgtccttccattcggcttgccgggcgcgcagcggcttgcggctgtggtcagccaccttcccgggaggcggtggtcgctggccgcgggaaggatgccgcgctgggggtcggggttcgtcccggctgtcacgccaccttgtgacatcacagggccatgccctcggggctcaaggccagagaggctccgcgcttccaggacccgagagctaaagataatgaatgggagagagcgagactggaggaggtaacgaataagtccccaccaccttgcccataacgcgttgctttcagtcacgttccgcgaactggcgaaggtaagtgaaaagataagcgcaggtacagaaaaacctgccagcgagaagctcccgccgtttcccaggagccccaggtggggtcttccggttggacccctgcttccgctgattggttggaggtcgccaccacgtgatg

SEQ ID NO: 76889 - DNA, 407 bp, Homo sapiens
  misc_feature 1..407: note = chr14:60794473-60794880
  misc_feature 1..407: note = hyper
  source 1..407: mol_type = genomic DNA
ttaaaaaaatatcctcgtggcttaatgaccaaggcgggtttattctcaaggaagggggagcggcgtggtggtgttactaaacataacagatggcagctgtctgcggctatatagggcgcgctgacaaatccctctggatggccacgcggcgctgggctgcggggcctgggtgcacttcgcgcctggctcggagggcgccgcctgcgggaggacctccgggagccgagctgcctccccgcaaacccggcccgggcccacgcgggctcagggcgccaggcggggtgcgccgaggtgcagctccccggccctaggcttcgctggggtgggggtcgaggcctctccgcgggtggctccctccaccctgccgccccgcctcgcggctgggagttgcccgggagctgtgaatt

SEQ ID NO: 76890 - DNA, 30 bp, Homo sapiens
  misc_feature 1..30: note = chr14:60798457-60798487
  misc_feature 1..30: note = hyper
  source 1..30: mol_type = genomic DNA
gccttctgactgcatcgccctctgccttat

SEQ ID NO: 76891 - DNA, 132 bp, Homo sapiens
  misc_feature 1..132: note = chr14:60951858-60951990
  misc_feature 1..132: note = hyper
  source 1..132: mol_type = genomic DNA
ggatatatttcgtaacgaccttttcaatatagcattcttcacaggaacatgtgggcagagccagaactggaagacgagaggcccccttgagcccatggcgacattcccagccccttcccgggccaagcccaa

SEQ ID NO: 76892 - DNA, 225 bp, Homo sapiens; identical to SEQ ID NO: 1175
  misc_feature 1..225: note = chr14:60952195-60952420
  misc_feature 1..225: note = hyper
  source 1..225: mol_type = genomic DNA

SEQ ID NO: 76893 - DNA, 117 bp, Homo sapiens; identical to SEQ ID NO: 1176
  misc_feature 1..117: note = chr14:60952516-60952633
  misc_feature 1..117: note = hyper
  source 1..117: mol_type = genomic DNA

SEQ ID NO: 76894 - DNA, 230 bp, Homo sapiens; identical to SEQ ID NO: 35345
  misc_feature 1..230: note = chr14:60952729-60952959
  misc_feature 1..230: note = hyper
  source 1..230: mol_type = genomic DNA

SEQ ID NO: 76895 - DNA, 769 bp, Homo sapiens; identical to SEQ ID NO: 35346
  misc_feature 1..769: note = chr14:60973239-60974008
  misc_feature 1..769: note = hyper
  source 1..769: mol_type = genomic DNA

SEQ ID NO: 76896 - DNA, 15 bp, Homo sapiens
  misc_feature 1..15: note = chr14:60974077-60974092
  misc_feature 1..15: note = hyper
  source 1..15: mol_type = genomic DNA
cgatgtttctttcta

SEQ ID NO: 76897 - DNA, 47 bp, Homo sapiens; identical to SEQ ID NO: 35348
  misc_feature 1..47: note = chr14:60974368-60974415
  misc_feature 1..47: note = hyper
  source 1..47: mol_type = genomic DNA

SEQ ID NO: 76898 - DNA, 505 bp, Homo sapiens
  misc_feature 1..505: note = chr14:60975384-60975889
  misc_feature 1..505: note = hyper
  source 1..505: mol_type = genomic DNA
gaaaaatgagaagatcgcttccccccaccggcttcctgctcccaccgcaaggtttgctgtttcgttacaactaaacttgcgaattctcggagcatttcagtttggcccagtcctctttgtcctctggagacctctcgaccgagacaacgcatcgccccaaagtgaattcctgaattcctgtggcatcactgcctatttggtgggaaaaagggagggaggggtagagcggggtgggggagggaggagtagtgaacgctgccgcactcgcctctctttttctcccagacactcgcatgtcttttcaacctccaggttctgcaaaatactgaagaaaagtccaggagctaacggcgggcgctgtcgagcacggggaggtgctgaaatagtcctggcgtgctgattcaagctttgattggcagagccacccggtgactgacagggggtctccatggcgcccgcgccgccaatccgcccaccccaatagcggagccagctcgcctgccgg

SEQ ID NO: 76899 - DNA, 536 bp, Homo sapiens; identical to SEQ ID NO: 35350
  misc_feature 1..536: note = chr14:60976074-60976610
  misc_feature 1..536: note = hyper
  source 1..536: mol_type = genomic DNA

SEQ ID NO: 76900 - DNA, 58 bp, Homo sapiens
  misc_feature 1..58: note = chr14:60976802-60976860
  misc_feature 1..58: note = hyper
  source 1..58: mol_type = genomic DNA
cggtctgtcttgggttaagagccctgcgttctgggctcctggccgggagttcccttgc

SEQ ID NO: 76901 - DNA, 429 bp, Homo sapiens
  misc_feature 1..429: note = chr14:60977284-60977713
  misc_feature 1..429: note = hyper
  source 1..429: mol_type = genomic DNA
ttttgcggaagagcccggcctcatcccccaggcccaaatgctccttacaatcctttttgcctttaggtcgggccgacccgatccaacgcgatcgcgggagcacttgctcaggcgtaagccccaggcagacgcaccgttagaaatggtatcccatgtccctgggaccgatctgtccttgtcacccacacttcgtttatttcctgacagtcctgtaaatctcccaaaagtgcacaacaaacagggaggacactgcaagcccagtatataaaagacctgggagctgcggcgctgagaaagggcgcgaatcatggtggggcacaacagtagggacccgcggaggggcggccgcggactcctgcccgacctctgtcgccttgccgagtaatcctcgccttaactgctggggtcttcggaagaacctctagccgc

SEQ ID NO: 76902 - DNA, 410 bp, Homo sapiens; identical to SEQ ID NO: 35352
  misc_feature 1..410: note = chr14:60977879-60978289
  misc_feature 1..410: note = hyper
  source 1..410: mol_type = genomic DNA

SEQ ID NO: 76903 - DNA, 30 bp, Homo sapiens
  misc_feature 1..30: note = chr14:60978879-60978909
  misc_feature 1..30: note = hyper
  source 1..30: mol_type = genomic DNA
tgtccacttgacactcgtttacatgaagtg

SEQ ID NO: 76904 - DNA, 656 bp, Homo sapiens
  misc_feature 1..656: note = chr14:60981157-60981813
  misc_feature 1..656: note = hyper
  source 1..656: mol_type = genomic DNA
ggtcaggctcttttccggcttataaacatttcaaccacactccagtttcaccaaaaaaaacgacggcccctgctccccaaatgccgcagttcctctcgcctccactttaatgacccactccacttccacccgtcactccctcctttcccttcgccagtttgtttataaaaaatctgggagggaggggagaagacgatgggggtggggagggcttgctctttgtttacattaaacaaatgacaggcaaagagctcaagcaaagtcttccttgacctcgttccctctccctaattttaacaaaaaggaaaaaaatattgtatccaaagagaatgtgaatggggcgggaggagaggagaagcagcttttcgctctattcaacggggacgcgagagcgcggacgatttccgctccttttgtgaggcggagcccgggggcggccgtgaatggggggtctgtggagcggccggcggggctgtcaggcggctctgcgtaatcagggctaatgacggcggccgggcgctcggcgggacaatgcgcggggccgcggggttttgtcggcctgaatggctaataggtttgcctgtgagctgcgagggggcggtgtcggggaggaggcggcggcgaggggagaaggggtcattgtccgcgcgctggcc

SEQ ID NO: 76905 - DNA, 396 bp, Homo sapiens; identical to SEQ ID NO: 35354
  misc_feature 1..396: note = chr14:60981972-60982368
  misc_feature 1..396: note = hyper
  source 1..396: mol_type = genomic DNA

SEQ ID NO: 76906 - DNA, 426 bp, Homo sapiens; identical to SEQ ID NO: 35355
  misc_feature 1..426: note = chr14:60982573-60982999
  misc_feature 1..426: note = hyper
  source 1..426: mol_type = genomic DNA

SEQ ID NO: 76907 - DNA, 15 bp, Homo sapiens
  misc_feature 1..15: note = chr14:61104140-61104155
  misc_feature 1..15: note = hyper
  source 1..15: mol_type = genomic DNA
cctaccccccagtgc

SEQ ID NO: 76908 - DNA, 316 bp, Homo sapiens; identical to SEQ ID NO: 1182
  misc_feature 1..316: note = chr14:61104241-61104557
  misc_feature 1..316: note = hyper
  source 1..316: mol_type = genomic DNA

SEQ ID NO: 76909 - DNA, 241 bp, Homo sapiens; identical to SEQ ID NO: 1183
  misc_feature 1..241: note = chr14:61104623-61104864
  misc_feature 1..241: note = hyper
  source 1..241: mol_type = genomic DNA

SEQ ID NO: 76910 - DNA, 254 bp, Homo sapiens
  misc_feature 1..254: note = chr14:61108567-61108821
  misc_feature 1..254: note = hyper
  source 1..254: mol_type = genomic DNA
cgcgacagcctgacccgaagcgcgctgcagacctaggctggtgccttccccttggggccagggctgtgcgtgggggacaaggccgctgctctccctagggccgctggctaagaaggaaatacctgacctggccccaccaagaaagtggagctcctccacccccagttctgctggagacactagaagccagggcccctctctctgccgcgggaagttctagcgacaagcccagaaagtgacgtcctctctacctg

SEQ ID NO: 76911 - DNA, 1157 bp, Homo sapiens
  misc_feature 1..1157: note = chr14:61109111-61110268
  misc_feature 1..1157: note = hyper
  source 1..1157: mol_type = genomic DNA
cagccgggtgtccagcgccgctcacgtgcctcgcctggagcttagctctcagactccgaagagggcgactgagacttgggcctgggagttggcttcggggtacccaaggcgacgacagctgagttgtaccacgaagctcaggccgaggcctcctcccttgtctggccttcgaatccatactggcagcctctcctctcaggcactccgcgggccgggccactaggccccctgctcctggagctgcgctatgatccgggtcttgagatgcgcgcgattctctctgaaccggtggagaggaggctctgccccgcgcggagcgaggacagcggcgcccgagcttcccgcgcctctccagggcccaatggcaagaacagcctccgaagtgcgcggatgacaggaaaagatcttcagttcttctgccgctagagaagtgcgggatacaagcctctattggatccacaacctggagtcctgccttcggactttgccaaagacttgcaggcggtggggaggcagtaggaaatgaagccccctccagcctcagccgccgccgcgttcggtgcagcagcagcagtgccactgccacagagcagaggaaggcccgctccgcgcgagttctgtgccaggtgtcccgttggccctcagcggacaagggagagccgctaataagggtcgctgctcagcaaactcagagctcatccataagtgccaacgccactgcttctttctggaagcttccactccggcccggggtccggccccagccacgctgtcctagcccagagaacaggttcaagaacggtggtgcccagccccagcggtgcccttctccgtccctgtagctcgctgggctcttgagcccctacccactaagccaaaaattcgggaaccgggagccaaaccccttggcctctgagaatttaggaagcttcgttttcagccaagaggtcaaggcgagcagagagtggggactcgaacaatcgcgtgtttaggtttaaaacgttaaaaaataaacatcactcgagtgttttttttttttttcatttcacttggcacaatgctgtatggtttcgtcctacaaactatttataagccgttgttcattacttttggctaccgttatgacatctgtagaggagaaacgaaaagtggcttta

SEQ ID NO: 76912 - DNA, 197 bp, Homo sapiens
  misc_feature 1..197: note = chr14:61110508-61110705
  misc_feature 1..197: note = hyper
  source 1..197: mol_type = genomic DNA
catctggaatatgcgcgctctggatttagtgccaggggttttacaaagagtttatgactgtgacagaaaattgtccttttaacaagtttacaagcagtaatcacgggggcttttacaggaccagcgctcttgctcctcgccggatctgcagacatttccaagattcaccaactaagggagcaggaagtgggccgggg

SEQ ID NO: 76913 - DNA, 58 bp, Homo sapiens
  misc_feature 1..58: note = chr14:61110749-61110807
  misc_feature 1..58: note = hyper
  source 1..58: mol_type = genomic DNA
cggagctgggagagtggagggtagtcaccggagtaggaagagacggcatgtaagaaat

SEQ ID NO: 76914 - DNA, 608 bp, Homo sapiens
  misc_feature 1..608: note = chr14:61114114-61114722
  misc_feature 1..608: note = hyper
  source 1..608: mol_type = genomic DNA
caggctgccagcgggcgcggcgcgctggggcgtcagtccgggcactcggtaccggttaacttcaggatttcgcttccctcgccgcttccgccttccgagtgctcgtcagtcctcccgactcctagcgcctgtctgtctcctttctttccccttatcctcacagtctctgtctcccgacaagcccatttcagcagaatttatcctggctctggttttccaccaagacaagaaagggagcaagatcttcggcccctagtcttggaagcgaacaaaggaaaacctaaccggcccctgcgctcaggttttcccccaaactctttggcttcgcggagcgctctccccgccacagccacctccccaccgtccttctgaatctctgtccgaaacgctatagagaacagaaggagcctgcccaggtggccgaaggtgttgccccgaggtgggggaaagtagagaccaatttttaaaatattgccttgtgagctccagtgcgagagagggctgcgactggagaccctttcctcgtctgggcatgcggcgcggtcagccagaccgacgggctgcagtgccgggccacgcgcgagcgagcacggcgaggatcaaccctt

SEQ ID NO: 76915 - DNA, 1613 bp, Homo sapiens
  misc_feature 1..1613: note = chr14:61114997-61116610
  misc_feature 1..1613: note = hyper
  source 1..1613: mol_type = genomic DNA
caacatttcactgcccgttgatttagaaactcactctccacccaccactcatagccgcggccagccagggaggcataaagaccaaatctagcgccaatatttcccgacactcacatcccagagaaacccacgcgcgggtgctcaaagcaaatgaggccccatccttagcaaggaacctcagagttcatgaactttcgctgcagcgccgcggagggcctgcgcgccgccccgtggacgggctccggccggcggggaggacttggtggctggtgcctgcgggggcgggagggggcggaggagaaaggacggcttcctagggtcgcccgagtcgcgggaagcacgccgcgtacctttccttggcctccgcggcccggtctctttgcctccggttcttaaaccagttgctgacctgggtggtggtgaggccggtggcctcggccagctcccgcttctcacgcggcgatgggtagggattgtgcgcgtaccactcccgcaggacacccctcgacttctccttgaagcagtagctggtctcctcgccgtcccagatggtgcgcggcagtggaaattttcggcgcacccgatatttgcccacggcgcccaggggtcggccgcgcagcttctcggcctccacgtaatgcgccttcagccacagttgctgcagtttggggtggttgtgaggcgagaactggtggctctccaggatcttgtagagctcacggaagttgccgcggtggaaggcgaccaccgccttggccttgagtacgctctcgttcttgtgcaggtggtcgcaggcgggcagtgaccacaggaacctgcccaggcgctccaggtttccgccttgctgcagaacctcgcacacgcacgccacttgctcctgcgtaaagccaaacgacggcagcatcgacatggctggggcctgccggggcgcacggcccaggcgcacgcggcagggagcagagccgagaggcagggggcggcggccgcagggaggggggcgcggctgttcctaacctcctccttaggctttgcaaaggcgaaaaccggagtcggaacttggcggtgggcggccaaggaagagaaggcggaggagtaggggaggttctggacacggaacggccggcgcactcagtagcctttaaggccttgctgcctccgacctcccgcccggtggatgctgctagttgccggggaacttggtttctgttctccccgcagcggccttaaagcgcgcagcgtccccggcacgctgattggctgccggcggcgcctatccggggctggccagccagcgcgccgcccggctgggcagagaggccgcaccgcccagagcggggagggcgaggctgcggagctgggggttgggggtgttgccggggctgcgcgggtagggagtggtgggaggagaaggaagaggaaaggtgggaagccagttggggtctgagggagctgcgctgcggaggtgtggggaggtagggagtgggtgagcgcgtcaggaccctgcaacgcgggacccgtcgccagtatcacctaaggggagtcgcgcacaactccgcacaaatcaatgactccaaaccttaattcctcccctctccctccgtactcttgtcctc

SEQ ID NO: 76916 - DNA, 160 bp, Homo sapiens
  misc_feature 1..160: note = chr14:61116868-61117028
  misc_feature 1..160: note = hyper
  source 1..160: mol_type = genomic DNA
acaagtactcccagtcggacagcgtttccctcgttcacaaaagacctccatgatttgagaccaggcagagagctgtttagagcatacttgctgagcacctagagactccgagcgttcatttgtgatttggtatcttaatgttctgcgattgaaaccagca

SEQ ID NO: 76917 - DNA, 358 bp, Homo sapiens; identical to SEQ ID NO: 35364
  misc_feature 1..358: note = chr14:61118778-61119136
  misc_feature 1..358: note = hyper
  source 1..358: mol_type = genomic DNA

SEQ ID NO: 76918 - DNA, 34 bp, Homo sapiens
  misc_feature 1..34: note = chr14:61120426-61120460
  misc_feature 1..34: note = hyper
  source 1..34: mol_type = genomic DNA
ccatctgaaagaggacgctcgttcattctgtctg

SEQ ID NO: 76919 - DNA, 141 bp, Homo sapiens
  misc_feature 1..141: note = chr14:61123540-61123681
  misc_feature 1..141: note = hyper
  source 1..141: mol_type = genomic DNA
gactaggaagaaggccgtaagatctttccttacctctactcaagttcacccgccaccctcacccatcaaccctcgtgcaggcccgggtccacgtttcgcggactgatcctgagcctcagtataactcgctgtgccaggtgc

SEQ ID NO: 76920 - DNA, 393 bp, Homo sapiens
  misc_feature 1..393: note = chr14:61124304-61124697
  misc_feature 1..393: note = hyper
  source 1..393: mol_type = genomic DNA
gccccggacggcactcgcgaggagggagttttctttggcttctttagctgtttccataatcgccttcttttagggccatccctccctcactttttccctccaaaaactggaggcgttgggataaggacggcgacgcttcgctggcgaatgaggtgcctcaatttgcccgaggcgagcggggaaatcgggatctcctttcatgaagccgagttggcttctcggtttcgtggaatctgcggccggaagccgcgaccccagccagtcattcgcgttgaagcgccgcagcaagtggcaatgcttttggccgcgcattgcccaggaacagcaaagagatggaagaccctctcatttaccatcaccaactggtcggggagcacacgcagagaccaataa

SEQ ID NO: 76921 - DNA, 125 bp, Homo sapiens
  misc_feature 1..125: note = chr14:61188120-61188245
  misc_feature 1..125: note = hyper
  source 1..125: mol_type = genomic DNA
atccccgcagtgccccgcggtcggttcgctttcatgccgaggggaggggattacccgggctttgggctgcggggccaggagcgcagaaagcgctttgatttacaagctgaggctgagccgccgtc

SEQ ID NO: 76922 - DNA, 381 bp, Homo sapiens
  misc_feature 1..381: note = chr14:61188246-61188627
  misc_feature 1..381: note = hyper
  source 1..381: mol_type = genomic DNA
ccgtctgcgagggtgactcaccgggggtgcgggtgggaggtagatccggagaggggcctaaaccaggcaactgggccggcggcggggtgggtgtggagtttatggggtggggcgggggggacgaagaagccagcagtggagcgtgggggagtcccagggagcgtgcccggctcgcgagcggaggcggcggagcagctggcctgctcgcggtgcccccttgccaccctctgccccggccctgcggattccgttggtttccgagcgcgggatccgcggcctctagtgggcgcagggcaggtggctcggcgtaaccaaagcgccttctctggacctctccgcatatctgcggaaggcgcacgcacatcccggtgcaccttttgt

SEQ ID NO: 76923 - DNA, 190 bp, Homo sapiens
  misc_feature 1..190: note = chr14:61655782-61655972
  misc_feature 1..190: note = hyper
  source 1..190: mol_type = genomic DNA
ggacagcactgggatcgaaagacgatctgctccttcggaagaaaacacagggtgcggcggtgactcgcagagctcccagcgccccagcgcccccgcgaggcccgggcagcgtccgcgctccctacagggggaagcccgccggtgtttgggaatcccagcggggtccccagcttgccgatctcccagccct

SEQ ID NO: 76924 - DNA, 140 bp, Homo sapiens
  misc_feature 1..140: note = chr14:61747388-61747528
  misc_feature 1..140: note = hyper
  source 1..140: mol_type = genomic DNA
gatgggcaggccggccgcgctgcgctggtagggggcgcactcgttgacagggtggcgcagcgcgctggggagtccgctcagctgcgcgtcgtcgcgggacacgccgtagcgccggttgttctggtagaagttggtcagct

SEQ ID NO: 76925 - DNA, 156 bp, Homo sapiens
  misc_feature 1..156: note = chr14:61747582-61747738
  misc_feature 1..156: note = hyper
  source 1..156: mol_type = genomic DNA
cgcacgagcaggggggcggcagcgcccggccctggccagccgcggcgcacaccgagcagttaccggtgcccgggtcgcctgtatagtcgtactccagctccttgatgccgttggaggagtagtagaggcccaggcccaggccgatgaaggccaggc

SEQ ID NO: 76926 - DNA, 107 bp, Homo sapiens
  misc_feature 1..107: note = chr14:61748097-61748204
  misc_feature 1..107: note = hyper
  source 1..107: mol_type = genomic DNA
acccccgcgggtcaccgggagccgcacctcgcccgccccttccgaggtgagcaggtgggtgttttttacctcacctggtagactcagtctcgcgtttcctctcagtc

SEQ ID NO: 76927 - DNA, 237 bp, Homo sapiens
  misc_feature 1..237: note = chr14:61788181-61788418
  misc_feature 1..237: note = hyper
  source 1..237: mol_type = genomic DNA
cgggcactggcctcccgggggcttgcgcggggatccacccaccgcagggccgggccgcggaccgcgggccacgcccctggggtccggaaggcgcgggagcggacgcgggggttctgtgaacttggaacctggcggtgcgaggttctcgccggggatgcggcggcggcagctgcttcctggtttgaagctcgccgagtgggggagagcgtgagccttcggaggcgggggcaggaggag

SEQ ID NO: 76928 - DNA, 483 bp, Homo sapiens; identical to SEQ ID NO: 35370
  misc_feature 1..483: note = chr14:61788722-61789205
  misc_feature 1..483: note = hyper
  source 1..483: mol_type = genomic DNA

SEQ ID NO: 76929 - DNA, 30 bp, Homo sapiens
  misc_feature 1..30: note = chr14:61943693-61943723
  misc_feature 1..30: note = hyper
  source 1..30: mol_type = genomic DNA
tcagatttcctcatgcgggtgcttttccac

SEQ ID NO: 76930 - DNA, 140 bp, Homo sapiens
  misc_feature 1..140: note = chr14:62148179-62148319
  misc_feature 1..140: note = hypo
  source 1..140: mol_type = genomic DNA
aatggagctgggatccgggagtcaatgggccataggcagagacgagatgaacaaccataggctaaggtgtagataaaatccgggtgatcaaccaattgacagttgaactgtagtctggtgaggatcgcatgaaggaaagg

SEQ ID NO: 76931 - DNA, 178 bp, Homo sapiens
  misc_feature 1..178: note = chr14:62279298-62279476
  misc_feature 1..178: note = hyper
  source 1..178: mol_type = genomic DNA
gctgggctctcaggacgccggcggcggccgcagggctggcggctgctgggcgcggggcggcgcggggcggcgcggcgcggcgggggcgcgcggcaggaggggctgtgcgcggcgcggcccccgagcgcaccgggcctgccgaggagcgcgcgcccggccgggctcggcgccggtttcc

SEQ ID NO: 76932 - DNA, 104 bp, Homo sapiens; identical to SEQ ID NO: 4152
  misc_feature 1..104: note = chr14:62279519-62279623
  misc_feature 1..104: note = hyper
  source 1..104: mol_type = genomic DNA

SEQ ID NO: 76933 - DNA, 229 bp, Homo sapiens; identical to SEQ ID NO: 4153
  misc_feature 1..229: note = chr14:62279624-62279853
  misc_feature 1..229: note = hyper
  source 1..229: mol_type = genomic DNA

SEQ ID NO: 76934 - DNA, 108 bp, Homo sapiens
  misc_feature 1..108: note = chr14:62279898-62280006
  misc_feature 1..108: note = hyper
  source 1..108: mol_type = genomic DNA
cgagttctgggtcgggtttgtgcgtctgccttttggggatcagggtggcttgcatggctcggctgcccggtggcccacgggctgtattcgcagcgggcagcacaaggc

SEQ ID NO: 76935 - DNA, 23 bp, Homo sapiens
  misc_feature 1..23: note = chr14:62483117-62483140
  misc_feature 1..23: note = hypo
  source 1..23: mol_type = genomic DNA
agttatggcattggccgggtgtg

SEQ ID NO: 76936 - DNA, 30 bp, Homo sapiens
  misc_feature 1..30: note = chr14:62523769-62523799
  misc_feature 1..30: note = hypo
  source 1..30: mol_type = genomic DNA
gccgtgcaaaggccccgtggtcagccagga

SEQ ID NO: 76937 - DNA, 206 bp, Homo sapiens
  misc_feature 1..206: note = chr14:62583664-62583870
  misc_feature 1..206: note = hyper
  source 1..206: mol_type = genomic DNA
cactgagccaaaccccgctgcttcctcagccgctgaaagtgccgccccacccctctccccaaacccgacctccgtaggggacaccgagccaaggcctgcagcgagtgacctgcccggggaggcgcgggaccgaggctcacctacccgggcccgcgagtctcgcccagccccagcctcccaacccactctgccggccccaacttagg

SEQ ID NO: 76938 - DNA, 360 bp, Homo sapiens; identical to SEQ ID NO: 35376
  misc_feature 1..360: note = chr14:62583918-62584278
  misc_feature 1..360: note = hyper
  source 1..360: mol_type = genomic DNA

SEQ ID NO: 76939 - DNA, 120 bp, Homo sapiens
  misc_feature 1..120: note = chr14:62584279-62584399
  misc_feature 1..120: note = hyper
  source 1..120: mol_type = genomic DNA
atctggtgagtggacccagctcacaaggtatgtctggattcatccagccaggtgccttcctccgagctcagaagggactcctttccttgagggggaggatagggacgtgttccgggatcc

SEQ ID NO: 76940 - DNA, 151 bp, Homo sapiens; identical to SEQ ID NO: 35378
  misc_feature 1..151: note = chr14:63511856-63512007
  misc_feature 1..151: note = hyper
  source 1..151: mol_type = genomic DNA

SEQ ID NO: 76941 - DNA, 646 bp, Homo sapiens; identical to SEQ ID NO: 4156
  misc_feature 1..646: note = chr14:63512063-63512709
  misc_feature 1..646: note = hyper
  source 1..646: mol_type = genomic DNA

SEQ ID NO: 76942 - DNA, 473 bp, Homo sapiens
  misc_feature 1..473: note = chr14:63512740-63513213
  misc_feature 1..473: note = hyper
  source 1..473: mol_type = genomic DNA
cgctgctaccgcccccctccgggctccggcgcctgaaaccttcctgaacactggcgctttccgcaccgcccttaccccaccccggagcgggagcgcgagccctgaagtccgagcgcacagccggcgcccggaatggcccctgcgacccgggccgggcttggcgtctgggggagcgtgcggccgcccaggggagtttcccccaggaccgctgagcgcaggaggcgatccgcgagcccgccaccgctgcaaagttgcgggaaaggttgcacttgatgtgaagagtaggggaagagggtgaataattcacacccgagagagggggagtgaggagggcagtgttagcgatggaaaaacggtaaaggctgtgggggcgaagatgcgccagggtggagcagggcacgaatcacctctaacaaaccccccaatttccaggcgttgagaacggacagcagcggcaccgttacaaacagtcc

SEQ ID NO: 76943 - DNA, 30 bp, Homo sapiens; identical to SEQ ID NO: 35381
  misc_feature 1..30: note = chr14:63670862-63670892
  misc_feature 1..30: note = hyper
  source 1..30: mol_type = genomic DNA

SEQ ID NO: 76944 - DNA, 88 bp, Homo sapiens; identical to SEQ ID NO: 43993
  misc_feature 1..88: note = chr14:64022981-64023069
  misc_feature 1..88: note = hypo
  source 1..88: mol_type = genomic DNA

SEQ ID NO: 76945 - DNA, 37 bp, Homo sapiens
  misc_feature 1..37: note = chr14:64222413-64222450
  misc_feature 1..37: note = hypo
  source 1..37: mol_type = genomic DNA
cctatggactaggcacggtgactcacgcctgtaatcc

SEQ ID NO: 76946 - DNA, 78 bp, Homo sapiens
  misc_feature 1..78: note = chr14:64760774-64760852
  misc_feature 1..78: note = hyper
  source 1..78: mol_type = genomic DNA
gccttctctaaaatgcggacacgtgcttttcccgcattagggggggtctcccggcgcgcgccccgccgccacctgttg

SEQ ID NO: 76947 - DNA, 181 bp, Homo sapiens
  misc_feature 1..181: note = chr14:64761073-64761254
  misc_feature 1..181: note = hyper
  source 1..181: mol_type = genomic DNA
tgaaaagatcacaagcgacttaacgataagccccttcttccttttaaagaccgagaggagggtagaggggagtagtgcctgagcccacgtgaccgagccagggagcccgacggtctcaggaacgcccgacgccgcgcgtgacctctaagtgggagcaccctcgaaccgactcctggtccac

SEQ ID NO: 76948 - DNA, 59 bp, Homo sapiens
  misc_feature 1..59: note = chr14:64932461-64932520
  misc_feature 1..59: note = hyper
  source 1..59: mol_type = genomic DNA
aagaacgcgggaggtcgcttgtccgctggaatccgcggccagggcgaccctcatcaggt

SEQ ID NO: 76949 - DNA, 141 bp, Homo sapiens
  misc_feature 1..141: note = chr14:65005802-65005943
  misc_feature 1..141: note = hypo
  source 1..141: mol_type = genomic DNA
catgagcctccacacccgtccaggagcccatttatatgggagcctgcttctaaagattattacctggtgccagggtattttccagacctgtcctcacattcctgttaaacaggaggaagtgaatcgcgctccttttcatct

SEQ ID NO: 76950 - DNA, 226 bp, Homo sapiens; identical to SEQ ID NO: 35384
  misc_feature 1..226: note = chr14:65007311-65007537
  misc_feature 1..226: note = hyper
  source 1..226: mol_type = genomic DNA

SEQ ID NO: 76951 - DNA, 59 bp, Homo sapiens
  misc_feature 1..59: note = chr14:65007552-65007611
  misc_feature 1..59: note = hyper
  source 1..59: mol_type = genomic DNA
cgcctttcagtcaggatgtctgcccgtggcccggctatcggcatcgacctgggcaccac

SEQ ID NO: 76952 - DNA, 44 bp, Homo sapiens
  misc_feature 1..44: note = chr14:65008676-65008720
  misc_feature 1..44: note = hyper
  source 1..44: mol_type = genomic DNA
ggcggtggcctatggcgccgcggtgcaggcggccatcctcatcg

SEQ ID NO: 76953 - DNA, 38 bp, Homo sapiens
  misc_feature 1..38: note = chr14:65008937-65008975
  misc_feature 1..38: note = hyper
  source 1..38: mol_type = genomic DNA
cctgctgggcaagttcgacctgaccgggattccccctg

SEQ ID NO: 76954 - DNA, 282 bp, Homo sapiens
  misc_feature 1..282: note = chr14:65008997-65009279
  misc_feature 1..282: note = hyper
  source 1..282: mol_type = genomic DNA
cgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgaggggcaagattagcgagcaggacaaaaa

SEQ ID NO: 76955 - DNA, 340 bp, Homo sapiens
  misc_feature 1..340: note = chr14:65016476-65016816
  misc_feature 1..340: note = hyper
  source 1..340: mol_type = genomic DNA
gaattatgccctgggcggctttacaatggataggccaatacgtcgccacggcttttaagactgggaaacggggcaccaggctgggctttagaaatcgctggagaagcctgggtgcggccgcagcccgcgcggcctaggacggaagcgacgccccgccccgctccgcgccccgggcagccgtgtgcaggcgcctgcgggcggtatcctcggcgacgccgtatggcttccagggcgaggccatgtaccgggtgcccgagttttatgcgaggaggaagcggttaggtgggcagaccccttacttgatggatgtaagtgcagccttggtcgcccccatacccgg

SEQ ID NO: 76956 - DNA, 149 bp, Homo sapiens
  misc_feature 1..149: note = chr14:65086478-65086627
  misc_feature 1..149: note = hypo
  source 1..149: mol_type = genomic DNA
cagcttcttctagagcgaggtgggacttcatttgaagtttttagagagagtgtctctagagtcttccttgagatctgcaggggatttcccttaatattctggcccctcccattggaagcatccaaagctgcctactggaccgactgaaa

SEQ ID NO: 76957 - DNA, 395 bp, Homo sapiens
  misc_feature 1..395: note = chr14:65170679-65171074
  misc_feature 1..395: note = hyper
  source 1..395: mol_type = genomic DNA
ttggaaaagcggacacggccggctctggtaggattaggatccccagatcgatcccggctggtcactcacttgggaaagccctcagcccccttcgcagggcccggtgttccctgtccatacaaggggtacgttctggcagtccatgctgtctcgggaggcggtgatagcaggtctgtgacaccagggtgaccccaccacgtgcgtcttggtatcctagagcatctaggctgcccgggggtgcgcgctcatcaccctgcgggcgttaatcgttaaccgcgcccaggcctcgccgccgccgcagccttaccccggctctggctcgccgcgccgcgaaggttgccccggcccccgcagagccgccaattgctggactgcagccgcgagctggagtctcc

SEQ ID NO: 76958 - DNA, 98 bp, Homo sapiens
  misc_feature 1..98: note = chr14:65171275-65171373
  misc_feature 1..98: note = hyper
  source 1..98: mol_type = genomic DNA
cagctgaggggctggcggtgggcgggagcggtcggcggcctcagccccttcagagagcgactttcaaactcgcgcccgcgtcgcggcagcacctgggc

SEQ ID NO: 76959 - DNA, 92 bp, Homo sapiens
  misc_feature 1..92: note = chr14:65171678-65171770
  misc_feature 1..92: note = hyper
  source 1..92: mol_type = genomic DNA
caaaaggggcaaatgcgccgggcggctccagagaggctcagtttgaaatccaggaagcccgcgaggccgcgcgcgcccgagggctggtgttt

SEQ ID NO: 76960 - DNA, 161 bp, Homo sapiens; identical to SEQ ID NO: 43995
  misc_feature 1..161: note = chr14:65233318-65233479
  misc_feature 1..161: note = hypo
  source 1..161: mol_type = genomic DNA

SEQ ID NO: 76961 - DNA, 30 bp, Homo sapiens
  misc_feature 1..30: note = chr14:65236314-65236344
  misc_feature 1..30: note = hypo
  source 1..30: mol_type = genomic DNA
gaggcctggtgctgccgctgcagcagggac

SEQ ID NO: 76962 - DNA, 532 bp, Homo sapiens
  misc_feature 1..532: note = chr14:65239262-65239794
  misc_feature 1..532: note = hypo
  source 1..532: mol_type = genomic DNA
ttggtagcaggtgggcggcagggggctgaaggtacctggacacccagcaggtggagctcccgctcgaaggctgtgtgcacccggtggaaggactcggccgtgctggcgtccagccccacgtcctcgggcagctcgcggtgcttctcgtcgatgaggcccaggatctcggcacccgtgtagaagtagcggtgcaggtcataggaggcggccagcagctgcatgcgcgtgtcaatgagctccaggaggtctgcccacatctcgttcagcccgtccttccactcggcgatggtggccgcctcgctgtggcccgcgtcgatgagtcgctcgatgaaggcattcacattgtccacccgctcctgcccaatcgccccggtctcccgggcaaagtcccggaacttgtcccgcagaagctaggcatggggcagacagaaatgtggttatggggggcacaggggttacaggtgtcaccagcttagccaaagactttcccaggcagcaactgcagctccgggagctgcgctgtcacaccttc

SEQ ID NO: 76963 - DNA, 63 bp, Homo sapiens; identical to SEQ ID NO: 43997
  misc_feature 1..63: note = chr14:65273132-65273195
  misc_feature 1..63: note = hypo
  source 1..63: mol_type = genomic DNA

SEQ ID NO: 76964 - DNA, 30 bp, Homo sapiens
  misc_feature 1..30: note = chr14:65282538-65282568
  misc_feature 1..30: note = hypo
  source 1..30: mol_type = genomic DNA
tagaagggctttgggcgtcatctagttcaa

SEQ ID NO: 76965 - DNA, 30 bp, Homo sapiens
  misc_feature 1..30: note = chr14:65310281-65310311
  misc_feature 1..30: note = hypo
  source 1..30: mol_type = genomic DNA
acaacccttagtctccggtagtaggaaaaa

SEQ ID NO: 76966 - DNA, 78 bp, Homo sapiens
  misc_feature 1..78: note = chr14:65345911-65345989
  misc_feature 1..78: note = hyper
  source 1..78: mol_type = genomic DNA
ggatctttcctccctcggtctacacggggtcactctctgggtggctcccagcacccggaggcccggccccctctgctg

SEQ ID NO: 76967 - DNA, 57 bp, Homo sapiens
  misc_feature 1..57: note = chr14:65346254-65346311
  misc_feature 1..57: note = hyper
  source 1..57: mol_type = genomic DNA
tagcaccaagtgcctcggacgcccgcgcgcgttcccgcgtcccgggatgatctttgc

SEQ ID NO: 76968 - DNA, 179 bp, Homo sapiens
  misc_feature 1..179: note = chr14:65406280-65406459
  misc_feature 1..179: note = hypo
  source 1..179: mol_type = genomic DNA
gaagggctctccctccggccctatgaggaacttctcaaagttccaggccacatctgagcggcgcacagggctccaaatgatgagcttgggatcggtcatgagggaaaatgggtcatcataagggtaggggagcttgtccttcaggtaggcgaagacaggatgctcgttctgcccattca

SEQ ID NO: 76969 - DNA, 30 bp, Homo sapiens
  misc_feature 1..30: note = chr14:65493283-65493313
  misc_feature 1..30: note = hypo
  source 1..30: mol_type = genomic DNA
aatgtgtttttcagccggatgcagtggctc

SEQ ID NO: 76970 - DNA, 155 bp, Homo sapiens
  misc_feature 1..155: note = chr14:65604586-65604741
  misc_feature 1..155: note = hypo
  source 1..155: mol_type = genomic DNA
catctgcgataccaccgcccttccccgtggcccatccccactcactgagctgtttaagattctcctgctgttctgtgaagaaaacaagaagctcaggtgctgttccaccaggcaatccccatccgccctgcacggagtttcggacttttcctaga

SEQ ID NO: 76971 - DNA, 29 bp, Homo sapiens
  misc_feature 1..29: note = chr14:65619090-65619119
  misc_feature 1..29: note = hypo
  source 1..29: mol_type = genomic DNA
ttcaagggccgggcgcggtggctcacgcc

SEQ ID NO: 76972 - DNA, 89 bp, Homo sapiens
  misc_feature 1..89: note = chr14:65694375-65694464
  misc_feature 1..89: note = hypo
  source 1..89: mol_type = genomic DNA
tgccccagcttccttcgcaccaagcgtgatcttaatcatttttcccaatacttcattcatagtaatttttttttatttttatttttttg

SEQ ID NO: 76973 - DNA, 33 bp, Homo sapiens
  misc_feature 1..33: note = chr14:66499270-66499303
  misc_feature 1..33: note = hypo
  source 1..33: mol_type = genomic DNA
atgctgggagctgtagaccggagctgttcctgt

SEQ ID NO: 76974 - DNA, 93 bp, Homo sapiens
  misc_feature 1..93: note = chr14:66560626-66560719
  misc_feature 1..93: note = hypo
  source 1..93: mol_type = genomic DNA
gtgtccacactgcctcgagcgtgcacacacctgcccaggctgcgacagcgtccaggcttgactacaactttgctccaagatcagagcaagtgc

SEQ ID NO: 76975 - DNA, 201 bp, Homo sapiens
  misc_feature 1..201: note = chr14:66792112-66792313
  misc_feature 1..201: note = hypo
  source 1..201: mol_type = genomic DNA
atggcactccattcccgaatacagatccagcatctgacagcaatgccagcagcgggaacttccagtgtgggaatgtagatgggagtggtgcaacaggccacctgggcattccagacaatccagatacagtggtactgcccggcagcctcagcacccaccctgaatccacctggccgtgaggcatcacgtggcattgcctcc

SEQ ID NO: 76976 - DNA, 181 bp, Homo sapiens; identical to SEQ ID NO: 44002
  misc_feature 1..181: note = chr14:67688245-67688426
  misc_feature 1..181: note = hypo
  source 1..181: mol_type = genomic DNA

SEQ ID NO: 76977 - DNA, 40 bp, Homo sapiens
  misc_feature 1..40: note = chr14:67876449-67876489
  misc_feature 1..40: note = hypo
  source 1..40: mol_type = genomic DNA
gactgctctgcactccggcttccaacgcaggccctgcccc

SEQ ID NO: 76978 - DNA, 216 bp, Homo sapiens
  misc_feature 1..216: note = chr14:67878803-67879019
  misc_feature 1..216: note = hyper
  source 1..216: mol_type = genomic DNA
caggtgcgccttccccgcgcctcgcgctcctcggcacccgcgcagcccgcgcagtccgcgcccacggcgcccaggaagcagctccgacgcggcagggcgacgcctccctggcgcgtgtccagagcctgaggccccggggcaggaagtcagaccaagtcgggatttctgacgtgacgtttccacccaaaggtgctccagggtcggtggttggtcctc

SEQ ID NO: 76979 - DNA, 30 bp, Homo sapiens; identical to SEQ ID NO: 44003
  misc_feature 1..30: note = chr14:67879219-67879249
  misc_feature 1..30: note = hypo
  source 1..30: mol_type = genomic DNA

SEQ ID NO: 76980 - DNA, 143 bp, Homo sapiens
  misc_feature 1..143: note = chr14:67886180-67886323
  misc_feature 1..143: note = hypo
  source 1..143: mol_type = genomic DNA
aaggcaaatgggggccggaggtgcagtctgcgttcaactaccaaaggcatgcctccacgcagggctgccttccccaaagaaagcaggggggttctcatctcataaaggctgcatccaggcggggggcggtggctcacgcctat

SEQ ID NO: 76981 - DNA, 82 bp, Homo sapiens
  misc_feature 1..82: note = chr14:67886563-67886645
  misc_feature 1..82: note = hypo
  source 1..82: mol_type = genomic DNA
tcaaaaaaaaaaaaaggctgcatccattcgctaagccacatggcagtgggtctgcatctccccagagcgggtgcttttttct

SEQ ID NO: 76982 - DNA, 206 bp, Homo sapiens
  misc_feature 1..206: note = chr14:67893599-67893805
  misc_feature 1..206: note = hypo
  source 1..206: mol_type = genomic DNA
agttttaagagacaacgtctgcagattcctagggcttatagctcaggggcagaggagtcagaagtcacctagtcctccccaggcctccgcaggctccaggactcttccctctgcccactgggaaaaactagatgagccaaagcaatgggaaagctggagtgttggaggtagctagagtgtattgtgtcgcgcgggggagggaggga

SEQ ID NO: 76983 - DNA, 30 bp, Homo sapiens
  misc_feature 1..30: note = chr14:67906990-67907020
  misc_feature 1..30: note = hypo
  source 1..30: mol_type = genomic DNA
cgaacctccttgatacggatgtaaagttac

SEQ ID NO: 76984 - DNA, 256 bp, Homo sapiens
  misc_feature 1..256: note = chr14:68067573-68067829
  misc_feature 1..256: note = hypo
  source 1..256: mol_type = genomic DNA
gcgtgagccaccgcacccagcccaaacccacagttttaatcatgcttttgcttggcaagccgatttctctaagccagagtgagccgcaaggagagcccacgggtattcatttcacttactcttttcctgtgccgggtagtttgaggtgcttgaggatgcagcagtgaacgatgttgatgacagtctctgccctcgggcagcttcctttctagtaggagacaatatggaaataagagagtatcgttggcaatactat

SEQ ID NO: 76985 - DNA, 30 bp, Homo sapiens
  misc_feature 1..30: note = chr14:68142255-68142285
  misc_feature 1..30: note = hypo
  source 1..30: mol_type = genomic DNA
tctagctgctaggcccgagtaattctcctc

SEQ ID NO: 76986 - DNA, 86 bp, Homo sapiens
  misc_feature 1..86: note = chr14:68187960-68188046
  misc_feature 1..86: note = hypo
  source 1..86: mol_type = genomic DNA
gagaggaacacagagcgaggaagggcaatgaatcccacttacccttctcccatctcacacacatccagaggcacgatcctagctca

SEQ ID NO: 76987 - DNA, 30 bp, Homo sapiens; identical to SEQ ID NO: 44006
  misc_feature 1..30: note = chr14:68231335-68231365
  misc_feature 1..30: note = hypo
  source 1..30: mol_type = genomic DNA

SEQ ID NO: 76988 - DNA, 36 bp, Homo sapiens; identical to SEQ ID NO: 44007
  misc_feature 1..36: note = chr14:68284131-68284167
  misc_feature 1..36: note = hypo
  source 1..36: mol_type = genomic DNA

SEQ ID NO: 76989 - DNA, 200 bp, Homo sapiens
  misc_feature 1..200: note = chr14:68841379-68841579
  misc_feature 1..200: note = hypo
  source 1..200: mol_type = genomic DNA
tttatcttaaatacacgcctcattatagatgtgtcacacttagcacagatggtctcagaagtttttcctggcttcccataccctaacagtatctagtatgttaatgtcaatattagctttactgttttaggtaactttggtatgcttctcattagctgaaaccgtaaagagctcagttttacctgcgctgagggatcact

SEQ ID NO: 76990 - DNA, 61 bp, Homo sapiens
  misc_feature 1..61: note = chr14:69014044-69014105
  misc_feature 1..61: note = hypo
  source 1..61: mol_type = genomic DNA
attctgccttccttccggccatccactgttacctttcacttcctgtcggcacgtacaggcc

SEQ ID NO: 76991 - DNA, 198 bp, Homo sapiens
  misc_feature 1..198: note = chr14:69143363-69143561
  misc_feature 1..198: note = hypo
  source 1..198: mol_type = genomic DNA
ctacacctgcacaggcgcttctggaggaggcaggtgtggcaagccccctgctgaggaatccagccagggaaggcatcctttgtcttgctctggtggctttcaagcaaagagcccagtgtgttttgcaggcgtccattcatgagcttagctcctgagctgcactgactggatgacgggcgtccccgcccaggagccaga

SEQ ID NO: 76992 - DNA, 40 bp, Homo sapiens
  misc_feature 1..40: note = chr14:69245934-69245974
  misc_feature 1..40: note = hypo
  source 1..40: mol_type = genomic DNA
agtgccaggcatcagcgttgacatgaaatagaacggtgaa

SEQ ID NO: 76993 - DNA, 30 bp, Homo sapiens
  misc_feature 1..30: note = chr14:69657584-69657614
  misc_feature 1..30: note = hypo
  source 1..30: mol_type = genomic DNA
gactgattggatgaacgatttaatatataa

SEQ ID NO: 76994 - DNA, 1557 bp, Homo sapiens
  misc_feature 1..1557: note = chr14:69726355-69727912
  misc_feature 1..1557: note = hyper
  source 1..1557: mol_type = genomic DNA
ctcaggactctcccccgcccagccgcccctacacaaggactcgccgaacacaccttgaatcccgcgccagagcgcagcccggaactgcagctcgcggcgcgggcccaggtcgggggtcgcgcgtctccagtcggtgactcaaggccgctcggtccgggggtgggtgtgggtcggcaggaccgaccagggccgcgcgggggcagctgccgggcgttcggtcacctagcggtgggagccgaggctggctttggccagtcgccattccgccgcgggcgtctgtctcgccgggttcccgggcgcgggaggaaggcccgcgccgcttcccactcggcgcgcttctctcccagtgcgcagtggcctggtgggtcagccggcggcggctggagcgcggggccggccctgcgcacgaatgaatgggcgcccgggggacgcgcgcgctcggggctgaagggcattaggaccgtgaggatcgctccgcgatcctgtctctccctatcacccccccgcccccccacctctctcctttttctgctctgcaggactgagcagctaggcgcgagcgaaaacaaacagctggggctgcgagcgcccccgccccggccccgagagcacgccggcccagtcccccacctggggcgcccgtctgcccaccatgaggaagatccgcgccaatgccatcgccatcctgaccgtagcctggatcctgggcactttctactacttatggcaggacaaccgagcccacgcagcatcctccggcggccggggcgcgcagagggcaggcaggaggtcggagcagctccgcgaggaccgcaccatcccgctcattgtgagtacgccccgagcgtcggccggccggctagggagccgcggcgcgcgtccagaccctgcgcggcggccgagggcgcggggcccggccagggctgagtgcccgctgcgccgggccggctttgtatatgttggagcattcctgcccgttgttatggcaacctctgccgggcggcggggctggggcgcaccgactaagggagggtgacagagggtgggggctgggagaaagtgctgcaagtttggtgggcccggcgtgcgcgcgcggctgggaacgtggcggctctcccggctctgcgctgccggggccgggagtctgggggctgcgggagcctcgtgtgccccggaaggctgccgggcccagcgcgcggcgagcgggcggtgggaaccactcgcagccgagcgcgtaggtggcagtgcgcagcccctctccagccttctgggggcagaggacatcgggtgggggcgtgggtaggggaaggctctctaggcgctgcgcctggcttcgaacccccttctgagccgggtcaacttgaacccgcttcttcggcgcggacacccagcttccccggagttctctgggttgaggagaggtctcgcactgtacgcgtctctcactcccaaccttagggtccgccaccacgggtaggtgggcagtgtcagcgcccgaacttggcgatacccttgcatgaagtcagcctcgcgacatctaagcgggcagggaaacaa

SEQ ID NO: 76995 - DNA, 32 bp, Homo sapiens
  misc_feature 1..32: note = chr14:69728306-69728338
  misc_feature 1..32: note = hyper
  source 1..32: mol_type = genomic DNA
aggggtgaggagatccgcgggggaggtgcaag

SEQ ID NO: 76996 - DNA, 174 bp, Homo sapiens
  misc_feature 1..174: note = chr14:69867022-69867196
  misc_feature 1..174: note = hypo
  source 1..174: mol_type = genomic DNA
aatttttggttaatacgttttgacattttcgttaatttgattggcaccttgaacagatgttaagcgagggtcccgggaagagggatagatgaaagcactgttcagtgaacatgctgataggtcctttaggtaggcaaaaggaattcacgaagtgcacagcgttcaaagatttag

SEQ ID NO: 76997 - DNA, 30 bp, Homo sapiens
  misc_feature 1..30: note = chr14:69867731-69867761
  misc_feature 1..30: note = hypo
  source 1..30: mol_type = genomic DNA
atatagatgaggaaacggagactggatagg

SEQ ID NO: 76998 - DNA, 58 bp, Homo sapiens; identical to SEQ ID NO: 35395
  misc_feature 1..58: note = chr14:69950779-69950837
  misc_feature 1..58: note = hyper
  source 1..58: mol_type = genomic DNA

SEQ ID NO: 76999 - DNA, 228 bp, Homo sapiens
  misc_feature 1..228: note = chr14:69951108-69951336
  misc_feature 1..228: note = hyper
  source 1..228: mol_type = genomic DNA
aaccccattgcaaagcggacgtggccctcgtctcgatgtcggcgctgctcgccgagagggaccccggggtggtgttgggcgcgcggggcggggacggggacgcgctgcggccaagtccccgggccctgcgacccgcagggaccttctggacgcacggagcccggccctccagccggcgcccgccctgattggcgcccgaggccggcctcccgccggctcacctgccac

SEQ ID NO: 77000 - DNA, 372 bp, Homo sapiens
  misc_feature 1..372: note = chr14:70014616-70014988
  misc_feature 1..372: note = hyper
  source 1..372: mol_type = genomic DNA
ccttgccagggtgggcgagacacggccgccttccttcacatccaacgccggtgaggctcagcactcattgtctcactggcagcacagacaaagccttgcgggctccacgggataatcaacagcgagaacgcccccagggacctccggaaagagacaccattggttgcaggcctccaggttctcgtctgcctggtgagtgaggtggcacgcagcgtcagtcgtctgcaggaatttgtgctggggtaaatgcgcgcttcgtgcagaccgcagagctggaggcggagggctggggtccctgggccgcgggcgggttccgcgtgcccctccctcgccgcaccgcgcagtcccgccagggggcgccaggcaccggcc

SEQ ID NO: 77001 - DNA, 30 bp, Homo sapiens
  misc_feature 1..30: note = chr14:70236264-70236294
  misc_feature 1..30: note = hypo
  source 1..30: mol_type = genomic DNA
gtgggttatcctaatcgttgtcttggtcac

SEQ ID NO: 77002 - DNA, 602 bp, Homo sapiens
  misc_feature 1..602: note = chr14:70345928-70346530
  misc_feature 1..602: note = hyper
  source 1..602: mol_type = genomic DNA
tatcccactctctcccggggcctactcccgcggagctcctcggcggggggttgaccacgagtggctcctcttgcccctctcccattggctttcacctgccagagggtcggcttcaacaggcctcttggcccgtcaatcaggcccgccgtgctccgccccgcccctcccgggggtttataacgggaattcccatggcccgggctcaggcgtccaacctgctgccgcctgggccccgccgagcggagctagcgccgcgcgcagagcacacgctcgcgctccagctcccctcctgcgcggttcatgactgtgtcccctgaccgcagcctctgcgagcccccgccgcaggaccacggcccgctccccgccgccgcgagggccccgagcgaaggaaggaagggaggcgcgctgtgcgccccgcggagcccgcgaaccccgctcgctgccggctgcccagcctggctggcaccatgctgcccgcgcgctgcgcccgcctgctcacgccccacttgctgctggtgttggtgcagctgtcccctgctcgcggccaccgcaccacaggccccagggtaagtgcgcccccagctttgcgcccacctgcggag

SEQ ID NO: 77003 - DNA, 86 bp, Homo sapiens
  misc_feature 1..86: note = chr14:70346797-70346883
  misc_feature 1..86: note = hyper
  source 1..86: mol_type = genomic DNA
cgtcggagagaagctcgctctccgctcatgcagggcttccctgtggtctcacgctggcgcccggtccagcgcgctggagttgttgg

SEQ ID NO: 77004 - DNA, 608 bp, Homo sapiens
  misc_feature 1..608: note = chr14:70653682-70654290
  misc_feature 1..608: note = hyper
  source 1..608: mol_type = genomic DNA
ggaagattaatcacacgccgctgcaagtcaccgggtcgccaggggccgaggaggcttcccttttggtgccccaccggaaggccggatgtgttcctatcacgtacccacattccacccccgctcaactccctcctccccccacccccttcgggtgtttcttgaccacccaggagcttggctgcgcctgctgcagtctgcgtttctgataaattgaaaccagttttaattcttctgcccgggagacctaaccgccgaatgcgttcggaggtatgttttttaatcgccaggaaagggggagagagagagaaagagagagagagagagagaggaaaggaggagagaagagaagagaagcggggggcggggggagagagagagagagagagaaggaagctgcgatgagcgggtaaatttatggtactgcattaaaggcatttcttctatttaaccccaccccgccaccaccaccactaccacaccgttaaaaataaaatacaatgaattaagacgaagaactgcttttttccccggagcaaattgctttcatcatctttcccagtggctcgggtcctctgggcaggtcagccagggcctgtaggagcagcagc

SEQ ID NO: 77005 - DNA, 15 bp, Homo sapiens
  misc_feature 1..15: note = chr14:70654291-70654306
  misc_feature 1..15: note = hyper
  source 1..15: mol_type = genomic DNA
ctagcctctgaatca

SEQ ID NO: 77006 - DNA, 231 bp, Homo sapiens
  misc_feature 1..231: note = chr14:70654366-70654597
  misc_feature 1..231: note = hyper
  source 1..231: mol_type = genomic DNA
cgtgtgtgttgggggatcgggggagggttagttatatatttcgattctctccaccgagtcccggatcacgcagaccaccaggggctggagagtgcagcactggagaaaccctccttctccctcgcccccttggccccagcggtgggtgctctggggctgcagctcccgacccgcggcggtggagtcccgagattggggtgagcgcgtgcgtgcgtatgtgcacgcgggcgc

SEQ ID NO: 77007 - DNA, 41 bp, Homo sapiens; identical to SEQ ID NO: 1186
  misc_feature 1..41: note = chr14:70654598-70654639
  misc_feature 1..41: note = hyper
  source 1..41: mol_type = genomic DNA

SEQ ID NO: 77008 - DNA, 1250 bp, Homo sapiens
  misc_feature 1..1250: note = chr14:70654640-70655890
  misc_feature 1..1250: note = hyper
  source 1..1250: mol_type = genomic DNA
gcggacactcacagcaccagaagcacaacacgccctggcccaggtggcacacatatgccgacatgcatccagcacacacaacacagcagtcagtctccccaaacagcacccgctaccaacccagcatgctcacgatccaactgtacccacctgcccaggcatctctctctgcccctccccacccggcggcaccctcctgtagacacccactctgccagatctgcccccccaacactgcatacacaatgtacactttccggggcaccctcaccccacttctcctggcactaaatccacaggaaggcggttcatatgaatgatcttgagaaataacttaaccccgttactcacaatcagggatcctcttaggggcatcccaagccccccaacctctacctcccatgtctcggctgcccgctaagggggaagggcaggaggctcaccccattactcaccgtttcctctcggcctcccgagcggagtgggcaagggaggggggtgaggaaggtacgcgatgcccccgccgcccggcgcctcaccggtcgcagcggctcatcgcccccgcgggctgcccgccggccgcagccgcgtccggggcatgtcagtccgccgccgccgccctcccgccggggttcgtgggctcgcagctgtcagggagctgcggggcagcgcatctggagcgcggggtctgggagggagggtgtctggggccagggcgaggggccccgggaggggtccttccgcacggatttcagaaagagggaaaccccgacccagagcggtgactggaatctacgcccgggagaggcccggagtcccggccgcgggcggcgggggattcctgcaggaaggggcaggaaggcaagcagcccggcgcgccctggcggctccgagggacctgggctcgggcttgcggtcgcgtcgcctgggctttccctgggctgggagcgcgccgggtctccgccttgcacgctgtcaccgcgggagacgtctcggcctcgccgcgcgcagaggggacgcgcggagaggctggtttctgggcgagcggagagctttgcccattaagctgccggaagaagccaaatcaaaaagccaatctccaagcctccaaacggaacgtcaccctatcagctgggagacagcgccgcactgactgacaagccgcgcatatttatcctcgcgcgcggaggggagactctcagaacgctcctcgaccagcagcgaggaagtcgagcccgcatcccgcatcc

SEQ ID NO: 77009 - DNA, 211 bp, Homo sapiens; identical to SEQ ID NO: 35407
  misc_feature 1..211: note = chr14:70655919-70656130
  misc_feature 1..211: note = hyper
  source 1..211: mol_type = genomic DNA

SEQ ID NO: 77010 - DNA, 349 bp, Homo sapiens
  misc_feature 1..349: note = chr14:70701157-70701506
  misc_feature 1..349: note = hypo
  source 1..349: mol_type = genomic DNA
ggaaccccagatcctcgttccccccaggtggcctgggaggtggccccctcgaggatgactccactagctccctgggaccccaactacgaagccaaagcaggacctcggctggtttggggggccaactgtagctcaggagcctcgttctcaggccagacggtgtgtcacccctcgttctggccgctgtacgaggcagcctcgggcaggggtctcaggcccgtggcccctgccacagggcattggaatggacagcaggcggccccggatgcagggttcccggtgatgtgctgtgaagacgtcttcctctcggaccctctgctgccccggggggcagcgtgtccccctgtac

SEQ ID NO: 77011 - DNA, 18 bp, Homo sapiens
  misc_feature 1..18: note = chr14:70725489-70725507
  misc_feature 1..18: note = hypo
  source 1..18: mol_type = genomic DNA
agcactttgggaggccga

SEQ ID NO: 77012 - DNA, 17 bp, Homo sapiens
  misc_feature 1..17: note = chr14:70725747-70725764
  misc_feature 1..17: note = hypo
  source 1..17: mol_type = genomic DNA
aacgaaaaagaagccac

SEQ ID NO: 77013 - DNA, 30 bp, Homo sapiens
  misc_feature 1..30: note = chr14:70904873-70904903
  misc_feature 1..30: note = hypo
  source 1..30: mol_type = genomic DNA
gctcgggcttgtgagcgttggtttggggga

SEQ ID NO: 77014 - DNA, 138 bp, Homo sapiens
  misc_feature 1..138: note = chr14:71659705-71659843
  misc_feature 1..138: note = hypo
  source 1..138: mol_type = genomic DNA
ggcaagttgaggggtcgcaccacctgaagcccatgaggctcggcatggcgagtgctgggaggagcagaaggcaagactgggcaggtgcgagtgggacaggcttccatgcacctgtcctcctcccgcaaacactggcat

SEQ ID NO: 77015 - DNA, 30 bp, Homo sapiens
  misc_feature 1..30: note = chr14:72286297-72286327
  misc_feature 1..30: note = hypo
  source 1..30: mol_type = genomic DNA
tctcatcctaactctcgtttcttcttccaa

SEQ ID NO: 77016 - DNA, 635 bp, Homo sapiens
  misc_feature 1..635: note = chr14:72398598-72399233
  misc_feature 1..635: note = hyper
  source 1..635: mol_type = genomic DNA
atattccaaatgcagcgtgtggtgtgcatgttgaatacataaaaatgacgaggttaggaacaatatcgctgacggtcgcggtgtcccgttttaatttagagggcgccagcaacacgtcagtgagggagattcagaagccgccgggcacctcaccccgggccgggaatccctaagagaaccttgacgccgctgaagtttccggaccgggccagtttggaattgacgaaagcagcctccgcccggtcgagccagtctctcggttttctcggcggcttcttgaggatgaggcatttctaggttttctcctcctcgagcaaatcacggtctgcgccttccgcggctctgggaacaggtgagccgtgcggcggcgcccgcgggacgcgctcaggtgccggtccccgcccgccggcccctccctgcagcacgcggtccgggcccaggtgccggggcccaggtgccggcgcccaggtgcgcggggcacggggctgcagctccgctcggcatccgacagcgggcgccgctgcagcagctcgcgggccgcggagctgaacggcttcgcgagttggggcagctcctcgcgctcggccctgctcggcggcgagagctccgcctgggcgccgcgttcctacagccgc

SEQ ID NO: 77017 - DNA, 35 bp, Homo sapiens
  misc_feature 1..35: note = chr14:72399451-72399486
  misc_feature 1..35: note = hyper
  source 1..35: mol_type = genomic DNA
cgctcgccaccacggaaactcggaaagaggaggcg

SEQ ID NO: 77018 - DNA, 459 bp, Homo sapiens; identical to SEQ ID NO: 35410
  misc_feature 1..459: note = chr14:72399780-72400239
  misc_feature 1..459: note = hyper
  source 1..459: mol_type = genomic DNA

SEQ ID NO: 77019 - DNA, 195 bp, Homo sapiens
  misc_feature 1..195: note = chr14:72720654-72720849
  misc_feature 1..195: note = hypo
  source 1..195: mol_type = genomic DNA
tcccagggcacctcacgtggcattctttgttactgacttctttataatgtttgcgttgtagaccacgatgacagaatttacttaacgatgatgttttgattatcatgcaagtgtgggggaggattgttctgttgaaacagcgtgactgcaaatattttaccaatagatcagtgaaattcacgtgcccttgaacat

SEQ ID NO: 77020 - DNA, 30 bp, Homo sapiens; identical to SEQ ID NO: 15833
  misc_feature 1..30: note = chr14:72892242-72892272
  misc_feature 1..30: note = hypo
  source 1..30: mol_type = genomic DNA

SEQ ID NO: 77021 - DNA, 30 bp, Homo sapiens; identical to SEQ ID NO: 44013
  misc_feature 1..30: note = chr14:72976891-72976921
  misc_feature 1..30: note = hypo
  source 1..30: mol_type = genomic DNA

SEQ ID NO: 77022 - DNA, 202 bp, Homo sapiens
  misc_feature 1..202: note = chr14:73029646-73029848
  misc_feature 1..202: note = hypo
  source 1..202: mol_type = genomic DNA
ccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggc

SEQ ID NO: 77023 - DNA, 30 bp, Homo sapiens
  misc_feature 1..30: note = chr14:73138163-73138193
  misc_feature 1..30: note = hypo
  source 1..30: mol_type = genomic DNA
ccaaagggattaacccggtgcatcacctgg

SEQ ID NO: 77024 - DNA, 30 bp, Homo sapiens
  misc_feature 1..30: note = chr14:73140382-73140412
  misc_feature 1..30: note = hypo
  source 1..30: mol_type = genomic DNA
gcctcattgatctatcggggtctcttctgt

SEQ ID NO: 77025 - DNA, 250 bp, Homo sapiens; identical to SEQ ID NO: 44015
  misc_feature 1..250: note = chr14:73140612-73140862
  misc_feature 1..250: note = hypo
  source 1..250: mol_type = genomic DNA

SEQ ID NO: 77026 - DNA, 151 bp, Homo sapiens
  misc_feature 1..151: note = chr14:73146774-73146925
  misc_feature 1..151: note = hypo
  source 1..151: mol_type = genomic DNA
ctccggcaggcccagcgtgaagcagagccaggagagggttaaaagtggcgtgatagagactgtggggaaggctggaccagagggcaaagggagcatcaaagccgggataaatggccttaattctcatgctcccactcgctggtcgtgttta

SEQ ID NO: 77027 - DNA, 319 bp, Homo sapiens
  misc_feature 1..319: note = chr14:73147249-73147568
  misc_feature 1..319: note = hypo
  source 1..319: mol_type = genomic DNA
cagctctgaggacaccgtgaatatatgggaaagtaaaggggactacgctggagcggatgcggaaggcgctgaggccagggctgctgtcatgagtcctcacatttatggatggggctgataaactgtcacactccgcaccgtcaaggacaaggtgagaagatgagctggaatggcagcacatgccacaggagagctggaaaggcaggtggctaacaacgaaagccatggccagagggcgggcttctctggagaggcctctgcacacagggaagggcccctaggcccggggttttgactgcgttgccgatctagaggcaag

SEQ ID NO: 77028 - DNA, 175 bp, Homo sapiens
  misc_feature 1..175: note = chr14:73149208-73149383
  misc_feature 1..175: note = hypo
  source 1..175: mol_type = genomic DNA
gtctgtttaagttgtcgggatattattatcgacataattaggattcaacaagccccttgttttgctttgcccagccgtgccctctcaaccctcttcactagcaccactgaactctgtctgcaaggggaccagcattttctttgttcttcagacagaaagccgtatttaagaaaag

SEQ ID NO: 77029 - DNA, 30 bp, Homo sapiens; identical to SEQ ID NO: 44018
  misc_feature 1..30: note = chr14:73150302-73150332
  misc_feature 1..30: note = hypo
  source 1..30: mol_type = genomic DNA

SEQ ID NO: 77030 - DNA, 37 bp, Homo sapiens; identical to SEQ ID NO: 44019
  misc_feature 1..37: note = chr14:73157349-73157386
  misc_feature 1..37: note = hypo
  source 1..37: mol_type = genomic DNA

SEQ ID NO: 77031 - DNA, 149 bp, Homo sapiens; identical to SEQ ID NO: 5153
  misc_feature 1..149: note = chr14:73167750-73167899
  misc_feature 1..149: note = hypo
  source 1..149: mol_type = genomic DNA

SEQ ID NO: 77032 - DNA, 143 bp, Homo sapiens
  misc_feature 1..143: note = chr14:73168818-73168961
  misc_feature 1..143: note = hypo
  source 1..143: mol_type = genomic DNA
tctgcccttgaagcacgtgactgaaaggtgcgctggtgagtctctgcttggcactgcctccctccccacccaccccaacggcctggggctgactggcgtggcctgcttcacccatgctcccttgctctcggcaagaaggaggc

SEQ ID NO: 77033 - DNA, 151 bp, Homo sapiens; identical to SEQ ID NO: 44021
  misc_feature 1..151: note = chr14:73172944-73173095
  misc_feature 1..151: note = hypo
  source 1..151: mol_type = genomic DNA

SEQ ID NO: 77034 - DNA, 255 bp, Homo sapiens
  misc_feature 1..255: note = chr14:73174955-73175210
  misc_feature 1..255: note = hypo
  source 1..255: mol_type = genomic DNA
tctggccagtcctgccggaacacctgcaacctgtgtccatgacacaatggcatttaaatatttaaacagacccagctttgctggaacggcgcactcagtctccagggatcaatcccatgccacaagccccgctccacaaatcaagtttctgggggcaccgagcctttcctcccctccccgatcctacccccatccaaggacctgcaagacaactgagtgatgagcccagcttcccttccgcgacaaaggcagtga

SEQ ID NO: 77035 - DNA, 30 bp, Homo sapiens; identical to SEQ ID NO: 44023
  misc_feature 1..30: note = chr14:73176464-73176494
  misc_feature 1..30: note = hypo
  source 1..30: mol_type = genomic DNA

SEQ ID NO: 77036 - DNA, 67 bp, Homo sapiens
  misc_feature 1..67: note = chr14:73178102-73178169
  misc_feature 1..67: note = hypo
  source 1..67: mol_type = genomic DNA
gaaggaataatcaaacgcataagtagaaaagagcatgcacctggagaggcatcgacaccgaggctgg

SEQ ID NO: 77037 - DNA, 202 bp, Homo sapiens
  misc_feature 1..202: note = chr14:73178763-73178965
  misc_feature 1..202: note = hypo
  source 1..202: mol_type = genomic DNA
acagagaagggcaatcgacggtggcccctgctccaccgagagagggagaggaggcagcacgcatgcggacagagccaagaaagcagccgctgagacttccagaaagcctgccgtcaggcctcccaggcactacagggcacacagaaggtgggagagagcctgcggggagggcatcgagagaagcaaacgtcactgagagtcc

SEQ ID NO: 77038 - DNA, 146 bp, Homo sapiens; identical to SEQ ID NO: 44026
  misc_feature 1..146: note = chr14:73180113-73180259
  misc_feature 1..146: note = hypo
  source 1..146: mol_type = genomic DNA

SEQ ID NO: 77039 - DNA, 80 bp, Homo sapiens
  misc_feature 1..80: note = chr14:73185163-73185243
  misc_feature 1..80: note = hypo
  source 1..80: mol_type = genomic DNA
ccttgttcactctcacgctctcacaggcatccagtggagtcttccagaggcgacatgacacgtgacgatgctgtcactgt

SEQ ID NO: 77040 - DNA, 38 bp, Homo sapiens
  misc_feature 1..38: note = chr14:73185482-73185520
  misc_feature 1..38: note = hypo
  source 1..38: mol_type = genomic DNA
tttttttttttgagacggagtcactctgtcatgcaggc

SEQ ID NO: 77041 - DNA, 30 bp, Homo sapiens
  misc_feature 1..30: note = chr14:73189045-73189075
  misc_feature 1..30: note = hypo
  source 1..30: mol_type = genomic DNA
gcacagccccacatgcgacaggctggagca

SEQ ID NO: 77042 - DNA, 146 bp, Homo sapiens; identical to SEQ ID NO: 44028
  misc_feature 1..146: note = chr14:73194579-73194725
  misc_feature 1..146: note = hypo
  source 1..146: mol_type = genomic DNA

SEQ ID NO: 77043 - DNA, 513 bp, Homo sapiens
  misc_feature 1..513: note = chr14:73195193-73195706
  misc_feature 1..513: note = hypo
  source 1..513: mol_type = genomic DNA
ggaatggagaggacacgcccaggaaggtcacgctcatccttttcgatttatttagtgggaaacaacagttttttagcagagttttgctctagaacaaaaggacagctagcaaagtaggacatgtcagagacgggaagaactggggacagggcgattcctggaatctgttccctcatgtgtccattcaacaaatatttatgttgcacctggtaagcaccaagcactgtttgggtgcttatgagatataagcaagcaaaactggcaacggatcctgccctcgaggagtttacattctactggaagaaaacagacaataaacaataacataataagtaagtaaattagaaagtacattagatgatgataagagtgatggaaaagaacaagaaaagcagagtggaatcgggaggcaggggcagtcagggcaagggtgtgagatgaagtacggcacggtcagggacatctttgagagaagaggaaggccaggcaccgtggctcatgcctgtaatccca

SEQ ID NO: 77044 - DNA, 30 bp, Homo sapiens; identical to SEQ ID NO: 44031
  misc_feature 1..30: note = chr14:73196936-73196966
  misc_feature 1..30: note = hypo
  source 1..30: mol_type = genomic DNA

SEQ ID NO: 77045 - DNA, 30 bp, Homo sapiens; identical to SEQ ID NO: 44032
  misc_feature 1..30: note = chr14:73197190-73197220
  misc_feature 1..30: note = hypo
  source 1..30: mol_type = genomic DNA

SEQ ID NO: 77046 - DNA, 103 bp, Homo sapiens
  misc_feature 1..103: note = chr14:73197913-73198016
  misc_feature 1..103: note = hypo
  source 1..103: mol_type = genomic DNA
ggtgtgcacccttataatcctattcagtgagagttttagaagtggcatggatagagggtagtggacccatggggacagagcagccatccgcctgaagggtgag

SEQ ID NO: 77047 - DNA, 52 bp, Homo sapiens
  misc_feature 1..52: note = chr14:73198555-73198607
  misc_feature 1..52: note = hypo
  source 1..52: mol_type = genomic DNA
tcttctcaaccccctcgccacggagcaaggcttccagcgtggtgctctctga

SEQ ID NO: 77048 - DNA, 30 bp, Homo sapiens
  misc_feature 1..30: note = chr14:73199030-73199060
  misc_feature 1..30: note = hypo
  source 1..30: mol_type = genomic DNA
acatgtgttcatttgcgggaaagtgtttca

SEQ ID NO: 77049 - DNA, 243 bp, Homo sapiens
  misc_feature 1..243: note = chr14:73202777-73203020
  misc_feature 1..243: note = hypo
  source 1..243: mol_type = genomic DNA
acagaaatgtaataccggccacttatgtaatttttaacttactagtagtcacatgtagaaaaaggaagaaagtcaggtgtcattaattttaataagatattgtatccgatctggtatttctaaaacattaccattcaacatgaaatcaacataaaaatatggacgcaaaattttacattcttttatctgcattgtcttcaaagtctggtgggtattttccatttagagcgtatctcaattcag

SEQ ID NO: 77050 - DNA, 30 bp, Homo sapiens
  misc_feature 1..30: note = chr14:73207724-73207754
  misc_feature 1..30: note = hypo
  source 1..30: mol_type = genomic DNA
gaacacagcaaggcccgtctctaaaaataa

SEQ ID NO: 77051 - DNA, 30 bp, Homo sapiens
  misc_feature 1..30: note = chr14:73207963-73207993
  misc_feature 1..30: note = hypo
  source 1..30: mol_type = genomic DNA
accctccatcccacacgcctctcagaataa

SEQ ID NO: 77052 - DNA, 470 bp, Homo sapiens
  misc_feature 1..470: note = chr14:73209578-73210048
  misc_feature 1..470: note = hypo
  source 1..470: mol_type = genomic DNA
ctcaccacccctgctcgagctggccagactcaagtccctccgcctggaccacccctttgggagatacccctctgcaggtccctacgacttgcttgttggccagcctgtggccctctctgctttgggacaccttaagccactgtcgtcttcggggtgcatgccctcttgtctgagtttcccccaacgacatgggatgggggcgatcatcctggtcgttcatccccagtcattgaaggactgccaaaaacagaaaaaatacaagagaaagaacactatccctggctgccctccctcccatcaccctcggaattcggcaagggtggcaaagagccaccctgctccccaagagtcctggagcagaagggatcgacaaggcctcaggtgcattccaggtacaggaggagcgtcaactgtaaagcccttttcatctgcgggtccaggataagtgagtgtgtcgggccttcaagcaa

SEQ ID NO: 77053 - DNA, 76 bp, Homo sapiens
  misc_feature 1..76: note = chr14:73226814-73226890
  misc_feature 1..76: note = hypo
  source 1..76: mol_type = genomic DNA
acatgaataattatacgagatgtttttcttattattttaaactcattaaaagatgatcaactatttttaaaaatac

SEQ ID NO: 77054 - DNA, 28 bp, Homo sapiens
  misc_feature 1..28: note = chr14:73231480-73231508
  misc_feature 1..28: note = hypo
  source 1..28: mol_type = genomic DNA
gagccaccgcgcccggcctgttttcctg

SEQ ID NO: 77055 - DNA, 32 bp, Homo sapiens
  misc_feature 1..32: note = chr14:73232361-73232393
  misc_feature 1..32: note = hypo
  source 1..32: mol_type = genomic DNA
agggagtacacaggccgggtgcggtggctcac

SEQ ID NO: 77056 - DNA, 182 bp, Homo sapiens
  misc_feature 1..182: note = chr14:73263871-73264053
  misc_feature 1..182: note = hypo
  source 1..182: mol_type = genomic DNA
cttagcatatgaatacgcttgggctagcctgctggagaatgagcagacacagaacacaaacaagctatcctagatgaagctattcatctaggacaagctgactgcagacacataggttaaccagcccaaatcagaagaaccagctagctgagcccaaatcgaattgccgacccacggaatag

SEQ ID NO: 77057 - DNA, 144 bp, Homo sapiens
  misc_feature 1..144: note = chr14:73273275-73273419
  misc_feature 1..144: note = hypo
  source 1..144: mol_type = genomic DNA
caaaacactttatatcgtaatccttttttccccacccgcactgggcgaaagaacctattcttgcaaccaacactatcctgaaaatgtggaaaacctctaatggaagtgcaaccaagtgctcctggaattcgacatgctttttta

SEQ ID NO: 77058 - DNA, 30 bp, Homo sapiens; identical to SEQ ID NO: 15844
  misc_feature 1..30: note = chr14:73275087-73275117
  misc_feature 1..30: note = hypo
  source 1..30: mol_type = genomic DNA

SEQ ID NO: 77059 - DNA, 30 bp, Homo sapiens
  misc_feature 1..30: note = chr14:73280813-73280843
  misc_feature 1..30: note = hypo
  source 1..30: mol_type = genomic DNA
cctccatgttgcaggcgacgtggccctgga

SEQ ID NO: 77060 - DNA, 260 bp, Homo sapiens
  misc_feature 1..260: note = chr14:73299836-73300096
  misc_feature 1..260: note = hypo
  source 1..260: mol_type = genomic DNA
agctaggaagactatcggaatgacaaagacctgaactaaggcagtctgagcgggagtgaactgataacacattaggaagagctattgaccacagcaaatggacaaaactgggtgggaagagggcagatgtgtctgagagagacagaaaggatcccagatgacgtctagcttggccaactaggtagacgatgacaacactcaccctgacggggaatccgggaggaggcgaaggcttggcagaggaacgtggtgagttttga

SEQ ID NO: 77061 - DNA, 412 bp, Homo sapiens
  misc_feature 1..412: note = chr14:73302316-73302728
  misc_feature 1..412: note = hypo
  source 1..412: mol_type = genomic DNA
aaacagcctgcttcccgggagacccttaaatgtcttcacacatccacagctgggggaggagacgctgatgaacaggagaagatggagcatcggcctcccctggctactcactctgtgctcgggccgcctcgcccacttgtaaaaccccaaatgccagggtggcagcaaggcatacatgcaactatgacttgacccgcagcgaggcagcaaccaggtctcacctgggcatagttaccccacaaggacaggaaaggagaaatggtttccaggcccaggacacccagaagccaccaaaaaccaacctcatggttcatcccccttatttgactcttcgacacctaaaacctgtgcgttgtgttcaagatacacccgccggagaccacattcccagacatcccgagggccagccgtc

SEQ ID NO: 77062 - DNA, 19 bp, Homo sapiens
  misc_feature 1..19: note = chr14:73305454-73305473
  misc_feature 1..19: note = hypo
  source 1..19: mol_type = genomic DNA
actccgtctcaaaaaaaaa

SEQ ID NO: 77063 - DNA, 30 bp, Homo sapiens
  misc_feature 1..30: note = chr14:73306326-73306356
  misc_feature 1..30: note = hypo
  source 1..30: mol_type = genomic DNA
ctgaggtaggacaaccggatgccctacttt

SEQ ID NO: 77064 - DNA, 50 bp, Homo sapiens
  misc_feature 1..50: note = chr14:73309119-73309169
  misc_feature 1..50: note = hypo
  source 1..50: mol_type = genomic DNA
tacaaccacagccaacgctgggtgaatctcacaaacgcaatgttaaaggg

SEQ ID NO: 77065 - DNA, 48 bp, Homo sapiens
  misc_feature 1..48: note = chr14:73313912-73313960
  misc_feature 1..48: note = hypo
  source 1..48: mol_type = genomic DNA
cactctggaccagaccgcgtcctaagagcttcacgtgtgtggtcattc

SEQ ID NO: 77066 - DNA, 590 bp, Homo sapiens
  misc_feature 1..590: note = chr14:73318385-73318975
  misc_feature 1..590: note = hypo
  source 1..590: mol_type = genomic DNA
cacaaactaacttcccgagggatgagtattttgatgcagatacttcttcaagtgaaaaatgtacaatgtacaaaatgtccactcgaggatctgttcctccccgtgtgggtaatcgccctcctaccacgggcaacgggtaggcaaccgatatgcccagaaaggcggccaatgggaggacagctcgcccagcctcccgattggccaggcccgccaccagctggaaccatggcgagctttgaggacagcagagccacttgatgggattctctctctcttcaaagcatagagcaaacatcaattaatcctcaaaagacgctttcaagaagaacattatcccttttggagacgcagaagctaagaggtgccgcaggtaggtgaagggaaggcaggaagttgaagaggagaggagaaagtggagcaccgggctttcagccccagttctggttctcctgagagagtcaagttgcaggagaagaatgaacctgcagaagccgggcagggagaggtggtggagaagccgctgctcttgggtgcgcccctcaaggcttcccactgccccatcccctaggagaccacggagtgaaaaaagt

SEQ ID NO: 77067 - DNA, 30 bp, Homo sapiens; identical to SEQ ID NO: 44043
  misc_feature 1..30: note = chr14:73331141-73331171
  misc_feature 1..30: note = hypo
  source 1..30: mol_type = genomic DNA

SEQ ID NO: 77068 - DNA, 30 bp, Homo sapiens
  misc_feature 1..30: note = chr14:73332342-73332372
  misc_feature 1..30: note = hypo
  source 1..30: mol_type = genomic DNA
cgaggacctcactgacggctgaaaccacag

SEQ ID NO: 77069 - DNA, 256 bp, Homo sapiens
  misc_feature 1..256: note = chr14:73333000-73333256
  misc_feature 1..256: note = hypo
  source 1..256: mol_type = genomic DNA
accctcaacattcatcgtgccaaaccttaagtaactccccagcacctgcaggatcagtgccaaacttttcgcccaagtatttataatcaggtccttcgtgacctgtccagcttctctctcccagtgacctggctggtgttctcactgctcctttctgaacccaagcttattcgaatgcacaggctcaggtacccgcctctgctccatcgataccagccatggagtcttgggcaaatcttgggcaactccttggagt

SEQ ID NO: 77070 - DNA, 75 bp, Homo sapiens
  misc_feature 1..75: note = chr14:73333616-73333691
  misc_feature 1..75: note = hypo
  source 1..75: mol_type = genomic DNA
gccatcatgcctagcccactggtactcattttctaagggtattcttttctaaccagaccacgaaatctccaggct

SEQ ID NO: 77071 - DNA, 36 bp, Homo sapiens
  misc_feature 1..36: note = chr14:73349481-73349517
  misc_feature 1..36: note = hypo
  source 1..36: mol_type = genomic DNA
ctatcaccagcaccgcgttgccgcccctctccccac

SEQ ID NO: 77072 - DNA, 42 bp, Homo sapiens
  misc_feature 1..42: note = chr14:73352048-73352090
  misc_feature 1..42: note = hypo
  source 1..42: mol_type = genomic DNA
atctagaaatgtagccgctaattttttgggtttgtttgtttg

SEQ ID NO: 77073 - DNA, 38 bp, Homo sapiens
  misc_feature 1..38: note = chr14:73352791-73352829
  misc_feature 1..38: note = hypo
  source 1..38: mol_type = genomic DNA
ctgggcagctgggcacggtggctcatgcctataatccc

SEQ ID NO: 77074 - DNA, 76 bp, Homo sapiens; identical to SEQ ID NO: 35411
  misc_feature 1..76: note = chr14:73358964-73359040
  misc_feature 1..76: note = hyper
  source 1..76: mol_type = genomic DNA

SEQ ID NO: 77075 - DNA, 196 bp, Homo sapiens
  misc_feature 1..196: note = chr14:73359294-73359490
  misc_feature 1..196: note = hyper
  source 1..196: mol_type = genomic DNA
taccgtccccgggagcgaacctggttttcaactccaggagtggccaggggtgaagacgagaatgcgctgaattaaaagaaccagggtcgacagcggccacgcaccagggagaattcggcatgaaccgccccccacccgacctgcacctccctctgccacttcgcctgcggcttcgtccgggcggggaagtcccggt

SEQ ID NO: 77076 - DNA, 30 bp, Homo sapiens
  misc_feature 1..30: note = chr14:73392384-73392414
  misc_feature 1..30: note = hypo
  source 1..30: mol_type = genomic DNA
cacaaactgtctcttcgggacacaagccca

SEQ ID NO: 77077 - DNA, 23 bp, Homo sapiens
  misc_feature 1..23: note = chr14:73472913-73472936
  misc_feature 1..23: note = hypo
  source 1..23: mol_type = genomic DNA
accgcgcccggccaaaacacatt

SEQ ID NO: 77078 - DNA, 30 bp, Homo sapiens
  misc_feature 1..30: note = chr14:73591774-73591804
  misc_feature 1..30: note = hypo
  source 1..30: mol_type = genomic DNA
tgttcagtatactgtcgaggcaactttcta

SEQ ID NO: 77079 - DNA, 157 bp, Homo sapiens
  misc_feature 1..157: note = chr14:73602342-73602499
  misc_feature 1..157: note = hypo
  source 1..157: mol_type = genomic DNA
cggaattacaggcgtgagcgactgcacccggccgcttgggggtggatttttaaagaaactttagaagaatgtaacttgcccagataccatgtaccgttaatttcattttcggttttttgaatacccatgtttgacatttctccgttcaccttgatta

SEQ ID NO: 77080 - DNA, 30 bp, Homo sapiens; identical to SEQ ID NO: 44046
  misc_feature 1..30: note = chr14:73691528-73691558
  misc_feature 1..30: note = hypo
  source 1..30: mol_type = genomic DNA

SEQ ID NO: 77081 - DNA, 30 bp, Homo sapiens
  misc_feature 1..30: note = chr14:73704186-73704216
  misc_feature 1..30: note = hyper
  source 1..30: mol_type = genomic DNA
aaagtcccacccctgcgggcgttccttgcg

SEQ ID NO: 77082 - DNA, 49 bp, Homo sapiens
  misc_feature 1..49: note = chr14:73704924-73704973
  misc_feature 1..49: note = hyper
  source 1..49: mol_type = genomic DNA
cttcccgccctctggcgcctagggtcgccgccttcggccctagctcaag

SEQ ID NO: 77083 - DNA, 30 bp, Homo sapiens; identical to SEQ ID NO: 15848
  misc_feature 1..30: note = chr14:73958845-73958875
  misc_feature 1..30: note = hypo
  source 1..30: mol_type = genomic DNA

SEQ ID NO: 77084 - DNA, 109 bp, Homo sapiens; identical to SEQ ID NO: 44048
  misc_feature 1..109: note = chr14:73959120-73959229
  misc_feature 1..109: note = hypo
  source 1..109: mol_type = genomic DNA

SEQ ID NO: 77085 - DNA, 46 bp, Homo sapiens
  misc_feature 1..46: note = chr14:74058905-74058951
  misc_feature 1..46: note = hyper
  source 1..46: mol_type = genomic DNA
ctgggccctggaacccgagaagcctttttggcgcttcctgaagcgg

SEQ ID NO: 77086 - DNA, 196 bp, Homo sapiens
  misc_feature 1..196: note = chr14:74079595-74079791
  misc_feature 1..196: note = hyper
  source 1..196: mol_type = genomic DNA
agtgctggacggccacgacaccgagcccgggcggctgctgtgcctggcgcagaacaagcgcgactttctccggccgggggtgcggcgcgagccggtgcgcgcgggcccggtgcgcgccgcgctcttcctgccgccggatgagtagtctgcccagaatttggtcgagctctgcgacccccaccggcccctttcctgt

SEQ ID NO: 77087 - DNA, 110 bp, Homo sapiens
  misc_feature 1..110: note = chr14:74208209-74208319
  misc_feature 1..110: note = hyper
  source 1..110: mol_type = genomic DNA
gttagcaaccccagccgctcccaggaaaccagccagcagcagcggagggcagggctgggcgggcacagggtcccgactatacccagtttgcagttcggcccacccccagc

SEQ ID NO: 77088 - DNA, 66 bp, Homo sapiens
  misc_feature 1..66: note = chr14:74252666-74252732
  misc_feature 1..66: note = hyper
  source 1..66: mol_type = genomic DNA
tttcttcgccactaccgaggtcttgcacaatagcctgtgtataaacatccacgccaacaatgcctg

SEQ ID NO: 77089 - DNA, 241 bp, Homo sapiens
  misc_feature 1..241: note = chr14:74254402-74254643
  misc_feature 1..241: note = hyper
  source 1..241: mol_type = genomic DNA
gggtccctgtccccacgttctctctaaaagtctgcatgatgtccctcgtcatttctacgggttataagtgagcaagacgtttaccacgtatcacacttctgggggctatttcaacgcccaagctggggctgcagaatggtttctgttctaatcctcccccgcgatttccacctctttacactcaactcacagaaaatagagtctgatgcattctgtgtttcatcaccggtcaaaagtgact

SEQ ID NO: 77090 - DNA, 30 bp, Homo sapiens
  misc_feature 1..30: note = chr14:74273409-74273439
  misc_feature 1..30: note = hypo
  source 1..30: mol_type = genomic DNA
ttgacacacccatctcggtgccagctgggc

SEQ ID NO: 77091 - DNA, 20 bp, Homo sapiens
  misc_feature 1..20: note = chr14:74529016-74529036
  misc_feature 1..20: note = hypo
  source 1..20: mol_type = genomic DNA
tgactaggccgggtgcggtg

SEQ ID NO: 77092 - DNA, 382 bp, Homo sapiens
  misc_feature 1..382: note = chr14:74706015-74706397
  misc_feature 1..382: note = hyper
  source 1..382: mol_type = genomic DNA
cgacattgcctgcggcgggagctgccagctttttggaattcctaatcgctcctggccccggtgattggctgctcagctctgaccccacttgggctgccgcctggttggataaaaggggaatctccttgggctccagagcattagacaccggagggggcacctgggaccaacttcgcgaagcgggaagcccggcgggggggtggggggagctaaagacctgcggcctcagcccctccaaagaacagggagatgacggggaaagcaggggaagcgctgagcaagcccaaatccgagacagtggccaagagtacctcggggggcgccccggccaggtgcactgggttcggcatccaggagatcctgggcttgaacaaggagcccc

SEQ ID NO: 77093 - DNA, 605 bp, Homo sapiens; identical to SEQ ID NO: 1189
  misc_feature 1..605: note = chr14:74706940-74707545
  misc_feature 1..605: note = hyper
  source 1..605: mol_type = genomic DNA

SEQ ID NO: 77094 - DNA, 176 bp, Homo sapiens; identical to SEQ ID NO: 1190
  misc_feature 1..176: note = chr14:74707572-74707748
  misc_feature 1..176: note = hyper
  source 1..176: mol_type = genomic DNA

SEQ ID NO: 77095 - DNA, 120 bp, Homo sapiens; identical to SEQ ID NO: 1191
  misc_feature 1..120: note = chr14:74707791-74707911
  misc_feature 1..120: note = hyper
  source 1..120: mol_type = genomic DNA

SEQ ID NO: 77096 - DNA, 621 bp, Homo sapiens
  misc_feature 1..621: note = chr14:74707912-74708533
  misc_feature 1..621: note = hyper
  source 1..621: mol_type = genomic DNA
aaaaatgtccaaatctgctttaaaccagaccaagaaacggaagaagcggcgacacaggtgaggcccccgctttctgttacctctcctgcccgcgcaccccgctgccgtcccccgttccgggatcgggtctctcggaccctattttcgccgacaacggatctgaggtccgaggccgtgccagggcgcagaccacgggttgtttggcggaatctgcccgggggccttggcgtcggcaccggttgagcaggatgagtggccgccgggaaagcggcccggttcgggctttctcctccttgttcaggagaaaggaaaggctccaacacaggccaaactgagccacagagtgggggcggtccccagatccccgcaccagtacattctgagagccacacagacccggcggcgggcagattagctcccacctcctgccagagccggttctttgccctcggcctcaaccgccgcccccatttctctcccggggtccctgtcctctctgccaactccctaagctttctgctcccaccgttctccaaagctggagcgatctctgcactgacagagcattttcttttggcttctgctcattcgtgattctgaccgagtcgcttcccttctgtg

SEQ ID NO: 77097 - DNA, 333 bp, Homo sapiens
  misc_feature 1..333: note = chr14:74708774-74709107
  misc_feature 1..333: note = hyper
  source 1..333: mol_type = genomic DNA
cccttccgcaccagccgcactgctaccagttccttgggtacatttgtaaggtggttttcaaggaaataaaggagaaagaaccaaaaatctgcctgcctttctgcgggtgctgctcgcaggtgctgccccggcgctcacctcggagctatttccccgcaccccactccgtccccatcaggtggggccgccacagactctgcgccctttcaagacatttctccactagggcgttctctggcacccccgccgccacatcgttttctcccaccctaatttgttttcagcctctttgcaccctctctgcgcttttctatgcttcgttcttccttggcc

SEQ ID NO: 77098 - DNA, 86 bp, Homo sapiens
  misc_feature 1..86: note = chr14:74717661-74717747
  misc_feature 1..86: note = hypo
  source 1..86: mol_type = genomic DNA
tttaaaatgcccatgcgctcccccggccaacacccagcaattccgatttaattggtttaaaatcaaacatcttcggcaggtcacag

SEQ ID NO: 77099 - DNA, 387 bp, Homo sapiens
  misc_feature 1..387: note = chr14:74724894-74725281
  misc_feature 1..387: note = hyper
  source 1..387: mol_type = genomic DNA
agtgcgggtcaatgccgcggctcccgggagagcagccgctttaatttcccgtggtatttcagtgcctgaggcccatcgattcaaactgaaattaacttatttttcaatcagcccagggctgcccctgggggtgactcttcttttgccgcctcctgaatagagctggagcaatttttcattaaaagctgatacctctgccgcgggggagggggcccggagggaagggcggcgccggcccagacccaggcaaggaaatcgggaggaaatgaacagatttcccaagcccgcctcggtcctcccctcccgactccctcgacttccctggggcgactcgctgcccccggggtctgagcctttaaggactgtgaggggcgagaagggaaccgc

SEQ ID NO: 77100 - DNA, 36 bp, Homo sapiens
  misc_feature 1..36: note = chr14:74824362-74824398
  misc_feature 1..36: note = hypo
  source 1..36: mol_type = genomic DNA
aaaagcaccttctaccgctggcggcggcagtcccag

SEQ ID NO: 77101 - DNA, 30 bp, Homo sapiens
  misc_feature 1..30: note = chr14:74824734-74824764
  misc_feature 1..30: note = hypo
  source 1..30: mol_type = genomic DNA
acactggtaccctatcgctgcttcaaacgc

SEQ ID NO: 77102 - DNA, 223 bp, Homo sapiens
  misc_feature 1..223: note = chr14:74892548-74892771
  misc_feature 1..223: note = hyper
  source 1..223: mol_type = genomic DNA
ccccagctcactccccgctccgtgcctagctctgcgctcccgcggcgcccccagaccgccccttacctgtcccgccgcggacggtcccgcctcctccgcggggctcgggggctcggcatgggccggtgagcgacggcgcccccgcctcgcggtcgcggtggaactcccaggagggctcccctgctctcgtccccgcgtccctgagcagccgccgcttcagcac

SEQ ID NO: 77103 - DNA, 315 bp, Homo sapiens
  misc_feature 1..315: note = chr14:74892798-74893113
  misc_feature 1..315: note = hyper
  source 1..315: mol_type = genomic DNA
cgccgccgcccgccccgccccgcgcggtcccgggagccccgcatcctggccgggccccgccgccgccgccgccgcgcagccctcggcccggcccgaggcggctccgcgccgacttgggagagcagcgaggagggtccccctccttcccgcctcccgccgccgccgcctccctctcgcttccgtgctccgtgctcccttccacgctccggaatcagcccaccaggcactccggacccggctccggggcggggcggggcgggaagtcgggggagcccggaggaggcggcgaagcgaggggcgcgcagctggaacccg

SEQ ID NO: 77104 - DNA, 348 bp, Homo sapiens; identical to SEQ ID NO: 35424
  misc_feature 1..348: note = chr14:75077895-75078243
  misc_feature 1..348: note = hyper
  source 1..348: mol_type = genomic DNA

SEQ ID NO: 77105 - DNA, 574 bp, Homo sapiens
  misc_feature 1..574: note = chr14:75078651-75079225
  misc_feature 1..574: note = hyper
  source 1..574: mol_type = genomic DNA
cggggcggctggagagtggtgcgcgcgggcaccgcgaagagctttgtggtcggcacgctggacgcccgcgggctgttctcccggccccgcccggcggccagcttctctgagtctagggggccctgaagcggccgactgggggcccggctctcggcggaacgagggctgcgcgccccgagcctcgagtccgcgctcctactccagctgggctcgcacggctgctgcaccttcgcgcctcctccctgtgcctgcagccgtctgaaggggacccggacggttttatttttggaaacctcccccggctttttcgtctcttttatccacaccaggccccctcctcggagggacagctcagccccctcattaccggagagggagcgaggaattccagcaacacccactttggcaccgggaagccagcgggcggcgagcgggcggcgagggggattaacccgtgcggagcagggggcggcgcggggctgacccaggcgctggtcgggcagatggcgcctgccacgaccgggacactgggccgcctttctcctgctctgggcaagttcgaactgcagacctg

SEQ ID NO: 77106 - DNA, 30 bp, Homo sapiens
  misc_feature 1..30: note = chr14:75326230-75326260
  misc_feature 1..30: note = hypo
  source 1..30: mol_type = genomic DNA
ccctttaacaagagtcggagaattgtgatg

SEQ ID NO: 77107 - DNA, 30 bp, Homo sapiens
  misc_feature 1..30: note = chr14:75332119-75332149
  misc_feature 1..30: note = hypo
  source 1..30: mol_type = genomic DNA
ggaaactggagagagcggttggggagaagg

SEQ ID NO: 77108 - DNA, 80 bp, Homo sapiens
  misc_feature 1..80: note = chr14:75389373-75389453
  misc_feature 1..80: note = hypo
  source 1..80: mol_type = genomic DNA
caaagggatgacagccgtggctgcgggaagggaaggggctcagagagaggcccacaaagctaccccgcctttgctctccc

SEQ ID NO: 77109 - DNA, 30 bp, Homo sapiens
  misc_feature 1..30: note = chr14:75411978-75412008
  misc_feature 1..30: note = hypo
  source 1..30: mol_type = genomic DNA
tgggaacaggagccacgggacactttctgc

SEQ ID NO: 77110 - DNA, 30 bp, Homo sapiens
  misc_feature 1..30: note = chr14:75422033-75422063
  misc_feature 1..30: note = hyper
  source 1..30: mol_type = genomic DNA
gagtggggggctggacgcctccctcactgc

SEQ ID NO: 77111 - DNA, 43 bp, Homo sapiens
  misc_feature 1..43: note = chr14:75422408-75422451
  misc_feature 1..43: note = hyper
  source 1..43: mol_type = genomic DNA
ccggtcagcccgcagcgcccggccagcccgcagcgccggagcc

SEQ ID NO: 77112 - DNA, 51 bp, Homo sapiens
  misc_feature 1..51: note = chr14:75446328-75446379
  misc_feature 1..51: note = hypo
  source 1..51: mol_type = genomic DNA
ggcaagaaggcaagacggattgcatttcagcctgaacgtgcctgggatatg

SEQ ID NO: 77113 - DNA, 18 bp, Homo sapiens
  misc_feature 1..18: note = chr14:75517394-75517412
  misc_feature 1..18: note = hypo
  source 1..18: mol_type = genomic DNA
gcccggccagaaggtcat

SEQ ID NO: 77114 - DNA, 19 bp, Homo sapiens
  misc_feature 1..19: note = chr14:75749479-75749498
  misc_feature 1..19: note = hypo
  source 1..19: mol_type = genomic DNA
aaaaaattttcaggccggg

SEQ ID NO: 77115 - DNA, 209 bp, Homo sapiens
  misc_feature 1..209: note = chr14:75760140-75760349
  misc_feature 1..209: note = hypo
  source 1..209: mol_type = genomic DNA
taatatagtctggggcgcagaggtctgctcaagatcatccaactggagtggcagcgctggaattagagtccaggcagtgtggcttcaatgcctgaactcttagccattagaaaggaaaaacaaagcaaaatcagtatccgcaacaaccttgcaggcacggaggccctcagaagggacaggagaggccgggcgcggtaatcccagcactt

SEQ ID NO: 77116 - DNA, 51 bp, Homo sapiens
  misc_feature 1..51: note = chr14:75791653-75791704
  misc_feature 1..51: note = hypo
  source 1..51: mol_type = genomic DNA
attcggctccctccccggtgtactgctattcctcttcgtcctcctttaccc

SEQ ID NO: 77117 - DNA, 30 bp, Homo sapiens
  misc_feature 1..30: note = chr14:75938324-75938354
  misc_feature 1..30: note = hypo
  source 1..30: mol_type = genomic DNA
ctgtgatccctccctcgctcactcctctca

SEQ ID NO: 77118 - DNA, 34 bp, Homo sapiens
  misc_feature 1..34: note = chr14:75996120-75996154
  misc_feature 1..34: note = hypo
  source 1..34: mol_type = genomic DNA
acaatgggccgggcgcggcggctcacgccttaat

SEQ ID NO: 77119 - DNA, 232 bp, Homo sapiens
  misc_feature 1..232: note = chr14:76001805-76002037
  misc_feature 1..232: note = hypo
  source 1..232: mol_type = genomic DNA
gactaggatcatgggcgtttttaacttttaaaaaatatctttaatgtagttatactgtatttttttatttttaaagaaacagaagaaaatggccaaatagagagctgaaggaactctggaggacatcaagtacaaagagacaatattactgagctcgaatttggggatcaggttttggtaggagaccttataatttataccccaaataggaatacttcgagagtggaagatg

SEQ ID NO: 77120 - DNA, 34 bp, Homo sapiens
  misc_feature 1..34: note = chr14:76101271-76101305
  misc_feature 1..34: note = hypo
  source 1..34: mol_type = genomic DNA
gaagaattggcctgacgatcgtcattgcaggaat

SEQ ID NO: 77121 - DNA, 69 bp, Homo sapiens
  misc_feature 1..69: note = chr14:76597656-76597725
  misc_feature 1..69: note = hyper
  source 1..69: mol_type = genomic DNA
cgtcggtgggctgggcgggagcgctgaccctggcgcctcggaggagggagggggcgggctggggagggg

SEQ ID NO: 77122 - DNA, 890 bp, Homo sapiens
  misc_feature 1..890: note = chr14:76604575-76605465
  misc_feature 1..890: note = hyper
  source 1..890: mol_type = genomic DNA
tagagagattcagcccggacaatcagggttggcttcacggaggagggggtatctgagctgagctttgatgaatacgtcagatttgggggaaaggttgctgctggatagcggggcaggaagaacgagcgtatctagttgtaatgccaacaggtcagggggggaaagttggggaatggggtgggaggaggaagaattagactggccccttccatcatcgccatccttctgtgttgacccaccccggctccgtcccaactctcccttcctctccacatccaggaaagattaacttctctccgtgcgagaaagttatcattagccaagaattaaaagagtgattaatgatgccccctcccctgccccctccccaaggccttatctggtggcggtcagctggacaatgcggcagggtgggagggggaagcgagggcgacggagaaaatggaaaacaataaatattaagcgcaagaaaaaagggagcgcagcgccgttcccacttgttagattgaaggcgcctctccagaggggggaaggctccaaattgctaattagcgcctgtgaaaaggcctagctctgatatgcgcgccgctgaaaggccgacgttaatgaagccgcggcgcgcccgcttccctttgactggccttcatccctcctccgcgccccgggccggcccgaacaatgcggcggggagcgcaggctcccccaggcctcgccgggacggcccgggcagcgcgcgcggggggcggcgcggcgccggcgaaatgtggagggggagataaggccgagcgcagggaagaggctcactcccaggggcccagggaaaatttgcagttattatgaaggagatgagacagattaaaagcccttgtgttcgccgctttgccccttta

SEQ ID NO: 77123 - DNA, 169 bp, Homo sapiens
  misc_feature 1..169: note = chr14:76744173-76744342
  misc_feature 1..169: note = hypo
  source 1..169: mol_type = genomic DNA
gggcagggggcactgcggtgaggtgtgtgctattctgatggggcctgggagtggaacagaccaggccattggtgcctcacgtgctacaagcctaggagcatgaacttgcctagcctcaggcagcgcctagtgctggaggagccaactcgaagtgcgtcctgggagagca

SEQ ID NO: 77124 - DNA, 109 bp, Homo sapiens; identical to SEQ ID NO: 35428
  misc_feature 1..109: note = chr14:76795936-76796045
  misc_feature 1..109: note = hyper
  source 1..109: mol_type = genomic DNA

SEQ ID NO: 77125 - DNA, 255 bp, Homo sapiens
  misc_feature 1..255: note = chr14:76819137-76819392
  misc_feature 1..255: note = hyper
  source 1..255: mol_type = genomic DNA
ctaaccctcgaactccgggctttctgggaacgcgggctctctcccctctttccctccgcccccacgcgcacacaggcgagcaccgtccgcccttcctagttcccaccgcgcgcccctcgctgagcgctccgcacactctgagatccagcgcgccctctggtggcacacggccccgaatcgccgcgctcctgcgggccgcgcgcagggtcgccgggtaggcacaggcacgtcccgtggccacggacctttgccctc

SEQ ID NO: 77126 - DNA, 443 bp, Homo sapiens
  misc_feature 1..443: note = chr14:76842512-76842955
  misc_feature 1..443: note = hyper
  source 1..443: mol_type = genomic DNA
cgcatcccctctgcccgctctctccggagcgtgcggatgagtggagagctgggctgtgcgcgcacggctctctgcctccctctcccccgccgcggccgcctcctcccactctgcgttctcgcgctcactgtgccctgcccgggctcgcaccttgcccgtgcccttcactcgctcttccgcgtgatttccccgccgtctttctctaccaactgggaatgctaaaacgggactgatggacgtgtccgaactctgcatcccggaccccctcggctaccacaaccagtaggtgccctgcttctcggtctgtctgtccttctgcccgtctggcagtctctgtcctggggatcgcagttccttttctgcacattcttgtgtaaaagtggaagggacttcgggggggcacttgggggacgaaggaggggaaaagccgcacacttctgggt

SEQ ID NO: 77127 - DNA, 202 bp, Homo sapiens; identical to SEQ ID NO: 35431
  misc_feature 1..202: note = chr14:76843184-76843386
  misc_feature 1..202: note = hyper
  source 1..202: mol_type = genomic DNA

SEQ ID NO: 77128 - DNA, 262 bp, Homo sapiens; identical to SEQ ID NO: 11972
  misc_feature 1..262: note = chr14:76843732-76843994
  misc_feature 1..262: note = hyper
  source 1..262: mol_type = genomic DNA

SEQ ID NO: 77129 - DNA, 180 bp, Homo sapiens
  misc_feature 1..180: note = chr14:76998049-76998229
  misc_feature 1..180: note = hypo
  source 1..180: mol_type = genomic DNA
gtcacaggcatctgccgtacagcacacactaatttctggcgataattatctcttgggtttcccaccctctcctccttgtgtcaccctggctaaatgacacacgcagatttcattgaccagccatgaacctcaccttcatggagaccgacgatgtgatcgggtttccgcttctgctgatct

SEQ ID NO: 77130 - DNA, 415 bp, Homo sapiens
  misc_feature 1..415: note = chr14:77227599-77228014
  misc_feature 1..415: note = hyper
  source 1..415: mol_type = genomic DNA
tctccatggagtttgcgctccctctggcacgttgaaaacgtcctccgcagcttcgcaccggcttcgcggcgccctgacagctgggtgaggagggagcgaatgcccaccggcgtccttggggtaacttgggacagaggcaccgccgcggggggcggaggactgggcgcgaaggcgctggccctttaagggggggacggagcgcatgcgcggcgcgggccgtagtcgagcctggtgggcggctggctggcaggggacgtggtcggcggcagcggggcccaggggcggcggggctgcagcagcggcggccccagcttcgccgagcagcgatcggctggtgggcttctcgttggcgggctccgcgttggcgggctgctccccaggcaccagcgcagcgcgcgctcgcccggcttcgtca

SEQ ID NO: 77131 - DNA, 247 bp, Homo sapiens
  misc_feature 1..247: note = chr14:77228556-77228803
  misc_feature 1..247: note = hyper
  source 1..247: mol_type = genomic DNA
ctcccggacttgtctcgtcgcgtcggagaaatcgccccccagcgccgctctcccgcccgggggtcttggttccgagctcgcgcggccgggagtcgcctcggtcttccttggggcgcgcgcagatgtgagcgtgcgagagttgtgtaggggattttgttccctccgaaactgagacccagggcgcccagtgggcacccgtgccttgactctgtcctttctgcagccgctggtccgagctgtctggcct

SEQ ID NO: 77132 - DNA, 258 bp, Homo sapiens
  misc_feature 1..258: note = chr14:77242433-77242691
  misc_feature 1..258: note = hypo
  source 1..258: mol_type = genomic DNA
gaggccgcctacggccgctgctggcacgtgctcaagaaggtgaagctgggccagagcgtgtcacacgacccgcacagcgtggagcagatcgagtggaagcactcggtgctggacgtggagcgcctgggccgcgatgacttccgcaaggagctggagcgccacgcccgcgacatgcggctcaaggtctgcccgccttccacgccctcgccccctccctcgccccctcccccgccccagcagaggcgatgtgaggattga

SEQ ID NO: 77133 - DNA, 222 bp, Homo sapiens
  misc_feature 1..222: note = chr14:77519615-77519837
  misc_feature 1..222: note = hyper
  source 1..222: mol_type = genomic DNA
cctgctggggaagaccgcataatttgaagcctcctgacataaaacaggctggttgagggagggccctttctgtctaatacaccactcgtcgggacaggattgcaaagggggcctggggaggtgagcccactggaaaacaatgtgtgcgcgccccctgctggctgcgagcagaggtcccgcctgtccgctgggggtcttcaggtggttcgtgttagcaccacc

SEQ ID NO: 77134 - DNA, 578 bp, Homo sapiens
  misc_feature 1..578: note = chr14:77591173-77591751
  misc_feature 1..578: note = hyper
  source 1..578: mol_type = genomic DNA
ggagacgcggtgatgcgcggggcccgggccgtggacaagactgcagtgtcctgcactacctgccgcccactcatcaggccgattctcctcaccttacgcttagatgagtttcgagtaagaccactgctggcatcaagagtctgggcccatgatctcgccctttcgggctaggcgaggcagacccaggttggctgcggcccgcggtccccgcgcagccaacactggcagccaagcgcggggcgcgcgcgccgggagagtggagcgcggaggcccgacggcgccccctcccggcgggcccgagccacggccgcgggctctggcgggtgccggggaggccacgcgcgacggcgtcgcagccggagcccagacagacgccccacgctgcgcggccttcatcccacggctggggcgatggaaaggtggtcccgacacgcgcaggggtctgaggaatcggcttcgggattctgtggtctttgtggtccgcagccggcaccactgcttcctgtaatttaattttctctcccgaaagcgttgctaattaaatcctttctccggcgagccgtcgccccccgcccctg

SEQ ID NO: 77135 - DNA, 15 bp, Homo sapiens
  misc_feature 1..15: note = chr14:77600201-77600216
  misc_feature 1..15: note = hyper
  source 1..15: mol_type = genomic DNA
ggtggcagcagaagc

SEQ ID NO: 77136 - DNA, 125 bp, Homo sapiens
  misc_feature 1..125: note = chr14:77600264-77600389
  misc_feature 1..125: note = hyper
  source 1..125: mol_type = genomic DNA
cgaacatttcagaacccaggacagctcctgcagggcacggggaggggaaacaccagagccgctttacacccaggccaccggcataactgcgatctaggcaggctttccaccgggagggagggaga

SEQ ID NO: 77137 - DNA, 93 bp, Homo sapiens
  misc_feature 1..93: note = chr14:77606256-77606349
  misc_feature 1..93: note = hyper
  source 1..93: mol_type = genomic DNA
ggcaggccagagacccgagcccgcagcggcctcgggtctaggccccacctgggggtgagtgttgcctggggttttgagcgagctcggcgcctt

SEQ ID NO: 77138 - DNA, 99 bp, Homo sapiens; identical to SEQ ID NO: 35438
  misc_feature 1..99: note = chr14:77606757-77606856
  misc_feature 1..99: note = hyper
  source 1..99: mol_type = genomic DNA

SEQ ID NO: 77139 - DNA, 1396 bp, Homo sapiens; identical to SEQ ID NO: 35439
  misc_feature 1..1396: note = chr14:77606921-77608317
  misc_feature 1..1396: note = hyper
  source 1..1396: mol_type = genomic DNA

SEQ ID NO: 77140 - DNA, 30 bp, Homo sapiens
  misc_feature 1..30: note = chr14:77646077-77646107
  misc_feature 1..30: note = hypo
  source 1..30: mol_type = genomic DNA
cctggcctctctttacggcatgaccttgat

SEQ ID NO: 77141 - DNA, 165 bp, Homo sapiens
  misc_feature 1..165: note = chr14:77703958-77704123
  misc_feature 1..165: note = hypo
  source 1..165: mol_type = genomic DNA
gttcattgagggttgcgcttgggggctttaactcctcccctacttggccctgcacaaaagctgaacatgccccaaggccgggaaagagcagtcgcagtatttgaagcatgctgcaggtgttggtgtgcagagatgactgacggggggccacgggcaggcaccagc

SEQ ID NO: 77142 - DNA, 85 bp, Homo sapiens
  misc_feature 1..85: note = chr14:77736611-77736696
  misc_feature 1..85: note = hyper
  source 1..85: mol_type = genomic DNA
cacccctctcccctgcggtgaggctcccgcatctgtcaccccttccccggctgctctctggctctttcctcggaaaggtttgtct

SEQ ID NO: 77143 - DNA, 166 bp, Homo sapiens
  misc_feature 1..166: note = chr14:77736980-77737146
  misc_feature 1..166: note = hyper
  source 1..166: mol_type = genomic DNA
ctggttggcaacaggcgcccacggtcgagagagaggcagaggggctgtgccacccgtcgccgcgccccgctcctctggcgcacatctggcaggcgccccagcgccccggcagcggccagttttccctccttcggggccggtcctgccgcgtgacccctttcccgcc

SEQ ID NO: 77144 - DNA, 462 bp, Homo sapiens
  misc_feature 1..462: note = chr14:77737147-77737609
  misc_feature 1..462: note = hyper
  source 1..462: mol_type = genomic DNA
aggcagcctccacccgcatccccgggcgctcgtgtagccctcacctggcaaacaggacggtgccgtgctccagcgggctgcggctcactgcccgccagctctgccggatcagctcgggctccgggcgctccatgctgtcccggggacgcggagcgcggggctgggaccctcagggctcgggtgccgtcaccgcacgtgccgcgccatctcctccgcgacgcggtcccctccgcccctcgtacgccccccgtgcctccgcccggcgggggccgcagccgctccttccctggcgcgggagagaaaaggcgcgcggccagtcgtaggtggagacaccccagctgtgcttccggggaccccgcttggccgctgcgccctgcgccccgcagccgccagagccgccccaccccgcgacgcctgggctgggcgctttaaagccgccacggcccccgccccctccaggcc

SEQ ID NO: 77145 - DNA, 675 bp, Homo sapiens
  misc_feature 1..675: note = chr14:77964462-77965137
  misc_feature 1..675: note = hyper
  source 1..675: mol_type = genomic DNA
cccacccacaggccacgaggacagagccagtctcaggctggccacccctgccggcggctggagagccccactgtgcctccgcttgtctcatggaaggggctcacctgaccgtttgaacctcagcggccctggcccgccactccgcaaagcgccagattcctcgcaccggcgggactcctctccgagctagcgcgcacctggaaagggggctgcaggcgaggtccgctcagggcgaggaagcccggccaccgtggagtgtcggccacctcactccgcacagaagtcaaacttgtcacccggctggtccgcggcagcccggctcgcggtcacgcgcgaggagtggaagccccgaagtccggcgcacctgggcaacgcccggtgtccgggagcttccggccggccccggcccctctctccatcggggggtcgctgcctgtgtgtgtcccggtcccgctccccgcacggctggagccggcgggctggggaggtgggaccgacagcgcgctccgcagcccggtgccgccgccactcacctctgcgagcctcgtgaggctcccaggccgtggtccgcggagccgcggcttcttcacggggagccctagcgccgcctccagcagcgccgccagcagcagcacgcagaggaggagcccggctcggtcgcggagcgcacgcatc

SEQ ID NO: 77146 - DNA, 259 bp, Homo sapiens
  misc_feature 1..259: note = chr14:77965424-77965683
  misc_feature 1..259: note = hyper
  source 1..259: mol_type = genomic DNA
atctggccgcctccccgccctcagtccccgccgctgtcgccgtcgcagcccccagcgaattcctgttcgcgggaagctgcggcccggcgcgctccggccctgcgctgcgactcctgcggggccctgagggtccgacgccacctctgccctccccgaccgcgctccaactgcgacctggaccggcggtgccgcgcgggcgagggaggcgcagcccgacgggagagtggcgcgagtcttcggatgccgggcagatgtttgg

SEQ ID NO: 77147 - DNA, 30 bp, Homo sapiens
  misc_feature 1..30: note = chr14:77968899-77968929
  misc_feature 1..30: note = hypo
  source 1..30: mol_type = genomic DNA
tgttttttttttcctcgagatggaatctgc

SEQ ID NO: 77148 - DNA, 30 bp, Homo sapiens; identical to SEQ ID NO: 44058
  misc_feature 1..30: note = chr14:78141401-78141431
  misc_feature 1..30: note = hypo
  source 1..30: mol_type = genomic DNA

SEQ ID NO: 77149 - DNA, 22 bp, Homo sapiens
  misc_feature 1..22: note = chr14:78165413-78165435
  misc_feature 1..22: note = hypo
  source 1..22: mol_type = genomic DNA
ccttattcggtctctttagcac

SEQ ID NO: 77150 - DNA, 40 bp, Homo sapiens
  misc_feature 1..40: note = chr14:78247790-78247830
  misc_feature 1..40: note = hypo
  source 1..40: mol_type = genomic DNA
aaaaataattaggtgcggccgggtgcggtggctcacgcct

SEQ ID NO: 77151 - DNA, 30 bp, Homo sapiens; identical to SEQ ID NO: 11983
  misc_feature 1..30: note = chr14:78624601-78624631
  misc_feature 1..30: note = hyper
  source 1..30: mol_type = genomic DNA

SEQ ID NO: 77152 - DNA, 36 bp, Homo sapiens
  misc_feature 1..36: note = chr14:78709766-78709802
  misc_feature 1..36: note = hypo
  source 1..36: mol_type = genomic DNA
ttcctcatggtgagccgtgaccgcctgcgcacggtg

SEQ ID NO: 77153 - DNA, 30 bp, Homo sapiens; identical to SEQ ID NO: 44060
  misc_feature 1..30: note = chr14:79111630-79111660
  misc_feature 1..30: note = hypo
  source 1..30: mol_type = genomic DNA

SEQ ID NO: 77154 - DNA, 70 bp, Homo sapiens
  misc_feature 1..70: note = chr14:79745172-79745242
  misc_feature 1..70: note = hyper
  source 1..70: mol_type = genomic DNA
tgggcattttaaccccgggagacacacgcgcctggagagtggtcgcccaagccaccgccaggcagggagg

SEQ ID NO: 77155 - DNA, 82 bp, Homo sapiens
  misc_feature 1..82: note = chr14:79745475-79745557
  misc_feature 1..82: note = hyper
  source 1..82: mol_type = genomic DNA
gcacacacggcggggcgggagccgcgcgagcgagaggagggcgggcggcgtgtgctggaggctcgcgcgggtgtatacgagc

SEQ ID NO: 77156 - DNA, 30 bp, Homo sapiens
  misc_feature 1..30: note = chr14:79745998-79746028
  misc_feature 1..30: note = hyper
  source 1..30: mol_type = genomic DNA
gcggctgctccgtggcgctagtccagcacg

SEQ ID NO: 77157 - DNA, 30 bp, Homo sapiens; identical to SEQ ID NO: 44061
  misc_feature 1..30: note = chr14:81489175-81489205
  misc_feature 1..30: note = hypo
  source 1..30: mol_type = genomic DNA

SEQ ID NO: 77158 - DNA, 204 bp, Homo sapiens
  misc_feature 1..204: note = chr14:81902032-81902236
  misc_feature 1..204: note = hyper
  source 1..204: mol_type = genomic DNA
gcacacacacgcacacgcgcgcgcacacacgcactctcatcttcaactcttcatcccagcgagaggcgggtgtcaggcaaattgcttggcaacgcgcagagaaaactccatccaagccccacgtccaggccgcctctgggcgctgtccagcgggcagagcgcctgaggccaagctggggtcctgcctcccgacaccccgaaggc

SEQ ID NO: 77159 - DNA, 182 bp, Homo sapiens
  misc_feature 1..182: note = chr14:81902823-81903005
  misc_feature 1..182: note = hyper
  source 1..182: mol_type = genomic DNA
cccgccggctcccggcgccgctcccgccgctcctgattggccgcggcgcgctcccgagccgcgccatgattgggcagccggggagccggggcggggggactggccgggcgccgccgggatctgctggccaagcttcccgcgccgcagactcgctttcccgcggctcccggggccccaaccag

SEQ ID NO: 77160 - DNA, 30 bp, Homo sapiens
  misc_feature 1..30: note = chr14:82090665-82090695
  misc_feature 1..30: note = hypo
  source 1..30: mol_type = genomic DNA
cacctctcacaggagcgatatgggagagga

SEQ ID NO: 77161 - DNA, 655 bp, Homo sapiens
  misc_feature 1..655: note = chr14:85996141-85996796
  misc_feature 1..655: note = hyper
  source 1..655: mol_type = genomic DNA
caacttcaataaatccggtaactggaggcaaaaaatagactccgagggctgggtctggtccggatgaaacgctagggctccttcccttccttgaatcttgggcgctggaagccagccacgggcgtcttgccacgcgagtgcccctagacagcaacacacccactggaaacgcacgtgaacaaagctctcgcccccgggagccgctgcctgcggtttcctagtcgatcccagcttctctagggagtgtcaggcgcacacagggttaagttagttccctccctggtaggagggagaggaggaggaggggaaaagcagcatactgtctcaggctgggtaccttgtagttagttgtacgttcgaaacctgtcgccgtcacttgcgcgtttggcattatccattgtcaccgcggaggaacgagcgctcgagatatcatcagtgcccgcaaatctccgcgccaaggcgctgagctactcctttccgaggtgcgcctctggtcctccgtccctggtgcccagcagcggcgaggcggcatctccgctcccgccgccgtgtccaccgagccctgggatcagggtggcagttctcaacgatgggcaggagggacctcggcggcgacccctaaaacaataccatgccccgggatccccgctgctgc

SEQ ID NO: 77162 - DNA, 58 bp, Homo sapiens
  misc_feature 1..58: note = chr14:85996891-85996949
  misc_feature 1..58: note = hyper
  source 1..58: mol_type = genomic DNA
cgttgccaggtgaagtttccagtaaccggccgagctgctgctacgctggcaccacgct

SEQ ID NO: 77163 - DNA, 473 bp, Homo sapiens
  misc_feature 1..473: note = chr14:85997453-85997926
  misc_feature 1..473: note = hyper
  source 1..473: mol_type = genomic DNA
cctgcttgtcctcttcgggctggcgggcactgagctggggccatcacgcctttctagagcgcctgcggaggtggcgaaggcttggagagcatacgaggcggaatccggatcgagtgagttccttgagccgcttgcgtgggacgcagggagagggcgaataacgccctcaggcgctgaatgcaggggcaaggagccagcgagggtggctggagcaggccttgccagctgttaccaagtctctccacaggcttgggggcttggggcctcctggaaagatccctccgccgcgctgaccagtacggggctcgctcccgcactttgaaggctgccgcggtctttcgtcatttataatcaagcccaagatcaaggttgcaagctgaggtcggggtactgacaacgggaatgaagccataggggaagaggataactgggacgggctggacccatacttgatacccgggaaactcctagag

SEQ ID NO: 77164 - DNA, 15 bp, Homo sapiens
  misc_feature 1..15: note = chr14:85998560-85998575
  misc_feature 1..15: note = hyper
  source 1..15: mol_type = genomic DNA
tagttttaaactctc

SEQ ID NO: 77165 - DNA, 104 bp, Homo sapiens
  misc_feature 1..104: note = chr14:85998629-85998733
  misc_feature 1..104: note = hyper
  source 1..104: mol_type = genomic DNA
cgggctcgttctccctcttctgttcagattcagcctcaccggacttgttacaacatgacagcaacttactggaggcaggaagagcagcacgaaataagatgaga

SEQ ID NO: 77166 - DNA, 15 bp, Homo sapiens
  misc_feature 1..15: note = chr14:85999517-85999532
  misc_feature 1..15: note = hyper
  source 1..15: mol_type = genomic DNA
agagggctccaggag

SEQ ID NO: 77167 - DNA, 134 bp, Homo sapiens; identical to SEQ ID NO: 35452
  misc_feature 1..134: note = chr14:85999596-85999730
  misc_feature 1..134: note = hyper
  source 1..134: mol_type = genomic DNA

SEQ ID NO: 77168 - DNA, 653 bp, Homo sapiens
  misc_feature 1..653: note = chr14:85999838-86000491
  misc_feature 1..653: note = hyper
  source 1..653: mol_type = genomic DNA
cgccgagtcccgggatcctccaaatccgaggagctccggcgccgcggggcagctttctgccgccttccccgctcgctgtacttcttttggggttcgttggcttggcgaagcggagagggggaggcggaggaggagagaaggcgggggtcgcggcggccgaagccaagagaaagtggcatgcccgaaccctggaggcggtggtggcggaggacgggggaagacgatgccgcagctccgtaggggacgtaggcgagagcaagcgaggcgagctgggcgccccggccccggcccgctgcggggaggcgcgcgccgctctgaggctccggcctccgcacccccgcgccccgacgctgcgggcgacagggcttggctccagcagccgccgccgtcgccgccgccgccacccggaggacccagcaaaagtttggatctgggggagggcgcggcgctgagcgggattaccaccagggctggaaggagacctcgagaacctttgcaggtaacgcgcgcccccaaccctcttcttccatgccccgccgctgcgctcccgcttcctcccagagcccttcctggccctcgcgggtctggcagaaagtaagagggaggcgaagttcaagatcccggggatgagcaccgagcgctggcagatcact

SEQ ID NO: 77169 - DNA, 213 bp, Homo sapiens
  misc_feature 1..213: note = chr14:86000988-86001201
  misc_feature 1..213: note = hyper
  source 1..213: mol_type = genomic DNA
ggtgttgcagagaggcggaatttttctcggtggcctgatgcgcagtggtcctaaggtagtgagtggccgcgtgtgcgcattgaggcggcggcagcggagagaagacggtcacgtttcccgaacggcagccttacttaggctaagaaaatagctgcagctcactccaaaagcaaaaagattccagccccaactccccgacgccccctttccccc

SEQ ID NO: 77170 - DNA, 23 bp, Homo sapiens
  misc_feature 1..23: note = chr14:87889659-87889682
  misc_feature 1..23: note = hypo
  source 1..23: mol_type = genomic DNA
aggagccaagatggccgaatagg

SEQ ID NO: 77171 - DNA, 40 bp, Homo sapiens
  misc_feature 1..40: note = chr14:88449385-88449425
  misc_feature 1..40: note = hypo
  source 1..40: mol_type = genomic DNA
tttaagaaagttctccggccaggcgtggtggctcattcct

SEQ ID NO: 77172 - DNA, 30 bp, Homo sapiens
  misc_feature 1..30: note = chr14:88458934-88458964
  misc_feature 1..30: note = hyper
  source 1..30: mol_type = genomic DNA
ccctttctggagcgacgctccccgactgcc

SEQ ID NO: 77173 - DNA, 222 bp, Homo sapiens
  misc_feature 1..222: note = chr14:88459409-88459631
  misc_feature 1..222: note = hyper
  source 1..222: mol_type = genomic DNA
cagcagcaagggcaccgcggcgcggcccgccgaacccgcggccgcagtcatagctttcgctcggcgttgccaggaagccgagagtagccactcagccattgtgtgggtcacatgactccggcgcccagggaggcgggtcccgtcgccgccacgatagatacgggcaggaggccgctgatgctgacgccgccgccgccattttgagtgcgggtcaagggcctc

SEQ ID NO: 77174 - DNA, 30 bp, Homo sapiens; identical to SEQ ID NO: 44062
  misc_feature 1..30: note = chr14:88673478-88673508
  misc_feature 1..30: note = hypo
  source 1..30: mol_type = genomic DNA

SEQ ID NO: 77175 - DNA, 323 bp, Homo sapiens
  misc_feature 1..323: note = chr14:88789333-88789656
  misc_feature 1..323: note = hyper
  source 1..323: mol_type = genomic DNA
cttgggtgtttgcaccggccagggggtggccggccgcggccccgtgggtaaaagaaaaagtaagatcggcgaggggtggatgaaaggatggagaggaaggcttggggagatggaagagccaagctgcttcccaaaagcggtgccggcaggttaggggctgcgcagcctgaaggctggggctacggagaagcccactgcagtgtcactccagcccccgaaggcgtgtgcgcacacactcccgcacacacacacccgcacacacactcccgggcgcgcgcttgggcgggcacgtcagcctcgctcggccgcgctgagcgcacacg

SEQ ID NO: 77176 - DNA, 285 bp, Homo sapiens
  misc_feature 1..285: note = chr14:88789962-88790247
  misc_feature 1..285: note = hyper
  source 1..285: mol_type = genomic DNA
aacgagcggtgggcgcgccgctacttactggctcggccggccggcgggcgggcgtggaggcggcagcggcgcgcttgctggagttgcagccggagacacgcttggttgcctggaaggcgctgcaggaggcggaggaagggccgctgcggctccgccgcagacctcggcctccgggtcacctcttctcaccgctctcaccctgagctctccctccttctcttttctcacttcattttttttcctcccgcgtctggctctctcgcctgagtcccgaacccacgtccc

SEQ ID NO: 77177 - DNA, 384 bp, Homo sapiens
  misc_feature 1..384: note = chr14:88790298-88790682
  misc_feature 1..384: note = hyper
  source 1..384: mol_type = genomic DNA
cgctccgcatctgctgcgctctccccgcccggggaagctcgctcccaaggcacagcttggtcccttccccagctacctgcagccggactggggccgctggtcgttggctggaaaggaggcttgagagaggcacgggggcccccggaggaaagcggagttgccaagacccggcagctcccggaagcggcggccccgggatcctgggaccagcagggcagatgcgaagggacccagacctgttcccggaaaggggctaaacctggagcattcgtctaacgccctctcactgcccctgcttgaagccccacaggggtttgtggtggggcctcagtcttcagaaaagccaggtggtgctgaggtgctcttgaacgggtcactccgagt

SEQ ID NO: 77178 - DNA, 506 bp, Homo sapiens
  misc_feature 1..506: note = chr14:88792857-88793363
  misc_feature 1..506: note = hyper
  source 1..506: mol_type = genomic DNA
ggctattgcttcaggcgggttaagtctggtggaaagagactgcctagcgttcctgcggcaggaaaacaaaacatcgtggcgcaaagtctccctgcactcgccggcccccagcaggagacccgggctggcggccactgcgtcctgggtgcactcggtggcaaagcgctgctaccgggcacgggtctctgcagctcaaaacctgcccggctggagcgcaccaatagttgccccaccactttaatgaatgccgtgtggcccggcatgggaaggctgggaaagcccgaaaaccccagtcatctctggcaacgaagtttccccgagttggctggctcccttaccccctccccacgctccagcccggggtagctgtgagaccggaggagacgatgcctgccgcgtggggagtctcagggtggctggcaatgaacagctcagccagagaagagtcgaacacggattccggggcgagtcaggagaatttcctgggacagcgaatggcagggagt

SEQ ID NO: 77179 - DNA, 30 bp, Homo sapiens
  misc_feature 1..30: note = chr14:89017832-89017862
  misc_feature 1..30: note = hyper
  source 1..30: mol_type = genomic DNA
tagactcggaggccccggaaccctctttct

SEQ ID NO: 77180 - DNA, 356 bp, Homo sapiens
  misc_feature 1..356: note = chr14:89493134-89493490
  misc_feature 1..356: note = hyper
  source 1..356: mol_type = genomic DNA
gcgagcaagagcccacgatggggttggcggagaggcgcgtcctcgaggtaacagggatgctgagaggtggctgaattcttccttctttcagcgcccctgacctcccggcacggcgctggggaactcacgggtctggagcgtgtccgtgctgggcccccggagatgatttctggaatcgcgacccggggacctgaggccactctgggacctgcgaggcagttgttgcccaaagacaaggcctgggtacaggagctcgggaagctctctgctgcccgtctccgttatccacgttcgtctgggcaccctcctcgggtgctgcccattattcctcccgcacctgccggatccaagagtag

SEQ ID NO: 77181 - DNA, 155 bp, Homo sapiens
  misc_feature 1..155: note = chr14:89493899-89494054
  misc_feature 1..155: note = hyper
  source 1..155: mol_type = genomic DNA
gctcatcctggaacccgggcgcccgcagggtcgcgaggccaagtgtaggtcattcccctccccgcgggacccgtgcctggtggacgcatcgccgacgcggaccctgaacgctcacatgagatccttagggaaactgaggccgaagaattgggaat

SEQ ID NO: 77182 - DNA, 54 bp, Homo sapiens
  misc_feature 1..54: note = chr14:89579245-89579299
  misc_feature 1..54: note = hypo
  source 1..54: mol_type = genomic DNA
agcagccgaggggcccgggcactgcagcctgagcccggccgtgcacccaccaca

SEQ ID NO: 77183 - DNA, 102 bp, Homo sapiens
  misc_feature 1..102: note = chr14:89606032-89606134
  misc_feature 1..102: note = hypo
  source 1..102: mol_type = genomic DNA
ctttaaaagatgactcggcggcttttctttaggtgtgcctccaaacacctgggttcaagtcttagctctgccacataatagctatgacgcctcaggcaaatt

SEQ ID NO: 77184 - DNA, 30 bp, Homo sapiens
  misc_feature 1..30: note = chr14:89606445-89606475
  misc_feature 1..30: note = hypo
  source 1..30: mol_type = genomic DNA
atgtaaatgcgctaccgggaagaagccggg

SEQ ID NO: 77185 - DNA, 140 bp, Homo sapiens
  misc_feature 1..140: note = chr14:89657653-89657793
  misc_feature 1..140: note = hypo
  source 1..140: mol_type = genomic DNA
gaacatctgccccagcgcagcgtcccagctgccctggggcgaaattcactaatagtgcggtgatgccgcgtgacagaagctgccgcctgtgccctgtccaaataaatgaagtgtgcaattgaagtcgacatcaaaatgcc

SEQ ID NO: 77186 - DNA, 194 bp, Homo sapiens
  misc_feature 1..194: note = chr14:89817840-89818034
  misc_feature 1..194: note = hyper
  source 1..194: mol_type = genomic DNA
caaattttctaaaaccgttctgtggagagagggaggcttcctgtgaggcccacttcctgtgaagcgtttggtctatggacagcctatttttaaaaatgtaagtccttcctttgaggccccccggaactggcagcaggccgacgggcaatcgttcctctggccgcacactttcaagtgaccgaatgtacccaaac

SEQ ID NO: 77187 - DNA, 30 bp, Homo sapiens; identical to SEQ ID NO: 44065
  misc_feature 1..30: note = chr14:89895234-89895264
  misc_feature 1..30: note = hypo
  source 1..30: mol_type = genomic DNA

SEQ ID NO: 77188 - DNA, 30 bp, Homo sapiens
  misc_feature 1..30: note = chr14:89898427-89898457
  misc_feature 1..30: note = hypo
  source 1..30: mol_type = genomic DNA
aatcataaagaacatcgcattgcagtctct

SEQ ID NO: 77189 - DNA, 58 bp, Homo sapiens
  misc_feature 1..58: note = chr14:89918692-89918750
  misc_feature 1..58: note = hypo
  source 1..58: mol_type = genomic DNA
gtgggaaggttccctcgccaagcccatccccatctccccagcacgctggggagggccg

SEQ ID NO: 77190 - DNA, 103 bp, Homo sapiens
  misc_feature 1..103: note = chr14:89938186-89938289
  misc_feature 1..103: note = hypo
  source 1..103: mol_type = genomic DNA
cctttccctcggccacggagatgaggaatgacccatcagcttcgatccaggaatgggaataaagatgacttggaacagagtcctcatcaatcttcaacagaaa

SEQ ID NO: 77191 - DNA, 19 bp, Homo sapiens
  misc_feature 1..19: note = chr14:89941442-89941461
  misc_feature 1..19: note = hypo
  source 1..19: mol_type = genomic DNA
ccaccgcgcccggccaggt

SEQ ID NO: 77192 - DNA, 85 bp, Homo sapiens
  misc_feature 1..85: note = chr14:89954654-89954739
  misc_feature 1..85: note = hypo
  source 1..85: mol_type = genomic DNA
ttcattaaagaccaccgagcaggcaccagtggctgatgtttaattaatgtctgggccaggcatggtgactcatgcctgtaatccc

SEQ ID NO: 77193 - DNA, 41 bp, Homo sapiens
  misc_feature 1..41: note = chr14:89962244-89962285
  misc_feature 1..41: note = hypo
  source 1..41: mol_type = genomic DNA
gttctctataggggccgtgctgctcctaagcatgctcacaa

SEQ ID NO: 77194 - DNA, 41 bp, Homo sapiens
  misc_feature 1..41: note = chr14:89962525-89962566
  misc_feature 1..41: note = hypo
  source 1..41: mol_type = genomic DNA
cagcctgggcaacaagagcaaaactccgtctcaaaaaaaga

SEQ ID NO: 77195 - DNA, 25 bp, Homo sapiens
  misc_feature 1..25: note = chr14:90002828-90002853
  misc_feature 1..25: note = hypo
  source 1..25: mol_type = genomic DNA
aagattaaataaggtcggcgggcgc

SEQ ID NO: 77196 - DNA, 20 bp, Homo sapiens
  misc_feature 1..20: note = chr14:90006790-90006810
  misc_feature 1..20: note = hypo
  source 1..20: mol_type = genomic DNA
aaatgaggctgggcacggtg

SEQ ID NO: 77197 - DNA, 41 bp, Homo sapiens
  misc_feature 1..41: note = chr14:90043896-90043937
  misc_feature 1..41: note = hypo
  source 1..41: mol_type = genomic DNA
aaatccatatattcccggggcaatcacggggaatttctaat

SEQ ID NO: 77198 - DNA, 30 bp, Homo sapiens
  misc_feature 1..30: note = chr14:90083564-90083594
  misc_feature 1..30: note = hyper
  source 1..30: mol_type = genomic DNA
cttctttaatgaaatcgctttaaaggctca

SEQ ID NO: 77199 - DNA, 630 bp, Homo sapiens
  misc_feature 1..630: note = chr14:90084018-90084648
  misc_feature 1..630: note = hyper
  source 1..630: mol_type = genomic DNA
taagctagtagctgacgtctgcaaagaaatttgtcaccaaaatggcctactttatgtggatagaaacaacaacaaaaaattaaacataaaggtatctcgagcaaactgcacccaaatgaaaaaccgaccctgcagaaatctgtgcacaagagggctatctgaaactacagcacgattttaaaagaaggttttgggtgactgttttcataagtctcaatctaactgaccaatcagtgtgagagttaaagtgggctccagtcattcgtgcagccttcagagctctgcaccctccgagctgctctcctctccaaggcagagtcggcgatcaatgaaaaacagggaacaaaaggaatataacaggatgtcttccttagctaaggaaaacgattccctttttcctcaatgagccagtcgcaccctgcctacgacagctccacacgggagcttccagcagaccagtcctttcgggtgaggcacattttacatttgcaatcatgtgtcccaactgctagcaaatgtgtcaccttaagcacagcctgtgacggagggctccccgagcccaaccaattgaaactaataaattaaataaattaataatcccacaattaaaacctccggagaaagattgca

SEQ ID NO: 77200 - DNA, 153 bp, Homo sapiens
  misc_feature 1..153: note = chr14:90085797-90085950
  misc_feature 1..153: note = hyper
  source 1..153: mol_type = genomic DNA
ctaggatctgcagcccgagggtaagcgtaggggcagtacctggcagacagaggtttgccgggtgcactggtgacattggccgttcacagacggtgagacgcggtacgggatcgataaagatagatttcaaaaatataacgctaaaaagaaaaa

SEQ ID NO: 77201 - DNA, 20 bp, Homo sapiens
  misc_feature 1..20: note = chr14:90201050-90201070
  misc_feature 1..20: note = hypo
  source 1..20: mol_type = genomic DNA
ttaaccgatagtaaaacata

SEQ ID NO: 77202 - DNA, 62 bp, Homo sapiens
  misc_feature 1..62: note = chr14:90204670-90204732
  misc_feature 1..62: note = hypo
  source 1..62: mol_type = genomic DNA
gcaaggtccaaacaccgggaacggcaagaggatgcgttagccactcccgtgtcgctagcacc

SEQ ID NO: 77203 - DNA, 30 bp, Homo sapiens
  misc_feature 1..30: note = chr14:90323596-90323626
  misc_feature 1..30: note = hypo
  source 1..30: mol_type = genomic DNA
atctggattcaaagacgcatttcacagctc

SEQ ID NO: 77204 - DNA, 625 bp, Homo sapiens; identical to SEQ ID NO: 35465
  misc_feature 1..625: note = chr14:90526555-90527180
  misc_feature 1..625: note = hyper
  source 1..625: mol_type = genomic DNA

SEQ ID NO: 77205 - DNA, 419 bp, Homo sapiens
  misc_feature 1..419: note = chr14:90527512-90527931
  misc_feature 1..419: note = hyper
  source 1..419: mol_type = genomic DNA
gaagcggggctggctcgcggtgcgcgcttggtccgggcggagcctactagtaggcgcagaggacgcccccgcgcaggatccagagaccaagggcgctctggcatggtcaaggcgagggaggctgcccgggggagaagcccctaacttcctttgctccctgttccaacctccctttctggtctcctctctccagcccgtccgcccaacggatgcgcagcgttggggcccggccggaggtcggagccctcggacgccgcagccctcggacgccgctcagcacagcccctctctccgtgcgcccgccctggaccccctccatccctaagccccggcagccgattcggagactcgggaggccacaggctcagcgcgacaccacgaccacaactaggaggcaccatcgtcgatctacctgggga

SEQ ID NO: 77206 - DNA, 650 bp, Homo sapiens
  misc_feature 1..650: note = chr14:90528157-90528807
  misc_feature 1..650: note = hyper
  source 1..650: mol_type = genomic DNA
ctcccctatctgagccggacagggagccggggtggaaactgcgcccgcatcccagcgccaagcagacgtgaactctgcgcccgttccccgggaccttcagcgttaaggagaactccgaggagagcagggggagtggaggggaacggcggcgacaaagcggatttgaaactaggagtcaaggaggacgtggggagctggcgccacaggagctaccgaggcggcggccgggggagcctcgcggcctgcgggagagcccggcggtcatgggcgagccggcggtggggcgcccgggagctggctgagcgccggggcccttatttcccgggggtgtgggcgagactccgccgacgcccggtgccgtgggcctgggggctgcccccgggggcccggccatggctggccggggtttcagctggggcccgggccacctgaacgaggacaacgcgcgctttctgctgctggccgcgctcatcgtgctctacctgctgggcggcgccgccgtcttctccgcgctggagctggcgcacgagcgccaggccaagcagcgctgggaggagcgcctggccaacttcagccgcggccacaacctgagccgcgacgagctgcgcggcttcctccgccactacgaggaggccactcgggccggcatc

SEQ ID NO: 77207 - DNA, 278 bp, Homo sapiens
  misc_feature 1..278: note = chr14:90528869-90529147
  misc_feature 1..278: note = hyper
  source 1..278: mol_type = genomic DNA
cgtttccaccataggtaagtgtgctggccggactcgctgacaacctccgggcggcctccacttcctccggggggcaggaccgaccctctcatcctttcattcatccatctgggcgcccagccagactccactgacatgagctgtcgcctgatcaacaggtggtattgcctccccgctgctctaatgtggtccaggcaccggcagcttcagcgtcacctggcagcttgttagaaatgcagtctcagtcccctctgcagacctgccgagtcagaatctgc

SEQ ID NO: 77208 - DNA, 67 bp, Homo sapiens
  misc_feature 1..67: note = chr14:90632615-90632682
  misc_feature 1..67: note = hypo
  source 1..67: mol_type = genomic DNA
attgatagcggtaaccgctgcaaaatgatagctcaagcacagagtggaaatacgttccctttggctt

SEQ ID NO: 77209 - DNA, 30 bp, Homo sapiens; identical to SEQ ID NO: 44069
  misc_feature 1..30: note = chr14:90650692-90650722
  misc_feature 1..30: note = hypo
  source 1..30: mol_type = genomic DNA

SEQ ID NO: 77210 - DNA, 61 bp, Homo sapiens
  misc_feature 1..61: note = chr14:90651094-90651155
  misc_feature 1..61: note = hypo
  source 1..61: mol_type = genomic DNA
ctccatagagacagacggggtggcagagagtgacacggacgggcgccggctctcaggggag

SEQ ID NO: 77211 - DNA, 32 bp, Homo sapiens; identical to SEQ ID NO: 44070
  misc_feature 1..32: note = chr14:90724207-90724239
  misc_feature 1..32: note = hypo
  source 1..32: mol_type = genomic DNA

SEQ ID NO: 77212 - DNA, 526 bp, Homo sapiens
  misc_feature 1..526: note = chr14:90849950-90850476
  misc_feature 1..526: note = hyper
  source 1..526: mol_type = genomic DNA
caaatacccgtgctgcggcccgtggccctccatagggccacctgaactagcctcgcctgtccccttgctctttgccgttcgtccttcgcgttttgtgaaaacagttggcgccgcagaaatgagataaacgcccctgagctcgaaacccgcactcgaactgccaccgagccgacccttcctgttttggaactcagggcccggccacccgagaagcaccctcatgggcactttgtttctacaagggcccgtttccatttccttcctaaggtttccttatcccctgcggcaggaggggcccgctgggctcgggttttcagctgcgttggagctgcagaggctgcggagtgaacgcggccaggagcccgcctgggagcgcgcagcgctctaggagccgagagccgctgcttggccctcgctggccgggtaaaccgaggggaagctcctggcctcctttcccttaagccccttattgcttctgtggggaaggccctcctaggtagaggcgaaggaccggggagataacctc

SEQ ID NO: 77213 - DNA, 30 bp, Homo sapiens; identical to SEQ ID NO: 15852
  misc_feature 1..30: note = chr14:90983280-90983310
  misc_feature 1..30: note = hypo
  source 1..30: mol_type = genomic DNA

SEQ ID NO: 77214 - DNA, 46 bp, Homo sapiens
  misc_feature 1..46: note = chr14:91059788-91059834
  misc_feature 1..46: note = hypo
  source 1..46: mol_type = genomic DNA
gctctggcacagcagcgggttgtgggtgaggcggagggtacctgca

SEQ ID NO: 77215 - DNA, 30 bp, Homo sapiens
  misc_feature 1..30: note = chr14:91065728-91065758
  misc_feature 1..30: note = hypo
  source 1..30: mol_type = genomic DNA
ggaatcctgcccacccggtgacttggcgag

SEQ ID NO: 77216 - DNA, 77 bp, Homo sapiens
  misc_feature 1..77: note = chr14:91580352-91580429
  misc_feature 1..77: note = hyper
  source 1..77: mol_type = genomic DNA
ctttaagaactggggcgggctagctgccgaggagaccacgctgctgcatgggccacgtgagctcaggctgtgggagc

SEQ ID NO: 77217 - DNA, 64 bp, Homo sapiens
  misc_feature 1..64: note = chr14:91580430-91580494
  misc_feature 1..64: note = hyper
  source 1..64: mol_type = genomic DNA
gatggagctgctacagtcagcgcttggggctggcctcagcttgtagacccgagccctgcagaac

SEQ ID NO: 77218 - DNA, 30 bp, Homo sapiens; identical to SEQ ID NO: 35471
  misc_feature 1..30: note = chr14:91581588-91581618
  misc_feature 1..30: note = hyper
  source 1..30: mol_type = genomic DNA

SEQ ID NO: 77219 - DNA, 40 bp, Homo sapiens; identical to SEQ ID NO: 44073
  misc_feature 1..40: note = chr14:91691266-91691306
  misc_feature 1..40: note = hypo
  source 1..40: mol_type = genomic DNA

SEQ ID NO: 77220 - DNA, 30 bp, Homo sapiens; identical to SEQ ID NO: 35472
  misc_feature 1..30: note = chr14:91720177-91720207
  misc_feature 1..30: note = hyper
  source 1..30: mol_type = genomic DNA

SEQ ID NO: 77221 - DNA, 38 bp, Homo sapiens
  misc_feature 1..38: note = chr14:91730743-91730781
  misc_feature 1..38: note = hyper
  source 1..38: mol_type = genomic DNA
cgccccggtagctggcggggagccggcctcgctgaagg

SEQ ID NO: 77222 - DNA, 30 bp, Homo sapiens
  misc_feature 1..30: note = chr14:91743801-91743831
  misc_feature 1..30: note = hypo
  source 1..30: mol_type = genomic DNA
aagtgtctgctttctcgaatgtggcagaat

SEQ ID NO: 77223 - DNA, 146 bp, Homo sapiens
  misc_feature 1..146: note = chr14:91747935-91748081
  misc_feature 1..146: note = hypo
  source 1..146: mol_type = genomic DNA
acctcgcctggcacccggatcccagtagctccagctcttggggatgagggaatggcatgcagatgctgcctttgggacctgcctctcctacccctccaccgtttctcctgctgggacaaccctgacactcccgattcccatcccct

SEQ ID NO: 77224 - DNA, 55 bp, Homo sapiens
  misc_feature 1..55: note = chr14:91754739-91754794
  misc_feature 1..55: note = hypo
  source 1..55: mol_type = genomic DNA
accacccaaggctttcgggaggtcttatatacatggagaacgtgttgagtgcacc

SEQ ID NO: 77225 - DNA, 30 bp, Homo sapiens
  misc_feature 1..30: note = chr14:91757392-91757422
  misc_feature 1..30: note = hypo
  source 1..30: mol_type = genomic DNA
ttttccttatgtcttcgtaaggcatttaat

SEQ ID NO: 77226 - DNA, 96 bp, Homo sapiens
  misc_feature 1..96: note = chr14:91758260-91758356
  misc_feature 1..96: note = hypo
  source 1..96: mol_type = genomic DNA
ggagtcacggggctgcgcccacagtgcattcggagccgcgctgcccatggtactgaggactgctgcccactcatgcctcagcgctgggtggtcttg

SEQ ID NO: 77227 - DNA, 325 bp, Homo sapiens
  misc_feature 1..325: note = chr14:91766265-91766590
  misc_feature 1..325: note = hypo
  source 1..325: mol_type = genomic DNA
ctcacctgtccagctcgccccgcagcctctggttctcgcccatggcgagggcgtttgtcctctgctcctgctgcagcgcctctcgctcagtggtcaagaccttctcccgctcctccagctccgccttgcgcttcagcatgtcaccgtgcctgttggagggaagcacctgccgtgagtctggccagggccttcttttccgacaggtaactcacatcccagaggatctgcgtgcctcccgtgagaaaatgggattcctctggagagtctctctgcagaagtgaggggcatggggcagggaacaggcggggagcgcagccactgggag

SEQ ID NO: 77228 - DNA, 30 bp, Homo sapiens
  misc_feature 1..30: note = chr14:91837088-91837118
  misc_feature 1..30: note = hypo
  source 1..30: mol_type = genomic DNA
gtaggtggacacatccgtgcatacagaccc

SEQ ID NO: 77229 - DNA, 90 bp, Homo sapiens; identical to SEQ ID NO: 44077
  misc_feature 1..90: note = chr14:91849645-91849735
  misc_feature 1..90: note = hypo
  source 1..90: mol_type = genomic DNA

SEQ ID NO: 77230 - DNA, 30 bp, Homo sapiens; identical to SEQ ID NO: 44078
  misc_feature 1..30: note = chr14:91850063-91850093
  misc_feature 1..30: note = hypo
  source 1..30: mol_type = genomic DNA

SEQ ID NO: 77231 - DNA, 30 bp, Homo sapiens
  misc_feature 1..30: note = chr14:91850338-91850368
  misc_feature 1..30: note = hypo
  source 1..30: mol_type = genomic DNA
cacacctgggtaccacggcacactggtgca

SEQ ID NO: 77232 - DNA, 518 bp, Homo sapiens
  misc_feature 1..518: note = chr14:92040365-92040883
  misc_feature 1..518: note = hyper
  source 1..518: mol_type = genomic DNA
ttggcagggaggaggcggcttgcagatgagaaggctggcaggcaagcgctgcgggcgaccgtgggtggtgggcgggttttcccctcaggcaggtgcaggtcctaagggggcgggccccgttgggtgctcatgacgcaaaggtccctaggatttgctcctcacagcgggagcgccctcgagaggaaccgcgtctgcgcctcccgagacggaccactcgggcgcctccgccccgcgccctgcctcgggggccgccccgcgcagtgagctcagcgtggaggcggcagcgccctcgcccttccgcgccctcccagcgcggtctctcctcgtccgcgcgccccgctccccaggcgtttctgggatgctggttggccgggcacttacgtgtttcaaagcgggtgacagccgccgctcgggtgtactgttcgctctctcccgccaggatccgagttcttgttccccgacaactcgtgggagtgcccgctccagcgtggtttctccttctccgggaacggccccag

SEQ ID NO: 77233 - DNA, 326 bp, Homo sapiens
  misc_feature 1..326: note = chr14:92414011-92414337
  misc_feature 1..326: note = hyper
  source 1..326: mol_type = genomic DNA
tcggctgcgagcgcccgggcagaaggcgaggggcgggcgcgcgcaggggtgcgggggctgggagggcccgggccccttgaccttcccacccaggggcggggcggggctggcagcgcggcccggcggggaggggcgtgcacgcccgcgctgcgtggcaaggggacccgcgagaacgttgtcgcctccggaaggaaagggacttgaactcacgacccacgcagctccagggactagaaactcacgatcgattgggaaaccagaacctacgaagcagaggcttggggcgagcgacgggagagtcgcgatcttcccgaagaaggggtggg

SEQ ID NO: 77234 - DNA, 30 bp, Homo sapiens
  misc_feature 1..30: note = chr14:92672989-92673019
  misc_feature 1..30: note = hypo
  source 1..30: mol_type = genomic DNA
taaaacacctgcctccgttctgccccagta

SEQ ID NO: 77235 - DNA, 746 bp, Homo sapiens
  misc_feature 1..746: note = chr14:92789076-92789822
  misc_feature 1..746: note = hyper
  source 1..746: mol_type = genomic DNA
tttgttagctctgcacgaccaattaattttctcctgcatcttccccccgtggtgggtggcggggtggggagggggtgtgtggcggggcctcgggtcggctcgggggtcggagagcccggacaggagcgactacactgcagaaaccctttttctaagagtccccagcggtgccataacctgtttctctctgcagcagcctcagagggtaaaggaagggctcgttgcagctccatatggaagaaaggagagaaaaagggagaaggaaggggattatattggtcagtagaggtccaactactgaagagaagagtgcacgggggagtgcgccctacgggacgagtacacgtgctgggaagggcggggggtgagaggcgggcaggaggggaggagtagggaggcgagagcagcgggcgggaggcgccacggcctctcagacgctggcgcccgcagccgagaagccagagagaaagttcccggggagagctcgcccctgggagggccgacgtcgagcctgctcgccgcgagggtctcaggtaccgcgcgtccagccagccttcccgcggcgcgcactcggccgcccgggctcggctcgtcgggaagcaggggaacatcgccggctggcagccggggcggccgccgccaaacttggaggaggaggatgctgcgagtgggcgcggcggcgcggggcgcgggggcgcactgagtgctccctacggcgctgctgccagggctgtggccgggcgagc

SEQ ID NO: 77236 - DNA, 140 bp, Homo sapiens; identical to SEQ ID NO: 12004
  misc_feature 1..140: note = chr14:92789959-92790099
  misc_feature 1..140: note = hyper
  source 1..140: mol_type = genomic DNA

SEQ ID NO: 77237 - DNA, 616 bp, Homo sapiens
  misc_feature 1..616: note = chr14:92790280-92790896
  misc_feature 1..616: note = hyper
  source 1..616: mol_type = genomic DNA
cgtccggcctcttcggcagcttgggtgggtgctggtacgggtcccctcttcctggggagttgggggctttggctggggagtctcggggcggctgcgagatgttttcccctccttcctcatcaggttggtcccaagggttcatccagtcccctccccgccgggcaggtagagcgcgcccagaagagctgatggacgctctgggctgtggcgccggttcccctgagctacgagcggcccctgggggggctcaggacgcggctgcaggtgtgtgttactaagacgaaagcaagaaccgcttccgtcccgggagtgcgcccggaatgggcagcgcaactgcggggtgcaggcaggattctcttggtctggggtgggcgaaactgagtggcccgctttcctattctgcagagccgcaggaaccgccactgcgtctcgcccctgccctggttcaaaggggtcccctgggtgccctgaggtgtttgttcttcccaaaccctaaaggcgttggggcagtctgccgcggggggtagctgccatgtttcagcatcgcgtctctcaactccccttaactcccacggagggagaaggcgggtgtgtggagcctcgacccatgccccct

SEQ ID NO: 77238 - DNA, 101 bp, Homo sapiens
  misc_feature 1..101: note = chr14:92801293-92801394
  misc_feature 1..101: note = hypo
  source 1..101: mol_type = genomic DNA
cctatgttgggcgctattctaagcacttttcaggggttacttgcttctcgtaacaactctgaaggcaggtgctgtcctcagtttgccgatgaagtgaaaga

SEQ ID NO: 77239 - DNA, 191 bp, Homo sapiens; identical to SEQ ID NO: 44080
  misc_feature 1..191: note = chr14:92829024-92829215
  misc_feature 1..191: note = hypo
  source 1..191: mol_type = genomic DNA

SEQ ID NO: 77240 - DNA, 131 bp, Homo sapiens
  misc_feature 1..131: note = chr14:92839920-92840051
  misc_feature 1..131: note = hypo
  source 1..131: mol_type = genomic DNA
tttcttttacacatccgaacaactcaggactgaggggaaagttttggaaatgatctgtctccatacccagtggactctgaggacaggggacggtgaaccctgtgggtttcgacgaccgcacatcagacttt

SEQ ID NO: 77241 - DNA, 30 bp, Homo sapiens
  misc_feature 1..30: note = chr14:92858667-92858697
  misc_feature 1..30: note = hypo
  source 1..30: mol_type = genomic DNA
tttctcctgggtccccggattttgtcagtc

SEQ ID NO: 77242 - DNA, 1180 bp, Homo sapiens
  misc_feature 1..1180: note = chr14:92979590-92980770
  misc_feature 1..1180: note = hyper
  source 1..1180: mol_type = genomic DNA
gtgagctccttgtcacgggaagcatccaagaggaggcggcgtgcacatctgtcaggaatgtggaggaggcgccctggctctggtctgaggttgcccttgaacgatttcgaggctccctcgggcaaggctgtggctccgagtgggacgaactccccgccagctctgggcctccccacctgccggcccgcggtcggcgccggcacaggcggagggcgtcttccttcccctgcggccccaagccaagtggaagacttttctctaagtttccctctccgaagccccgcgggcctcccgcgccccagccccagccacagcctgtggaggcggcaccccgaggttgggcgcccgtgcggcgccttggccccagcaccccccgccccgaggcccggccccgggggcgcggccgcccgggcctccgtgtgccccagggggctccgggccgcgagccgctgccgaatggcttttgacaaaaaaacccttgaccaccaaggccagcctcttcctgaaagccccgctcgctccgatacaggaagtagaagggagcgagagccccagagcgcggcggcagcggcggcctggcccttccagagggccagagccagggacatgcgggcgcccgggactccgcgttccgcgcggcccggcgcctgagcgcctccgttccccgtcccggagctgccggcggcatgatccgacacgccggggcgcccgcgcgcggggaccccacggggtaagtccgggcggccgccccctcctccctcgcgatccccacggcccgcgtcctggccgccccactccacttcttgtcccagagagtccttcgggcgcgtgacctcggggttgtcgggctgatacgggacccccaccgtggccgaggccagaacctggttctgcggggcagggggcggccctggtgactccgctggacccgatgttggctaaactttcaaggccaggcatttcactgggaacccagtgcacactttaggctgctggtggacggattacgagggagtgcgtcgctacctgtcagcgccggggctgcccgcgtggacgcggccccctccctggcgtctgccccgcctgaactttgcaaacaaaactcgcggtcccagccccgccagcctgctgcacccgctgctctgcgagtcgcagcgcgcgccctcgggtactagagccc

SEQ ID NO: 77243 - DNA, 59 bp, Homo sapiens
  misc_feature 1..59: note = chr14:93065511-93065570
  misc_feature 1..59: note = hypo
  source 1..59: mol_type = genomic DNA
cctggggaaccccagcgaaggacattaagtgtgggggcacgatccgatgtgcctgctaa

SEQ ID NO: 77244 - DNA, 21 bp, Homo sapiens
  misc_feature 1..21: note = chr14:93091187-93091208
  misc_feature 1..21: note = hypo
  source 1..21: mol_type = genomic DNA
agggggcggtgctttcttgac

SEQ ID NO: 77245 - DNA, 30 bp, Homo sapiens
  misc_feature 1..30: note = chr14:93101791-93101821
  misc_feature 1..30: note = hypo
  source 1..30: mol_type = genomic DNA
aataggagcaagctgcggaaaaggggatca

SEQ ID NO: 77246 - DNA, 107 bp, Homo sapiens
  misc_feature 1..107: note = chr14:93107944-93108051
  misc_feature 1..107: note = hypo
  source 1..107: mol_type = genomic DNA
ggtcctgggagaagccgagctttaccccagggcccttctgagtgggagccagagagctgggcctggcagccaccacagccctggcccctcatcggatggaaaagcag

SEQ ID NO: 77247 - DNA, 30 bp, Homo sapiens
  misc_feature 1..30: note = chr14:93109368-93109398
  misc_feature 1..30: note = hypo
  source 1..30: mol_type = genomic DNA
tcccacacctgccatcgtctcatggtgcct

SEQ ID NO: 77248 - DNA, 79 bp, Homo sapiens; identical to SEQ ID NO: 44082
  misc_feature 1..79: note = chr14:93151456-93151535
  misc_feature 1..79: note = hypo
  source 1..79: mol_type = genomic DNA

SEQ ID NO: 77249 - DNA, 395 bp, Homo sapiens
  misc_feature 1..395: note = chr14:93154887-93155282
  misc_feature 1..395: note = hypo
  source 1..395: mol_type = genomic DNA
ggcgccctcttcacacgtagctcctcaggccattccccatgagtcccccacacccaccccatcctcggtctttgcaaagaagggcccgagcttagtttccccaggactggcctaggaaggagcaccggccacagctgctccccgtgccactcagggtggacccagcatctcaggagcacctcagggtgtcggttaagagacaggcctccacccctgcaccagagcctgctcttagctcccggtgcccccagaccccgcagctctgtgcccggcaagaagcagctagacacacgccagggcgccaagcacggccagctccgcggacccatggacaagcccagccccgcctcagggaaaacagggcctttccctacaggacacgccccagagctgtg

SEQ ID NO: 77250 - DNA, 35 bp, Homo sapiens
  misc_feature 1..35: note = chr14:93379041-93379076
  misc_feature 1..35: note = hypo
  source 1..35: mol_type = genomic DNA
agcgggagagggagcgggagcgggagagggagagg

SEQ ID NO: 77251 - DNA, 196 bp, Homo sapiens
  misc_feature 1..196: note = chr14:93389262-93389458
  misc_feature 1..196: note = hyper
  source 1..196: mol_type = genomic DNA
tcagccacagccccccgcctcccacgccacctcttggaaaccagatacccgcctcgcggccaagacccaccagctccaagcggcggaggccagaggtagcgaggggtgaggttagaggtgggggcgagcggggactggacacctggggagtggggaaaggggaagggggcggcaccgctgacgtcatttccggggt

SEQ ID NO: 77252 - DNA, 138 bp, Homo sapiens
  misc_feature 1..138: note = chr14:93389556-93389694
  misc_feature 1..138: note = hyper
  source 1..138: mol_type = genomic DNA
cgacagacggacgcacgccgaggcactgcgcccccagccccgcgccggtgccaccgcagcccgaccccggccgccagtccagccgcccctcgcccggtgcctaggtgcccggccccacaccgccagctgctcggcgcc

SEQ ID NO: 77253 - DNA, 423 bp, Homo sapiens
  misc_feature 1..423: note = chr14:93389712-93390135
  misc_feature 1..423: note = hyper
  source 1..423: mol_type = genomic DNA
cgccgctgtcctggctcttctgctctgcgccgggcaaggtgagcgagcgcggggagctcgcgggagagggttccgggcgcccctgcccaccttgaggtccgggcaccgcgcggcgccccgcacccctccacacttcccttcgggcgcggcgagttttcagcaccgcggacagcgcctccgcctcccgcctgaccctgcagtgtggcctccgcctgggacccacaagacacttgggcctgactcccaaccccccggggcaactcccccttgtgcccaccccttgtctgggcttggcgcctcggttgcatcagggccagtgccggttgcgcggtggccggccaaggtcactgcggggaggtgggagcatggctgctcgcaaccctccacccctcttcccctttcatctcacgctccccgcctttc

SEQ ID NO: 77254 - DNA, 30 bp, Homo sapiens
  misc_feature 1..30: note = chr14:93425612-93425642
  misc_feature 1..30: note = hypo
  source 1..30: mol_type = genomic DNA
gctaatccctcagcccgcagggccccagga

SEQ ID NO: 77255 - DNA, 30 bp, Homo sapiens; identical to SEQ ID NO: 44084
  misc_feature 1..30: note = chr14:93454054-93454084
  misc_feature 1..30: note = hypo
  source 1..30: mol_type = genomic DNA

SEQ ID NO: 77256 - DNA, 37 bp, Homo sapiens; identical to SEQ ID NO: 15855
  misc_feature 1..37: note = chr14:93697020-93697057
  misc_feature 1..37: note = hypo
  source 1..37: mol_type = genomic DNA

SEQ ID NO: 77257 - DNA, 159 bp, Homo sapiens
  misc_feature 1..159: note = chr14:93706719-93706878
  misc_feature 1..159: note = hypo
  source 1..159: mol_type = genomic DNA
aaaggaggaaaagaccgtaagagaaactatagttttgggagaaatcagcgttgttgacacccaatagaaaacctatttacttcaaagtgcatgtaattcatttacccggtagctcataaacgctccctagccctgcatagttttcgagtgagtgtgagt

SEQ ID NO: 77258 - DNA, 506 bp, Homo sapiens
  misc_feature 1..506: note = chr14:93897125-93897631
  misc_feature 1..506: note = hyper
  source 1..506: mol_type = genomic DNA
caggaagcctttggccgcctattaaatcccacccatttctccgggggcgatttcctaaccttccgggaccgaattctgcaatttgatgtgcgttttgtccgaatggtagcgacacgggcctaagggagggggaaagcgagggggtggggggtggggggtatgcactcttttcctcgcaacatcgctggcggagcgagggagctcacacgacacagattttggggcaaagcctttccaactggacagcaccatgtccaccaaagcggagcagtgtaagtagcagccggcccggcattccggcccggcctcggctgggagctattgcagctgcggcgtttgcggctgctgggagaccttggcattgtgctggtgcgggggtgggggctgaggttggggcgggtggggggtggcggagagagaaggtgggggagggtggacgttaatggcagcgcggcgctgtccccggtgctgaaaaataatacggtcttcctcgggctccagcgggg

SEQ ID NO: 77259 - DNA, 35 bp, Homo sapiens
  misc_feature 1..35: note = chr14:94222874-94222909
  misc_feature 1..35: note = hypo
  source 1..35: mol_type = genomic DNA
cccggaccccgaccccgccccggccctatcgatgc

SEQ ID NO: 77260 - DNA, 36 bp, Homo sapiens
  misc_feature 1..36: note = chr14:94226375-94226411
  misc_feature 1..36: note = hyper
  source 1..36: mol_type = genomic DNA
cagggcaacagctgccgtccccgagggctgcctgac

SEQ ID NO: 77261 - DNA, 165 bp, Homo sapiens; identical to SEQ ID NO: 35483
  misc_feature 1..165: note = chr14:94254294-94254459
  misc_feature 1..165: note = hyper
  source 1..165: mol_type = genomic DNA

SEQ ID NO: 77262 - DNA, 786 bp, Homo sapiens
  misc_feature 1..786: note = chr14:94254498-94255284
  misc_feature 1..786: note = hyper
  source 1..786: mol_type = genomic DNA
cgtgcacacacactgatccccgtgcacacccaccgactcctgcctgcaccctcgctgaccctgcatgcacggccccaagaaatctcacgctgcctgcacccacactgcccagccggcctcattgcgcacactgcaacataggcacctccgtgcgctgcccctttgcacgcctccgcccagccccgatctcccgctcccgggcgtgggttcccccacgcctccatctccgcccgcacccttccaacgcctcacgctaccttgcctggcggcggccccagccgaccctgggctcggggaaaagaggtccgcgttccccccgcggcagctctgtttcccagcagccggacagcccccatttaaagccagccgcctccccagtcccccgccctctaggcggggcctccgtcctcaccttggcggctgcgcgggcgcccgggggcttcacatgccggggaggagcgcccggcgctggagcaaaagtttgcgcgccggttgggcctcccgggccgctgagcagaggaccaggagcggcgtcctcgcacggggcgcagggcgcggtggctccggactgcgcctagccgcgcgcggggcgggaggggcggcaccccgctcccagggccagggctggccgccgaggcggaggcagagggcggggaaagtctcctccacgccgcctggagccggccgcgcgagccctccccgggcccgcgttggctccccgcctttcctggtggcgccgcgcggctgcccggggcactggggtgcccgagctctctactaccctca

SEQ ID NO: 77263 - DNA, 303 bp, Homo sapiens
  misc_feature 1..303: note = chr14:94255304-94255607
  misc_feature 1..303: note = hyper
  source 1..303: mol_type = genomic DNA
cggcgggaggcgccggcagggagctcccgctggggcagcaaagccgtgggtggaggcgaaataaataatccacgaaaaaggaaaacagacgtgagccgagccagagcctctcccgcctcccgcccggggttgcgctccccccgccgccgccgccagcgccgctgcagtgattcctcgtctccatctagcgaggctattgtgtattgggcgcttaattatttattcaccctggaggccgaggattcccacttccatggggttttggcccttgcctgcgcttcccccaagcctctcccgaggctg

SEQ ID NO: 77264 - DNA, 46 bp, Homo sapiens; identical to SEQ ID NO: 12016
  misc_feature 1..46: note = chr14:94255669-94255715
  misc_feature 1..46: note = hyper
  source 1..46: mol_type = genomic DNA

SEQ ID NO: 77265 - DNA, 39 bp, Homo sapiens
  misc_feature 1..39: note = chr14:94393706-94393745
  misc_feature 1..39: note = hypo
  source 1..39: mol_type = genomic DNA
cggacggagctcggccggctgcgccggggcctgtcccag

SEQ ID NO: 77266 - DNA, 106 bp, Homo sapiens
  misc_feature 1..106: note = chr14:94394699-94394805
  misc_feature 1..106: note = hypo
  source 1..106: mol_type = genomic DNA
agccctggataagtccgcaccctgccgccgctccgtggaccatcgcaagtacctgcagaagcagctcaagcgcttctcccagaagtattcccggctcccgcggggc

SEQ ID NO: 77267 - DNA, 30 bp, Homo sapiens
  misc_feature 1..30: note = chr14:94404198-94404228
  misc_feature 1..30: note = hypo
  source 1..30: mol_type = genomic DNA
tgaaagagaacatgccgggaccaagaagtg

SEQ ID NO: 77268 - DNA, 396 bp, Homo sapiens
  misc_feature 1..396: note = chr14:94405641-94406037
  misc_feature 1..396: note = hyper
  source 1..396: mol_type = genomic DNA
cggtggggtgcgtggcgatataggcgtcgatgttcgcgccgtggtccagcagcagctgcattgtgcgcaggcagccgtggcggatggccacgagcaaggggctgatgacgtcgcggttggggtcggcgccgtgttgcagcagcagctcggtggcgtacacgttgttgttgaccaccgcgaagtacagcgcggagctgcgccggtcttcgtagaggcgcgcgcgctcgggggccagcggcgtgttcacgtcgaagcgcgcgctcagcagcgcctccagcacctcgtcgtggttgcgctcggccgccaggtgcagcggactgacgccgctacggcgtatgcgcgtgcggctggtcaccggcagcagcatctgcacgatcctgccgggtcgaggggcgg

SEQ ID NO: 77269 - DNA, 284 bp, Homo sapiens
  misc_feature 1..284: note = chr14:94641377-94641661
  misc_feature 1..284: note = hyper
  source 1..284: mol_type = genomic DNA
ccccaacctctggtccgctgacgccgcccgggttctggccccaggcccacccatcggtccacacattcccaactcctccccccacctctcccggagacaccaccccgcgtcccgtcccctcacccccagcccaagtcagatcaagctcgggtccttctgccctcgaggtagcccggcctcccctcgcttcccagccagcactctttctcagtgtcgtcctggtccctgtctacaagccctcgcgaccctttgccgccatcctgagtcaccgctcatcctttcct

SEQ ID NO: 77270 - DNA, 30 bp, Homo sapiens
  misc_feature 1..30: note = chr14:94890121-94890151
  misc_feature 1..30: note = hyper
  source 1..30: mol_type = genomic DNA
attgagtctttgccacgctcttctggggtg

SEQ ID NO: 77271 - DNA, 40 bp, Homo sapiens
  misc_feature 1..40: note = chr14:94953764-94953804
  misc_feature 1..40: note = hypo
  source 1..40: mol_type = genomic DNA
gtgctccggtgccagcggccccttccgtacccctctcatc

SEQ ID NO: 77272 - DNA, 30 bp, Homo sapiens; identical to SEQ ID NO: 44087
  misc_feature 1..30: note = chr14:95200361-95200391
  misc_feature 1..30: note = hypo
  source 1..30: mol_type = genomic DNA

SEQ ID NO: 77273 - DNA, 70 bp, Homo sapiens
  misc_feature 1..70: note = chr14:95233491-95233561
  misc_feature 1..70: note = hyper
  source 1..70: mol_type = genomic DNA
cttgcaccaaatacccgaggtagcccaagagaaagaacaaatccctgcagccggccgttgccggaagcca

SEQ ID NO: 77274 - DNA, 30 bp, Homo sapiens; identical to SEQ ID NO: 35492
  misc_feature 1..30: note = chr14:95234025-95234055
  misc_feature 1..30: note = hyper
  source 1..30: mol_type = genomic DNA

SEQ ID NO: 77275 - DNA, 171 bp, Homo sapiens
  misc_feature 1..171: note = chr14:95234540-95234711
  misc_feature 1..171: note = hyper
  source 1..171: mol_type = genomic DNA
atacagaatgtggcccgtctacatcgccatcactttattgtactgtcacccttaatttaactataaatactacggtgggggctagtcgcgggcggcctcgggctgctgggctgtgcgcgccctgaccccagacgccgaccctcccggctctgtacactatttacagctcct

SEQ ID NO: 77276 - DNA, 358 bp, Homo sapiens; identical to SEQ ID NO: 4177
  misc_feature 1..358: note = chr14:95235025-95235383
  misc_feature 1..358: note = hyper
  source 1..358: mol_type = genomic DNA

SEQ ID NO: 77277 - DNA, 182 bp, Homo sapiens; identical to SEQ ID NO: 35495
  misc_feature 1..182: note = chr14:95235513-95235695
  misc_feature 1..182: note = hyper
  source 1..182: mol_type = genomic DNA

SEQ ID NO: 77278 - DNA, 476 bp, Homo sapiens
  misc_feature 1..476: note = chr14:95236030-95236506
  misc_feature 1..476: note = hyper
  source 1..476: mol_type = genomic DNA
cgcccagcggcggcacggccccgcagcaggccgggcccacgggcgccgcctgcacgtgcagctgcccgtagaagtagttgttgtagccgaggcgggagccgctgaccgcggccgggaggcccgcgccgccgggggccacggggcgcgggtagaaggcgccatagtccgaggaggcgccgccgctggcgccgtagagcgagtccccgtgcagggccgggaagacgacgggagccgccgcgctgtgcgccaccggcaacaccgagtccttgcagcgcggccgggcggctaggatgttgtcgatgctgaacatgctggcgggcatccccgagccccgcgtcgggaccggggggcggcgggaacgcgccgaggacagagccttaaagtgggggggtccactctcctccagccgccgaccaaaccgaaagagagcgccggcgagcgcgcagccctgcgcccctccccgccccctgcgtccg

SEQ ID NO: 77279 - DNA, 125 bp, Homo sapiens; identical to SEQ ID NO: 35497
  misc_feature 1..125: note = chr14:95237011-95237136
  misc_feature 1..125: note = hyper
  source 1..125: mol_type = genomic DNA

SEQ ID NO: 77280 - DNA, 55 bp, Homo sapiens; identical to SEQ ID NO: 35498
  misc_feature 1..55: note = chr14:95237867-95237922
  misc_feature 1..55: note = hyper
  source 1..55: mol_type = genomic DNA

SEQ ID NO: 77281 - DNA, 30 bp, Homo sapiens
  misc_feature 1..30: note = chr14:95238321-95238351
  misc_feature 1..30: note = hyper
  source 1..30: mol_type = genomic DNA
gggattaggacatgacggagatgggtctca

SEQ ID NO: 77282 - DNA, 15 bp, Homo sapiens
  misc_feature 1..15: note = chr14:95239334-95239349
  misc_feature 1..15: note = hyper
  source 1..15: mol_type = genomic DNA
ctccagacactctgc

SEQ ID NO: 77283 - DNA, 760 bp, Homo sapiens
  misc_feature 1..760: note = chr14:95239421-95240181
  misc_feature 1..760: note = hyper
  source 1..760: mol_type = genomic DNA
cgcggaggcaggccccgggaaaggcagtcggcgctcggtgctcgcactgcgcctcggcgggcggaaactcacaagtgtcctcaacgtgctaaacaaaccatcagggccccgcatcgcctggcgcaattggaataacaaatgcgacgcacgcaaattgtccacctcgtgttgctaagcgattgtttgtcggccccgcacgcacagctcagcatgggaggaccgcgagcgtccagaggcagccggcgagcgcttaggtcggaaatgcagtaaacatgccgctgattttccctattatcacccaaacacgatttcacacaaagcaatcaccacgcagaagtctatgaaaatgtgtttgttgaggagtcactcgccccagtaatagtcctcatttttaagatattaaagaatagctcagcggattccacatgcataaggtctatttgccgttcggcatctgtcacggcgcttttgcactgcggtcatcactaaattgattcatagagtgtagattaaattgcttctctgatttaaaacagtgtccaactttggagtatgcgtgtgagtatcttctcccgccccaaggtatttttgtcagggagaaaactgtcgccccactatccttacaccccattccgcataactgtaaaaaaataatgcatcttcgaccccaacttcttacggttcgtttcaggaactttcttaattctctccgtctcctgcccggccacagagcagagttcacaatcggatgcgtttaagt

SEQ ID NO: 77284 - DNA, 30 bp, Homo sapiens; identical to SEQ ID NO: 12023
  misc_feature 1..30: note = chr14:95240484-95240514
  misc_feature 1..30: note = hyper
  source 1..30: mol_type = genomic DNA

SEQ ID NO: 77285 - DNA, 30 bp, Homo sapiens
  misc_feature 1..30: note = chr14:95313261-95313291
  misc_feature 1..30: note = hypo
  source 1..30: mol_type = genomic DNA
gacaacatggttcaccgagaatggcagaca

SEQ ID NO: 77286 - DNA, 30 bp, Homo sapiens
  misc_feature 1..30: note = chr14:95461950-95461980
  misc_feature 1..30: note = hypo
  source 1..30: mol_type = genomic DNA
tcagagacctccagccgggatgccagctga

SEQ ID NO: 77287 - DNA, 55 bp, Homo sapiens; identical to SEQ ID NO: 44088
  misc_feature 1..55: note = chr14:95522889-95522944
  misc_feature 1..55: note = hypo
  source 1..55: mol_type = genomic DNA

SEQ ID NO: 77288 - DNA, 30 bp, Homo sapiens
  misc_feature 1..30: note = chr14:95897683-95897713
  misc_feature 1..30: note = hypo
  source 1..30: mol_type = genomic DNA
ccccttctgtttcctcgcgctgaaagttga

SEQ ID NO: 77289 - DNA, 30 bp, Homo sapiens
  misc_feature 1..30: note = chr14:95899653-95899683
  misc_feature 1..30: note = hypo
  source 1..30: mol_type = genomic DNA
atcttccagctcatccgaggtcccccttgc

SEQ ID NO: 77290 - DNA, 72 bp, Homo sapiens
  misc_feature 1..72: note = chr14:95906284-95906356
  misc_feature 1..72: note = hypo
  source 1..72: mol_type = genomic DNA
gggcccgcctctccccggtgtgcctccagcttttgcgtggtcacaacgatccactgccgcagctccagcagc

SEQ ID NO: 77291 - DNA, 130 bp, Homo sapiens
  misc_feature 1..130: note = chr14:95922717-95922847
  misc_feature 1..130: note = hypo
  source 1..130: mol_type = genomic DNA
ctggcgcctgcaccacggttcttctcccttggcaccattgccacgtgggctggatcgctctgtgctgtgtggggctgtcctgtgcactgtaggatggttttgcagcatccttggccgccacccagaggca

SEQ ID NO: 77292 - DNA, 143 bp, Homo sapiens
  misc_feature 1..143: note = chr14:95927934-95928077
  misc_feature 1..143: note = hypo
  source 1..143: mol_type = genomic DNA
aaaatgggttttcctcgttggagcagtggcctgttctagcatggcaagcagtggcaatgggctctcataggtaaaagtaggggcactaacctgaacctagagaccaatcccaccccgaggccaggcctcgacccccaggaagg

SEQ ID NO: 77293 - DNA, 29 bp, Homo sapiens
  misc_feature 1..29: note = chr14:96342281-96342310
  misc_feature 1..29: note = hyper
  source 1..29: mol_type = genomic DNA
gcccaaagccacattcgccacgctcccgc

SEQ ID NO: 77294 - DNA, 41 bp, Homo sapiens
  misc_feature 1..41: note = chr14:96342590-96342631
  misc_feature 1..41: note = hyper
  source 1..41: mol_type = genomic DNA
tgccgcagcccggctcgcagcgcgcgtcagcgggggctccc

SEQ ID NO: 77295 - DNA, 364 bp, Homo sapiens; identical to SEQ ID NO: 35503
  misc_feature 1..364: note = chr14:96342879-96343243
  misc_feature 1..364: note = hyper
  source 1..364: mol_type = genomic DNA

SEQ ID NO: 77296 - DNA, 116 bp, Homo sapiens; identical to SEQ ID NO: 35504
  misc_feature 1..116: note = chr14:96343319-96343435
  misc_feature 1..116: note = hyper
  source 1..116: mol_type = genomic DNA

SEQ ID NO: 77297 - DNA, 118 bp, Homo sapiens; identical to SEQ ID NO: 12028
  misc_feature 1..118: note = chr14:96343667-96343785
  misc_feature 1..118: note = hyper
  source 1..118: mol_type = genomic DNA

SEQ ID NO: 77298 - DNA, 353 bp, Homo sapiens
  misc_feature 1..353: note = chr14:96505338-96505691
  misc_feature 1..353: note = hyper
  source 1..353: mol_type = genomic DNA
aaagccaggtcactccgatcttggtcctcaggctcgggataacgtgtcagccccaagagagcgctgcccacagccccgggtgggttgggttcaactgcacggggcggggcgccaacagctcaggacttgggttgcaggctggttcttgcaccaaccagcggggcggcctcgggcctcagtttccccatcccgcccacgaagggaggcgattgcgagcgcttggggtttctgacggaccccgccccgggggtggggcggggagtggtcacgtggaggggcgccccgtccgccgagccccgccccaccccgccccgcccgcccccgcgctcggggccctccgcctagtagagatc

SEQ ID NO: 77299 - DNA, 153 bp, Homo sapiens; identical to SEQ ID NO: 35507
  misc_feature 1..153: note = chr14:96505900-96506053
  misc_feature 1..153: note = hyper
  source 1..153: mol_type = genomic DNA

SEQ ID NO: 77300 - DNA, 177 bp, Homo sapiens
  misc_feature 1..177: note = chr14:96506343-96506520
  misc_feature 1..177: note = hyper
  source 1..177: mol_type = genomic DNA
gaaggctctgagacccgctttgtgaccgtgacccgccaagcgtcgacgcgccgcggtcgtttgtcctgttttgctttgtgtagagtctgatggagccaccagtgcccagcgcggccagaacccccccacccccctccccgacacaaacaggctcccagtggccggaaaaacaaatct

SEQ ID NO: 77301 - DNA, 30 bp, Homo sapiens
  misc_feature 1..30: note = chr14:96671088-96671118
  misc_feature 1..30: note = hyper
  source 1..30: mol_type = genomic DNA
gagctcagctggaggcggagggggaagtgc

SEQ ID NO: 77302 - DNA, 39 bp, Homo sapiens; identical to SEQ ID NO: 44091
  misc_feature 1..39: note = chr14:96967321-96967360
  misc_feature 1..39: note = hypo
  source 1..39: mol_type = genomic DNA

SEQ ID NO: 77303 - DNA, 30 bp, Homo sapiens; identical to SEQ ID NO: 44092
  misc_feature 1..30: note = chr14:97045401-97045431
  misc_feature 1..30: note = hypo
  source 1..30: mol_type = genomic DNA

SEQ ID NO: 77304 - DNA, 186 bp, Homo sapiens
  misc_feature 1..186: note = chr14:97058943-97059129
  misc_feature 1..186: note = hyper
  source 1..186: mol_type = genomic DNA
cgcccgggcccgcggattgccgggtcggttctcagtcaccgcacaggtgccctggagagtgcgaccaccccctgccctccgccccgcgccggccctcggctcagtgccccgcccttcctggagcacggcctgcgcatgcgcgcgccccagggcccagccctgttcctgctccggctcctgcgggga

SEQ ID NO: 77305 - DNA, 30 bp, Homo sapiens
  misc_feature 1..30: note = chr14:97081601-97081631
  misc_feature 1..30: note = hypo
  source 1..30: mol_type = genomic DNA
gtgtggtgacagcggcggggtgggtggcat

SEQ ID NO: 77306 - DNA, 184 bp, Homo sapiens
  misc_feature 1..184: note = chr14:97129784-97129968
  misc_feature 1..184: note = hypo
  source 1..184: mol_type = genomic DNA
cccagttctaaacaccgatgccaaggcacctctctgccaagggtcctgtactgtttcctctgcagttttctgagatcttccatgctagtataattcctcaccccactttctcttttagtcccagaaaaatcttcctggcctctcaattgcgagctgcctgcctgacgcccgctccttcctcctc

SEQ ID NO: 77307 - DNA, 109 bp, Homo sapiens; identical to SEQ ID NO: 44093
  misc_feature 1..109: note = chr14:97188235-97188344
  misc_feature 1..109: note = hypo
  source 1..109: mol_type = genomic DNA

SEQ ID NO: 77308 - DNA, 224 bp, Homo sapiens
  misc_feature 1..224: note = chr14:97262648-97262872
  misc_feature 1..224: note = hypo
  source 1..224: mol_type = genomic DNA
aaagaaaagtaaaatcgacaaataaacccccaaagctatgtaaactcattgagggacctgcgcaagtgaggtcctgaagcttacgcttcattggcttcattgttaatctccctctgcctgtgacttcagtgattttgacctagaacaatgacccagtgcccaataagctctcagcctcatgggtgatggagacttagctgattataataaacacaatgcggccg

SEQ ID NO: 77309 - DNA, 140 bp, Homo sapiens
  misc_feature 1..140: note = chr14:97411536-97411676
  misc_feature 1..140: note = hypo
  source 1..140: mol_type = genomic DNA
ttatcagcatggctccgaatcctatatccaccctccagccacaccccgggacactctggatcgaagccacccagcgtcagagcttggacgatcaaggtggacctacccgctcagaaagacagtggcgcttctgtcaaggg

SEQ ID NO: 77310 - DNA, 42 bp, Homo sapiens
  misc_feature 1..42: note = chr14:97431047-97431089
  misc_feature 1..42: note = hypo
  source 1..42: mol_type = genomic DNA
ccctcttgtggattacggtctgtcacgcgacatccattagcg

SEQ ID NO: 77311 - DNA, 350 bp, Homo sapiens
  misc_feature 1..350: note = chr14:97499277-97499627
  misc_feature 1..350: note = hyper
  source 1..350: mol_type = genomic DNA
atgggtctgggagtccgaaggctcgcggaggagagtgtgatgtggggtctgctcccagagcgcgcgcgctgtggctcttggaaggtggggctctgaggaccggggtcctgcgtgcatagacctggagcccaccttaaagacgctgcttcagggacgcttcaacaagccccaacccacccaactgcgtggcgctccccgcctttgggcgccctgttagggttgggggtgacccctgcagcccctcatgtgcgaatccaggttctcctcccctccaggctgcttcctgcacagcagcaccgagcagcagccacctcagggccagggagcccgagctgcgggatccgccgccc

SEQ ID NO: 77312 - skipped

SEQ ID NO: 77313 - DNA, 170 bp, Homo sapiens
  misc_feature 1..170: note = chr14:97524036-97524206
  misc_feature 1..170: note = hypo
  source 1..170: mol_type = genomic DNA
attgatctcttattgcgatgtgatttttaaacagcattaaagtaaacatagtcttattgtgttcgttttactggataacacttatctagacaaaaggaggcacgaagctgccggagctactcagctttacctctaggaaagatacagcgaatcaccgccaataaaacaaa

SEQ ID NO: 77314 - DNA, 30 bp, Homo sapiens
  misc_feature 1..30: note = chr14:97673679-97673709
  misc_feature 1..30: note = hypo
  source 1..30: mol_type = genomic DNA
agcgcaaactgctaacggaacagtgcgctc

SEQ ID NO: 77315 - DNA, 381 bp, Homo sapiens
  misc_feature 1..381: note = chr14:97684916-97685297
  misc_feature 1..381: note = hyper
  source 1..381: mol_type = genomic DNA
tgggggaggagggtccgaaaggaaaggctggtgggggggtggggggaagggccccagtgacgactggattcggaattttcctctcacttcgtggtagtgaagaatttaactacaacagtaacaacactaataattctaaaagccgtgggaggtcagagcgggcgctgcccggcgtcacccctgcagcgtccggatcgctccgcataggcaggggtggtgccccctccccggggcacagaaacgccacatcccgggggcgccgcccagaggctgtctctgtttctgtgtcccttcatgaggctctgtcccacaaaggcagcctgagccaggaccctaaagaggcctggtcatcgggaccggagggagttccgcttcccaggc

SEQ ID NO: 77316 - DNA, 564 bp, Homo sapiens; identical to SEQ ID NO: 35513
  misc_feature 1..564: note = chr14:97685395-97685959
  misc_feature 1..564: note = hyper
  source 1..564: mol_type = genomic DNA

SEQ ID NO: 77317 - DNA, 75 bp, Homo sapiens
  misc_feature 1..75: note = chr14:97708952-97709027
  misc_feature 1..75: note = hypo
  source 1..75: mol_type = genomic DNA
gattcaatgagttcccgatctaaataccaagaggatttcttttttaagataacaacaaatcgattctaaaaaagt

SEQ ID NO: 77318 - DNA, 199 bp, Homo sapiens
  misc_feature 1..199: note = chr14:97791325-97791524
  misc_feature 1..199: note = hypo
  source 1..199: mol_type = genomic DNA
tttcctaaggtgttgcgtttcatttgactctctcctgaaatcgctgctggggtgaatgtctgggtaaaagtggtgccaagggaaggtccagtcttcactggatgggctgcaaagggtcctgggcaggaggggaacccagctgtgttctcgggccatatcagggttcctaatctcttggttacaccgcctctccgaaagt

SEQ ID NO: 77319 - DNA, 35 bp, Homo sapiens
  misc_feature 1..35: note = chr14:97900295-97900330
  misc_feature 1..35: note = hypo
  source 1..35: mol_type = genomic DNA
tctgcatacatgtaacgggtttagaatagtcccta

SEQ ID NO: 77320 - DNA, 123 bp, Homo sapiens
  misc_feature 1..123: note = chr14:98967846-98967969
  misc_feature 1..123: note = hypo
  source 1..123: mol_type = genomic DNA
cctgaccaagcctcacgtcaccttctctgttaagtcctgagtcacctgggtggggccagtcatactacaagctgttccagcagccctggattaacctctgtctctgcacgtgttttactccat

SEQ ID NO: 77321 - DNA, 30 bp, Homo sapiens
  misc_feature 1..30: note = chr14:99529159-99529189
  misc_feature 1..30: note = hypo
  source 1..30: mol_type = genomic DNA
ctgactctcccaccacgaaccttcccctcc

SEQ ID NO: 77322 - DNA, 96 bp, Homo sapiens
  misc_feature 1..96: note = chr14:99532931-99533027
  misc_feature 1..96: note = hypo
  source 1..96: mol_type = genomic DNA
gagggcggtggagggcggcggcccacgtacacaacggcgccttccagctctgggaggcttgctccagagcctggaaacacgcggggcttcccagga

SEQ ID NO: 77323 - DNA, 170 bp, Homo sapiens; identical to SEQ ID NO: 35514
  misc_feature 1..170: note = chr14:99584575-99584745
  misc_feature 1..170: note = hyper
  source 1..170: mol_type = genomic DNA

SEQ ID NO: 77324 - DNA, 30 bp, Homo sapiens
  misc_feature 1..30: note = chr14:99594536-99594566
  misc_feature 1..30: note = hypo
  source 1..30: mol_type = genomic DNA
tgcgagtgtgtctggcgtgtgtgtgcgcag

SEQ ID NO: 77325 - DNA, 30 bp, Homo sapiens; identical to SEQ ID NO: 44096
  misc_feature 1..30: note = chr14:99615561-99615591
  misc_feature 1..30: note = hypo
  source 1..30: mol_type = genomic DNA

SEQ ID NO: 77326 - DNA, 42 bp, Homo sapiens
  misc_feature 1..42: note = chr14:99626459-99626501
  misc_feature 1..42: note = hypo
  source 1..42: mol_type = genomic DNA
agcatgagagggaggcgggaaaacagacggggacgaggcccc

SEQ ID NO: 77327 - DNA, 40 bp, Homo sapiens
  misc_feature 1..40: note = chr14:99640421-99640461
  misc_feature 1..40: note = hypo
  source 1..40: mol_type = genomic DNA
aggtcagcattctctcggttggcaacggttccactgtaca

SEQ ID NO: 77328 - DNA, 30 bp, Homo sapiens
  misc_feature 1..30: note = chr14:99698209-99698239
  misc_feature 1..30: note = hyper
  source 1..30: mol_type = genomic DNA
aggaaggaccccccacgtgggggcctctgg

SEQ ID NO: 77329 - DNA, 58 bp, Homo sapiens
  misc_feature 1..58: note = chr14:99713206-99713264
  misc_feature 1..58: note = hyper
  source 1..58: mol_type = genomic DNA
cttgcaagttgcaaacgtcggggaaaccggaaaattgcagtagcggggaggcaggtgg

SEQ ID NO: 77330 - DNA, 98 bp, Homo sapiens
  misc_feature 1..98: note = chr14:99736115-99736213
  misc_feature 1..98: note = hyper
  source 1..98: mol_type = genomic DNA
ccggccccagcccggcgaggtgcgcggcggattgcaagcatataacctgcccgcggtctcgatggcacccagaggatgttttatttctattgcagtta

SEQ ID NO: 77331 - DNA, 158 bp, Homo sapiens
  misc_feature 1..158: note = chr14:99736273-99736431
  misc_feature 1..158: note = hyper
  source 1..158: mol_type = genomic DNA
gaaagaacggcggggaaatgttcgcgcgcagcgaagaagccgccccgcgggctgcggcgggcggggagcgccgcaaagccaccttcccggtgcaagtgtgcggggactcggggcgggttcccctgcaaacaccgtacctggcccgctcgcgctcgctt

SEQ ID NO: 77332 - DNA, 82 bp, Homo sapiens
  misc_feature 1..82: note = chr14:99736980-99737062
  misc_feature 1..82: note = hyper
  source 1..82: mol_type = genomic DNA
ccgcccctggccctacggctcccccagccggaacgcaccccgctctcctccgcccgcgccgtcagcgcggacccacgcgctc

SEQ ID NO: 77333 - DNA, 385 bp, Homo sapiens
  misc_feature 1..385: note = chr14:99738148-99738533
  misc_feature 1..385: note = hyper
  source 1..385: mol_type = genomic DNA
cgtaccccctcaccccgccccctcaaaaaacccaaagcaatgtaaaactgccccggttcggttgtttctgggttttctgcgggctgcctgtttttgtttttgtttttgttttttctcggagactgacccttccgaggctctggggggacaccaggagaggctccttcccagttcacctggcaggctggcgccggccggaggggctgccgagtccccgcgagcgctccccagcgctcccctggcgccgcgggcccggggggagcggggcggaggggcggctcgcccagtgcgcctgggtcggtgcgggcgcagactgggagctatagattgcaacgtgaagatggcggagtccgggttctctgggagctctcggtctctctatggc

SEQ ID NO: 77334 - DNA, 70 bp, Homo sapiens; identical to SEQ ID NO: 35520
  misc_feature 1..70: note = chr14:99739091-99739161
  misc_feature 1..70: note = hyper
  source 1..70: mol_type = genomic DNA

SEQ ID NO: 77335 - DNA, 414 bp, Homo sapiens
  misc_feature 1..414: note = chr14:99739618-99740032
  misc_feature 1..414: note = hyper
  source 1..414: mol_type = genomic DNA
tcagactgggaaggacgcagctgccttgtcagccgtttgatctccaaccggcgaggacaagaggagttgtggggcctctccgtggcccggggacaaggccagaccacggcccccgtggacaccccccattccccaggctgtggccaactttgtcaatttgatgacctggcctccagggctgggcgcgccacgcggctggcctcctctcccttctcagggtttctctggaggcggccagggcgggtcggggcctggctccggctaggcttcgcgggcgagtccagctgcacccaccccactccgcccccaggcctggctccggcggcttcacccgggcgcatggcgaggccgtgacgcctcagcgccgcctccctcggggccttttcctcggggggcacacgggggtttttgttt

SEQ ID NO: 77336 - DNA, 222 bp, Homo sapiens
  misc_feature 1..222: note = chr14:99740491-99740713
  misc_feature 1..222: note = hyper
  source 1..222: mol_type = genomic DNA
ctttctgagaactagcgatgtgaagcccagagagggtgagcactttgccctaggacacacagcgcgtcagggacaggtctggacccaaaacaccgcggcgtgcctgcagcccagcgccgccggcggtccgggactcgaaatcccgacccacgaccctcaccttcctggggttgattacaaggaaggcagaccccgccagtggcaaggcgggacggggaggac

SEQ ID NO: 77337 - DNA, 30 bp, Homo sapiens; identical to SEQ ID NO: 44098
  misc_feature 1..30: note = chr14:99804005-99804035
  misc_feature 1..30: note = hypo
  source 1..30: mol_type = genomic DNA

SEQ ID NO: 77338 - DNA, 79 bp, Homo sapiens
  misc_feature 1..79: note = chr14:99847959-99848038
  misc_feature 1..79: note = hypo
  source 1..79: mol_type = genomic DNA
ccaccagagccaggacgagcgtgcctgcctgggcatcccaggagccaccagccctaggacccttcggctctcacatctg

SEQ ID NO: 77339 - DNA, 176 bp, Homo sapiens
  misc_feature 1..176: note = chr14:99849887-99850063
  misc_feature 1..176: note = hypo
  source 1..176: mol_type = genomic DNA
ccaccagggctgatccgctgcttgggtggagcacaggcgggaagccctgccccgtctctttgtgagctgtgggtgcgcttggcgagtcacaagcctctctgggcccagttctttctatggaagtcatgggttgcagtgttgttgagggagccggtggtgcacgtggtgaagacctg

SEQ ID NO: 77340 - DNA, 30 bp, Homo sapiens
  misc_feature 1..30: note = chr14:99889404-99889434
  misc_feature 1..30: note = hypo
  source 1..30: mol_type = genomic DNA
atcaaagagaaaatccgcaacactgtccct

SEQ ID NO: 77341 - DNA, 30 bp, Homo sapiens
  misc_feature 1..30: note = chr14:99891695-99891725
  misc_feature 1..30: note = hypo
  source 1..30: mol_type = genomic DNA
cgaaaggcctgccagcgggcactgggagct

SEQ ID NO: 77342 - DNA, 30 bp, Homo sapiens
  misc_feature 1..30: note = chr14:99891938-99891968
  misc_feature 1..30: note = hypo
  source 1..30: mol_type = genomic DNA
cagaagggattatctcgctctaagcaaggc

SEQ ID NO: 77343 - DNA, 28 bp, Homo sapiens
  misc_feature 1..28: note = chr15:100274301-100274329
  misc_feature 1..28: note = hypo
  source 1..28: mol_type = genomic DNA
gcggtggctcacgcccgtaatcccagca

SEQ ID NO: 77344 - DNA, 39 bp, Homo sapiens
  misc_feature 1..39: note = chr15:100346202-100346241
  misc_feature 1..39: note = hyper
  source 1..39: mol_type = genomic DNA
cagccctttcccaggcggtagcggggacggtggtgctgt

SEQ ID NO: 77345 - DNA, 60 bp, Homo sapiens
  misc_feature 1..60: note = chr15:100378951-100379011
  misc_feature 1..60: note = hypo
  source 1..60: mol_type = genomic DNA
gcaatgctgccagagcggcagctacaactctatgattgaaggcatcgccctcctggttct

SEQ ID NO: 77346 - DNA, 24 bp, Homo sapiens
  misc_feature 1..24: note = chr15:100426310-100426334
  misc_feature 1..24: note = hypo
  source 1..24: mol_type = genomic DNA
aggcacggtggatcacgccggtaa

SEQ ID NO: 77347 - DNA, 586 bp, Homo sapiens
  misc_feature 1..586: note = chr15:100881258-100881844
  misc_feature 1..586: note = hyper
  source 1..586: mol_type = genomic DNA
gccgcaggcgctgagcgagacgagggagccggggtggccgagcacacggcccgagtagaagcacagctcggcggggcggccgcggcgccgggccgcgcccgcctcctccacctcgaagcctcgggacaggaagcgcaggtcgcggcgcagctgaaggtacaggtcgcgcccgaaggccggcaggtgcagcagcagggcgcgctctccgggccgggcgcgcggggcggctgggggcgtgcgggggcgtcgccgccgtcggggcccgggggctgcgggcagcggcggcaggtgcacgtcgtcggggcgcacccgccacgggagcaccacctccacgtcggccgccgcgtcgccgacagctgcggggagagaggagacgcgtcagcgcggcggggcccgcccggacgcccgccctcccgctggccgccagccgcgccagcgcggggacagcgcgacccggagccggcgctgccttcccttccctcgcccggcacctccacgctggcccgcgccacccggggagggtctccggcgcagccgcgcgagcacctcccggaacggcgccgcgcatcggcgagcggagacccgg

SEQ ID NO: 77348 - DNA, 126 bp, Homo sapiens; identical to SEQ ID NO: 35980
  misc_feature 1..126: note = chr15:100881966-100882092
  misc_feature 1..126: note = hyper
  source 1..126: mol_type = genomic DNA

SEQ ID NO: 77349 - DNA, 30 bp, Homo sapiens; identical to SEQ ID NO: 44383
  misc_feature 1..30: note = chr15:100888957-100888987
  misc_feature 1..30: note = hypo
  source 1..30: mol_type = genomic DNA

SEQ ID NO: 77350 - DNA, 173 bp, Homo sapiens; identical to SEQ ID NO: 35981
  misc_feature 1..173: note = chr15:100913423-100913596
  misc_feature 1..173: note = hyper
  source 1..173: mol_type = genomic DNA

SEQ ID NO: 77351 - DNA, 40 bp, Homo sapiens
  misc_feature 1..40: note = chr15:100914039-100914079
  misc_feature 1..40: note = hyper
  source 1..40: mol_type = genomic DNA
cgggagggagggagcagtgggcggccggggagcctggcag

SEQ ID NO: 77352 - DNA, 30 bp, Homo sapiens
  misc_feature 1..30: note = chr15:101089996-101090026
  misc_feature 1..30: note = hypo
  source 1..30: mol_type = genomic DNA
acgtgatcatctatgcggaaattttggaat

SEQ ID NO: 77353 - DNA, 30 bp, Homo sapiens
  misc_feature 1..30: note = chr15:101417814-101417844
  misc_feature 1..30: note = hypo
  source 1..30: mol_type = genomic DNA
ctccacccctcctgccgatgggagcagagg

SEQ ID NO: 77354 - DNA, 30 bp, Homo sapiens
  misc_feature 1..30: note = chr15:101419441-101419471
  misc_feature 1..30: note = hyper
  source 1..30: mol_type = genomic DNA
gtggggcgcagcgggcgtctgtcctgctag

SEQ ID NO: 77355 - DNA, 36 bp, Homo sapiens
  misc_feature 1..36: note = chr15:101420348-101420384
  misc_feature 1..36: note = hyper
  source 1..36: mol_type = genomic DNA
cggctctccagaaaccgcacctttcgcgggacgtct

SEQ ID NO: 77356 - DNA, 240 bp, Homo sapiens; identical to SEQ ID NO: 35984
  misc_feature 1..240: note = chr15:101420425-101420665
  misc_feature 1..240: note = hyper
  source 1..240: mol_type = genomic DNA

SEQ ID NO: 77357 - DNA, 126 bp, Homo sapiens; identical to SEQ ID NO: 35985
  misc_feature 1..126: note = chr15:101420734-101420860
  misc_feature 1..126: note = hyper
  source 1..126: mol_type = genomic DNA

SEQ ID NO: 77358 - DNA, 32 bp, Homo sapiens
  misc_feature 1..32: note = chr15:101420971-101421003
  misc_feature 1..32: note = hyper
  source 1..32: mol_type = genomic DNA
cggcgagattacctgcccggggcagaaaggaa

SEQ ID NO: 77359 - DNA, 243 bp, Homo sapiens
  misc_feature 1..243: note = chr15:101459070-101459313
  misc_feature 1..243: note = hyper
  source 1..243: mol_type = genomic DNA
atgcaaattgcaggtcgttaacgctttagaacgacacatttctgtatcgccccgtgaagagctctacgcacatgaatgttccccgtctgtttaactgttacggccgcagtgtgtgggccgcaggcgcgctgggggctcatctgctgattttgctgcccctggagcagagggatagcgaaagcggggctgagcgcagcacggaccgatcccatcgccgcgctcgccccgcgtggaggcagccgg

SEQ ID NO: 77360 - DNA, 329 bp, Homo sapiens
  misc_feature 1..329: note = chr15:101460006-101460335
  misc_feature 1..329: note = hyper
  source 1..329: mol_type = genomic DNA
acgagtcgggagacacgagccggggagcccataggtttcctctgcctttggagcgaacccagtcccttagcggggagcgggcggagtgtgagcgcgcgggtgagcccgtgccggggtgtcggcaagagaccgcccgggagcctctcgctggtccggggcttcctggggttgcggggcggcccagcgaggcttcaccctcctcgatgtctgggtcacgcttcttgcccaggtggtctctggctggcgcagatacaactgctctgtctaccatggtctctgcaagctacaggggaccttcctggcaggcagggacgcgggaaggaagccta

SEQ ID NO: 77361 - DNA, 64 bp, Homo sapiens
  misc_feature 1..64: note = chr15:101513805-101513869
  misc_feature 1..64: note = hyper
  source 1..64: mol_type = genomic DNA
ggtgccttcgcagcggccccggttgggttgcgggtcgcggggcggcgagcgcagggagcgtcgc

SEQ ID NO: 77362 - DNA, 30 bp, Homo sapiens
  misc_feature 1..30: note = chr15:101535285-101535315
  misc_feature 1..30: note = hypo
  source 1..30: mol_type = genomic DNA
tcagggcacgtgtgacggaggttgttgctc

SEQ ID NO: 77363 - DNA, 34 bp, Homo sapiens
  misc_feature 1..34: note = chr15:101558833-101558867
  misc_feature 1..34: note = hypo
  source 1..34: mol_type = genomic DNA
agcaccataggactacgcgcggtaccaatgctct

SEQ ID NO: 77364 - DNA, 30 bp, Homo sapiens
  misc_feature 1..30: note = chr15:101633788-101633818
  misc_feature 1..30: note = hypo
  source 1..30: mol_type = genomic DNA
gcctggccctctgggcgagcttattattga

SEQ ID NO: 77365 - DNA, 126 bp, Homo sapiens
  misc_feature 1..126: note = chr15:101785815-101785941
  misc_feature 1..126: note = hypo
  source 1..126: mol_type = genomic DNA
caatggaaacagtcacgcacaatccgctattgacagccacatctatccctggaatcaatccgctattgacagccacagccatccctggaaatccctggaatattgtttgagcgcttcaagatcttg

SEQ ID NO: 77366 - DNA, 30 bp, Homo sapiens
  misc_feature 1..30: note = chr15:101889834-101889864
  misc_feature 1..30: note = hypo
  source 1..30: mol_type = genomic DNA
aacctacacaggctgcgtgagaaatttcat

SEQ ID NO: 77367 - DNA, 151 bp, Homo sapiens
  misc_feature 1..151: note = chr15:102028841-102028992
  misc_feature 1..151: note = hyper
  source 1..151: mol_type = genomic DNA
tgccaaaggtcacaccgctcggccatcagaaccgcggcagaagcccccacacaaagcgccctccctccgctcctggagaggttttaaacccaggacccccggccctgcgctgtcccaaggcctctccgacggcggccgggctccagggtgc

SEQ ID NO: 77368 - DNA, 374 bp, Homo sapiens
  misc_feature 1..374: note = chr15:102042955-102043329
  misc_feature 1..374: note = hypo
  source 1..374: mol_type = genomic DNA
gacaggccagcaggccgccgggagcaggcagagtcaggaattccatgtccgtgacctgagagccgcaccactccacctcctgggcctcactccgccctatacacgcgcacacttaatgacatctctgatcatgtcttcaggacgcataccctctttgacttgaaaaagtaacaactgtttgtggccttctcacaggccgaaaagaacaagcggggtccagtggagaaaggtgaggcatgggaaggcctggcccgagcactgtgacttcagcgaggcaccctccacccctctcagctttcctggtctgaaagtagaatttcgccagagggtgagccgacaggtagagctgtttccacctgcgtgtgctgcctgtg

SEQ ID NO: 77369 - DNA, 40 bp, Homo sapiens
  misc_feature 1..40: note = chr15:102043695-102043735
  misc_feature 1..40: note = hypo
  source 1..40: mol_type = genomic DNA
catgaacaaagaatacgggccgggcacggtggctcatgcc

SEQ ID NO: 77370 - DNA, 47 bp, Homo sapiens
  misc_feature 1..47: note = chr15:102096642-102096689
  misc_feature 1..47: note = hypo
  source 1..47: mol_type = genomic DNA
gaggggtctgggttccgggtcccaggtacgttcgtccacagcatcac

SEQ ID NO: 77371 - DNA, 160 bp, Homo sapiens
  misc_feature 1..160: note = chr15:102154203-102154363
  misc_feature 1..160: note = hypo
  source 1..160: mol_type = genomic DNA
gggctccccagtccccgcagcagcattttcctctgactctcagggccctgctctgccttctgtgctcagcagttgtttcggattgggagtcaggaggccattcccacacttgaaacaaggctgcaagaggaggctgagcagaaaccgcacaccccgaggg

SEQ ID NO: 77372 - DNA, 22 bp, Homo sapiens
  misc_feature 1..22: note = chr15:102193729-102193751
  misc_feature 1..22: note = hypo
  source 1..22: mol_type = genomic DNA
gagactccgtctcaaaaaataa

SEQ ID NO: 77373 - DNA, 30 bp, Homo sapiens
  misc_feature 1..30: note = chr15:102270624-102270654
  misc_feature 1..30: note = hypo
  source 1..30: mol_type = genomic DNA
gggatctgtccaggacggcaccaagccatt

SEQ ID NO: 77374 - DNA, 30 bp, Homo sapiens; identical to SEQ ID NO: 44386
  misc_feature 1..30: note = chr15:102276370-102276400
  misc_feature 1..30: note = hypo
  source 1..30: mol_type = genomic DNA

SEQ ID NO: 77375 - DNA, 39 bp, Homo sapiens
  misc_feature 1..39: note = chr15:102306422-102306461
  misc_feature 1..39: note = hypo
  source 1..39: mol_type = genomic DNA
ctttcccaggagcctcgccatacccgcacctgtgccctc

SEQ ID NO: 77376 - DNA, 39 bp, Homo sapiens
  misc_feature 1..39: note = chr15:20499470-20499509
  misc_feature 1..39: note = hypo
  source 1..39: mol_type = genomic DNA
ttaggagaaacaggccgagcgcgctgactcacgcctgta

SEQ ID NO: 77377 - DNA, 35 bp, Homo sapiens; identical to SEQ ID NO: 44204
  misc_feature 1..35: note = chr15:22515501-22515536
  misc_feature 1..35: note = hypo
  source 1..35: mol_type = genomic DNA

SEQ ID NO: 77378 - DNA, 36 bp, Homo sapiens
  misc_feature 1..36: note = chr15:22587476-22587512
  misc_feature 1..36: note = hypo
  source 1..36: mol_type = genomic DNA
tgatgcttggccaggcgcggtggctcacgcctgtaa

SEQ ID NO: 77379 - DNA, 20 bp, Homo sapiens
  misc_feature 1..20: note = chr15:22792239-22792259
  misc_feature 1..20: note = hypo
  source 1..20: mol_type = genomic DNA
gccaccgctcctggccagga

SEQ ID NO: 77380 - DNA, 36 bp, Homo sapiens
  misc_feature 1..36: note = chr15:22822348-22822384
  misc_feature 1..36: note = hypo
  source 1..36: mol_type = genomic DNA
taaagttccaggatacggccgggcgcggtggctcat

SEQ ID NO: 77381 - DNA, 93 bp, Homo sapiens
  misc_feature 1..93: note = chr15:22876959-22877052
  misc_feature 1..93: note = hypo
  source 1..93: mol_type = genomic DNA
aggaatttttaaatgcgtccacgcagagatttgtatctgaatattcataagagctaaaagctagaaacatcctgatgacggtgaagaggtaga

SEQ ID NO: 77382 - DNA, 197 bp, Homo sapiens
  misc_feature 1..197: note = chr15:22977051-22977248
  misc_feature 1..197: note = hypo
  source 1..197: mol_type = genomic DNA
gcagtactcactgggcgtgccctaatacgattatagtcaattggaggaaaggatgcttgttggaaggatgtgcagggcaaagtctgggaggtttccatgtgcaaagctttccctgtcctcagggacgcatcaccctccgagctctgaggtgggacgctcctcagggtactgccagccaggggcgctcacttgggctg

SEQ ID NO: 77383 - DNA, 25 bp, Homo sapiens
  misc_feature 1..25: note = chr15:23035596-23035621
  misc_feature 1..25: note = hypo
  source 1..25: mol_type = genomic DNA
tttgagacagagtctcgctctgtcg

SEQ ID NO: 77384 - DNA, 20 bp, Homo sapiens
  misc_feature 1..20: note = chr15:23084842-23084862
  misc_feature 1..20: note = hypo
  source 1..20: mol_type = genomic DNA
ccggccgcaagatgttcttc

SEQ ID NO: 77385 - DNA, 19 bp, Homo sapiens
  misc_feature 1..19: note = chr15:23087577-23087596
  misc_feature 1..19: note = hypo
  source 1..19: mol_type = genomic DNA
tttgagacagagtctcgct

SEQ ID NO: 77386 - DNA, 264 bp, Homo sapiens
  misc_feature 1..264: note = chr15:23158318-23158582
  misc_feature 1..264: note = hyper
  source 1..264: mol_type = genomic DNA
acccccgaaatgcgccgggcgggtcaccgcaccccgagatgtgcccccaaggctctttcgaccgccgtgaagtggcgggcccccttgaagtggccggcggctgcccggctccctcgaggcgcctccctggcgctcgcaggggcctcgcagagccggcggggatcccaccgcggctcagtgtctagggccggtcccggcagccctctctcccgcccggctccgcaggtcctagcgtccccctcccccccgcgcccctgcaggccc

SEQ ID NO: 77387 - DNA, 145 bp, Homo sapiens
  misc_feature 1..145: note = chr15:23182506-23182651
  misc_feature 1..145: note = hypo
  source 1..145: mol_type = genomic DNA
tcaagcagggagcagcggccagccccttccctcgcagtccatgaatgatttggacagcgccttggtgccggtgatccatggaggggcctgccagctcagccctgtcgtcatggaactcattttttatattctggaagccgggcgc

SEQ ID NO: 77388 - DNA, 39 bp, Homo sapiens
  misc_feature 1..39: note = chr15:23217780-23217819
  misc_feature 1..39: note = hypo
  source 1..39: mol_type = genomic DNA
ctgggattacaggctgagccaccgcgccctgccctggga

SEQ ID NO: 77389 - DNA, 127 bp, Homo sapiens
  misc_feature 1..127: note = chr15:23662038-23662165
  misc_feature 1..127: note = hypo
  source 1..127: mol_type = genomic DNA
tgccagtgagagctccgcgaggcctggcccgagatgtggctggcgtgaggggtcccggacctgctgtggtggggacgcacccagttctgtggcgcttggtccagcgaggactcgagcccactgggga

SEQ ID NO: 77390 - DNA, 174 bp, Homo sapiens
  misc_feature 1..174: note = chr15:24515033-24515207
  misc_feature 1..174: note = hypo
  source 1..174: mol_type = genomic DNA
taacaggaagccgagcgaggagcacaaagtgcttccagagactaggtgatgggccacatccctggccagtgtgttgaccccctgaaccaaagtctgtgcgaccaacacctttgcctgtctgccccagttttctgagcatgtgctccactgacacatatgcgccaggccgccagc

SEQ ID NO: 77391 - DNA, 113 bp, Homo sapiens
  misc_feature 1..113: note = chr15:25334863-25334976
  misc_feature 1..113: note = hypo
  source 1..113: mol_type = genomic DNA
ttctctgcacctccccggtggtgttggtataaaaagcaggcttacatcagcaagggatgattgtcgtctcatgcgatcctgggagatggcagaagtcccgggacacatggagt

SEQ ID NO: 77392 - DNA, 150 bp, Homo sapiens
  misc_feature 1..150: note = chr15:25449793-25449943
  misc_feature 1..150: note = hypo
  source 1..150: mol_type = genomic DNA
ttgtccctgagtacccgttctcccctgtgtctttcagtgagctcttctgcccaggtggtccccctggtcttgatgggcataggtgagtacatcctgctggtgtcctggtccatgagccagggtgcgtacggttgccggaggtcaccttta

SEQ ID NO: 77393 - DNA, 182 bp, Homo sapiens
  misc_feature 1..182: note = chr15:25477788-25477970
  misc_feature 1..182: note = hypo
  source 1..182: mol_type = genomic DNA
ccgggtctctggggacggggcacattggaggctccttcctgagcccccattctctcctgtgtctttcagtgagctcttcggcccaagtggtccccccggccttaagcggcataggtgagtgcatcctgttttgatcatgggccatgagtgttgcagcatggggtccccgacattcagccttc

SEQ ID NO: 77394 - DNA, 32 bp, Homo sapiens; identical to SEQ ID NO: 35581
  misc_feature 1..32: note = chr15:25915272-25915304
  misc_feature 1..32: note = hyper
  source 1..32: mol_type = genomic DNA

SEQ ID NO: 77395 - DNA, 350 bp, Homo sapiens
  misc_feature 1..350: note = chr15:26107394-26107744
  misc_feature 1..350: note = hyper
  source 1..350: mol_type = genomic DNA
accactgtgcctggccgaagactgaggcagggacttcaggccagggggccaggctggcttttcctgcctttcacttcaggtgggagcggctgtggatgaggatgtccagcggccgtcggtttctagccttgggatcattctggccccgacacggagtgacaggggatccccacgcgtccccgcatccagggcgcccctttagctgcggcggaggcacagagaggccttggcggcgctgtggcttcggtcggcaccgggtcccgcgcagccgggccctccaccctgagtggagctgccttctaagcacccagcccctgccaatcactgtgcccaacaccaagttcccgggg

SEQ ID NO: 77396 - DNA, 482 bp, Homo sapiens; identical to SEQ ID NO: 4188
  misc_feature 1..482: note = chr15:26107845-26108327
  misc_feature 1..482: note = hyper
  source 1..482: mol_type = genomic DNA

SEQ ID NO: 77397 - DNA, 283 bp, Homo sapiens; identical to SEQ ID NO: 35584
  misc_feature 1..283: note = chr15:26108548-26108831
  misc_feature 1..283: note = hyper
  source 1..283: mol_type = genomic DNA

SEQ ID NO: 77398 - DNA, 30 bp, Homo sapiens
  misc_feature 1..30: note = chr15:26147501-26147531
  misc_feature 1..30: note = hypo
  source 1..30: mol_type = genomic DNA
atagggctgatgcatcgcagtgtccacata

SEQ ID NO: 77399 - DNA, 30 bp, Homo sapiens
  misc_feature 1..30: note = chr15:26234528-26234558
  misc_feature 1..30: note = hypo
  source 1..30: mol_type = genomic DNA
gttctgagccctccacgtggcacctgggcg

SEQ ID NO: 77400 - DNA, 235 bp, Homo sapiens
  misc_feature 1..235: note = chr15:26327329-26327564
  misc_feature 1..235: note = hyper
  source 1..235: mol_type = genomic DNA
aggcttataaatttacgagtttcactgtgttccaaaagaaaggtccagtcattcccacaccgggagtcgaacccgggccgcctgggtgaaaaccaggaatcctaaccgctagaccatgtgggagatgacaagtaaccgttgaattctaaaccaattgaatcatttccgcctgcccttgctttccgccttctgccacgcctccgacaacaaatccctgtctgcgcctgcgcctgcg

SEQ ID NO: 77401 - DNA, 299 bp, Homo sapiens; identical to SEQ ID NO: 35586
  misc_feature 1..299: note = chr15:26327610-26327909
  misc_feature 1..299: note = hyper
  source 1..299: mol_type = genomic DNA

SEQ ID NO: 77402 - DNA, 35 bp, Homo sapiens
  misc_feature 1..35: note = chr15:26869355-26869390
  misc_feature 1..35: note = hypo
  source 1..35: mol_type = genomic DNA
tttcgctggtgtgggcggtgcgctggaactgaggc

SEQ ID NO: 77403 - DNA, 30 bp, Homo sapiens; identical to SEQ ID NO: 12083
  misc_feature 1..30: note = chr15:27016662-27016692
  misc_feature 1..30: note = hyper
  source 1..30: mol_type = genomic DNA

SEQ ID NO: 77404 - DNA, 36 bp, Homo sapiens
  misc_feature 1..36: note = chr15:27016983-27017019
  misc_feature 1..36: note = hyper
  source 1..36: mol_type = genomic DNA
agagactggcggtgccgggcccgggtctcccagtcc

SEQ ID NO: 77405 - DNA, 174 bp, Homo sapiens
  misc_feature 1..174: note = chr15:27017654-27017828
  misc_feature 1..174: note = hyper
  source 1..174: mol_type = genomic DNA
ggcgcggggcgcgggcggctctgaggactgggggctatcccaggaggggcgcgggcgaagggcccccactcccacccgccgctgctccgcggatgcggcccccgcctccctccgcccaggccgccgccgccgtgggtcgcgcttcccgcaacggccgcgcgcagcccacttacc

SEQ ID NO: 77406 - DNA, 45 bp, Homo sapiens; identical to SEQ ID NO: 35589
  misc_feature 1..45: note = chr15:27018284-27018329
  misc_feature 1..45: note = hyper
  source 1..45: mol_type = genomic DNA

SEQ ID NO: 77407 - DNA, 130 bp, Homo sapiens
  misc_feature 1..130: note = chr15:27018746-27018876
  misc_feature 1..130: note = hyper
  source 1..130: mol_type = genomic DNA
gcctcccgacggtgcctgcagaacgccgggaagcccccgcctcacctgcggggctcagagcctcgggtccccagggtccaggagagccagatgggcagcaggagctccaggagcccggagcacatggcgc

SEQ ID NO: 77408 - DNA, 17 bp, Homo sapiens
  misc_feature 1..17: note = chr15:27079519-27079536
  misc_feature 1..17: note = hypo
  source 1..17: mol_type = genomic DNA
ggagtcttgctctgtcg

SEQ ID NO: 77409 - DNA, 146 bp, Homo sapiens; identical to SEQ ID NO: 35591
  misc_feature 1..146: note = chr15:27111977-27112123
  misc_feature 1..146: note = hyper
  source 1..146: mol_type = genomic DNA

SEQ ID NO: 77410 - DNA, 22 bp, Homo sapiens
  misc_feature 1..22: note = chr15:27112921-27112943
  misc_feature 1..22: note = hyper
  source 1..22: mol_type = genomic DNA
ctcgcggggtggactcggaccc

SEQ ID NO: 77411 - DNA, 124 bp, Homo sapiens
  misc_feature 1..124: note = chr15:27113012-27113136
  misc_feature 1..124: note = hyper
  source 1..124: mol_type = genomic DNA
cgcgctcccagcccaggaggaaggcgctgcctggcggagcgcttggctcgtacccggggcaggagcaggggaagtctgcgaaagccgggagcgagccggggagggccggggagctggagaccct

SEQ ID NO: 77412 - DNA, 195 bp, Homo sapiens
  misc_feature 1..195: note = chr15:27113215-27113410
  misc_feature 1..195: note = hyper
  source 1..195: mol_type = genomic DNA
cgcgcccacctgccctggcgcgccggccctggtgagcctctgtgggggtccggagggtcgtgggagcgcagcctctcctgggggtccctggctcggggctgaggggcggcgggaggcgccgcccgggtttcccgcatgcagcgccgcgtgctcgccgcctggctctggcccgggccccgcgacgagccccccgga

SEQ ID NO: 77413 - DNA, 147 bp, Homo sapiens
  misc_feature 1..147: note = chr15:27113477-27113624
  misc_feature 1..147: note = hyper
  source 1..147: mol_type = genomic DNA
cgaggtggaagtacctgttgtgtctcccaattccggagtttgcgggggatgggggttgggggggcttcttgggaaaatgcttcttttcgaagcatactgttcggatgcctgtgagcacctatttgcgttatgcgcatactgagaaat

SEQ ID NO: 77414 - DNA, 610 bp, Homo sapiens
  misc_feature 1..610: note = chr15:27212788-27213398
  misc_feature 1..610: note = hyper
  source 1..610: mol_type = genomic DNA
ttgacaagggaaaggcgctttttcaaaatataaaaccacgaaacatcatgtaacccagaagtacagttttgggagtgggagagatgtttctcaaagcagaacctggggcaaccacggagcagcggatgcgcgctgaagggcgcgtgggcagcggggtggttccgcggcctgcggggcgcagcgcgccaccgcgggatctgaaaggcgcttcctggcaacgctgctagggtcccgccgcccccgccgaggtgaagtccaacccgcagctgcgcgggcagcccaggtcttccccagaacctccggagccgaggacccagcgccaagccaggagcaaagcagcgcgccaggctggagctgttccgtcattaccgccacgtctgcgcttcggttgtgagaaccgattcgttaccctaacctcttaggactaagagccagtcttctggtggcgctcgctttcacttactttttatttccctttctattcccgcgagctagggggagaaagtgtaaatcccgcccgcttctccagggctgaaaatggagaggctgaggcggcttggagagtgcgcactgcgcatgctccgcagagcatccccgcaggtcaaccggg

SEQ ID NO: 77415 - DNA, 177 bp, Homo sapiens; identical to SEQ ID NO: 35595
  misc_feature 1..177: note = chr15:27216067-27216244
  misc_feature 1..177: note = hyper
  source 1..177: mol_type = genomic DNA

SEQ ID NO: 77416 - DNA, 94 bp, Homo sapiens
  misc_feature 1..94: note = chr15:27216830-27216924
  misc_feature 1..94: note = hyper
  source 1..94: mol_type = genomic DNA
cggctgggctgcggcacggcgggccgggaggggactgggaagtcggtctgcacctcacctgtcccagctcccttggacacggtcatctgctttt

SEQ ID NO: 77417 - DNA, 30 bp, Homo sapiens; identical to SEQ ID NO: 35597
  misc_feature 1..30: note = chr15:27603952-27603982
  misc_feature 1..30: note = hyper
  source 1..30: mol_type = genomic DNA

SEQ ID NO: 77418 - DNA, 30 bp, Homo sapiens
  misc_feature 1..30: note = chr15:27884112-27884142
  misc_feature 1..30: note = hypo
  source 1..30: mol_type = genomic DNA
ctgcactacccagcccggaaaacttttttc

SEQ ID NO: 77419 - DNA, 30 bp, Homo sapiens
  misc_feature 1..30: note = chr15:28016476-28016506
  misc_feature 1..30: note = hypo
  source 1..30: mol_type = genomic DNA
gcgctatagagaggacgggccctgcctgcg

SEQ ID NO: 77420 - DNA, 34 bp, Homo sapiens
  misc_feature 1..34: note = chr15:28051056-28051090
  misc_feature 1..34: note = hypo
  source 1..34: mol_type = genomic DNA
gagcaccctggcctccgcccgcctccaggccgaa

SEQ ID NO: 77421 - DNA, 30 bp, Homo sapiens
  misc_feature 1..30: note = chr15:28076464-28076494
  misc_feature 1..30: note = hypo
  source 1..30: mol_type = genomic DNA
cagtgagtccaggctcgcccctggaataaa

SEQ ID NO: 77422 - DNA, 32 bp, Homo sapiens
  misc_feature 1..32: note = chr15:28114883-28114915
  misc_feature 1..32: note = hypo
  source 1..32: mol_type = genomic DNA
cattggctgggacagcgcggagtctcctgtgg

SEQ ID NO: 77423 - DNA, 170 bp, Homo sapiens
  misc_feature 1..170: note = chr15:28339763-28339933
  misc_feature 1..170: note = hyper
  source 1..170: mol_type = genomic DNA
caaccccaaatcgttcgtgtgggctactgccggccctctctccggctctgcgctctttctgcctgcaaccgtgcccccgaactcgggccctgcgaggtgggggtgggcccgggcccctcctgccgcccctgctgccagcaccgttctctccgaggccctcaacgccccgc

SEQ ID NO: 77424 - DNA, 80 bp, Homo sapiens
  misc_feature 1..80: note = chr15:28339954-28340034
  misc_feature 1..80: note = hyper
  source 1..80: mol_type = genomic DNA
cgccagacgctcaccaagcctgcccgagccccgcctcccgcagccgtgcccagggcggagtggggcgacggcaccggtgc

SEQ ID NO: 77425 - DNA, 268 bp, Homo sapiens
  misc_feature 1..268: note = chr15:28340309-28340577
  misc_feature 1..268: note = hyper
  source 1..268: mol_type = genomic DNA
cacggctgagtgctccgggcatggtgggtctgcgggactcggagcagagctcgagctggcggatccccggttggcgcccggcgggagggcaggagtggcccagccaggccgccctgcgcactccccgcccgggtgcgcccgggggaccgcggccctcccaccccgcccctgtgaaacgacagccggcagcaggcgccgcacgccgacttcacagtggcggcgatcaacagcgtgtggaaaacagcttcttcgtaaatcttaagaacat

SEQ ID NO: 77426 - DNA, 28 bp, Homo sapiens
  misc_feature 1..28: note = chr15:28340877-28340905
  misc_feature 1..28: note = hyper
  source 1..28: mol_type = genomic DNA
gaacattgttcttcgagttctttaaata

SEQ ID NO: 77427 - DNA, 360 bp, Homo sapiens
  misc_feature 1..360: note = chr15:28341620-28341980
  misc_feature 1..360: note = hyper
  source 1..360: mol_type = genomic DNA
gcaggagaagccctgcggccaagaaggcctgaagaagcccgtccaggggtcagcctcctcctcagccggtcctgggctgagacaggggtgtcccgctgagggcagtgtagggtgcggtgcccccaccccacttcgggcctggaccgagaccgcgagtgtgaccgtatatcccttcaggtggatttttcaacatgtgaacttggttaaaagcttctagaacgttaagccaaacatcgtggctttccatccgttttctgttcttgtttgaaagagtacgcctccttccagcctgggaggaggggcggggcccgggagagggcctcgggaggccgcgggtgggctctgccgagggccgcgttc

SEQ ID NO: 77428 - DNA, 39 bp, Homo sapiens; identical to SEQ ID NO: 1196
  misc_feature 1..39: note = chr15:28341981-28342020
  misc_feature 1..39: note = hyper
  source 1..39: mol_type = genomic DNA

SEQ ID NO: 77429 - DNA, 40 bp, Homo sapiens; identical to SEQ ID NO: 35602
  misc_feature 1..40: note = chr15:28342521-28342561
  misc_feature 1..40: note = hyper
  source 1..40: mol_type = genomic DNA

SEQ ID NO: 77430 - DNA, 85 bp, Homo sapiens
  misc_feature 1..85: note = chr15:28344103-28344188
  misc_feature 1..85: note = hyper
  source 1..85: mol_type = genomic DNA
tggcccaccagggggcgactttttcctgggtcgcctggcagagagccggagggggtgctcagggggcagctgctgcaggcccagg

SEQ ID NO: 77431 - DNA, 127 bp, Homo sapiens
  misc_feature 1..127: note = chr15:28344223-28344350
  misc_feature 1..127: note = hyper
  source 1..127: mol_type = genomic DNA
cgtctgtgcacactaacctttaggggaacttgccttgcttcctaagccgcgactcagccggggctgtgtaaaccctccctgcctgttcccaggctagtctggctcctcgcctccttcctcccgaccg

SEQ ID NO: 77432 - DNA, 281 bp, Homo sapiens
  misc_feature 1..281: note = chr15:28344411-28344692
  misc_feature 1..281: note = hyper
  source 1..281: mol_type = genomic DNA
cgcacctccgctctggatggtgagcggagcacagccttcgaagtaagaactcagagggagctcggcgctcccgcagcgggtcccccacccaggcacgcccccggcccggccccgcccacagcactccccactcggccccgcccacagtgcggccacgcccgtagcacgcccctcccggccacgcccacaaagctgcccacatggccccgcccacagctcgcccgctccgcacccccggcccctcagctccccagcccccggcggcgcgggctgagagcagc

SEQ ID NO: 77433 - DNA, 115 bp, Homo sapiens
  misc_feature 1..115: note = chr15:28346156-28346271
  misc_feature 1..115: note = hypo
  source 1..115: mol_type = genomic DNA
gacactgttacagggcgggaaggggctggggcacagagcccgggggaggctccctgagtgggcagaaggctcttggtgtgcacgcagatctgtcgaaatgcgggctttgaaacgc

SEQ ID NO: 77434 - DNA, 340 bp, Homo sapiens; identical to SEQ ID NO: 35606
  misc_feature 1..340: note = chr15:28351758-28352098
  misc_feature 1..340: note = hyper
  source 1..340: mol_type = genomic DNA

SEQ ID NO: 77435 - DNA, 22 bp, Homo sapiens
  misc_feature 1..22: note = chr15:28352099-28352121
  misc_feature 1..22: note = hyper
  source 1..22: mol_type = genomic DNA
ggctctggccccacggtgagcc

SEQ ID NO: 77436 - DNA, 270 bp, Homo sapiens; identical to SEQ ID NO: 4194
  misc_feature 1..270: note = chr15:28352152-28352422
  misc_feature 1..270: note = hyper
  source 1..270: mol_type = genomic DNA

SEQ ID NO: 77437 - DNA, 102 bp, Homo sapiens
  misc_feature 1..102: note = chr15:28352957-28353059
  misc_feature 1..102: note = hyper
  source 1..102: mol_type = genomic DNA
cgacaggcggggagaaggcatggcccaccggctcaggagaaagtcctggaggggaggcagtccgcccctggggacaacgcggggggccgtattcggacacca

SEQ ID NO: 77438 - DNA, 206 bp, Homo sapiens
  misc_feature 1..206: note = chr15:28389827-28390033
  misc_feature 1..206: note = hypo
  source 1..206: mol_type = genomic DNA
gcatgatgggatagacggtgaagcgccagccccagccattcacagacccatcgctgatgaacttccactttaactcatcccctgggatgcgcagctcgctggaccagtcggaccactctcggcctgcgggaggaaagcgcaccccggggttagcttcactccatcatccaatcaacacaaaccttcttagacgcaaagcagaatga

SEQ ID NO: 77439 - DNA, 122 bp, Homo sapiens; identical to SEQ ID NO: 44213
  misc_feature 1..122: note = chr15:28517076-28517198
  misc_feature 1..122: note = hypo
  source 1..122: mol_type = genomic DNA

SEQ ID NO: 77440 - DNA, 23 bp, Homo sapiens
  misc_feature 1..23: note = chr15:29008573-29008596
  misc_feature 1..23: note = hypo
  source 1..23: mol_type = genomic DNA
accgcgcccggcttccagaatat

SEQ ID NO: 77441 - DNA, 21 bp, Homo sapiens
  misc_feature 1..21: note = chr15:29029711-29029732
  misc_feature 1..21: note = hypo
  source 1..21: mol_type = genomic DNA
ctgagcgcggtgaatcgcttg

SEQ ID NO: 77442 - DNA, 37 bp, Homo sapiens
  misc_feature 1..37: note = chr15:29034132-29034169
  misc_feature 1..37: note = hyper
  source 1..37: mol_type = genomic DNA
cttgggggcacatctcggggtgcggtgacccgcccgg

SEQ ID NO: 77443 - DNA, 158 bp, Homo sapiens; identical to SEQ ID NO: 35610
  misc_feature 1..158: note = chr15:29077236-29077394
  misc_feature 1..158: note = hyper
  source 1..158: mol_type = genomic DNA

SEQ ID NO: 77444 - DNA, 196 bp, Homo sapiens; identical to SEQ ID NO: 35611
  misc_feature 1..196: note = chr15:29077428-29077624
  misc_feature 1..196: note = hyper
  source 1..196: mol_type = genomic DNA

SEQ ID NO: 77445 - DNA, 140 bp, Homo sapiens
  misc_feature 1..140: note = chr15:29077646-29077786
  misc_feature 1..140: note = hyper
  source 1..140: mol_type = genomic DNA
cgcggaccgcccgcggctcagcctccggtctctctccgtctctaagtggtggtggctgtgggtttttctgcaggtgatccttttgagtaatttgtttcacgcaggcgccctgctgtagggtaaagcggcagattcatgct

SEQ ID NO: 77446 - DNA, 88 bp, Homo sapiens
  misc_feature 1..88: note = chr15:29087614-29087702
  misc_feature 1..88: note = hypo
  source 1..88: mol_type = genomic DNA
gcaccgctcctcctgcgtcttctcctgctctcccatcctctccttcttctcccgcctcttctccacctgcctccggatcttctcctcc

SEQ ID NO: 77447 - DNA, 48 bp, Homo sapiens; identical to SEQ ID NO: 44215
  misc_feature 1..48: note = chr15:29112193-29112241
  misc_feature 1..48: note = hypo
  source 1..48: mol_type = genomic DNA

SEQ ID NO: 77448 - DNA, 21 bp, Homo sapiens
  misc_feature 1..21: note = chr15:29119934-29119955
  misc_feature 1..21: note = hypo
  source 1..21: mol_type = genomic DNA
ccactgcgcctggcctgcatg

SEQ ID NO: 77449 - DNA, 30 bp, Homo sapiens
  misc_feature 1..30: note = chr15:29123489-29123519
  misc_feature 1..30: note = hypo
  source 1..30: mol_type = genomic DNA
tccttagagttcccacgtgtggctcaccag

SEQ ID NO: 77450 - DNA, 341 bp, Homo sapiens
  misc_feature 1..341: note = chr15:29130707-29131048
  misc_feature 1..341: note = hyper
  source 1..341: mol_type = genomic DNA
cccccattacagctgcgcggggccgagcaagcagggcgcggcggccggggcaaggtgcggagcctcgcgttcaccggctctacctgcggagcctcgcgttcactggctctacctgcgggaccagacccctgcagctccccagccagcacggccggggcacgcccgggaatctgtgtgctccccagggcccggggcgttcggggcgccgcgccttccagcgcctgggtcccagccccgatcccggagaccggcccggggggacccggggtcccgagtgcaccctcctgccctgcagactgtcccagcgccggggccagggggcgcaggacctcgcgcacgcc

SEQ ID NO: 77451 - DNA, 99 bp, Homo sapiens; identical to SEQ ID NO: 4198
  misc_feature 1..99: note = chr15:29131532-29131631
  misc_feature 1..99: note = hyper
  source 1..99: mol_type = genomic DNA

SEQ ID NO: 77452 - DNA, 152 bp, Homo sapiens; identical to SEQ ID NO: 4199
  misc_feature 1..152: note = chr15:29131755-29131907
  misc_feature 1..152: note = hyper
  source 1..152: mol_type = genomic DNA

SEQ ID NO: 77453 - DNA, 297 bp, Homo sapiens; identical to SEQ ID NO: 44216
  misc_feature 1..297: note = chr15:29133536-29133833
  misc_feature 1..297: note = hypo
  source 1..297: mol_type = genomic DNA

SEQ ID NO: 77454 - DNA, 166 bp, Homo sapiens
  misc_feature 1..166: note = chr15:29145324-29145490
  misc_feature 1..166: note = hypo
  source 1..166: mol_type = genomic DNA
cttcccagcctcctccgcctggactcaggcttcttcgggctcatcagacctgaacagcctggcagtgtggctgtgtgggaatgggtgacaggtgctgttctccccagtgcaaatcaccaatgctgggcaccgtgcatcagcgtcgtggtgacggcagcattgggtg

SEQ ID NO: 77455 - DNA, 129 bp, Homo sapiens
  misc_feature 1..129: note = chr15:29158096-29158225
  misc_feature 1..129: note = hypo
  source 1..129: mol_type = genomic DNA
aggcactgcggtgggcgagccagagggctttgttgctccaaggagcttgcattctagtattctagttattttcacgcatctgcactatctgggacagggaccattgcgttttgtcgtatataaagcagc

SEQ ID NO: 77456 - DNA, 30 bp, Homo sapiens; identical to SEQ ID NO: 44218
  misc_feature 1..30: note = chr15:29221674-29221704
  misc_feature 1..30: note = hypo
  source 1..30: mol_type = genomic DNA

SEQ ID NO: 77457 - DNA, 68 bp, Homo sapiens
  misc_feature 1..68: note = chr15:29223705-29223773
  misc_feature 1..68: note = hypo
  source 1..68: mol_type = genomic DNA
tggtgctgttgccaccgtgggcccaaacatccactgcccttttagcaaggcagcgctgctccataggg

SEQ ID NO: 77458 - DNA, 52 bp, Homo sapiens
  misc_feature 1..52: note = chr15:29263052-29263104
  misc_feature 1..52: note = hypo
  source 1..52: mol_type = genomic DNA
tgccagtctcagtgccgctctttgccatgcacacacccgtatgtgtgcccat

SEQ ID NO: 77459 - DNA, 44 bp, Homo sapiens
  misc_feature 1..44: note = chr15:29283583-29283627
  misc_feature 1..44: note = hypo
  source 1..44: mol_type = genomic DNA
gctgagctacagggccgggccgcaggaggcgtccttgtgccgga

SEQ ID NO: 77460 - DNA, 22 bp, Homo sapiens
  misc_feature 1..22: note = chr15:29302734-29302756
  misc_feature 1..22: note = hypo
  source 1..22: mol_type = genomic DNA
acaggtgcgagccaccacaccc

SEQ ID NO: 77461 - DNA, 30 bp, Homo sapiens
  misc_feature 1..30: note = chr15:29389670-29389700
  misc_feature 1..30: note = hypo
  source 1..30: mol_type = genomic DNA
tagcatttccttctacgtggactctgggta

SEQ ID NO: 77462 - DNA, 35 bp, Homo sapiens
  misc_feature 1..35: note = chr15:29396552-29396587
  misc_feature 1..35: note = hypo
  source 1..35: mol_type = genomic DNA
ggccgccaagagccccgccgcgctcccagggctgc

SEQ ID NO: 77463 - DNA, 30 bp, Homo sapiens; identical to SEQ ID NO: 44219
  misc_feature 1..30: note = chr15:29397531-29397561
  misc_feature 1..30: note = hypo
  source 1..30: mol_type = genomic DNA

SEQ ID NO: 77464 - DNA, 349 bp, Homo sapiens
  misc_feature 1..349: note = chr15:29407125-29407474
  misc_feature 1..349: note = hyper
  source 1..349: mol_type = genomic DNA
gtgtgtatgtgtgcacggctgtggctgtgggtctgtgagtgggtgtgaggcatggggtgtgaggagagtgtgagtgggtgtgtctgtgtgtgtgtaggggtgtgtgaaggggtgttcagcacaaaggggctgcaggctctctgggaagcgtggtggccgcacgaggcgggaggctgagagctgaggagcccggcctacagaggggcccgctggggaccgggcagggaatttgggtctggggacagcagcagcaggccgggccgtctgtggtgctccccctggtggctctgtgaggctgagtgcgtggcgaccatccttgcagcctgtgggtgggcgggtgggtggaggg

SEQ ID NO: 77465 - DNA, 77 bp, Homo sapiens
  misc_feature 1..77: note = chr15:29407737-29407814
  misc_feature 1..77: note = hyper
  source 1..77: mol_type = genomic DNA
ccacccgtggaggagcgggcgggagaacggggaagaggcaggaggcggccggggcgttggaatcctttcagccctgc

SEQ ID NO: 77466 - DNA, 260 bp, Homo sapiens
  misc_feature 1..260: note = chr15:29407866-29408126
  misc_feature 1..260: note = hyper
  source 1..260: mol_type = genomic DNA
cgctgataaacaaggcttgcagttgcgaggggcctcggggtgggtttctggttgaggaacgccggggaatggctgatggaggaagcccctgccgggagcaggagcagcggaaacctacatcggccacacagatcccggcgggggagggagggcaacgctcagaagcagagctgcgcgatgtgcctttctgggctgctcagcccagggcccgagacctgcttgcctgaggaggggcagatgcacggcggctgcaccccgtg

SEQ ID NO: 77467 - DNA, 23 bp, Homo sapiens
  misc_feature 1..23: note = chr15:29408816-29408839
  misc_feature 1..23: note = hypo
  source 1..23: mol_type = genomic DNA
caagactccgtctcaaaaaaaaa

SEQ ID NO: 77468 - DNA, 58 bp, Homo sapiens
  misc_feature 1..58: note = chr15:29409339-29409397
  misc_feature 1..58: note = hypo
  source 1..58: mol_type = genomic DNA
accccagcctggccacgcagccaggacaccgggcagggccgcccgggcccagaggagc

SEQ ID NO: 77469 - DNA, 30 bp, Homo sapiens
  misc_feature 1..30: note = chr15:29409660-29409690
  misc_feature 1..30: note = hypo
  source 1..30: mol_type = genomic DNA
tgaagctgtgcggagcgaactggcgcctcc

SEQ ID NO: 77470 - DNA, 33 bp, Homo sapiens
  misc_feature 1..33: note = chr15:29410533-29410566
  misc_feature 1..33: note = hypo
  source 1..33: mol_type = genomic DNA
ggtctgttacctcagcggcgggtgcccgcctgt

SEQ ID NO: 77471 - DNA, 25 bp, Homo sapiens
  misc_feature 1..25: note = chr15:29449033-29449058
  misc_feature 1..25: note = hypo
  source 1..25: mol_type = genomic DNA
cctcagcaggccaggcgcagtggct

SEQ ID NO: 77472 - DNA, 71 bp, Homo sapiens
  misc_feature 1..71: note = chr15:29561245-29561316
  misc_feature 1..71: note = hyper
  source 1..71: mol_type = genomic DNA
gtttctttggatctccgaaaattaaatgcttcttggtggggtagacccctaagcgccgcagaaagtcccag

SEQ ID NO: 77473 - DNA, 22 bp, Homo sapiens
  misc_feature 1..22: note = chr15:29610811-29610833
  misc_feature 1..22: note = hypo
  source 1..22: mol_type = genomic DNA
ccacgcccggccaaattaaggt

SEQ ID NO: 77474 - DNA, 171 bp, Homo sapiens
  misc_feature 1..171: note = chr15:29721859-29722030
  misc_feature 1..171: note = hypo
  source 1..171: mol_type = genomic DNA
aattctgacaggatccggtagaagggacaaattcgtctgtggttgaaatctacggacagccatgagctgaaactacggaccccgtagttctcaaaggaatacagagaagcaggtatggaatgccaacagggctgtgcaatgcccgatccgggccggcgtgagggcacctcc

SEQ ID NO: 77475 - DNA, 524 bp, Homo sapiens; identical to SEQ ID NO: 35620
  misc_feature 1..524: note = chr15:29861915-29862439
  misc_feature 1..524: note = hyper
  source 1..524: mol_type = genomic DNA

SEQ ID NO: 77476 - DNA, 352 bp, Homo sapiens
  misc_feature 1..352: note = chr15:29862870-29863222
  misc_feature 1..352: note = hyper
  source 1..352: mol_type = genomic DNA
caggctgcggggcagcgcggcgggacgcggcgctcgggggccgccggccggaggcatcgcgccgggcgcccgcacgcctcgcccgctcccgcccggcccggcgcgcgccgccgcctctcctcacagagggtccgaggcaagttgcgccgggtgcagggacggcctcccagccggctgccagggctgcggcggccgcgcgccgggagcgggccgggccgggcggggagccgggcgcccgcagcccccgccggtgcccgcgcccatgccgccgccgccgcgccgcccgcccgccggccgcgccgcgctgcgccctcccccgcccgccccgcgcgctccccggcccgagcgcggg

SEQ ID NO: 77477 - DNA, 132 bp, Homo sapiens
  misc_feature 1..132: note = chr15:29863519-29863651
  misc_feature 1..132: note = hyper
  source 1..132: mol_type = genomic DNA
cggcagcgggccagccgagccttcagagcctggggacggctcgggatgggcgcgcggggcgctgaggacggggagacgggctgggagcagacaggagggaaattccgagcgctgggccgcaggtgtggcgaa

SEQ ID NO: 77478 - DNA, 118 bp, Homo sapiens
  misc_feature 1..118: note = chr15:30113866-30113984
  misc_feature 1..118: note = hyper
  source 1..118: mol_type = genomic DNA
ggagccgagtttctccgcgagggacctgttgcgtgtccccgccctcagcgagccgcagccaggcacaggcgccggcagctatgcacctgcccagtacggcggccgggcgcccgcagcc

SEQ ID NO: 77479 - DNA, 30 bp, Homo sapiens
  misc_feature 1..30: note = chr15:30114780-30114810
  misc_feature 1..30: note = hyper
  source 1..30: mol_type = genomic DNA
ggcgggacgagcggccggggtcccgacccc

SEQ ID NO: 77480 - DNA, 860 bp, Homo sapiens
  misc_feature 1..860: note = chr15:30260547-30261407
  misc_feature 1..860: note = hyper
  source 1..860: mol_type = genomic DNA
aaggacagacagaggcgggaggccgacgcccgggtgcgggtgccaggcgtcccggccgctccccgtcgccctacgcgccgcgggcacagcgagggtctcggcgaaaccagtcagcgggcacgcggtacaaggcggcgctcggccctgggctcggccttggctgctgcgccccgcgcggcgcgccccgcgtcccgtcgggcccgacagtcgcggcctcgccccccgcccgaccgccccggccgccgctcgctctcccactccggcccccgccccgctccgcgcctagcccggctggggctccgcgcccgcgcggccgcctcaccacagcttcctcttgagcggcaggaggctgccgcggttggagggggtgacgccgatggccatctgcagcaccgtcaggtatttctggtacttcatcttgtccccgctccgctcgcgggcagggccccgccgcctccgccgccgccgcagacacagcccctccaggcgccgcatagatcagctctgggccatccgccgccaccacagctcccaccgctcccgcgcccgccgcacccgcagctgcggccgtgcgtggcccgggctcccgctcccgccgccgccgtcgccgtgcgtgcccggccgctcccgccgccgccgccgtgcgtggcccgcagctcccgccgccgccgccccttccacccctgcaggccgtggcccggcggcgcgctccggtgggcgggtgcgggtctcgcgggaggccgggctggcttggcccccgctccggagccgctgggcgaggccgggccacctgcgcgccggccgccctgcccaggccctgcgcccgcgtgccgcggtgttttcagcggctggcaggagct

SEQ ID NO: 77481 - DNA, 43 bp, Homo sapiens
  misc_feature 1..43: note = chr15:31083763-31083806
  misc_feature 1..43: note = hypo
  source 1..43: mol_type = genomic DNA
tacccaccccacaatagcagaagaaactcgacagagcaaattg

SEQ ID NO: 77482 - DNA, 60 bp, Homo sapiens
  misc_feature 1..60: note = chr15:31121966-31122026
  misc_feature 1..60: note = hypo
  source 1..60: mol_type = genomic DNA
ttttgctagaatatacgttggtgtggccattctcagtgatgttctcggttagaagtaatg

SEQ ID NO: 77483 - DNA, 30 bp, Homo sapiens
  misc_feature 1..30: note = chr15:31126524-31126554
  misc_feature 1..30: note = hypo
  source 1..30: mol_type = genomic DNA
gagtgaagctaaccccgagattcactttcc

SEQ ID NO: 77484 - DNA, 30 bp, Homo sapiens; identical to SEQ ID NO: 44225
  misc_feature 1..30: note = chr15:31221190-31221220
  misc_feature 1..30: note = hypo
  source 1..30: mol_type = genomic DNA

SEQ ID NO: 77485 - DNA, 167 bp, Homo sapiens; identical to SEQ ID NO: 44226
  misc_feature 1..167: note = chr15:31377678-31377845
  misc_feature 1..167: note = hypo
  source 1..167: mol_type = genomic DNA

SEQ ID NO: 77486 - DNA, 112 bp, Homo sapiens
  misc_feature 1..112: note = chr15:31455390-31455502
  misc_feature 1..112: note = hypo
  source 1..112: mol_type = genomic DNA
aggattggatgcagccgatgcctcatcctcaggccgtcccagtttgcctccttgtcctcaggcaaatcctcagcaccctgcgtggtctgacatcttgcgtctaactggaatt

SEQ ID NO: 77487 - DNA, 30 bp, Homo sapiens; identical to SEQ ID NO: 44227
  misc_feature 1..30: note = chr15:31509535-31509565
  misc_feature 1..30: note = hypo
  source 1..30: mol_type = genomic DNA

SEQ ID NO: 77488 - DNA, 30 bp, Homo sapiens; identical to SEQ ID NO: 44228
  misc_feature 1..30: note = chr15:31539632-31539662
  misc_feature 1..30: note = hypo
  source 1..30: mol_type = genomic DNA

SEQ ID NO: 77489 - DNA, 33 bp, Homo sapiens
  misc_feature 1..33: note = chr15:31564940-31564973
  misc_feature 1..33: note = hypo
  source 1..33: mol_type = genomic DNA
aagccccaaggcccccgccgtggccctgccccc

SEQ ID NO: 77490 - DNA, 30 bp, Homo sapiens
  misc_feature 1..30: note = chr15:31566708-31566738
  misc_feature 1..30: note = hypo
  source 1..30: mol_type = genomic DNA
aacttcgcaccaacacgtgaaagggcaaca

SEQ ID NO: 77491 - DNA, 30 bp, Homo sapiens
  misc_feature 1..30: note = chr15:31597382-31597412
  misc_feature 1..30: note = hypo
  source 1..30: mol_type = genomic DNA
ctccctgggttctggcgcagctcacagtct

SEQ ID NO: 77492 - DNA, 159 bp, Homo sapiens
  misc_feature 1..159: note = chr15:31599458-31599617
  misc_feature 1..159: note = hypo
  source 1..159: mol_type = genomic DNA
gaggtttgaaggtcccggcccctcggggcatgcttctcacagcggtcccagagtttcccctggccctttcccctttcccttctgagcttctcagtcctttctctctctcctcaatggccttgccacagcatccagctgccttggcggcaagcacagtgc

SEQ ID NO: 77493 - DNA, 30 bp, Homo sapiens
  misc_feature 1..30: note = chr15:31601868-31601898
  misc_feature 1..30: note = hypo
  source 1..30: mol_type = genomic DNA
cttcttaaaaagtcacgaatccagctgggc

SEQ ID NO: 77494 - DNA, 56 bp, Homo sapiens; identical to SEQ ID NO: 44229
  misc_feature 1..56: note = chr15:31603992-31604048
  misc_feature 1..56: note = hypo
  source 1..56: mol_type = genomic DNA

SEQ ID NO: 77495 - DNA, 30 bp, Homo sapiens
  misc_feature 1..30: note = chr15:31668057-31668087
  misc_feature 1..30: note = hypo
  source 1..30: mol_type = genomic DNA
cccacccacgacactcgagtgcaagatcgc

SEQ ID NO: 77496 - DNA, 30 bp, Homo sapiens
  misc_feature 1..30: note = chr15:31669119-31669149
  misc_feature 1..30: note = hypo
  source 1..30: mol_type = genomic DNA
atgggagagaagtagcgtcccctaccctac

SEQ ID NO: 77497 - DNA, 142 bp, Homo sapiens
  misc_feature 1..142: note = chr15:31727629-31727771
  misc_feature 1..142: note = hyper
  source 1..142: mol_type = genomic DNA
aaggtcacagacccacggttttccgccccctagggtccaagctctttcctggacatctgcaggcaatgtcgacacgccctccagtgtctgtggcgggcaaaggatgtgtctccacccccagaccttccgatcctgtgctgaa

SEQ ID NO: 77498 - DNA, 237 bp, Homo sapiens
  misc_feature 1..237: note = chr15:31775237-31775474
  misc_feature 1..237: note = hyper
  source 1..237: mol_type = genomic DNA
gagtttccacaggtacgaggcagatgctaggctagcacacccacttccaacagtatgacttgtttcctatccgtctactacctgagtggcgtcagtgtaggttcaggcaccattaggaacgtttgaccaaacacgtacacggcactgacagaggaggcgccggccttccggtggaccagggcatgtaaaaaagacaccgacacaatggaaaagaaatcctcgaaggtagaacctcgc

SEQ ID NO: 77499 - DNA, 155 bp, Homo sapiens; identical to SEQ ID NO: 4201
  misc_feature 1..155: note = chr15:31775483-31775638
  misc_feature 1..155: note = hyper
  source 1..155: mol_type = genomic DNA

SEQ ID NO: 77500 - DNA, 105 bp, Homo sapiens; identical to SEQ ID NO: 4202
  misc_feature 1..105: note = chr15:31775678-31775783
  misc_feature 1..105: note = hyper
  source 1..105: mol_type = genomic DNA

SEQ ID NO: 77501 - DNA, 29 bp, Homo sapiens
  misc_feature 1..29: note = chr15:31776145-31776174
  misc_feature 1..29: note = hyper
  source 1..29: mol_type = genomic DNA
ggagaggcgcgctccgggaccggcacgcc

SEQ ID NO: 77502 - DNA, 107 bp, Homo sapiens
  misc_feature 1..107: note = chr15:31778235-31778342
  misc_feature 1..107: note = hypo
  source 1..107: mol_type = genomic DNA
ggagcgcactgagagcgggctcaggagtccctggctggaaggacccttcccacagttgtctgctgagagccctgcatctaacatgaaggcaccgaggcctggcaatt

SEQ ID NO: 77503 - DNA, 41 bp, Homo sapiens
  misc_feature 1..41: note = chr15:31813319-31813360
  misc_feature 1..41: note = hypo
  source 1..41: mol_type = genomic DNA
gaagctatgacaggccggagggttcgcgggggtgaggactg

SEQ ID NO: 77504 - DNA, 70 bp, Homo sapiens
  misc_feature 1..70: note = chr15:31830234-31830304
  misc_feature 1..70: note = hypo
  source 1..70: mol_type = genomic DNA
ttcatacgtccaagacgatctgtgcaattccactccccttgccatggactgctgtcgcctggctcacaag

SEQ ID NO: 77505 - DNA, 30 bp, Homo sapiens
  misc_feature 1..30: note = chr15:31862270-31862300
  misc_feature 1..30: note = hypo
  source 1..30: mol_type = genomic DNA
ccgggctgtggctctcgctctggctgcttg

SEQ ID NO: 77506 - DNA, 196 bp, Homo sapiens
  misc_feature 1..196: note = chr15:31897790-31897986
  misc_feature 1..196: note = hypo
  source 1..196: mol_type = genomic DNA
attagggggcgcctccgtgctcactttccaatgtagcctgcaatcatggaacaaatcgattaaagcagagaacaatcagttattttttcagactcattttcttaaatggcttaatctatgcctcaggccacacagactgttggttacgtaagcaactccagtgactgcattcctgtgacatcgctacagtgctgca

SEQ ID NO: 77507 - DNA, 30 bp, Homo sapiens
  misc_feature 1..30: note = chr15:31991592-31991622
  misc_feature 1..30: note = hypo
  source 1..30: mol_type = genomic DNA
ttttacccttgggtccgaggtgagtttcag

SEQ ID NO: 77508 - DNA, 67 bp, Homo sapiens; identical to SEQ ID NO: 35629
  misc_feature 1..67: note = chr15:32162215-32162282
  misc_feature 1..67: note = hyper
  source 1..67: mol_type = genomic DNA

SEQ ID NO: 77509 - DNA, 32 bp, Homo sapiens
  misc_feature 1..32: note = chr15:32162491-32162523
  misc_feature 1..32: note = hyper
  source 1..32: mol_type = genomic DNA
agcccgcaatgcagacgcgccggcgagcccag

SEQ ID NO: 77510 - DNA, 407 bp, Homo sapiens
  misc_feature 1..407: note = chr15:32322366-32322773
  misc_feature 1..407: note = hyper
  source 1..407: mol_type = genomic DNA
gcttctggctgagagcgggagcgggctgagtggggacaaagaacgcaagggagaggtagagcctggccttgggcagcccctggcctggccagaggcgcgaggccgagagcccgctcggtggagactgggggtggaggtgcccggagcgtacccagcgccgggagtacctcccgctcacacctcgggctgcagttccctgggtggccgccgagacgctggcccgggctggagggatgggggggcggggacgggggcgggggcggggctcgtcacgtggagaggcgcgcgggggcgggcggggcgggggcgcgcgcccggctccttaaaggcgcgcgagccgagcggcgaggtgcctctgtggccgcaggcgcaggcccgggcgacagccgagacgtggagcgcgccgg

SEQ ID NO: 77511 - DNA, 17 bp, Homo sapiens
  misc_feature 1..17: note = chr15:32934467-32934484
  misc_feature 1..17: note = hypo
  source 1..17: mol_type = genomic DNA
tagaaggagggtttgcg

SEQ ID NO: 77512 - DNA, 149 bp, Homo sapiens
  misc_feature 1..149: note = chr15:33009613-33009762
  misc_feature 1..149: note = hyper
  source 1..149: mol_type = genomic DNA
cgagcccgccaggttaacgggggcgccggggtcagcgccctcgaagttgggggcctcgggcggggccgccggggagccacgacggccgctcgaccagagcatcccgcagtcccgttccctccagaggggaagaatggccgaatctggca

SEQ ID NO: 77513 - DNA, 578 bp, Homo sapiens; identical to SEQ ID NO: 35632
  misc_feature 1..578: note = chr15:33009821-33010399
  misc_feature 1..578: note = hyper
  source 1..578: mol_type = genomic DNA

SEQ ID NO: 77514 - DNA, 276 bp, Homo sapiens; identical to SEQ ID NO: 35633
  misc_feature 1..276: note = chr15:33010400-33010676
  misc_feature 1..276: note = hyper
  source 1..276: mol_type = genomic DNA

SEQ ID NO: 77515 - DNA, 446 bp, Homo sapiens; identical to SEQ ID NO: 35634
  misc_feature 1..446: note = chr15:33010720-33011166
  misc_feature 1..446: note = hyper
  source 1..446: mol_type = genomic DNA

SEQ ID NO: 77516 - DNA, 504 bp, Homo sapiens
  misc_feature 1..504: note = chr15:33011167-33011671
  misc_feature 1..504: note = hyper
  source 1..504: mol_type = genomic DNA
gctggttcccacttccgcgcgcaccccttaaactgtgttctagaggccccagcctcgccttgcagcgcctcactagctcctgaggactagggactggcggctgaggcgggttggcggctgcaacgagctgggcgtctttcgttctctctcgctgcctggctggctccgctggcccctccacagcttgcggagcaaggccatagcaggggagtgggaggtatattggggctgtcacctccttgctggccggagttatttgtagactacagactccggaagaacagacgcgccaccgctctcgcttggcattgccttcggatcgcagctcctccttgggggtgccccagcttggcgtttatttgcctgcgccaggctctggcgacggtcaccgggccaggcggggagggacggacggcaggtgaccagcctctgctgtgaagaaattcctgcgcgcccggagctgtccctaatgcattcccgggtcgaatccgtctactgccttcc

SEQ ID NO: 77517 - DNA, 77 bp, Homo sapiens
  misc_feature 1..77: note = chr15:33438087-33438164
  misc_feature 1..77: note = hypo
  source 1..77: mol_type = genomic DNA
aactaaagacttgaacgttttagaaaaaatacgtgaaatctgaatgaactgatttgtgactttattgtgaataaaac

SEQ ID NO: 77518 - DNA, 16 bp, Homo sapiens
  misc_feature 1..16: note = chr15:33438284-33438300
  misc_feature 1..16: note = hypo
  source 1..16: mol_type = genomic DNA
tcgggcttcagcctcc

SEQ ID NO: 77519 - DNA, 223 bp, Homo sapiens
  misc_feature 1..223: note = chr15:33486950-33487173
  misc_feature 1..223: note = hyper
  source 1..223: mol_type = genomic DNA
acaggccacaggccccgccttcctagcacgcgccggcctgacgagctgtttgggggaggtgagcagtaaactgatcggcagggctgaagaccagtggaaacgtgcagcggcgcccgaggtggcaggggaggcggggcgggaggcggcggtgcccaatcagcagccgagccgttgggccaggctgggaagcagtgctgtcttttggcaccgtctgatccgggct

SEQ ID NO: 77520 - DNA, 97 bp, Homo sapiens
  misc_feature 1..97: note = chr15:33541637-33541734
  misc_feature 1..97: note = hypo
  source 1..97: mol_type = genomic DNA
tcagcctcccgtaaaggtttttaataaacttcccttccttctctaaaacttgccccggcctctccttctgcctatggcttctcggttgaattctttc

SEQ ID NO: 77521 - DNA, 903 bp, Homo sapiens
  misc_feature 1..903: note = chr15:33602706-33603609
  misc_feature 1..903: note = hyper
  source 1..903: mol_type = genomic DNA
gcaaagcgggcaaagcgagcaaagcgagagggttggtacccagtctgggcgcgctggagctaagcaactggcctttgtttgtgaattggagcagtttaggggacatcctccggtcgccgcggggcgcgcgcctccgctgagtgtgcggtgcggtacccagcggtgcgggggaggctccaccgcgccagcccagggcccccgcaccgcccccgccagctcgacgcgcccagcgttgcgctctccacggagcgggcggccgcagcgcacttggctggggcgagaggcgagaggggtgggcggactgcttggttggcgttggcgctctgcagtgcagtggagtgttagcccagctccctatatggtcggggattagcttggcgctgctgaggctgaggctgagccaggagctggaggaggaggtggaggacgaggacgaaaaggaggaggagaaagagcgcagcagcagtcagcgcacgccgagcggctgccgggggaagcagaggcgccggaggctggggcaccgccgacgcctcgggagccatggccgaagggggagaaggaggcgaggacgagatccagtttctgaggactgtgagtctccgcggcgggggcgaggccgtgggcaggtggggaggagcgcggagcgcggcgaggaggggctggctgcgctgcgccgcggtgccgggtgcccggtgccgggcgctttctccgcacccgcgggctgcagaggcggaccggccacctacccgcggggccgcgaggggctgcgtgggaaggggcaccatctcctgcctctcccttgttcccctaccgccacccctgccccaggccctccacctaggaccgctcgctctccaggcaacttgctacttggtctgaaacccttgatgcccaaacttcagc

SEQ ID NO: 77522 - DNA, 128 bp, Homo sapiens; identical to SEQ ID NO: 35639
  misc_feature 1..128: note = chr15:33603647-33603775
  misc_feature 1..128: note = hyper
  source 1..128: mol_type = genomic DNA

SEQ ID NO: 77523 - DNA, 37 bp, Homo sapiens
  misc_feature 1..37: note = chr15:33628963-33629000
  misc_feature 1..37: note = hypo
  source 1..37: mol_type = genomic DNA
ttctaaaactctggccgggcgtggtggctcacgcctg

SEQ ID NO: 77524 - DNA, 25 bp, Homo sapiens
  misc_feature 1..25: note = chr15:33632111-33632136
  misc_feature 1..25: note = hypo
  source 1..25: mol_type = genomic DNA
ttaccttagtcgtggaacaccaaag

SEQ ID NO: 77525 - DNA, 17 bp, Homo sapiens
  misc_feature 1..17: note = chr15:33633532-33633549
  misc_feature 1..17: note = hypo
  source 1..17: mol_type = genomic DNA
cccggtctgattcagtg

SEQ ID NO: 77526 - DNA, 30 bp, Homo sapiens; identical to SEQ ID NO: 44235
  misc_feature 1..30: note = chr15:33727786-33727816
  misc_feature 1..30: note = hypo
  source 1..30: mol_type = genomic DNA

SEQ ID NO: 77527 - DNA, 30 bp, Homo sapiens; identical to SEQ ID NO: 44236
  misc_feature 1..30: note = chr15:33746640-33746670
  misc_feature 1..30: note = hypo
  source 1..30: mol_type = genomic DNA

SEQ ID NO: 77528 - DNA, 45 bp, Homo sapiens
  misc_feature 1..45: note = chr15:33879242-33879287
  misc_feature 1..45: note = hypo
  source 1..45: mol_type = genomic DNA
acagctcagtgtgtccgggagattgagactcggcagcatagactg

SEQ ID NO: 77529 - DNA, 30 bp, Homo sapiens
  misc_feature 1..30: note = chr15:33952401-33952431
  misc_feature 1..30: note = hypo
  source 1..30: mol_type = genomic DNA
caatgcccctgtcagcggccatattcagga

SEQ ID NO: 77530 - DNA, 229 bp, Homo sapiens
  misc_feature 1..229: note = chr15:33954397-33954626
  misc_feature 1..229: note = hypo
  source 1..229: mol_type = genomic DNA
ggttccattaccacacgctgaggctctacagcgcggtgtgcgccctgggaaacagccgcgtggcctacgccctgtgcagccacgtggacctctcccagctcttctatgccattgacaacaagtacctccccggcctccttcgatctggtttctatgacctgctcatcagcatccacctggccagcgccaaggagaggaagctgatgatgaagaacgagtacatcatccc

SEQ ID NO: 77531 - DNA, 80 bp, Homo sapiens
  misc_feature 1..80: note = chr15:34014994-34015074
  misc_feature 1..80: note = hypo
  source 1..80: mol_type = genomic DNA
gggtgaggggggaaacgggctcttggcagccatgcagggtgccattaagatctctgagaacccagcgctcgacctcccct

SEQ ID NO: 77532 - DNA, 30 bp, Homo sapiens
  misc_feature 1..30: note = chr15:34067983-34068013
  misc_feature 1..30: note = hypo
  source 1..30: mol_type = genomic DNA
gcccaccaggtctcccgtggcctgctcaca

SEQ ID NO: 77533 - DNA, 30 bp, Homo sapiens
  misc_feature 1..30: note = chr15:34124561-34124591
  misc_feature 1..30: note = hypo
  source 1..30: mol_type = genomic DNA
aaccacatatgtggccgggcacggtggctc

SEQ ID NO: 77534 - DNA, 19 bp, Homo sapiens
  misc_feature 1..19: note = chr15:34208027-34208046
  misc_feature 1..19: note = hypo
  source 1..19: mol_type = genomic DNA
actccgtgctgttggagaa

SEQ ID NO: 77535 - DNA, 31 bp, Homo sapiens
  misc_feature 1..31: note = chr15:34339559-34339590
  misc_feature 1..31: note = hypo
  source 1..31: mol_type = genomic DNA
gagccaccgtgcccggcggagacctagcagt

SEQ ID NO: 77536 - DNA, 30 bp, Homo sapiens
  misc_feature 1..30: note = chr15:34353236-34353266
  misc_feature 1..30: note = hypo
  source 1..30: mol_type = genomic DNA
tttttttccctttaccgcccattatcatgt

SEQ ID NO: 77537 - DNA, 61 bp, Homo sapiens
  misc_feature 1..61: note = chr15:34394495-34394556
  misc_feature 1..61: note = hyper
  source 1..61: mol_type = genomic DNA
ttagccccgagattacgcgctgctgtgcctgcgactgcagcgtttacgccgagataactcg

SEQ ID NO: 77538 - DNA, 267 bp, Homo sapiens
  misc_feature 1..267: note = chr15:34634214-34634481
  misc_feature 1..267: note = hypo
  source 1..267: mol_type = genomic DNA
ttcttgatggtgattcggtgtcgagagtatttgtcatctggggagaaccgagcaggatgggctgagcaggtctgttgtcccatcgggtcaaatttctgctccaggaacacagaatgtatgtcagtacaggagtgatgaaatggggtggggccagcgcgaaaaagggcaaacatgaaaatagaagatgcaatggtcaactcaaaaagttgtacaaataaatagagaaatataaaatttaaaaaggccgagcgcggtggctcacgcctg

SEQ ID NO: 77539 - DNA, 30 bp, Homo sapiens
  misc_feature 1..30: note = chr15:34726887-34726917
  misc_feature 1..30: note = hypo
  source 1..30: mol_type = genomic DNA
agcacccccagcccccgatgggcacacagg

SEQ ID NO: 77540 - DNA, 812 bp, Homo sapiens
  misc_feature 1..812: note = chr15:34728824-34729636
  misc_feature 1..812: note = hyper
  source 1..812: mol_type = genomic DNA
ggagaaaaggaagttcgcccctagcctgggcttaccaaggcccgccgcccgacccatggagccctgcttggggaccgggggcctcgatgttctccttcaccatctgcggccagatctccctccagcagccttgccaggcagtgcctggcgtggagaaggggccctgcagaggcgcaggtccgcaccgtgcccccaacccggcgcctgcagcccaggggcaacaaggtgtggggtttttgagtttttccctctgggccttattatacagggaaagggaaggggcgaagatccgggctcgagttctcccagggaagtgaacccagaggcgatcccaaactcagtagttgccgcccggcacggggacttgatgccggcgccaagccgggcagcggaacgcaccagcggcccgaccagcccggcgagacgcgagcgggcggccccgccagacagcgccacttgccggcgccgagagtggcccctcgccgcggtgagcccctcccgggatgcgaaagccatcgcctagtccccgccgcacccgcccgcccatcgtgggaggaggatgggccggtccgagaggcgtaaggccgccgggctgcacccctagatcccagcggcggcctccccgcagccccgccgagtccggggggcagcgctcgggagctcttggcccgcagcttacgcgccgccccccacgcgtccgggtccccgcggcgccgcgggcggcccaaggctgccgccgccagcgagtcaggcagccgaggttccccagcttacctggccagggcgcggggctgccccggtccgccgccgtc

SEQ ID NO: 77541 - DNA, 99 bp, Homo sapiens
  misc_feature 1..99: note = chr15:34729944-34730043
  misc_feature 1..99: note = hyper
  source 1..99: mol_type = genomic DNA
agctcccgcagagctcgcgcctagccgcacacctcgactgctgattagcccgacagctgaatagcggcgggagcctaccgcgagcggagtacggaaagc

SEQ ID NO: 77542 - DNA, 467 bp, Homo sapiens
  misc_feature 1..467: note = chr15:34786477-34786944
  misc_feature 1..467: note = hyper
  source 1..467: mol_type = genomic DNA
gaaatgattttaaaacgttttggtggagcgctgcgggaggtgcgtgcgcgccccggccgccgaacaaaggagcaggggcgccgccgcggggacccgccacccacctcccggggccgcgccgcggcctcccgtccaccgccaccatgaccgccaacggcacagccgaggcggtgcagatccggttcggcctcatcaactgcggcaacaagtacctgagggcggaggcgttcgggttcaaggttaacgcgtcggccagcagcctgaagaagcagcagatctggacgctggagcagccccctgactaggcgggcagcgcggccgtgtgcctgcgcagccacctgggccgctacctggcggcggacaaggacggcaatgtgacctgcgagcgcgaggtgcccggtcccgactgccgcttcctcaccgtggcgcacgacgacggccgctggtcgctgcagtccgaggcgcac

SEQ ID NO: 77543 - DNA, 241 bp, Homo sapiens; identical to SEQ ID NO: 35643
  misc_feature 1..241: note = chr15:34787232-34787473
  misc_feature 1..241: note = hyper
  source 1..241: mol_type = genomic DNA

SEQ ID NO: 77544 - DNA, 134 bp, Homo sapiens
  misc_feature 1..134: note = chr15:34806507-34806641
  misc_feature 1..134: note = hyper
  source 1..134: mol_type = genomic DNA
cgccggagccgccctgcaccgccctgtcgcggtctccggagcaggctggccgactgagggcgaccatgggtcccaagaaggctccggcagtcgcgggctcccacctcggggcgcggcgacgggggcctagaggg

SEQ ID NO: 77545 - DNA, 513 bp, Homo sapiens
  misc_feature 1..513: note = chr15:34806875-34807388
  misc_feature 1..513: note = hyper
  source 1..513: mol_type = genomic DNA
gcagtggagcgtgagcgggggctgcggctcctggttcttgtggaagatagtcccagaaacttccctttggccttgaaccctgacacggacatcttccactcatctacggcgggaggggcgcggaaggggagcctgtccggagccgctgtcacggccgcgactacccagcggggccgcccagccgagctttcgcgactctgcctctgcctgccgcctggacccttgtgggagcgcggctggaaaatggcaagggcacggaggccttggcgggagctgtgtggcggcctggggggctgctccctttgtaaccgactccacccacaggaggcgcggctcctgtcaagccgcagcttcaaagggcaacataaccactgcccccactaccgcctgggaaagggctgcccctaccctgcccccgtcaccctcacccctcacccctcaaccaggcgggccctgcgcgcaccagtttcggcgggtgcacgagtccagagcgtgcgcgcgctcccggctgcc

SEQ ID NO: 77546 - DNA, 42 bp, Homo sapiens
  misc_feature 1..42: note = chr15:34876396-34876438
  misc_feature 1..42: note = hyper
  source 1..42: mol_type = genomic DNA
ggggatcgcggcctccgaaagccccatcgggcaggggaggcc

SEQ ID NO: 77547 - DNA, 36 bp, Homo sapiens; identical to SEQ ID NO: 44238
  misc_feature 1..36: note = chr15:34879893-34879929
  misc_feature 1..36: note = hypo
  source 1..36: mol_type = genomic DNA

SEQ ID NO: 77548 - DNA, 30 bp, Homo sapiens
  misc_feature 1..30: note = chr15:34911483-34911513
  misc_feature 1..30: note = hypo
  source 1..30: mol_type = genomic DNA
accagcatgagccaccgcacccagccacaa

SEQ ID NO: 77549 - DNA, 30 bp, Homo sapiens
  misc_feature 1..30: note = chr15:34915716-34915746
  misc_feature 1..30: note = hypo
  source 1..30: mol_type = genomic DNA
atctagaaacatgggcgtattaccagattg

SEQ ID NO: 77550 - DNA, 119 bp, Homo sapiens
  misc_feature 1..119: note = chr15:35014151-35014270
  misc_feature 1..119: note = hyper
  source 1..119: mol_type = genomic DNA
ccagcactcggcgggcgcaggctgagctggtgacccgggcaggaccggagccaaaggattaatccatcacaatgagacgttctattctgggcaggcggcgcgagcagatgctgggcgcc

SEQ ID NO: 77551 - DNA, 16 bp, Homo sapiens
  misc_feature 1..16: note = chr15:35014271-35014287
  misc_feature 1..16: note = hyper
  source 1..16: mol_type = genomic DNA
gcggaggcagcgtgca

SEQ ID NO: 77552 - DNA, 279 bp, Homo sapiens
  misc_feature 1..279: note = chr15:35046870-35047149
  misc_feature 1..279: note = hyper
  source 1..279: mol_type = genomic DNA
ggaaagaaatccaagcgcgtcccgaccgatggggcagttggcgcggtctagagagagggcacgaacctcgggcgccgtccggggttcgggtctggatcccgcggacgccgggacgaggggcggggcggggtggcagcctgcaggtcctccagcgctcgcccgcccaggagaagtctcagcgccgctctccgccgcaggttgggggccaggggagggtccgaacaccggctctgttcctgctacttcagcgggcacctggcgctccggcgcggcagcctg

SEQ ID NO: 77553 - DNA, 498 bp, Homo sapiens
  misc_feature 1..498: note = chr15:35047293-35047791
  misc_feature 1..498: note = hyper
  source 1..498: mol_type = genomic DNA
cgtcggagcccgaggggccggggacgcgcgcggggggagaggggcaagagtcctggaggcccggcggggagcggggcgatttcgaaaggaaggactgcagcgcccctcggggcttctcggggagcccaggtaacctcacctgaccgccagacccaagcaggcggagggggagccgggagcggacgcgtgggtgagtggggaggggagtgagtaggtatcttctcttctctcggtgcatccctcaccttttcgctttttgcctcctggagacaactgaaattccttccctagatggagatgctggctgagggagggcgagtgggggcgaccacttttaaatctcccttaggggacagagtggctgagagtgcttctgcagagtggctgcggttcggtgcctctgtggatccgacagtgaagtgagaaaggcttgatgggaatccatttaggctgaagggtaaatgcaggtgtggagctgtctctcggtataggggtcag

SEQ ID NO: 77554 - DNA, 30 bp, Homo sapiens
  misc_feature 1..30: note = chr15:35084827-35084857
  misc_feature 1..30: note = hypo
  source 1..30: mol_type = genomic DNA
agccacggcaaagcccgcttccaatcttgg

SEQ ID NO: 77555 - DNA, 192 bp, Homo sapiens
  misc_feature 1..192: note = chr15:35087595-35087787
  misc_feature 1..192: note = hyper
  source 1..192: mol_type = genomic DNA
ggccttggctgaatgcgggccgggctggccaggtggcggcgcggggctggcgtccggcgcggcccgcggaccaggcgaggagtgaacgcggagggccgggcgctgactcaccgtcggcggggcgggtcggctcggctccggcggcagcgggctctgggtggctggctccaggagggccgctttatagaacgc

SEQ ID NO: 77556 - DNA, 17 bp, Homo sapiens
  misc_feature 1..17: note = chr15:35262895-35262912
  misc_feature 1..17: note = hypo
  source 1..17: mol_type = genomic DNA
agcgagactagcctcaa

SEQ ID NO: 77557 - DNA, 120 bp, Homo sapiens
  misc_feature 1..120: note = chr15:35310610-35310730
  misc_feature 1..120: note = hypo
  source 1..120: mol_type = genomic DNA
aatgctgggattacaggcgtgagccactgcacccagcgtttaaagggaattctgatgtttgtttccatagacagtttttttcttagtaaggaatggatgtaggcacggtgcggtagctca

SEQ ID NO: 77558 - DNA, 39 bp, Homo sapiens
  misc_feature 1..39: note = chr15:35970597-35970636
  misc_feature 1..39: note = hypo
  source 1..39: mol_type = genomic DNA
attacaggcgtgagccacagcgcccggttgacattttta

SEQ ID NO: 77559 - DNA, 258 bp, Homo sapiens
  misc_feature 1..258: note = chr15:37175038-37175296
  misc_feature 1..258: note = hyper
  source 1..258: mol_type = genomic DNA
aagagtggaggttggcggtgcaggcggtgcggctgccagcctgagattgttccggctctcgttacctgtgcgccctcgcgttacatggtgctcataaatcccgcggcagattaactgggaaaccaagaaaatgcctctatgcaccgaaccgttgaaaaagaaccaaaattctctcaaatagtagcagtctcacaccttgcattggacgtgaaacactatagtaagatcaaatgtcaaagacatcggttattttggtgc

SEQ ID NO: 77560 - DNA, 35 bp, Homo sapiens
  misc_feature 1..35: note = chr15:37180103-37180138
  misc_feature 1..35: note = hyper
  source 1..35: mol_type = genomic DNA
cacctcctcacccagcgcctcggattatgagataa

SEQ ID NO: 77561 - DNA, 291 bp, Homo sapiens; identical to SEQ ID NO: 1200
  misc_feature 1..291: note = chr15:37180507-37180798
  misc_feature 1..291: note = hyper
  source 1..291: mol_type = genomic DNA

SEQ ID NO: 77562 - DNA, 337 bp, Homo sapiens
  misc_feature 1..337: note = chr15:37394400-37394737
  misc_feature 1..337: note = hyper
  source 1..337: mol_type = genomic DNA
ttcactgtaagctttcgagcaacagaaactaggctaagattgcagcctgcagagactccaagcggagtcggagaaatttggcctcgttttaatagggctgaggaatgaactccggaggtcaataaagccctccaaaaatgatgaatgattgagcacctgtgatgatgatagtgattaccagagcaattaaacagtttgattaaatgagccatcataacaatgatgtctgcgggaaatcggccctcacatataaagaaagatagtgcgaaggggctggcagaggcgcggatagcgcgacgccagggagaggggctgcgggccgcgaggtttctgccca

SEQ ID NO: 77563 - DNA, 90 bp, Homo sapiens
  misc_feature 1..90: note = chr15:37402997-37403087
  misc_feature 1..90: note = hyper
  source 1..90: mol_type = genomic DNA
aactcaatctcagggcggggtgtgagagctgggggtgagctggctcgggccgggacagaggtctctctgcgtacgccccgctccgcccgg

SEQ ID NO: 77564 - DNA, 221 bp, Homo sapiens
  misc_feature 1..221: note = chr15:37403115-37403336
  misc_feature 1..221: note = hyper
  source 1..221: mol_type = genomic DNA
cgagttctgagaccttggcaaacttccctcccccaaccgccggcgtgacttctgagttgtcactaatccgaacctgatattcaccagagctccttcggtcaccgacaacgctccccgctgctgccgcggcctcccgcccgccctcctcggcgtgttttcatttctaagtctacgggcagggattgccccgacccagtgtgtgtgtgcgtgtgtgtgtgtgc

SEQ ID NO: 77565 - DNA, 163 bp, Homo sapiens; identical to SEQ ID NO: 44239
  misc_feature 1..163: note = chr15:38218484-38218647
  misc_feature 1..163: note = hypo
  source 1..163: mol_type = genomic DNA

SEQ ID NO: 77566 - DNA, 30 bp, Homo sapiens
  misc_feature 1..30: note = chr15:38330892-38330922
  misc_feature 1..30: note = hypo
  source 1..30: mol_type = genomic DNA
cacaacacccggcctcggaagatgaaaatt

SEQ ID NO: 77567 - DNA, 178 bp, Homo sapiens
  misc_feature 1..178: note = chr15:39110605-39110783
  misc_feature 1..178: note = hypo
  source 1..178: mol_type = genomic DNA
tgctctggtgcatggcgtttccttgtgctgtgtctggtaatttgctggctccgctgccacccaacaggccgggcattggtggctcagctgcaggcagcctctacgggctccgtggaggtggcccctgcctgtgaagtgggcaagtctaacagcacctcccaatcgggatgccgcagat

SEQ ID NO: 77568 - DNA, 30 bp, Homo sapiens
  misc_feature 1..30: note = chr15:39416451-39416481
  misc_feature 1..30: note = hypo
  source 1..30: mol_type = genomic DNA
tctgacttggtgactcgtctttgctctgca

SEQ ID NO: 77569 - DNA, 180 bp, Homo sapiens
  misc_feature 1..180: note = chr15:39873123-39873303
  misc_feature 1..180: note = hyper
  source 1..180: mol_type = genomic DNA
ctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctg

SEQ ID NO: 77570 - DNA, 136 bp, Homo sapiens
  misc_feature 1..136: note = chr15:39873365-39873501
  misc_feature 1..136: note = hyper
  source 1..136: mol_type = genomic DNA
cgcgcccctccagccctcgccgccctcgccaccgctcccggccgccgcgctccggtacacacaggtaagtcgcccccggcggccgccgaggaccaaagctgcccgggacatccacctggagcgctgaggcttcagt

SEQ ID NO: 77571 - DNA, 691 bp, Homo sapiens
  misc_feature 1..691: note = chr15:40211553-40212244
  misc_feature 1..691: note = hyper
  source 1..691: mol_type = genomic DNA
tgttccgaagaagcacgcagtaaaacacgcacaaaataagggtctatcaaaataattgtatatattattatttcgagatatatatggaaagatgggatcgcaaaacatctttaacagaatgggtaacattccgttcaattatcagtaacaaattcccacagaatctttattcctcgctatttgtaaacaagagctgaagccagccgggcacccaggagcattccgccggggccatctgaggagggggactcccgcctggatcccgctccatcctcgggccacgagaaagccctatttgaactcttctgctcccgcgtgggggctggagtccaccgtccctgcttaactacactgcagctacccgggatccttaagcttccttcaactctctgcactttgccaggcacccgaaacccacggcggctgggcggccctgctcccggctctccgagcctgtaccctcggggaggcccggtccggaggcgccccgcgggaggcttaccgagcagcgagcctatgaagatgacgacctgcacggtggtggtgaactggcggtacagctgcgcctcgccgaactccccgagcgcgctgcggttcacacccgcagcctcggcgccggacgcgttgtgcggctcgctggcatttggagagatccagctcccgttatgtcccatggcgaggctgggactcc

SEQ ID NO: 77572 - DNA, 353 bp, Homo sapiens
  misc_feature 1..353: note = chr15:40212601-40212954
  misc_feature 1..353: note = hyper
  source 1..353: mol_type = genomic DNA
gctgcctccttcaaccgcgggtcctccgcccctcgagggctagggcatccctctccagtcccctcgggctgacgcactcgacccctctccttagcgggaggagaacgtttggccgaagctatttttcagtcctgttggcttcgaggctggatggcgatgtgaagccaacgtaatgcccacgccgagtggccggagccacgaggggacccccgagtgcccgacagcgcccatggcttgggtggaaagccctgagcgtccccagcagcctggccctgcgcccggccgcctgccaagacgcccgtgctgggtcctgcttcccagcccctcacttgtggctccgacctcctgcctca

SEQ ID NO: 77573 - DNA, 17 bp, Homo sapiens
  misc_feature 1..17: note = chr15:40228636-40228653
  misc_feature 1..17: note = hypo
  source 1..17: mol_type = genomic DNA
ggagtttctctctgtcg

SEQ ID NO: 77574 - DNA, 47 bp, Homo sapiens
  misc_feature 1..47: note = chr15:40368182-40368229
  misc_feature 1..47: note = hypo
  source 1..47: mol_type = genomic DNA
tcagcctcagagctgcggtcagtgcgtggagccggctacctgttggg

SEQ ID NO: 77575 - DNA, 30 bp, Homo sapiens
  misc_feature 1..30: note = chr15:40420189-40420219
  misc_feature 1..30: note = hypo
  source 1..30: mol_type = genomic DNA
ctaacatccagggggcgaaggatgatatta

SEQ ID NO: 77576 - DNA, 84 bp, Homo sapiens
  misc_feature 1..84: note = chr15:40420940-40421024
  misc_feature 1..84: note = hypo
  source 1..84: mol_type = genomic DNA
tttccaaacatgcagcggggtacatattaataatacccccaatatggaaagcagacaccccccgcgatgcggggagtaatatcc

SEQ ID NO: 77577 - DNA, 101 bp, Homo sapiens
  misc_feature 1..101: note = chr15:40423345-40423446
  misc_feature 1..101: note = hypo
  source 1..101: mol_type = genomic DNA
gagaagacgatattaatcccaatattgcagaaggtgtagacctcccctgatattcaggggaaagagcacgatattgctcccaatatcgcagtctgtgtacg

SEQ ID NO: 77578 - DNA, 189 bp, Homo sapiens
  misc_feature 1..189: note = chr15:40532032-40532221
  misc_feature 1..189: note = hypo
  source 1..189: mol_type = genomic DNA
acgtgtgtgtgagtgcgagagtgtgtaagccagtgtgtgtgccgtccccctgctggggacagcagctgggtccagcagagagctggctgggggcttgacaggagtttatcctaactgatgctgggtgggcgcaggccctgagatgggcgtcagggagaggggacgccagacacacggcctgagcagggt

SEQ ID NO: 77579 - DNA, 30 bp, Homo sapiens; identical to SEQ ID NO: 44244
  misc_feature 1..30: note = chr15:40532791-40532821
  misc_feature 1..30: note = hypo
  source 1..30: mol_type = genomic DNA

SEQ ID NO: 77580 - DNA, 779 bp, Homo sapiens
  misc_feature 1..779: note = chr15:40544663-40545442
  misc_feature 1..779: note = hyper
  source 1..779: mol_type = genomic DNA
tggccaaggccccagcgacacttggcaacttctcccgcgctctgggttcgccgccgcgtcctacctgaggccacaccctgaaatcaaaatcgcggtcaggtgaagccggcgctgcaccaacgtgtaagcgcggcccctcctcggcgttcccgcgccgaggtccctcccgcggagggcgggcccggctcccacgacctcttcgagcgttcctgggcttcccgctccgcaggtgggttccccggctgccccggaggttcgcggcgagaggacgggcctcccaacacgcgcagcccccttcctgggtgcccatgccccgaagttcgggaccagccggcgccaggcgaggggccttgggcgcaggcatctggagctccgcgtccctggagcgggacctccctccgcgggcgcccgcccggcgcggggcattcgcgtccccgagagggcgcagcagtggggcctgcgagctggggccgggtggccgcgccgggtcggagtgtggctggagaggggccgccccggaagcggtgctgcgcccaacgtccccttctccccgtaagccccgcaaggagcctgccgcctcttgcacctgagccaggagttcagtcgggaggcgggcgcggagcggttcccagcgcctggacgtcagccagtcgcaacacccgcgggaacacttgctacatttgccataatgcatttctgatctgtttccgcgcaggcctgcggaggactggcccagcaaggtcccaggtcttccctctcctcagcgcctaagagagagg

SEQ ID NO: 77581 - DNA, 56 bp, Homo sapiens; identical to SEQ ID NO: 44245
  misc_feature 1..56: note = chr15:40545776-40545832
  misc_feature 1..56: note = hypo
  source 1..56: mol_type = genomic DNA

SEQ ID NO: 77582 - DNA, 30 bp, Homo sapiens; identical to SEQ ID NO: 44246
  misc_feature 1..30: note = chr15:40546043-40546073
  misc_feature 1..30: note = hypo
  source 1..30: mol_type = genomic DNA

SEQ ID NO: 77583 - DNA, 43 bp, Homo sapiens
  misc_feature 1..43: note = chr15:40574169-40574212
  misc_feature 1..43: note = hyper
  source 1..43: mol_type = genomic DNA
atgctcggggctggccgcgggggccgggcggccagggggacta

SEQ ID NO: 77584 - DNA, 308 bp, Homo sapiens
  misc_feature 1..308: note = chr15:40575513-40575821
  misc_feature 1..308: note = hyper
  source 1..308: mol_type = genomic DNA
gagcggttcctcctccgcgctcccctgggaatgcggcggcggttgcggggcgggggcgggggctgctcgccgggggccacatgcacccaaccgggccaatcccaaagtcgcagtcttctctccccgccctccgcccccaaccgagtcggtgccctcggctccttagaaactggcgggacctcggcctcgtcggggaagactgaaagctgcccccatcggtccagggtgaaaggaattgggaccccatgagcgcagaactggaccacgcgcgagctaggggtggcagcgaaaggcggatgaggagtaat

SEQ ID NO: 77585 - DNA, 169 bp, Homo sapiens
  misc_feature 1..169: note = chr15:40639225-40639394
  misc_feature 1..169: note = hypo
  source 1..169: mol_type = genomic DNA
gaggcaggggagtggcggtggcttttacctgcaagaggacattaggttaggaaggtacagaccagactggggaggcactggaaggtagactgaggaggtggagtcatgcagaggggctgaaagttttacagcagctgctgatgaggccaccccacggtttaggaagctg

SEQ ID NO: 77586 - DNA, 31 bp, Homo sapiens
  misc_feature 1..31: note = chr15:40676552-40676583
  misc_feature 1..31: note = hypo
  source 1..31: mol_type = genomic DNA
cgacagagcgagactccgtctcaaaaaaaaa

SEQ ID NO: 77587 - DNA, 26 bp, Homo sapiens
  misc_feature 1..26: note = chr15:40729159-40729185
  misc_feature 1..26: note = hyper
  source 1..26: mol_type = genomic DNA
ggcagactgcaaagacgtcccctggc

SEQ ID NO: 77588 - DNA, 27 bp, Homo sapiens
  misc_feature 1..27: note = chr15:40856301-40856328
  misc_feature 1..27: note = hypo
  source 1..27: mol_type = genomic DNA
agccaccgcgcccggcccctaaattct

SEQ ID NO: 77589 - DNA, 30 bp, Homo sapiens
  misc_feature 1..30: note = chr15:41056770-41056800
  misc_feature 1..30: note = hyper
  source 1..30: mol_type = genomic DNA
caggggaaaaaagggcgaataacctgagag

SEQ ID NO: 77590 - DNA, 30 bp, Homo sapiens
  misc_feature 1..30: note = chr15:41059436-41059466
  misc_feature 1..30: note = hypo
  source 1..30: mol_type = genomic DNA
gtcgatgaccctccccgcatagtcctggac

SEQ ID NO: 77591 - DNA, 87 bp, Homo sapiens
  misc_feature 1..87: note = chr15:41078532-41078619
  misc_feature 1..87: note = hypo
  source 1..87: mol_type = genomic DNA
gaaagccaggtatcccgggttggaagctcctccagaaactgactctggcccaggtccagtggctcacgcctgtaatcccagcatttt

SEQ ID NO: 77592 - DNA, 30 bp, Homo sapiens; identical to SEQ ID NO: 71306
  misc_feature 1..30: note = chr15:41091139-41091169
  misc_feature 1..30: note = hypo
  source 1..30: mol_type = genomic DNA

SEQ ID NO: 77593 - DNA, 30 bp, Homo sapiens
  misc_feature 1..30: note = chr15:41137117-41137147
  misc_feature 1..30: note = hyper
  source 1..30: mol_type = genomic DNA
ctacgagcagaacttcgtgtgcaagttcgc

SEQ ID NO: 77594 - DNA, 30 bp, Homo sapiens
  misc_feature 1..30: note = chr15:41158108-41158138
  misc_feature 1..30: note = hypo
  source 1..30: mol_type = genomic DNA
atgggaggcagcctccgcattactgcatgc

SEQ ID NO: 77595 - DNA, 93 bp, Homo sapiens
  misc_feature 1..93: note = chr15:41164710-41164803
  misc_feature 1..93: note = hypo
  source 1..93: mol_type = genomic DNA
ctctctcctcctcctcgtcatcttctttccaggccttatccaccatcagtcccaggctccaagacctcttttcctgctcgctctctcaatctc

SEQ ID NO: 77596 - DNA, 412 bp, Homo sapiens
  misc_feature 1..412: note = chr15:41165245-41165657
  misc_feature 1..412: note = hypo
  source 1..412: mol_type = genomic DNA
ccatagctgctcaaacgaagcagaagaacttcttccagcggcagcgggagagggtgcgcacacctttggcattcagtttcttctccagccgggctttgtgctcaatggcactgagaatagccgagtcaaatacttccttcaagttcttctgcgtcaaggctgagcactcaaggtagcagcaggctcggatcttctcggccagaccctgagcctggggttggggcacggggccctcccggcccccctggtccagctgaattagtacgttgacatcgtccctcaggtcggcctgggtgcccaccagcagcacaggcgcctgggggttgtgcgtgcggatctcgggcagccatttctctgtgatgttttgaaaggagctgggctgcaccacgctgaagcacgccaggaagacatc

SEQ ID NO: 77597 - DNA, 58 bp, Homo sapiens
  misc_feature 1..58: note = chr15:41291802-41291860
  misc_feature 1..58: note = hypo
  source 1..58: mol_type = genomic DNA
caaaggttaatatttcgtaattgtatttatttaattcataaaacgccatctttatgat

SEQ ID NO: 77598 - DNA, 30 bp, Homo sapiens
  misc_feature 1..30: note = chr15:41409360-41409390
  misc_feature 1..30: note = hypo
  source 1..30: mol_type = genomic DNA
tcacctcaggccaaacgtctcagagcagtc

SEQ ID NO: 77599 - DNA, 45 bp, Homo sapiens
  misc_feature 1..45: note = chr15:41456235-41456280
  misc_feature 1..45: note = hypo
  source 1..45: mol_type = genomic DNA
tgaatttatcacaatcgaaatgttatttcacggcaaagctttaga

SEQ ID NO: 77600 - DNA, 36 bp, Homo sapiens
  misc_feature 1..36: note = chr15:41495761-41495797
  misc_feature 1..36: note = hypo
  source 1..36: mol_type = genomic DNA
cattctccctgaaggcgatcacggaaaccagaaccc

SEQ ID NO: 77601 - DNA, 737 bp, Homo sapiens
  misc_feature 1..737: note = chr15:41786804-41787541
  misc_feature 1..737: note = hyper
  source 1..737: mol_type = genomic DNA
gctccgccggcgggtcgtggcgctggccctggggcgtctaagaagcggggcgaggagcaggcgacccgccgcggggactgggcgaagcgggggtagcggaccttgttggctgtgggttaggacaggagggatcggaggggctgagccttgccgggtgaaccctcggaaggagagaggcgaaggagagtttcccttaccccccgccccctctccggtgccgcggccgcacccccgccgttgccacggtttccctctcctgagtgggagtggagcggcgctccaggctctgctcgggagccgctgccgtctgctcccagcgcccgcacgaggcgtggacgcaggggagggaggggcgtgggcctgggagctctggctgggagcggaacgcagcccacccagtgcgcgccctgcctcccatcttcccggctcgccgctcctgagcgcggcagagaggggcggtaaactgaggctgcaagggggcaggatcactctgctagtctctgcctctgatagcctgggtgttctgggaccaggtctgaccctcggaaaacacagccctgggcactgttaagtcattcctgacgcccgccacttagggatgtgcggctcccgggacaccctccttgttcccctcgttttaaccaaggccaaataccttgaataactgtccgtggtcagcgcgaaggactttctttagatccacgtttcgcaagtgtccctgaggccgaggaagaggc

SEQ ID NO: 77602 - DNA, 53 bp, Homo sapiens
  misc_feature 1..53: note = chr15:41788173-41788226
  misc_feature 1..53: note = hyper
  source 1..53: mol_type = genomic DNA
cgccgccctccgagccgtcgggagccggtgcaaatcgccgctgagggcccttc

SEQ ID NO: 77603 - DNA, 1221 bp, Homo sapiens
  misc_feature 1..1221: note = chr15:41804641-41805862
  misc_feature 1..1221: note = hyper
  source 1..1221: mol_type = genomic DNA
tatttcaggagggttcgtggaaatgtggggaggctcaagcaccccttggcgccgccctggttgggggccttccgctcggtgtaagaggttccgggtaagggctaactcggtggcgactactgccaccttgaagggcactcaaggtggacctccccgcggaatagtccaagacgcaagtcggtgcgcacgtggacttcgttaccctgagggtgaaacctccaactagcaggtcactgtccaccctacctccgccgtgcacttacagatactggccagggcccggcacgcgccacagctgcacgcctctcagctgcccggcggcccccacggtcaccaccacgctggtccccgcgtacgccccgtcacattgtgtctgtgtgggcccatgccggccgctggccccgcaggtagaaaacagccaagacccctcggtgcctgagagcaaggagcgaggcaagggtcgtcgagcccctggctgggccagaggggtctggtatggtgagcgaaagaggaaggaggcgtctaaagctcacccggagaattcagcggggaggctggctccaagatactaggcggggcgctgactttcgggtcccgggggctgggacttgccagcggcaggggcgaggaccgcagaaaagtctcctgggaccccgggctagagcagagaatggcgcctgaaaggtgttgggagaaggcgcaggacgttaaggcgggtggaaataggatatgaaagaaagagagaaccccgcaacagctgcccttgcggtcgcggccacacccgtcacccggcccagccgcgctctcagcctggaagccactacccgactccggtcgcagaagccccgcgggtgcgcgctgataggtctgccagtttctctcctcgagcgcctttcccagtgaataacttaggggccgcaatgaatttggtcctgcagcctccccaatgctttcctcaacttagattggtggccccgccccaaggcggtgctgagaccccaaagaatgttcctccttcccaagctgcgtgatccagactctgggattcgcacgcacttggcgcttctcggcccgcactccagaagcacggaccggagaaatttggctgtgagagttcgaggcctctggaggaaccactgacacctggcctgttgaccggccacccccaagcctaggaaagtgcctcaggctggacggtcccctgaccgccagatagcactt

SEQ ID NO: 77604 - DNA, 30 bp, Homo sapiens
  misc_feature 1..30: note = chr15:41806074-41806104
  misc_feature 1..30: note = hyper
  source 1..30: mol_type = genomic DNA
cctcagaccccaggacgccagaggaggaaa

SEQ ID NO: 77605 - DNA, 95 bp, Homo sapiens
  misc_feature 1..95: note = chr15:41835731-41835826
  misc_feature 1..95: note = hypo
  source 1..95: mol_type = genomic DNA
tttccacaactgtaaaatgtgagtaacaggtcctatataataggaaatgtgtgaggatttaaatgactatacacgcaaaacgcctagcccagtgc

SEQ ID NO: 77606 - DNA, 103 bp, Homo sapiens
  misc_feature 1..103: note = chr15:41877608-41877711
  misc_feature 1..103: note = hyper
  source 1..103: mol_type = genomic DNA
aaggcttggcctggccggcgggacaccagcgcctttgtccgcggcgcagaagggccccagctgcggacagagccggcgccctgcaggccgcggggaggagcgc

SEQ ID NO: 77607 - DNA, 30 bp, Homo sapiens; identical to SEQ ID NO: 44250
  misc_feature 1..30: note = chr15:41878349-41878379
  misc_feature 1..30: note = hypo
  source 1..30: mol_type = genomic DNA

SEQ ID NO: 77608 - DNA, 45 bp, Homo sapiens; identical to SEQ ID NO: 35664
  misc_feature 1..45: note = chr15:41913327-41913372
  misc_feature 1..45: note = hyper
  source 1..45: mol_type = genomic DNA

SEQ ID NO: 77609 - DNA, 224 bp, Homo sapiens
  misc_feature 1..224: note = chr15:41913733-41913957
  misc_feature 1..224: note = hyper
  source 1..224: mol_type = genomic DNA
tccgggacccgcgagcggagcggcgcgtgggtcggttgcggtcggccccggcaggtatgcgcaggcgccttgcttgccacgcgctacgcccgtccccacgcgcctggtggcgtgttcttggcgcgaagtgttaagagtctgggtgtttttgtgcgttggggggaaggagagggtggcgggggcgggggggcgctgaggcgtcacgtggacgccacagccaatct

SEQ ID NO: 77610 - DNA, 73 bp, Homo sapiens
  misc_feature 1..73: note = chr15:41914167-41914240
  misc_feature 1..73: note = hyper
  source 1..73: mol_type = genomic DNA
ggggagtgctggggccgcgtgaaggtcacatgacgaggttggcagcgcgtgctgctggcgcggggtaggggga

SEQ ID NO: 77611 - DNA, 973 bp, Homo sapiens
  misc_feature 1..973: note = chr15:41952201-41953174
  misc_feature 1..973: note = hyper
  source 1..973: mol_type = genomic DNA
gggtctgcggagccccgtgtgggtggggctgggcgcggccggggcggagccggcgaggagccctagggaaagggtgaaaggcacagttgagaaaggcccgccgggcattggtttcacagtttccacgaaggcttcgtgtgcaagcctgaggagtttaggtgcctccctcctgcctcgcctttcttggttctagaaccttcagtaggcttttctgggttgcagggacccggaaaagcagcggcttccactcggggggcgggtcccaagggtcttgctgctgctctggggccgtttggactcctggtgttgggggaggggtcagggaggtgctgctcgcgtctccttttgcgcctgcgcggcgggctccgagcgggtaggagcgcgtgcgcggtgacgtggacgtccggtgcgcgcgcgcaggctcttcagctggagcggacacacggtgtgcgaaccgaacagaataacccgcccccagcgggatgtgaaggactccgggtgaggccggccacgccccgcacggtaactctcgggcctgggtggagggcatcgcttagtactggcccgattggagtttttcgagagtttgaagctcttgtgtatttgaacggcgtgagaaacgttccgctgagagagcttcgcacgccctcgccaggccgggccttgcgcagggccgcctttggcgcgcccctgtggtccctgagcgaggctgcgcatgtcacctcgcgcgcgtccccggcctcacttccgcgtcgctcagctacctaactgggaacatcgacgccagagagagcggccacgaggcgggaggggtgagaagcgcccatggctcggccctgccctcgcgtgtgtggggtgccgctccgcgtggtacggtccgcgtgacgacttctcgcccggcgccgggctctaggtcgagagccacgcttacgcgcttttcagtttagagcctaggtctcgtggttctagaact

SEQ ID NO: 77612 - DNA, 62 bp, Homo sapiens
  misc_feature 1..62: note = chr15:41954254-41954316
  misc_feature 1..62: note = hyper
  source 1..62: mol_type = genomic DNA
ggaaggcagtgagaccgagccttttactttcctgcgtatcggaacagcgctagtgtttcttg

SEQ ID NO: 77613 - DNA, 49 bp, Homo sapiens
  misc_feature 1..49: note = chr15:42151201-42151250
  misc_feature 1..49: note = hypo
  source 1..49: mol_type = genomic DNA
gcctggagccacccccggggccaggtggggtgcccgtccagcctaggct

SEQ ID NO: 77614 - DNA, 30 bp, Homo sapiens
  misc_feature 1..30: note = chr15:42159399-42159429
  misc_feature 1..30: note = hypo
  source 1..30: mol_type = genomic DNA
tttctttgagggccccggagccctttcctc

SEQ ID NO: 77615 - DNA, 77 bp, Homo sapiens
  misc_feature 1..77: note = chr15:42448018-42448095
  misc_feature 1..77: note = hypo
  source 1..77: mol_type = genomic DNA
gactcactgaactaacgatggctgtcacgcaccacacacctgcagctcccctcagacgctcgcgcccccactctagc

SEQ ID NO: 77616 - DNA, 91 bp, Homo sapiens
  misc_feature 1..91: note = chr15:42562561-42562652
  misc_feature 1..91: note = hypo
  source 1..91: mol_type = genomic DNA
cgtctcaaaaaacaacaacaaaaaataaagtgcctcaaatcctccaaaaacaatgaaatataaacacttcaaaatacgcagttagggctgg

SEQ ID NO: 77617 - DNA, 399 bp, Homo sapiens
  misc_feature 1..399: note = chr15:42684673-42685072
  misc_feature 1..399: note = hypo
  source 1..399: mol_type = genomic DNA
gggccactgaaggtccgttcgtggtcgtgaggcacactttcagggagcagagtggtctgtgtcttcacagagcccggaaaatgaactagtatgaactttgcctccaagcagcagaacttctgttcccccgcccctaatgggttctctggttactgctctacagacaatcattccggttcagtatgagacaagaatggcctgcgggctggtcagaggtcacgcctactctgtcacggggctggatgaggtaagcctggtggggcttggtggggcaagggcaccctcctgggttaacctcatgaagtcaggacttagctgttggggccccttccctgtctgcagagcttgcctccaatcaggacattcagttcaaggtccaagccacgcctgggagcagag

SEQ ID NO: 77618 - DNA, 41 bp, Homo sapiens
  misc_feature 1..41: note = chr15:42748507-42748548
  misc_feature 1..41: note = hypo
  source 1..41: mol_type = genomic DNA
actggaaaatttaaacgccaaataaaaacttattggtattc

SEQ ID NO: 77619 - DNA, 40 bp, Homo sapiens; identical to SEQ ID NO: 44254
  misc_feature 1..40: note = chr15:42784374-42784414
  misc_feature 1..40: note = hypo
  source 1..40: mol_type = genomic DNA

SEQ ID NO: 77620 - DNA, 79 bp, Homo sapiens
  misc_feature 1..79: note = chr15:42868395-42868474
  misc_feature 1..79: note = hyper
  source 1..79: mol_type = genomic DNA
agcagaaggtgagggcgtgagggggaaattgaggccgacacaggtcgcggtttctttctatgctcgacagctgatttaa

SEQ ID NO: 77621 - DNA, 141 bp, Homo sapiens; identical to SEQ ID NO: 44255
  misc_feature 1..141: note = chr15:43020219-43020360
  misc_feature 1..141: note = hypo
  source 1..141: mol_type = genomic DNA

SEQ ID NO: 77622 - DNA, 30 bp, Homo sapiens
  misc_feature 1..30: note = chr15:43213577-43213607
  misc_feature 1..30: note = hyper
  source 1..30: mol_type = genomic DNA
cgccgtccccagaaccgcctaacgtgaagc

SEQ ID NO: 77623 - DNA, 198 bp, Homo sapiens
  misc_feature 1..198: note = chr15:43467727-43467925
  misc_feature 1..198: note = hypo
  source 1..198: mol_type = genomic DNA
actgtagactgtggccgcagaatggagcttctctgagtcaagcccttacacttgggctttttggcactgtattttaaaagcacgttaatttggaaagtttagggaagcctttcagttggagtaagaggttagctgtgcgttaagaactgtagaaatagggaaagcgctggcagccaagatggccgaacaggaacagct

SEQ ID NO: 77624 - DNA, 30 bp, Homo sapiens
  misc_feature 1..30: note = chr15:43502442-43502472
  misc_feature 1..30: note = hypo
  source 1..30: mol_type = genomic DNA
gggtttctgaggccacggtggtggggcagg

SEQ ID NO: 77625 - DNA, 30 bp, Homo sapiens
  misc_feature 1..30: note = chr15:43508293-43508323
  misc_feature 1..30: note = hypo
  source 1..30: mol_type = genomic DNA
ccaggcacataatctcgtggcaccctcatg

SEQ ID NO: 77626 - DNA, 16 bp, Homo sapiens
  misc_feature 1..16: note = chr15:43511842-43511858
  misc_feature 1..16: note = hypo
  source 1..16: mol_type = genomic DNA
acagaataaaaagaac

SEQ ID NO: 77627 - DNA, 30 bp, Homo sapiens
  misc_feature 1..30: note = chr15:43519643-43519673
  misc_feature 1..30: note = hypo
  source 1..30: mol_type = genomic DNA
gatggtggtctactccggggggtgttagta

SEQ ID NO: 77628 - DNA, 30 bp, Homo sapiens
  misc_feature 1..30: note = chr15:43527822-43527852
  misc_feature 1..30: note = hypo
  source 1..30: mol_type = genomic DNA
ccatgttgggcgggtcgagcagcttgaatt

SEQ ID NO: 77629 - DNA, 35 bp, Homo sapiens
  misc_feature 1..35: note = chr15:43622105-43622140
  misc_feature 1..35: note = hyper
  source 1..35: mol_type = genomic DNA
gaggtaggtcagcaccgcctcggccaggagcagag

SEQ ID NO: 77630 - DNA, 101 bp, Homo sapiens
  misc_feature 1..101: note = chr15:43661891-43661992
  misc_feature 1..101: note = hypo
  source 1..101: mol_type = genomic DNA
tctccccaggtaagacggtcaggaactgctctagcaccaacagttctacaatctgctccttggtgcgcacctccggccttagccaccgacagcaaagttcc

SEQ ID NO: 77631 - DNA, 342 bp, Homo sapiens
  misc_feature 1..342: note = chr15:43810570-43810912
  misc_feature 1..342: note = hyper
  source 1..342: mol_type = genomic DNA
ccctgcatttccagtcgtgtcaaccccacaggttcccagtctcagccctacccccacctcatctctgcttctcttcccaagatgggggctcttgaacagaggagccagtttcttctctctctctgcatccccccatccccaccccccatgcagaagcagccaagaaaatgacttgtcatgctggggtggggggtgggggcggagctggagccggagctcagcgcgcacactcacacactgcggcaaactgcagctgcccaaacggtccccctccccttctgcctcactgcggagacacctgccctcctgcctgctcagcctctgcaccgcagcccacccccc

SEQ ID NO: 77632 - DNA, 160 bp, Homo sapiens; identical to SEQ ID NO: 44258
  misc_feature 1..160: note = chr15:44037474-44037634
  misc_feature 1..160: note = hypo
  source 1..160: mol_type = genomic DNA

SEQ ID NO: 77633 - DNA, 23 bp, Homo sapiens
  misc_feature 1..23: note = chr15:44090533-44090556
  misc_feature 1..23: note = hypo
  source 1..23: mol_type = genomic DNA
actgcacccggccattactcctc

SEQ ID NO: 77634 - DNA, 274 bp, Homo sapiens
  misc_feature 1..274: note = chr15:44092138-44092412
  misc_feature 1..274: note = hypo
  source 1..274: mol_type = genomic DNA
ggcccagggaggtgccggggctggggccggccttggcacccaccatccttgtcccagggattaggcttaggtccaccagatggaaggcagatgagagcagcagttgcttctgtcctcagcccattggactgccactgtgttggggctgagcacccggtcccgggcagaatggagacgtccggaagagaacactgacctccaggttgcggtaaatgcaaatgccctgtgaaggagctttgtccttagggcctcaacactgcggccactcaggctg

SEQ ID NO: 77635 - DNA, 208 bp, Homo sapiens
  misc_feature 1..208: note = chr15:44115848-44116056
  misc_feature 1..208: note = hypo
  source 1..208: mol_type = genomic DNA
atgggcataagacaccgtgcctggccgcagcacttttttgaacaaggggacaaccacctgcctctcagtagggaataaagtgtggattacagtttattttatacaatggaattcataagctgttaagatgaatgaattagatgtatagggatccaaagataattctcaaaagccatgttgagactagatacggcggcatctactcggg

SEQ ID NO: 77636 - DNA, 170 bp, Homo sapiens; identical to SEQ ID NO: 35669
  misc_feature 1..170: note = chr15:44486726-44486896
  misc_feature 1..170: note = hyper
  source 1..170: mol_type = genomic DNA

SEQ ID NO: 77637 - DNA, 24 bp, Homo sapiens
  misc_feature 1..24: note = chr15:44827765-44827789
  misc_feature 1..24: note = hypo
  source 1..24: mol_type = genomic DNA
tttttttttttgagacgggtctaa

SEQ ID NO: 77638 - DNA, 27 bp, Homo sapiens
  misc_feature 1..27: note = chr15:45046196-45046223
  misc_feature 1..27: note = hypo
  source 1..27: mol_type = genomic DNA
agccgcagtgcccggctgcttcaaaca

SEQ ID NO: 77639 - DNA, 30 bp, Homo sapiens
  misc_feature 1..30: note = chr15:45389393-45389423
  misc_feature 1..30: note = hypo
  source 1..30: mol_type = genomic DNA
ggcctctgtcgctcccgacccaggtcaggc

SEQ ID NO: 77640 - DNA, 88 bp, Homo sapiens
  misc_feature 1..88: note = chr15:45403593-45403681
  misc_feature 1..88: note = hyper
  source 1..88: mol_type = genomic DNA
ggggcccgttctgcccggtggcggggtcgggcgccgcccacatgagcagggggttctgcgagtctcgggggaaagcggggtcgggccc

SEQ ID NO: 77641 - DNA, 202 bp, Homo sapiens; identical to SEQ ID NO: 1202
  misc_feature 1..202: note = chr15:45403798-45404000
  misc_feature 1..202: note = hyper
  source 1..202: mol_type = genomic DNA

SEQ ID NO: 77642 - DNA, 88 bp, Homo sapiens
  misc_feature 1..88: note = chr15:45404102-45404190
  misc_feature 1..88: note = hyper
  source 1..88: mol_type = genomic DNA
cggggcaaccgggcgtttccacgctcaccacgtcggaaagaacatggtagcctgcgggcatggggcgccaatacgtgacaaaccgtcc

SEQ ID NO: 77643 - DNA, 249 bp, Homo sapiens
  misc_feature 1..249: note = chr15:45404917-45405166
  misc_feature 1..249: note = hyper
  source 1..249: mol_type = genomic DNA
tgcggaggcagggagcggggctctgtctaagcactccatcccctaggatcccccaaacctctccctaagcctccctcaacccccatcccacttcactgacagaaccttccctcaagggtctcttggccccgggagcgcataagattgcgctgtgtaggcagcggagctgctgggcgcgtgttccccgcagattccccgctcagggcctttcgcgccccggcccttcgcgagccacggccccagcacgcc

SEQ ID NO: 77644 - DNA, 139 bp, Homo sapiens
  misc_feature 1..139: note = chr15:45405416-45405555
  misc_feature 1..139: note = hyper
  source 1..139: mol_type = genomic DNA
tcccgctgagctgcacggcgaaatgaccttccagtctcagggagccgcttgccgcacctctccccgccccacctcccagggatcctggggaacaccccgccgctagaggagcctgatacttgcccgatggacccaggga

SEQ ID NO: 77645 - DNA, 414 bp, Homo sapiens
  misc_feature 1..414: note = chr15:45406452-45406866
  misc_feature 1..414: note = hyper
  source 1..414: mol_type = genomic DNA
ctgggctgggacacccgtgtggcacgtcgcccacgctgctataaaaggggtcccgcgcgacttccaaactcagcgccaacccgcagaaccaggaaagtaacggctacagacagtgagaaatagtttcgctcgccggctagaaaaactctgtcggtaccaaccccagagcgttgagagcagcccacctccacgcttccttaacggagaggtgcaggactcagacttcaccagcccactcggtcccagccttgtacgcaaagagacgccaaggacgcgctctcccgcgtccaggcagccccagcttgctggcttgcctgcccgcctgcgtgcagcactcggccggcgtgcagcatgaccctgtggaacggcgtactgcctttttacccccagccccggcatgccgcaggcttcagc

SEQ ID NO: 77646 - DNA, 28 bp, Homo sapiens
  misc_feature 1..28: note = chr15:45406867-45406895
  misc_feature 1..28: note = hyper
  source 1..28: mol_type = genomic DNA
ttccactgctcatcgttattctagtgtt

SEQ ID NO: 77647 - DNA, 57 bp, Homo sapiens
  misc_feature 1..57: note = chr15:45409154-45409211
  misc_feature 1..57: note = hyper
  source 1..57: mol_type = genomic DNA
ggaattcccctgcaccgctgccatcccagtccctggctttgacgctggggtagggat

SEQ ID NO: 77648 - DNA, 413 bp, Homo sapiens
  misc_feature 1..413: note = chr15:45421268-45421681
  misc_feature 1..413: note = hyper
  source 1..413: mol_type = genomic DNA
ccgtggaacctcacacgaagcgcccccgggggtgtgattaaagagggaaccaggtcccgacgttctgtgaacaaacgcgcgcccttactctcagtggggctcccgtccgacccccactcctctcctaactcacgtaaggacccggctgtgaccggacaaaccgggtctggggtgcttccagtcactcttcaagtcactcccaaacttctcagactgcacccgaggctctgcggcgccgcctccctctcccggcctggtacagagaagggctgggtgcgccaggacagtagtaccggggtctgccagctccgcagaggtccctccaatcccccctcctcctctgcgcccccccacccatgcccagcaatcccagcagctccagcgcaaacctagcgacgcagttccgggtctgg

SEQ ID NO: 77649 - DNA, 140 bp, Homo sapiens; identical to SEQ ID NO: 35678
  misc_feature 1..140: note = chr15:45421706-45421846
  misc_feature 1..140: note = hyper
  source 1..140: mol_type = genomic DNA

SEQ ID NO: 77650 - skipped

SEQ ID NO: 77651 - DNA, 351 bp, Homo sapiens; identical to SEQ ID NO: 35679
  misc_feature 1..351: note = chr15:45427369-45427720
  misc_feature 1..351: note = hyper
  source 1..351: mol_type = genomic DNA

SEQ ID NO: 77652 - DNA, 88 bp, Homo sapiens
  misc_feature 1..88: note = chr15:45427771-45427859
  misc_feature 1..88: note = hyper
  source 1..88: mol_type = genomic DNA
cggggcccgaccccgcttttccccgagactcgcagaaccccctgctcatgtgggcggcgcccgaccccgccaccgggcagaacgggcc

SEQ ID NO: 77653 - DNA, 290 bp, Homo sapiens
  misc_feature 1..290: note = chr15:45471645-45471935
  misc_feature 1..290: note = hypo
  source 1..290: mol_type = genomic DNA
gcccttcacttcctacgctgcccctttctcccacacaagtgggctcacggccactcctctatgcctgctgccattcatcgcacagtgaactgcaaaccacacactccgaagaggcactcaaggtgctcagggcggggcgcagctgaggacaatagaacctttctccaagctgggcttgggcttctcctgatggggcgctggctgaggcagagactgagcccggttcacccagggctgccagcaccccaggagcactgcaccactgggttgacaggcgatgacaggaggtg

SEQ ID NO: 77654 - DNA, 71 bp, Homo sapiens; identical to SEQ ID NO: 1203
  misc_feature 1..71: note = chr15:45479446-45479517
  misc_feature 1..71: note = hyper
  source 1..71: mol_type = genomic DNA

SEQ ID NO: 77655 - DNA, 59 bp, Homo sapiens; identical to SEQ ID NO: 35682
  misc_feature 1..59: note = chr15:45479774-45479833
  misc_feature 1..59: note = hyper
  source 1..59: mol_type = genomic DNA

SEQ ID NO: 77656 - DNA, 30 bp, Homo sapiens
  misc_feature 1..30: note = chr15:45480705-45480735
  misc_feature 1..30: note = hyper
  source 1..30: mol_type = genomic DNA
cgcactgcacatacccgaacctacgttact

SEQ ID NO: 77657 - DNA, 26 bp, Homo sapiens
  misc_feature 1..26: note = chr15:45544198-45544224
  misc_feature 1..26: note = hypo
  source 1..26: mol_type = genomic DNA
tctcggcctcccgaagtgctgggatt

SEQ ID NO: 77658 - DNA, 251 bp, Homo sapiens
  misc_feature 1..251: note = chr15:45670588-45670839
  misc_feature 1..251: note = hyper
  source 1..251: mol_type = genomic DNA
tccgatgtagtgcaccgcctcggcgccgcggctcccgccgcgcagacaccgcacccgcagcatcgccctggcccggctggtccacgcgcggaatgttcctggcctctgggccgcgtcggtccaagccttcccgagagcgcgcccggagcggggtgggcgggcgcgcggggcccgaggccttttgtagccgcgctccgccccggccgccccccgcggccccattggctgccgggaacaggtggtggggccgg

SEQ ID NO: 77659 - DNA, 83 bp, Homo sapiens
  misc_feature 1..83: note = chr15:45670932-45671015
  misc_feature 1..83: note = hyper
  source 1..83: mol_type = genomic DNA
cggcttctgttgcacgtccggacccggacccagacccgagcgtcgcaagaaggcccgttggagtctcgcgcaactgggcagga

SEQ ID NO: 77660 - DNA, 30 bp, Homo sapiens
  misc_feature 1..30: note = chr15:45742581-45742611
  misc_feature 1..30: note = hypo
  source 1..30: mol_type = genomic DNA
aggggctccggctgacgacaggcaggggac

SEQ ID NO: 77661 - DNA, 58 bp, Homo sapiens
  misc_feature 1..58: note = chr15:45996505-45996563
  misc_feature 1..58: note = hyper
  source 1..58: mol_type = genomic DNA
gtgcaagtaatggtacgcggagagggcgcgcgaaagcgcctggctcgttcctggagcc

SEQ ID NO: 77662 - DNA, 91 bp, Homo sapiens
  misc_feature 1..91: note = chr15:47476715-47476806
  misc_feature 1..91: note = hyper
  source 1..91: mol_type = genomic DNA
ggggagctctggcggcgtccaggatgctccagcctcccggcgcgccgcggccggcgcagagacccgaccgcgaggcccgccgcccggttcc

SEQ ID NO: 77663 - DNA, 105 bp, Homo sapiens
  misc_feature 1..105: note = chr15:47476876-47476981
  misc_feature 1..105: note = hyper
  source 1..105: mol_type = genomic DNA
cgatcccggagctgtgccaggccggggggagggagcggaagccactttatggctcgtggccccacctcttgcccccaccccaaatcctccgggatttcaaaatgc

SEQ ID NO: 77664 - DNA, 253 bp, Homo sapiens; identical to SEQ ID NO: 35685
  misc_feature 1..253: note = chr15:47477012-47477265
  misc_feature 1..253: note = hyper
  source 1..253: mol_type = genomic DNA

SEQ ID NO: 77665 - DNA, 158 bp, Homo sapiens; identical to SEQ ID NO: 35686
  misc_feature 1..158: note = chr15:47477354-47477512
  misc_feature 1..158: note = hyper
  source 1..158: mol_type = genomic DNA

SEQ ID NO: 77666 - DNA, 35 bp, Homo sapiens
  misc_feature 1..35: note = chr15:48003206-48003241
  misc_feature 1..35: note = hypo
  source 1..35: mol_type = genomic DNA
gtaaaaatgtataggcgtggccgggcgcggtggct

SEQ ID NO: 77667 - DNA, 146 bp, Homo sapiens; identical to SEQ ID NO: 35687
  misc_feature 1..146: note = chr15:48009524-48009670
  misc_feature 1..146: note = hyper
  source 1..146: mol_type = genomic DNA

SEQ ID NO: 77668 - DNA, 88 bp, Homo sapiens
  misc_feature 1..88: note = chr15:48009881-48009969
  misc_feature 1..88: note = hyper
  source 1..88: mol_type = genomic DNA
ccaatgaggtaagaccgttttcaacaatttgctaatgctcttgtggcgcccggtgggggtcggaacctgagatcccgaatcgctgtgt

SEQ ID NO: 77669 - DNA, 808 bp, Homo sapiens
  misc_feature 1..808: note = chr15:48010089-48010897
  misc_feature 1..808: note = hyper
  source 1..808: mol_type = genomic DNA
ttgatttattttccaagctgctctctctgcctgccgtgcaagggacgcgcaaagggctagagaggtttggcggacgcgtcaaaactggcaaagctggcggcttagggggaggggcaagtggacttggaggccctcctccactgtgcacccccttggaaaaaaagcggagggggcatcaagtaaaagtttcttgccaggcagagccagctcggcgtcccccgcacatagctggggttagcaggggttgcttctctgccgggcacagcgtctccaggagccagccggggagagctgagccaaggccgaaggagccgcctgcgggcttagccgccccctcccgcccgttggccccagagcggacgctgggacgcccggggtctggcagctctgcgcccggctaggagcgggcgggcgagcattagcctgcgtcctggagaaggggcgcagcgccgcagttgaggccggagcagcccctcgcgggcgtaggatacctgtcagtgagcgcccggattgcacggcccccgggtagtgcctgccggcgaggggcgggagctcgggtgacttggccatccccatccccggcccaggcccggagggcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaaga

SEQ ID NO: 77670 - DNA, 232 bp, Homo sapiens
  misc_feature 1..232: note = chr15:48011225-48011457
  misc_feature 1..232: note = hyper
  source 1..232: mol_type = genomic DNA
acttggaagtgtgcacgagaattgggtttgaaaaatttgtgctccatccactcttgggaccattgctgtcaggtgattgtttaaatcctgaacttgttaaaaggcgaaatgtcagggagctggcgggggtgggggtgtggagggggattgaagtcccggtatgaatcgcagcgtttgaggaacttagggcagtactccctgttctggggtgaccattcggtaactgatgttc

SEQ ID NO: 77671 - DNA, 30 bp, Homo sapiens
  misc_feature 1..30: note = chr15:48470064-48470094
  misc_feature 1..30: note = hyper
  source 1..30: mol_type = genomic DNA
ctcccagaccacaggcggccaggcctgggg

SEQ ID NO: 77672 - DNA, 143 bp, Homo sapiens; identical to SEQ ID NO: 35691
  misc_feature 1..143: note = chr15:48470373-48470516
  misc_feature 1..143: note = hyper
  source 1..143: mol_type = genomic DNA

SEQ ID NO: 77673 - DNA, 109 bp, Homo sapiens
  misc_feature 1..109: note = chr15:48470517-48470626
  misc_feature 1..109: note = hyper
  source 1..109: mol_type = genomic DNA
gatcccgatttgaaaaggccccgagcgctcagtaacccggatctcgcgagaaccggtcgagactgggtgactgggagatggtgtgtgccgggtgcggggggtgggagtg

SEQ ID NO: 77674 - DNA, 30 bp, Homo sapiens
  misc_feature 1..30: note = chr15:48666415-48666445
  misc_feature 1..30: note = hypo
  source 1..30: mol_type = genomic DNA
cgcgacccaccctttcggcatccagtcctc

SEQ ID NO: 77675 - DNA, 20 bp, Homo sapiens
  misc_feature 1..20: note = chr15:48906097-48906117
  misc_feature 1..20: note = hypo
  source 1..20: mol_type = genomic DNA
ctgggcgacagagtgagact

SEQ ID NO: 77676 - DNA, 87 bp, Homo sapiens
  misc_feature 1..87: note = chr15:48911244-48911331
  misc_feature 1..87: note = hypo
  source 1..87: mol_type = genomic DNA
atgagcttgaatcatcctgaaaccatccccccatcccccagcacccttggtccgtggaaaagttatgttccacgaaaccagtccctg

SEQ ID NO: 77677 - DNA, 487 bp, Homo sapiens; identical to SEQ ID NO: 35693
  misc_feature 1..487: note = chr15:48936726-48937213
  misc_feature 1..487: note = hyper
  source 1..487: mol_type = genomic DNA

SEQ ID NO: 77678 - DNA, 432 bp, Homo sapiens; identical to SEQ ID NO: 1206
  misc_feature 1..432: note = chr15:48937214-48937646
  misc_feature 1..432: note = hyper
  source 1..432: mol_type = genomic DNA

SEQ ID NO: 77679 - DNA, 638 bp, Homo sapiens; identical to SEQ ID NO: 1207
  misc_feature 1..638: note = chr15:48937709-48938347
  misc_feature 1..638: note = hyper
  source 1..638: mol_type = genomic DNA

SEQ ID NO: 77680 - DNA, 242 bp, Homo sapiens; identical to SEQ ID NO: 35696
  misc_feature 1..242: note = chr15:48938348-48938590
  misc_feature 1..242: note = hyper
  source 1..242: mol_type = genomic DNA

SEQ ID NO: 77681 - DNA, 204 bp, Homo sapiens; identical to SEQ ID NO: 44264
  misc_feature 1..204: note = chr15:49182759-49182963
  misc_feature 1..204: note = hypo
  source 1..204: mol_type = genomic DNA

SEQ ID NO: 77682 - DNA, 78 bp, Homo sapiens
  misc_feature 1..78: note = chr15:49255775-49255853
  misc_feature 1..78: note = hyper
  source 1..78: mol_type = genomic DNA
ccttttgcctgggttcgttgattccaaaggctgccctctcttggaagatcttgtcttgcatcccgttctgggccacca

SEQ ID NO: 77683 - DNA, 139 bp, Homo sapiens
  misc_feature 1..139: note = chr15:49572508-49572647
  misc_feature 1..139: note = hypo
  source 1..139: mol_type = genomic DNA
gtggtgcaggttccacggcaaggtgctgcttgaattgttgactagttgggaatgcggtggggagtattgagtgaagagaatggaaaatcatatttgtaaagacaatgagatgtgaaagagcctgcggtagtaaagaaca

SEQ ID NO: 77684 - DNA, 157 bp, Homo sapiens
  misc_feature 1..157: note = chr15:50124618-50124775
  misc_feature 1..157: note = hypo
  source 1..157: mol_type = genomic DNA
tgttgtgtaggagatcggtcagagtggtaggagaagctataaggaaagacgcaaaccttcttgaaaggtgggaaggtcttgcaaaagcttccggagagaataaagctgaaggcagctaattctctcaccctgacgctaagggcgaggactccgtaac

SEQ ID NO: 77685 - DNA, 19 bp, Homo sapiens
  misc_feature 1..19: note = chr15:50716090-50716109
  misc_feature 1..19: note = hypo
  source 1..19: mol_type = genomic DNA
ccaccgtgcccagcctcgc

SEQ ID NO: 77686 - DNA, 102 bp, Homo sapiens
  misc_feature 1..102: note = chr15:51202472-51202574
  misc_feature 1..102: note = hypo
  source 1..102: mol_type = genomic DNA
ccgggcccccacaggcgctcgatggttgcacggattgtgtagtataccgattcacagctacaaggagtttatatcttaaaaagagcacgtgttaatgtcatt

SEQ ID NO: 77687 - DNA, 422 bp, Homo sapiens
  misc_feature 1..422: note = chr15:51385846-51386268
  misc_feature 1..422: note = hyper
  source 1..422: mol_type = genomic DNA
tcagagctgcacaagcgccgggagctgtgggcacgtgaggagggcgagcgggtcctaggtgcgtagacccgtgggtggggggcggagcggaccggtggaggtgggcagagaccggcggcaagtcgacccacggctgtgggtggcttcctcctgttgctcagtatcagggagaggcgggggaggacattcattttttttcttccctaagtaagcatccacctattgctttaataactatcgattgtgaaaagccggcggggcctcttaaaggcgaagtcgggaggcgcgcgcccctgcgtctgtgttcggggaccagtccgcggggaccttctggaccttctccgccggctgcgcggcagcgatggaccctgtgcatgggctctcctagcagcctcgggaaccgcggccgcaagctgtggttt

SEQ ID NO: 77688 - DNA, 417 bp, Homo sapiens
  misc_feature 1..417: note = chr15:51559380-51559797
  misc_feature 1..417: note = hyper
  source 1..417: mol_type = genomic DNA
gcaaaaccagctcctcgtattgtgtcccattcacagctggagcagctcgggcactaggcgaggcagggggtgcggcgagcggtctccagccggctgcctgcggtcggtgccgcccgcagaatctgcgcggcccagtgcaaaataaaaacgcggggccccgcgttcaaaaagcaggaaaaagcctttccctttctcccgtggtctttctgtccacctgtctcggcagggtttatttgctagttaagttgcgctggcttgagcacagggacgctggcgggccaaaggccgaccctcacaggcgacccagcgtggcggcgaggtcccttggctgtacgccgaggtctgcgccgcccccacgtccgtggccggccactgcccagggcggagggcagcggtgttcgccgggtgggggcccag

SEQ ID NO: 77689 - DNA, 185 bp, Homo sapiens
  misc_feature 1..185: note = chr15:51633966-51634151
  misc_feature 1..185: note = hyper
  source 1..185: mol_type = genomic DNA
tcaacgctgcgggcacggtgttcgcgctgtgccagtggcgcgggctgagctcggcgctgcgggctttggaggcgcagcggggccgggagcagcgcgaggacagtgccctgcgctccttcctggccgagttgagccgcgcgccgcgcggggcgtccgcaccaccccaagacccggccagctcagct

SEQ ID NO: 77690 - skipped

SEQ ID NO: 77691 - DNA, 320 bp, Homo sapiens
  misc_feature 1..320: note = chr15:51973774-51974094
  misc_feature 1..320: note = hyper
  source 1..320: mol_type = genomic DNA
tgcttatcccttgaccgtcgagtgtcagagatcctgcagccgcccagtcccggcccctctcccgccccacacccaccctcctggctcttcctgtttttactcctccttttcattcataacaaaagctacagctccaggagcccagcgccgggctgtgacccaagccgagcgtggaagaatggggttcctcgggaccggcacttggattctggtgttagtgctcccgattcaagctttccccaaacctggaggaagccaaggtatgtgaacacttttcttcttcctaccttccttttatttcgccacgaaaaggtaaagtt

SEQ ID NO: 77692 - DNA, 26 bp, Homo sapiens
  misc_feature 1..26: note = chr15:52000764-52000790
  misc_feature 1..26: note = hypo
  source 1..26: mol_type = genomic DNA
ctgccttgccgggcgcggaggctcac

SEQ ID NO: 77693 - DNA, 41 bp, Homo sapiens
  misc_feature 1..41: note = chr15:52967811-52967852
  misc_feature 1..41: note = hypo
  source 1..41: mol_type = genomic DNA
aacttagtgttaggccgggcgcggtggctcacgcctgtaat

SEQ ID NO: 77694 - DNA, 257 bp, Homo sapiens
  misc_feature 1..257: note = chr15:53075403-53075660
  misc_feature 1..257: note = hyper
  source 1..257: mol_type = genomic DNA
tcacacccacagggacgcgaattccgattttataagcaggtgtgcacgtgcactcagatactcacacaaagccgcgtggagggacgaaaagatcaaccacccgatcgacgaggataggtttgatcttttcgattacctcagtgtgccagtgtatattcccggctgggcctagcgccctaagaaacttcggaactttagctgttaatttttgttttcttactatgacttcccaaagacattctatctgcctaccgggg

SEQ ID NO: 77695 - DNA, 126 bp, Homo sapiens; identical to SEQ ID NO: 35700
  misc_feature 1..126: note = chr15:53075739-53075865
  misc_feature 1..126: note = hyper
  source 1..126: mol_type = genomic DNA

SEQ ID NO: 77696 - DNA, 1016 bp, Homo sapiens; identical to SEQ ID NO: 1210
  misc_feature 1..1016: note = chr15:53075985-53077001
  misc_feature 1..1016: note = hyper
  source 1..1016: mol_type = genomic DNA

SEQ ID NO: 77697 - DNA, 1171 bp, Homo sapiens
  misc_feature 1..1171: note = chr15:53077065-53078236
  misc_feature 1..1171: note = hyper
  source 1..1171: mol_type = genomic DNA
cgctcccagctggcggcgcccctcgccccgggctcagaggcggacacggtcggtcgcgccctgctggccctttgttcgcgccgcagcgggctgggagcagctgcgcgacaccagacccacagcgccaagacgcgaagcgcgaggaaaccgctgcgcttgactccttctcccccaactcttggacccaggaacgcttccagctcctgcgtcccacacgcccagtcctggcttctctcccggcccagaagtcttcaaggattgaagggctctgcctagggccccgcactcctgcctgactcccatggcccagaaaagcagggggacatttgaaatgtcaccccgggataaatattaacaaaaaagcaaatggacttgtgcaggggccagttatcaatcaaccaggccgcaaggccactcagggcaaacacagcccaggttgggctgggcgagactttctcatggccgccccccgaccgaacccctccccccttggctcaggtccttcttaggtcgttctggggcaaacaccggacgggaagggggcgccgccaactcccccgcggggtttggaggtttcctcgcctccaagtcccgcagggcagggtcggagtgcccaacacccacccccgcccgaacctcgggcctgcgcgccgccttcccctgggtccgcggtgctgcgcttgctgttgggtgtgtgtcgctgtctctttccgagccggcagctcctgctgtgtggccgaagccctctggaatctttaattggaaactaatcttggtcttgatagacgcccacgtcagaggcgcgccacccacccacaccccccgcctcatcccggaggagacgcggcgagaaccctgtcgctctgctctttaatggggcagcagcaagtagtacatggagggaacatatattgatttttaaaaggtagttaatttggtgggaatttcctcctgtcgcccttcttccaccagccgctgttatttcgtgaccggaaggcgcctccccaaacacagcgccacgtgcaagagggttttgaccctctgcaacaggctgccggcaactggaggacagaggggcgtggagaagccaccactctcccgctgcggagcgaaggaaccgagctcagtgagccctgacctcgcaaggtggttggaacgagactggggaggg

SEQ ID NO: 77698 - DNA, 251 bp, Homo sapiens; identical to SEQ ID NO: 35704
  misc_feature 1..251: note = chr15:53078741-53078992
  misc_feature 1..251: note = hyper
  source 1..251: mol_type = genomic DNA

SEQ ID NO: 77699 - DNA, 459 bp, Homo sapiens
  misc_feature 1..459: note = chr15:53079219-53079678
  misc_feature 1..459: note = hyper
  source 1..459: mol_type = genomic DNA
acggagcagtcaggacgaggagcagccccttcgcccactccctccggaacctcagttgctcgcgggcagcccacgggtggagatatggtgccggtagcacaagagctagagagtggaaaaccgggggccagcgattcgctggggcgcccagcgagcctcttctcccctgactggttcccgggcgcaggctgcaggaacctgcatgaggactttgcctggggcgaacgaaggcagagctgggctggaaaacctggcagggcagagtctcagccagcgcggtgctttgggaccggtggcctgcagcgcccaaacccaaagaacgctttgggtcgcttcggggcacgaatcgcaggctggtcggcacctgccacccccagcttctcattggcaggcacgagttggaggagggggctttggcctcacgctttgattttagactgtgaaacggctcagtgcccc

SEQ ID NO: 77700 - DNA, 175 bp, Homo sapiens; identical to SEQ ID NO: 4225
  misc_feature 1..175: note = chr15:53079717-53079892
  misc_feature 1..175: note = hyper
  source 1..175: mol_type = genomic DNA

SEQ ID NO: 77701 - DNA, 112 bp, Homo sapiens
  misc_feature 1..112: note = chr15:53079970-53080082
  misc_feature 1..112: note = hyper
  source 1..112: mol_type = genomic DNA
cgaatcctcctgaaatccccggtggggttcgggctgggctcagctttcttctctgcctatccgcggtctcggggagccaggcgcggtgtctgcgctgcgccaaggagagctt

SEQ ID NO: 77702 - DNA, 321 bp, Homo sapiens
  misc_feature 1..321: note = chr15:53080299-53080620
  misc_feature 1..321: note = hyper
  source 1..321: mol_type = genomic DNA
actgggaccttgggacggtcagcctccctctcctttccacagccaattccatgcgcagagagcgtcctaacccttacaactcgtctgtgctacacacccaccgcccaatggctctgaaactttttgcccatactcttagattgaggtcaccccagccagcgccaaaagaatgagcgcgggagggggtcacagcagccagttcggccaaacatcgacgctgctccggcacgctccagcccagcgcctgggatgtgtcagaggtacctgcgaggaacatttgcgtgcgattccacgcacgcgttgcatccctcttcccaaacc

SEQ ID NO: 77703 - DNA, 255 bp, Homo sapiens
  misc_feature 1..255: note = chr15:53080736-53080991
  misc_feature 1..255: note = hyper
  source 1..255: mol_type = genomic DNA
cgccgaggcccggccgcttagctctcggagccttccacagcccaacaccctgagccctggagtaggcaatttgctcccacagccctgtgctggcccttccaggcacagggagtcccccttctaggggtaggggcgggcgggatgaagcgcacccagccctctctcctacccttcctcctttggtcccttcggctttcgtgtaccttatctcccgcgcgcccagctccttggccggctcacctgctaagcggagcg

SEQ ID NO: 77704 - DNA, 243 bp, Homo sapiens; identical to SEQ ID NO: 4229
  misc_feature 1..243: note = chr15:53081054-53081297
  misc_feature 1..243: note = hyper
  source 1..243: mol_type = genomic DNA

SEQ ID NO: 77705 - DNA, 622 bp, Homo sapiens; identical to SEQ ID NO: 35711
  misc_feature 1..622: note = chr15:53081398-53082020
  misc_feature 1..622: note = hyper
  source 1..622: mol_type = genomic DNA

SEQ ID NO: 77706 - DNA, 740 bp, Homo sapiens
  misc_feature 1..740: note = chr15:53082303-53083043
  misc_feature 1..740: note = hyper
  source 1..740: mol_type = genomic DNA
ccaccttcccctctgcgtcctcggcttttttttttttaatattaatttccaaagaggatccgcgccgttgggagagcgcagtgccccagcccgcccgcctcggccacctctcgcccctctctttcttaaaattctgaggtctccggctcccctgccgcggcccgcgcgcctgccgcgtctgctgcctgcccgccccgctggccagcttgagccatggctctgttactgttacagactctgtggccgcggttcggtagccgccgccgccgccgccgcagcggcccgccctcacgcccgccaggcgcagcgcgcatgcgcgaggcccgcccccgccccctaggtcgcggcgcgccaggcccttggcgtcccggtacaaatgaaggagggggcccagcgccttccctgcggcgctggatggccagggagctgcgggcacgtgcgaaagattggcgcagagcgcgacctggggccgccgctgcaatcccaggagactcgcgcctggctcgctcgcctcccttgcttgagtgggctctgtcctcccagcccggggacgctcgtgtcgggcttctagcggctggagtgctgtgcttggagacatcgcccctctctctccagttgctgcttcccggtgcagcttgcccggggagctggggactgtgtcatcaccccttcggctctagcccactaagctttatttcccggggggctgctgggagtgcgctttcccacccttgaattca

SEQ ID NO: 77707 - DNA, 19 bp, Homo sapiens
  misc_feature 1..19: note = chr15:53083116-53083135
  misc_feature 1..19: note = hyper
  source 1..19: mol_type = genomic DNA
cgttgacccggcacccttc

SEQ ID NO: 77708 - DNA, 13 bp, Homo sapiens
  misc_feature 1..13: note = chr15:53083136-53083149
  misc_feature 1..13: note = hyper
  source 1..13: mol_type = genomic DNA
tcctcccagatac

SEQ ID NO: 77709 - DNA, 30 bp, Homo sapiens
  misc_feature 1..30: note = chr15:53089890-53089920
  misc_feature 1..30: note = hyper
  source 1..30: mol_type = genomic DNA
agcgctccactgagccggttgcagctttaa

SEQ ID NO: 77710 - DNA, 21 bp, Homo sapiens
  misc_feature 1..21: note = chr15:53091057-53091078
  misc_feature 1..21: note = hyper
  source 1..21: mol_type = genomic DNA
caggcccgagttcccatcccc

SEQ ID NO: 77711 - DNA, 1941 bp, Homo sapiens
  misc_feature 1..1941: note = chr15:53095628-53097569
  misc_feature 1..1941: note = hyper
  source 1..1941: mol_type = genomic DNA
aacgaaaaagctcaccgccagacagcttccagcactcgaaccaatacaagtaaagcacatttgcaaatgtgtttgactgtttttgtaggtttaagaagactacgtttttctgaccacttcaaaaaaacaaacacgaattcagccgctgctttaataacctctgaccagaggagctgattttgccaccgagttatcggtcagtgctgcgaggtcagtggcctgtgatcatgtttatagcaggtttggcttggatttggtgacacagccagcaaacctgggagattatgaaaccgtgaaccagcccagggaagtgtagtcaagtttcagtttgggcatttctccgggtgagggaatccggtgggctccatttctacaaggctcacaaacgcaggtgcagttcggccgccgcacgctgcctggcgggagaaacgcgcacaaaccgcagacgcgtgctcctgtagttgccactagctcggggcacgcccgtgttatttacaccctgctcgggggcccccctctcatttgttactttaaactcatggggaggaactgttagctgccgtggcgggactggcaggctgggaggggggcgcccccgctcggctcccgggccgtgacgcggccgctgccctccgcccctggcttccaccctgtttgcatggccacaagctcagcggtggaccagcgtggccaggcccccggagcccttgccccggcctaccgcccctacttcttccccctcaccaccccccccaaacgcttgtgagactggcttaccctggtgggcgagtcgcagcgcattagcggatttcatggcaagttgcttctgtgacatgagatcaggttcgcgttcgaggatttgccccctaggagggaaggaaaggagagtcaatctgcataatttcaaatgagaaataaatagggaaacagggaactgaatttcaagccccctaattcctccctccccccgaacctgtgagccaccccgcaccccccacaacacgccccgtgcacaggtaaaaaaaaaaaaaaaaagtaatcagcacacgtcgcaggtgataccttttattgtgctcattttaaagacaggaacaggatggcctcctgcccgaagactttctctgcagccaggcccggggcaggagggtcagctgggcagcatccgggcccgcggattcctgcaaggtcgcgaggtgagaggtgcggggaggatagacctcgggctcggcgcacagggtctgggccagacgcacaagcccaaattccctccagcttcttcggctccatctttaagtccaggcaaagatcaattccctctctctcttgaacacacacatttgcagccataaataaacagctcccagctaaatcaggaaccggagaggagaaagggaaaaagaaaggagaaaagagaaggattgagaacccaagcgcgagtctcgcctcttccgggcgccgactggctctttttggtcaggccagcctcgcatttggggatgcaacttgcatttgaatagctgcctgggcttgttatggacccgggaaagctctgaaagggaatcactatgcaaattgtcccagttacaatcgaaaggttcgatctccaggagctgcctgacggaagttgatgtcagctatctatgcattagggttgcattaccgccttcgtcggcctcctcgccacccccgctcgcgcctgcaggggaggctttttttttttttgcttatgtttatattttccctcagtaattaaaaaaaaataaaaaaagaaaataaaaggctgaaggtggtggcatagctggctagggcctgggaggcccacgggctgagaggggaggaggtgcggaagggcggggttgggtggcggggggggtcgttcttttgcagcaggtgttgatggtgcgtttgaaatcaaacatttagatttttttttcgctttgc

SEQ ID NO: 77712 - DNA, 130 bp, Homo sapiens; identical to SEQ ID NO: 35716
  misc_feature 1..130: note = chr15:53097777-53097907
  misc_feature 1..130: note = hyper
  source 1..130: mol_type = genomic DNA

SEQ ID NO: 77713 - DNA, 309 bp, Homo sapiens; identical to SEQ ID NO: 35717
  misc_feature 1..309: note = chr15:53098381-53098690
  misc_feature 1..309: note = hyper
  source 1..309: mol_type = genomic DNA

SEQ ID NO: 77714 - DNA, 145 bp, Homo sapiens; identical to SEQ ID NO: 15900
  misc_feature 1..145: note = chr15:53976280-53976425
  misc_feature 1..145: note = hypo
  source 1..145: mol_type = genomic DNA

SEQ ID NO: 77715 - DNA, 311 bp, Homo sapiens
  misc_feature 1..311: note = chr15:54051665-54051976
  misc_feature 1..311: note = hyper
  source 1..311: mol_type = genomic DNA
gcccaccctctttcccggcccagctgtatccaagcgcgggccgtcccctcctgcgccgtgctctgaaggcgggaaggcgtgcggctgcaccagccaggggcagacgaagaccaccagcctgggacccggcagcccgacctgcgctctgggggtgcctgccttacctgagccgtggggcggaggagcggcagaggccaggcaggctggcgggtctcgcccttagggtcacgggtaccggccccgcccgcctcgccccgccccgccccgccccggtcctgcccccgcagcgcgcggaccgggctagctctggc

SEQ ID NO: 77716 - DNA, 465 bp, Homo sapiens
  misc_feature 1..465: note = chr15:54270462-54270927
  misc_feature 1..465: note = hyper
  source 1..465: mol_type = genomic DNA
agttagttgtcagtgcggtggtgaaggccacacctggcagtggctacagtgcgtctcctgtgagcaggggctgtagctcaccctctcggagctacgccgtgctacggcggcaggagagggagcccgggcgctctcggtggaggaggctggggatcgcagtgccggtgctgcattcagaaaagactcagccgcagccggcgatgtgtgaagttcccagcacgcactcagcccggctgctcctcaccctcaaatgttgatgagcctgggcgctcctcaacacacgggagagatcccattttgctttctgggagaaagagatgagaaatgagccgcggaaggtatttggcaatgagaagagtgaaaggcagtttcttgccagcagctaagttgtagaattgcttcggaggctacccgggagtgcgatagaattgacaagaaaagaacagacaccgttgcagaccaagg

SEQ ID NO: 77717 - DNA, 30 bp, Homo sapiens
  misc_feature 1..30: note = chr15:54633940-54633970
  misc_feature 1..30: note = hypo
  source 1..30: mol_type = genomic DNA
gaggcaggtagatcacgaggtcaggagatc

SEQ ID NO: 77718 - DNA, 22 bp, Homo sapiens
  misc_feature 1..22: note = chr15:55452971-55452993
  misc_feature 1..22: note = hypo
  source 1..22: mol_type = genomic DNA
gagccaccgcacccagccaaca

SEQ ID NO: 77719 - DNA, 43 bp, Homo sapiens; identical to SEQ ID NO: 44269
  misc_feature 1..43: note = chr15:55689108-55689151
  misc_feature 1..43: note = hypo
  source 1..43: mol_type = genomic DNA

SEQ ID NO: 77720 - DNA, 86 bp, Homo sapiens
  misc_feature 1..86: note = chr15:55699080-55699166
  misc_feature 1..86: note = hypo
  source 1..86: mol_type = genomic DNA
ttttgactgaaattccgccctcagcgtaaaaggttaaaaattatgaattaacgcccgcgcggtgggtcacgcctgtaatcccagca

SEQ ID NO: 77721 - DNA, 92 bp, Homo sapiens; identical to SEQ ID NO: 44271
  misc_feature 1..92: note = chr15:55806620-55806712
  misc_feature 1..92: note = hypo
  source 1..92: mol_type = genomic DNA

SEQ ID NO: 77722 - DNA, 971 bp, Homo sapiens
  misc_feature 1..971: note = chr15:55879812-55880783
  misc_feature 1..971: note = hyper
  source 1..971: mol_type = genomic DNA
cacaaagtcgggaggcgagggatccgcgcggatgtctcgggggccagcgggcgcccgggccgcgcgctcggatcgcagcctcggccccggggtgccggcgggacgcgggctgcgcggacttaggcccggacagagccccatggcctcccggcggccgggcacggggccccgcgcacctcactcaccccggttcccccaatccggcacccttctcggttacctcgaactctcttcagcgaaatgggatccttctcctgttctgctgacattacagaccgcaaagcatgactcccccccaggccgcgggaattcggtctctttgatgctgcggcggcggctcctcctcctcgcggggccgctgcggctgcgaggcaagcctcggagccgaggcacggccgagggcggtggggacgcgggccgactttgcaaagtttgggaggaggacgaggcctcggggcggcggggcggcggggcggcgtgcgggcaccggcggggctcagcggcggtggccgggagcgcggcctgggggcggccccccacccggggccggcatgtgctgagggcgagtgcgccgccgccgccgccgcctcctcccactccttcttcttcgccgccgcctcaggagccgctgacaggggaagcaggaggctcgcggcccggccctggcggcacactcacagcgccctctgaggaggaggtctgctctctcgccgctcccgagtcgcagacacaaaagcccccagactggagccgcctgtaaaacccgctctggggcgggcgagggacgtggcgcggccccgcggcttccccgccctgagctccccagccccgcgcggggacgggcttcggggggcgggggccgctgcctcgtcccgcggcgcctcccgccaccgccgccgcctcgcgctccgcctcggcccagcccccacggcccgcgcgcgcctcttgctccaagccggggctcgcgggcc

SEQ ID NO: 77723 - DNA, 154 bp, Homo sapiens
  misc_feature 1..154: note = chr15:55880890-55881044
  misc_feature 1..154: note = hyper
  source 1..154: mol_type = genomic DNA
cgacgctaccgggcccagctttcgcaaggaaagggcatctccgaacttcgtcggaggccacagcagcaggcgtctcggcctcgcagctagggatcggaaagatgaacgtaccatgcgaggaaactttgtaagcgggagctggagagttctcggc

SEQ ID NO: 77724 - DNA, 131 bp, Homo sapiens
  misc_feature 1..131: note = chr15:55881045-55881176
  misc_feature 1..131: note = hyper
  source 1..131: mol_type = genomic DNA
ggcatgtggggatccagattccccgactccgtgtccgcgtggccgtggtgtggacacctgtctgtagaatgcctccacttggtattttaacgacttgactcttcaagaaagagcgacgtagaataaatacc

SEQ ID NO: 77725 - DNA, 20 bp, Homo sapiens
  misc_feature 1..20: note = chr15:55933134-55933154
  misc_feature 1..20: note = hypo
  source 1..20: mol_type = genomic DNA
gaacccgggaggcaacaaac

SEQ ID NO: 77726 - DNA, 336 bp, Homo sapiens
  misc_feature 1..336: note = chr15:56034387-56034723
  misc_feature 1..336: note = hyper
  source 1..336: mol_type = genomic DNA
ttcccccctcctttccggggcacaaatcggccacttcacttccaaccctgccaattccaccctcccatctcctcctggctggatccagatccggcaagctggtgccgattggggttatgagttcacctattccctctcgcagccctaaaaagtgggggaactcccacaacagacacgggaagccgcgaggaaccgcggcgccccctgcacggcgaggctgccactaaggaaacaatataaataaagccacgtgcagccgcggcggccccggcgggctggcgacccggagtccggccggtcgcggaggcgcggacgcggccggagccgggacaatgg

SEQ ID NO: 77727 - DNA, 375 bp, Homo sapiens; identical to SEQ ID NO: 35725
  misc_feature 1..375: note = chr15:56034885-56035260
  misc_feature 1..375: note = hyper
  source 1..375: mol_type = genomic DNA

SEQ ID NO: 77728 - DNA, 206 bp, Homo sapiens; identical to SEQ ID NO: 35726
  misc_feature 1..206: note = chr15:56035304-56035510
  misc_feature 1..206: note = hyper
  source 1..206: mol_type = genomic DNA

SEQ ID NO: 77729 - DNA, 84 bp, Homo sapiens
  misc_feature 1..84: note = chr15:57618488-57618572
  misc_feature 1..84: note = hypo
  source 1..84: mol_type = genomic DNA
ctctataaactctcacgagggtcgccggtcggtccactaggaggtcgaaggccttcatcaggtagacgacggggttgggcagcc

SEQ ID NO: 77730 - DNA, 30 bp, Homo sapiens
  misc_feature 1..30: note = chr15:57967966-57967996
  misc_feature 1..30: note = hypo
  source 1..30: mol_type = genomic DNA
ctaactcaccattcccgggtgctcacaact

SEQ ID NO: 77731 - DNA, 71 bp, Homo sapiens
  misc_feature 1..71: note = chr15:58357149-58357220
  misc_feature 1..71: note = hyper
  source 1..71: mol_type = genomic DNA
aaaattcacatgaaacgctgacgttggagttactgtacttatcagtcaggtttccgtgaaatttgtcaaac

SEQ ID NO: 77732 - DNA, 21 bp, Homo sapiens
  misc_feature 1..21: note = chr15:58357799-58357820
  misc_feature 1..21: note = hyper
  source 1..21: mol_type = genomic DNA
cggggtcggccttcacctcgc

SEQ ID NO: 77733 - DNA, 260 bp, Homo sapiens
  misc_feature 1..260: note = chr15:58358503-58358763
  misc_feature 1..260: note = hyper
  source 1..260: mol_type = genomic DNA
cgccctctcccccgaccccccgactcccctcagccgggccgaggtgcatggtggccagagggtcagggagaggtggcagtgggtgcgagtccccctcgcctcgggctcagaatgaggatccctgcgagcgggtcagcgcggggcggcccttgccaggcgtcgcccgcccagttgctgccctctgccggccgggaccgcccgggcggcttgcgctgtggcgggaggatatgggcagtgatcatccccggctcctccgagga

SEQ ID NO: 77734 - DNA, 101 bp, Homo sapiens
  misc_feature 1..101: note = chr15:59158436-59158537
  misc_feature 1..101: note = hypo
  source 1..101: mol_type = genomic DNA
gggattacaggtgtgagccaccgcgcccggccccaggtttggattctttcacacagcaggtatgggccgactcactgtctggggcccgcccagcccagccc

SEQ ID NO: 77735 - DNA, 30 bp, Homo sapiens; identical to SEQ ID NO: 44273
  misc_feature 1..30: note = chr15:59243729-59243759
  misc_feature 1..30: note = hypo
  source 1..30: mol_type = genomic DNA

SEQ ID NO: 77736 - DNA, 24 bp, Homo sapiens
  misc_feature 1..24: note = chr15:59279029-59279053
  misc_feature 1..24: note = hypo
  source 1..24: mol_type = genomic DNA
tgaatgatacggaaaatatgagtg

SEQ ID NO: 77737 - DNA, 30 bp, Homo sapiens
  misc_feature 1..30: note = chr15:59445742-59445772
  misc_feature 1..30: note = hypo
  source 1..30: mol_type = genomic DNA
ggagatggagcttgccggcttcatccagag

SEQ ID NO: 77738 - DNA, 64 bp, Homo sapiens
  misc_feature 1..64: note = chr15:59453450-59453514
  misc_feature 1..64: note = hypo
  source 1..64: mol_type = genomic DNA
taacaggtcgaaggacgcagtgagaaaacggtgctcagagatcccgccacggagttctgctgct

SEQ ID NO: 77739 - DNA, 159 bp, Homo sapiens; identical to SEQ ID NO: 35730
  misc_feature 1..159: note = chr15:59729656-59729815
  misc_feature 1..159: note = hyper
  source 1..159: mol_type = genomic DNA

SEQ ID NO: 77740 - DNA, 30 bp, Homo sapiens
  misc_feature 1..30: note = chr15:59846186-59846216
  misc_feature 1..30: note = hypo
  source 1..30: mol_type = genomic DNA
tgatgcacatgggtgcggggcctgtgcagc

SEQ ID NO: 77741 - DNA, 21 bp, Homo sapiens
  misc_feature 1..21: note = chr15:59950342-59950363
  misc_feature 1..21: note = hypo
  source 1..21: mol_type = genomic DNA
aaactccgtctcaaaaaaaaa

SEQ ID NO: 77742 - DNA, 23 bp, Homo sapiens
  misc_feature 1..23: note = chr15:60085007-60085030
  misc_feature 1..23: note = hypo
  source 1..23: mol_type = genomic DNA
tcattatccggatgaaaagtata

SEQ ID NO: 77743 - DNA, 18 bp, Homo sapiens
  misc_feature 1..18: note = chr15:60121321-60121339
  misc_feature 1..18: note = hypo
  source 1..18: mol_type = genomic DNA
actgactcacggccccgg

SEQ ID NO: 77744 - DNA, 80 bp, Homo sapiens
  misc_feature 1..80: note = chr15:60286430-60286510
  misc_feature 1..80: note = hyper
  source 1..80: mol_type = genomic DNA
ttatttatttatttgcgccctgaaggacgactcggatttccaggccagccggaagaggcagaaagcgaacaggctgctca

SEQ ID NO: 77745 - DNA, 782 bp, Homo sapiens
  misc_feature 1..782: note = chr15:60286804-60287586
  misc_feature 1..782: note = hyper
  source 1..782: mol_type = genomic DNA
tattcactaatccagcgcattgccaaatacccccttaattctgcttaacactaaaagggttttgagcaccataatgagattcttctgtctgctaattaattgacacgctcctgaatattcatatgagctagcaccaatacgttcctaattgcaccgtggaatagatctcagaggaaagtaaatcgccatagacttaattaaaataatgtattccagatccagcacggggaaagatgagacatttgccttcgagctcgctaagaaagtggcacctggttggtggaggggagagataccaaatgtcggcgcccagcctgaaataagtggcatgggacgcgcagggagggcgttcagcttcagaaagcagcggctacgctgggtccaaacccggcggctcgggaggccatagctcctaggtgcgtccgagctcctgctaccctgcgcggtgttgtcctaccggaggaagtggctgatgggcagtctaggatcccggcccctgacccagggccctctcctccctgcggtcctggtccgggtcatggtcccggggctggtctgaagtgctgtctacagagggcacttggggaaacatcgtaggtccggaaattcccagggaaagtttttgcaggagttgtggacgccgcagcagccccaactctcccaacccagcttgcgacccgagagaagtcgctcacacttctctttgggggagggcgacagttccggggaggacgcttggatcccgaaaatgacgggatccaggtcccacaaccctcaggaag

SEQ ID NO: 77746 - DNA, 33 bp, Homo sapiens; identical to SEQ ID NO: 1213
  misc_feature 1..33: note = chr15:60287643-60287676
  misc_feature 1..33: note = hyper
  source 1..33: mol_type = genomic DNA

SEQ ID NO: 77747 - DNA, 30 bp, Homo sapiens
  misc_feature 1..30: note = chr15:60288131-60288161
  misc_feature 1..30: note = hyper
  source 1..30: mol_type = genomic DNA
aatctgggaaacctacgaggcccacagttc

SEQ ID NO: 77748 - DNA, 171 bp, Homo sapiens
  misc_feature 1..171: note = chr15:60288412-60288583
  misc_feature 1..171: note = hyper
  source 1..171: mol_type = genomic DNA
ttcctttactgccggcgagggaagaaaagacagcctaccttggctaagggaggccaccggctccaccaatcaaatcgctatggctatgaacaaatggttatccgctccaaagaaaatcacttgctggatcagccttcttggaattattaaatccttcgtggttctagattt

SEQ ID NO: 77749 - DNA, 132 bp, Homo sapiens
  misc_feature 1..132: note = chr15:60288786-60288918
  misc_feature 1..132: note = hyper
  source 1..132: mol_type = genomic DNA
aagtggcaaagttttcgaaaaacctcgccgatcctctgaagatcgggttaatgatttaccccactcgccaaccacctgatgtagcctaccgctacgccgcggaggtgtgccaggatgcgctgcaggggggga

SEQ ID NO: 77750 - DNA, 316 bp, Homo sapiens; identical to SEQ ID NO: 35735
  misc_feature 1..316: note = chr15:60289310-60289626
  misc_feature 1..316: note = hyper
  source 1..316: mol_type = genomic DNA

SEQ ID NO: 77751 - DNA, 30 bp, Homo sapiens; identical to SEQ ID NO: 35736
  misc_feature 1..30: note = chr15:60289876-60289906
  misc_feature 1..30: note = hyper
  source 1..30: mol_type = genomic DNA

SEQ ID NO: 77752 - DNA, 48 bp, Homo sapiens
  misc_feature 1..48: note = chr15:60292201-60292249
  misc_feature 1..48: note = hyper
  source 1..48: mol_type = genomic DNA
tcccgaaatccagcacgttaaagccaggccttgcggtgctggggggct

SEQ ID NO: 77753 - DNA, 701 bp, Homo sapiens
  misc_feature 1..701: note = chr15:60295917-60296618
  misc_feature 1..701: note = hyper
  source 1..701: mol_type = genomic DNA
agtcaagtcaaatttcgacctaactctccggggactggggggcaagggtgtgttttcattattataacccatgcaaccaaccccgggtagtgctaagcgcaggaaaagggtcggcttcaggggaaagccgtgcctaaagttacctaacgatacaaaccggatacaacgcagaggaaacagaataccccagccaagcaatttccatgtcaaacatcatccgcgcggctgctccatctgtgaacgtgagtggtcgcctggctccctcttccgcggcggccgcttcctcataccttcacacggcgcacaccggccggcgcgtccagctgcctgcccagtggccgaggctcttccccctcgcccagtcttgagctggaagtgattcctattggccaaggtgtccatgtaaataggtgtgaaagaaaccagagctggccgggctctcccttctcgctcagtcccctccctctgcagcccccgctccccctcctcttcctcctcctcccaaggcgattgtcatatgatagctaagaagtggcacattaatgaagcgccgctacaggggtcttttctgctcctgtcaccgcttaaaactatcagatggttcgagggaggacatggaggcagccacctagctcagcggagacgcggagcccacagcagcgccctccggagccctaacacgtcgctgccaccatccgcgc

SEQ ID NO: 77754 - DNA, 64 bp, Homo sapiens; identical to SEQ ID NO: 35740
  misc_feature 1..64: note = chr15:60296860-60296924
  misc_feature 1..64: note = hyper
  source 1..64: mol_type = genomic DNA

SEQ ID NO: 77755 - DNA, 676 bp, Homo sapiens; identical to SEQ ID NO: 35741
  misc_feature 1..676: note = chr15:60297151-60297827
  misc_feature 1..676: note = hyper
  source 1..676: mol_type = genomic DNA

SEQ ID NO: 77756 - DNA, 238 bp, Homo sapiens; identical to SEQ ID NO: 35742
  misc_feature 1..238: note = chr15:60297941-60298179
  misc_feature 1..238: note = hyper
  source 1..238: mol_type = genomic DNA

SEQ ID NO: 77757 - DNA, 30 bp, Homo sapiens
  misc_feature 1..30: note = chr15:60615951-60615981
  misc_feature 1..30: note = hypo
  source 1..30: mol_type = genomic DNA
gagtctcagtgtcttcgacagaatttgact

SEQ ID NO: 77758 - DNA, 30 bp, Homo sapiens
  misc_feature 1..30: note = chr15:60789762-60789792
  misc_feature 1..30: note = hypo
  source 1..30: mol_type = genomic DNA
agcttttctgtatgtcgtccacataaggct

SEQ ID NO: 77759 - DNA, 321 bp, Homo sapiens
  misc_feature 1..321: note = chr15:60883283-60883604
  misc_feature 1..321: note = hyper
  source 1..321: mol_type = genomic DNA
ccccaaactagcaaacgtttaacaggcgcttggcacccgcaccggtggctaggacccgcaggacagtctgggtctgcacaattgctgcgcattagggaagccgcgtccgccgcaaacagatggggctctaaatccccaagcctggcggccgggcctgcgaagcagctcgggcagattatccacggcgaggaacctgcgggcgcacaagcgggcggcgggcggcgggcggcgtgctgcgggctgagtttctccggagctgtttgcaaccgtcccaagagcgagtctcggtttctccggcagcacgggcgacttcctgaacac

SEQ ID NO: 77760 - DNA, 32 bp, Homo sapiens
  misc_feature 1..32: note = chr15:60896339-60896371
  misc_feature 1..32: note = hypo
  source 1..32: mol_type = genomic DNA
aaaaaaaaaaaaaagcacgaacattagaaaaa

SEQ ID NO: 77761 - DNA, 30 bp, Homo sapiens; identical to SEQ ID NO: 44275
  misc_feature 1..30: note = chr15:60915264-60915294
  misc_feature 1..30: note = hypo
  source 1..30: mol_type = genomic DNA

SEQ ID NO: 77762 - DNA, 30 bp, Homo sapiens
  misc_feature 1..30: note = chr15:60924136-60924166
  misc_feature 1..30: note = hypo
  source 1..30: mol_type = genomic DNA
cgctttactcttctccgggtttaatagaag

SEQ ID NO: 77763 - DNA, 30 bp, Homo sapiens
  misc_feature 1..30: note = chr15:61065077-61065107
  misc_feature 1..30: note = hypo
  source 1..30: mol_type = genomic DNA
acattaaaatgtctccgattaagccctgga

SEQ ID NO: 77764 - DNA, 127 bp, Homo sapiens
  misc_feature 1..127: note = chr15:61113449-61113576
  misc_feature 1..127: note = hypo
  source 1..127: mol_type = genomic DNA
gccatagcctctttccgtctccctgctgtgtgctgttccctttcagtgctgactcttgtccccttggctgtttggatccggggcttctagcccctacgctctgcactgggtccgctccatctgctgc

SEQ ID NO: 77765 - DNA, 30 bp, Homo sapiens; identical to SEQ ID NO: 44276
  misc_feature 1..30: note = chr15:61305596-61305626
  misc_feature 1..30: note = hypo
  source 1..30: mol_type = genomic DNA

SEQ ID NO: 77766 - DNA, 250 bp, Homo sapiens
  misc_feature 1..250: note = chr15:61519861-61520111
  misc_feature 1..250: note = hyper
  source 1..250: mol_type = genomic DNA
cctggggcccccattcgcctctacccagccctccccaaccgccgccagaagccgagtgcaagaggagggggcgcgctgggccggtacccaagccggggctggagaaatcctctccgtccccagctccaggcggctcgcgcgagcacgcttcctccggagtgacaggcgcgatttatacattatttacaacagtaattaaagctgtagcttcctcctgttctttgcaaactccaggcgcattcaaataaat

SEQ ID NO: 77767 - DNA, 89 bp, Homo sapiens
  misc_feature 1..89: note = chr15:61520408-61520497
  misc_feature 1..89: note = hyper
  source 1..89: mol_type = genomic DNA
gcttgcttttgtagacgctccctccggatgcgcgtggagcgccccacaggaccgccgccctctgcgcgttggcgcgcacacgccccccg

SEQ ID NO: 77768 - DNA, 540 bp, Homo sapiens
  misc_feature 1..540: note = chr15:61520754-61521294
  misc_feature 1..540: note = hyper
  source 1..540: mol_type = genomic DNA
ccgaaaacacacccccgactcgggcagccagggccgaaactgtcaagaggagaaaaggtaaagcggaaggagggtggccataaacagatttttttgccccttcttaaaaggacactgccgctttaaaagtttctttcccgggcccccactccccgcatctccgtattttgggggagcgtatttaattgaggcaacgcagctttcctccagtgtttgcagaaaaatcaaagccaggggggtgagcccgccggctgtcaaccttcccgccgcctcccccgccccactctgctcccgcaagccgagaacgggctgcaaaagtttgcaacatttctggggggcggaggggggaggggaggggggtcctccgggctcggggcgccgccgcaggctcgcgcgcggccgccggaccccgcgccccgggcgcccgctcccggccgccccccgctccgcgcccgggctcccgccgccccctccccagcccctctccagcctcctacctctgctggtgctggaatagctctgtctgcgcaccggggcagg

SEQ ID NO: 77769 - DNA, 185 bp, Homo sapiens
  misc_feature 1..185: note = chr15:61521311-61521496
  misc_feature 1..185: note = hyper
  source 1..185: mol_type = genomic DNA
cggattcctggttcagcggggtctccctggagccggcggccgcgtccgcgccgctgctgcctggctcgctggcggcggggtcgggggctgccggagctgactccatgttttttcccaatgtagagatcgctggagatggcgagctccgagactccctctatcttctgttttcagagcaactctat

SEQ ID NO: 77770 - DNA, 22 bp, Homo sapiens
  misc_feature 1..22: note = chr15:61521556-61521578
  misc_feature 1..22: note = hyper
  source 1..22: mol_type = genomic DNA
cgaccggcgaaagcaggaggga

SEQ ID NO: 77771 - DNA, 165 bp, Homo sapiens
  misc_feature 1..165: note = chr15:61521809-61521974
  misc_feature 1..165: note = hyper
  source 1..165: mol_type = genomic DNA
gagaacagagcctcccgcgccccaatcctcccctctccccagcccagggacagaaattaaaatcggtgagatgattccgtgcctacttctgagactctctcgggaacagaactcgtccccatccgctgccagcttgggtagagacaaatccgattgtccacgtcc

SEQ ID NO: 77772 - DNA, 139 bp, Homo sapiens
  misc_feature 1..139: note = chr15:61739721-61739860
  misc_feature 1..139: note = hypo
  source 1..139: mol_type = genomic DNA
ggtcaaaaaagtagttgttttttttttaaccatgtgcccacattactctttaaaaaacttcattaagtataatgtagacaagaaaagtgcacgtaagtgtaccgtttgataaattttcacacaccgatgtaactaacat

SEQ ID NO: 77773 - DNA, 37 bp, Homo sapiens
  misc_feature 1..37: note = chr15:62068181-62068218
  misc_feature 1..37: note = hypo
  source 1..37: mol_type = genomic DNA
ctcatggacataaagatggcaacgatagacactgggg

SEQ ID NO: 77774 - DNA, 30 bp, Homo sapiens; identical to SEQ ID NO: 44277
  misc_feature 1..30: note = chr15:62361320-62361350
  misc_feature 1..30: note = hypo
  source 1..30: mol_type = genomic DNA

SEQ ID NO: 77775 - DNA, 44 bp, Homo sapiens; identical to SEQ ID NO: 44278
  misc_feature 1..44: note = chr15:62367703-62367747
  misc_feature 1..44: note = hypo
  source 1..44: mol_type = genomic DNA

SEQ ID NO: 77776 - DNA, 159 bp, Homo sapiens
  misc_feature 1..159: note = chr15:62456236-62456395
  misc_feature 1..159: note = hyper
  source 1..159: mol_type = genomic DNA
tcaaaggaggccttgcggctgcgccccaccacagcgctgcattgccaacgcgcagtgcccggcggccgcaggacgaggctgaggcggcagcggacggcgcggggcccgggggcgcctccgaacaggctctccgcgcggagcagccggaggcggagacgc

SEQ ID NO: 77777 - DNA, 245 bp, Homo sapiens
  misc_feature 1..245: note = chr15:62456686-62456931
  misc_feature 1..245: note = hyper
  source 1..245: mol_type = genomic DNA
gcgtcctggggcaggcggggaccgccgggggccgcgggggtggccgggcccggacctcgcgggccgcacagggtccccaggggggcgtccgggcctccgccgccgccgcagctgtgggcccggggccggggcgcgggcgggcccccgagcaggagcgactccttgcggcgcgtgtgcgggctctcgagcagcgcgcagaagccgtaggtggtgcgcacacggggcaggtgcggcagtgacagcgc

SEQ ID NO: 77778 - DNA, 158 bp, Homo sapiens
  misc_feature 1..158: note = chr15:62457138-62457296
  misc_feature 1..158: note = hyper
  source 1..158: mol_type = genomic DNA
ggagctgcctgcggccgaggaacagagtttctcgaggagccgcatccttggaggctggggctaggagtggcgggaagaggtgcgcctgcgggggagagaagctgctgagtttgggcgcctggagctgctgcagcccctcgacgcggctggatccctcc

SEQ ID NO: 77779 - DNA, 80 bp, Homo sapiens
  misc_feature 1..80: note = chr15:62684233-62684313
  misc_feature 1..80: note = hyper
  source 1..80: mol_type = genomic DNA
ggcctgtggtcgccccgaggccgccgaacagcctgagcttccagtcgcctctttggctttagcggcgacagcagtagcgc

SEQ ID NO: 77780 - DNA, 91 bp, Homo sapiens
  misc_feature 1..91: note = chr15:62821527-62821618
  misc_feature 1..91: note = hypo
  source 1..91: mol_type = genomic DNA
ggcaatcttcccaccttggccttgtgttggtattacacgtgtgagccactgcgcccagcctttttagggcttttatcgtctactgtaaagt

SEQ ID NO: 77781 - DNA, 243 bp, Homo sapiens
  misc_feature 1..243: note = chr15:63334477-63334720
  misc_feature 1..243: note = hyper
  source 1..243: mol_type = genomic DNA
aagcgcgccgggggacggcacaggggggcgacgcgcatccaccacctggtccgcgctctcccggcctccggcagctcagggcgggctcggttggggaccctaatggctgggtgccggccctgggagaagggcacgcggagggcggagggttgcgcctcggccccggctcggccccaacgccctctccctggcgcgcaggtttagaaacagggcggcctctccggccgccgcctcggcggctcg

SEQ ID NO: 77782 - DNA, 74 bp, Homo sapiens
  misc_feature 1..74: note = chr15:63334921-63334995
  misc_feature 1..74: note = hyper
  source 1..74: mol_type = genomic DNA
tctgggagaagcaggcggctccgcgctcgcactcccgctcctccgcccgaccgcgcgctcgccccgccgctcct

SEQ ID NO: 77783 - DNA, 72 bp, Homo sapiens
  misc_feature 1..72: note = chr15:63335932-63336004
  misc_feature 1..72: note = hyper
  source 1..72: mol_type = genomic DNA
agttgctgcgggtgtcggaggacgagcgggaccgggtgctggaggagctgcacaaggcggaggacagcctcc

SEQ ID NO: 77784 - DNA, 35 bp, Homo sapiens
  misc_feature 1..35: note = chr15:63390437-63390472
  misc_feature 1..35: note = hypo
  source 1..35: mol_type = genomic DNA
gaaaagagtgaaattcgtccctctccctctccctc

SEQ ID NO: 77785 - DNA, 501 bp, Homo sapiens
  misc_feature 1..501: note = chr15:63673771-63674272
  misc_feature 1..501: note = hyper
  source 1..501: mol_type = genomic DNA
ccttcagcccaggggcggctgagcgctcaggagtgttaggaaagaagcaggcggaaactttaccgttcactggggccgggctggaaggctgttcctttaagatcaccagcaggagcacggccgccgcgtgcaggctgcgccggggcatcttcgcgggctcctgcggggcgggcgcgggctgtgccgggggctcccggtggccgctcgctctccagctgcacaccgggaccgcgtgcgcgcagcctgggtgccgtggcgagtacgtccgcccttcgctctcctggcttccccgggcagcttttatggagcaactcaacgccaaacacttgatgtcatcgtgcggggagggggtgggggaggagaacgccctgcccaccggagggctggcgccccagatcctaggtgagttgtagccttgacttcagcagcactctgcgggtccccggcgctcctctgggccagggctgacccaggaacacagttctccgaggagctgctggc

SEQ ID NO: 77786 - DNA, 249 bp, Homo sapiens
  misc_feature 1..249: note = chr15:63753342-63753591
  misc_feature 1..249: note = hypo
  source 1..249: mol_type = genomic DNA
aaaagaatgttactgcggggcctccctaaaagacaagggaggaatcaagagaattccaagaaaggcgtccgagcaggaggtaagacagtagatttgaaagcaggactgagggagcaggaatgggaagaggggcccagccccagcgggtcaggggccggactaggctagcgaggcccaagtgcggtggccccatgcagagatcctggctcggtgcaaaggagatgccgctcccaccgtctgcaggaggca

SEQ ID NO: 77787 - DNA, 30 bp, Homo sapiens
  misc_feature 1..30: note = chr15:63756300-63756330
  misc_feature 1..30: note = hypo
  source 1..30: mol_type = genomic DNA
catagctgtgggagccgatcaagttcccta

SEQ ID NO: 77788 - DNA, 82 bp, Homo sapiens
  misc_feature 1..82: note = chr15:63779643-63779725
  misc_feature 1..82: note = hyper
  source 1..82: mol_type = genomic DNA
ctctcactgggagcccggactcacgcagcaccacctgtgtcccctagggggcgagctggggagagaccggagtccctgggag

SEQ ID NO: 77789 - DNA, 30 bp, Homo sapiens
  misc_feature 1..30: note = chr15:63795471-63795501
  misc_feature 1..30: note = hyper
  source 1..30: mol_type = genomic DNA
gtaagaagtgattgacggggcgtccctggc

SEQ ID NO: 77790 - DNA, 43 bp, Homo sapiens
  misc_feature 1..43: note = chr15:63795851-63795894
  misc_feature 1..43: note = hyper
  source 1..43: mol_type = genomic DNA
aacaagttacagactcggtttccccctgcggtaaaaaggggat

SEQ ID NO: 77791 - DNA, 30 bp, Homo sapiens
  misc_feature 1..30: note = chr15:64210208-64210238
  misc_feature 1..30: note = hypo
  source 1..30: mol_type = genomic DNA
tcagtgtttgttcaacgggactggaccctt

SEQ ID NO: 77792 - DNA, 30 bp, Homo sapiens; identical to SEQ ID NO: 44280
  misc_feature 1..30: note = chr15:64440388-64440418
  misc_feature 1..30: note = hypo
  source 1..30: mol_type = genomic DNA

SEQ ID NO: 77793 - DNA, 91 bp, Homo sapiens
  misc_feature 1..91: note = chr15:64443195-64443286
  misc_feature 1..91: note = hypo
  source 1..91: mol_type = genomic DNA
cggccaaatcatctcactttatacacttgcctgaaggagccacgttatccctattttgcagatgagcaaaggtctacggagctcctgaaat

SEQ ID NO: 77794 - DNA, 38 bp, Homo sapiens
  misc_feature 1..38: note = chr15:64649878-64649916
  misc_feature 1..38: note = hypo
  source 1..38: mol_type = genomic DNA
accttcaaaataaactttcataccgacactatggataa

SEQ ID NO: 77795 - DNA, 30 bp, Homo sapiens
  misc_feature 1..30: note = chr15:65036371-65036401
  misc_feature 1..30: note = hypo
  source 1..30: mol_type = genomic DNA
gaagcctcacttatccgaaattaaaacatt

SEQ ID NO: 77796 - DNA, 152 bp, Homo sapiens; identical to SEQ ID NO: 44282
  misc_feature 1..152: note = chr15:65043526-65043678
  misc_feature 1..152: note = hypo
  source 1..152: mol_type = genomic DNA

SEQ ID NO: 77797 - DNA, 50 bp, Homo sapiens
  misc_feature 1..50: note = chr15:65068204-65068254
  misc_feature 1..50: note = hyper
  source 1..50: mol_type = genomic DNA
ctgcccgggcggcctcgcgcttagggcacccgcagcgaggtttccgggcc

SEQ ID NO: 77798 - DNA, 30 bp, Homo sapiens
  misc_feature 1..30: note = chr15:65118647-65118677
  misc_feature 1..30: note = hypo
  source 1..30: mol_type = genomic DNA
tagggctcactctgtcgcccaggctgtagt

SEQ ID NO: 77799 - DNA, 35 bp, Homo sapiens
  misc_feature 1..35: note = chr15:65119226-65119261
  misc_feature 1..35: note = hypo
  source 1..35: mol_type = genomic DNA
ctcccagtctgttagcggtagagggtgatgactga

SEQ ID NO: 77800 - DNA, 29 bp, Homo sapiens
  misc_feature 1..29: note = chr15:65127732-65127761
  misc_feature 1..29: note = hypo
  source 1..29: mol_type = genomic DNA
tgagccaccgcgcccggcctggatttatg

SEQ ID NO: 77801 - DNA, 48 bp, Homo sapiens
  misc_feature 1..48: note = chr15:65204187-65204235
  misc_feature 1..48: note = hyper
  source 1..48: mol_type = genomic DNA
ggggcgggccgaggccgagaggacccccgcatccgtttggggagtgcc

SEQ ID NO: 77802 - DNA, 30 bp, Homo sapiens
  misc_feature 1..30: note = chr15:65214117-65214147
  misc_feature 1..30: note = hypo
  source 1..30: mol_type = genomic DNA
agtttgggatgaatgcgcttctcctgtctg

SEQ ID NO: 77803 - DNA, 37 bp, Homo sapiens
  misc_feature 1..37: note = chr15:65322459-65322496
  misc_feature 1..37: note = hypo
  source 1..37: mol_type = genomic DNA
gataagtcttttggtaacaaatcgtgcatgttttcag

SEQ ID NO: 77804 - DNA, 121 bp, Homo sapiens; identical to SEQ ID NO: 35757
  misc_feature 1..121: note = chr15:65360172-65360293
  misc_feature 1..121: note = hyper
  source 1..121: mol_type = genomic DNA

SEQ ID NO: 77805 - DNA, 76 bp, Homo sapiens; identical to SEQ ID NO: 35758
  misc_feature 1..76: note = chr15:65360323-65360399
  misc_feature 1..76: note = hyper
  source 1..76: mol_type = genomic DNA

SEQ ID NO: 77806 - DNA, 50 bp, Homo sapiens
  misc_feature 1..50: note = chr15:65622968-65623018
  misc_feature 1..50: note = hypo
  source 1..50: mol_type = genomic DNA
aaaacagcttgaagccgccctcgtgctgggccagccggggccaaggctcc

SEQ ID NO: 77807 - DNA, 197 bp, Homo sapiens
  misc_feature 1..197: note = chr15:65625104-65625301
  misc_feature 1..197: note = hypo
  source 1..197: mol_type = genomic DNA
gaaggaccaggttagcggcagggccccgccccacgggaggggaggcagctctgcctgcgcagtgaggctgccggcgacagagtgaaaatgacaagcaggcccggagtgcacaggcaggcaggtgtgagcgtggagatgccacacgtgtgaatgaaaacagcacgtgggaagacacgtgtgagcgacacaggtgggga

SEQ ID NO: 77808 - DNA, 236 bp, Homo sapiens
  misc_feature 1..236: note = chr15:65647864-65648100
  misc_feature 1..236: note = hyper
  source 1..236: mol_type = genomic DNA
cggcgggccccttcccggcggccgggcccgaggcgggggccggttcccacagccgaccgggccgcgcgccgcctttgaagtggccgcagctgcgccccggcccgcggctaatccccgccgacgcgggcgtcccgcccccccgcccctcccgcatagcaatagtgtccgcgctgaatggcgctggctaattacctcgctcgcaccaccgcgggtgaatgagagaatccggcattgtg

SEQ ID NO: 77809 - DNA, 15 bp, Homo sapiens
  misc_feature 1..15: note = chr15:65648136-65648151
  misc_feature 1..15: note = hyper
  source 1..15: mol_type = genomic DNA
cgcacgccaaacgag

SEQ ID NO: 77810 - DNA, 1174 bp, Homo sapiens
  misc_feature 1..1174: note = chr15:65669070-65670244
  misc_feature 1..1174: note = hyper
  source 1..1174: mol_type = genomic DNA
ccctggtatagctgtcgggaataaagtttttccttgatgcggacgcgagcttctacttcttgggagaggagtggagagagaatagcccagatgagtgtctgtggggaacttgaggtgggagggttaagggactagatttgcactctcctcccgggagatgggaccattgcagccactaaagggaacagagtggtggtgaccgagctccaggcagcagagccgagctccaggcagcagaaccggcggaccgcgagagccagggcaaggtctccgcgtgtgcacacttcggggaagggcaggggcacgtgagcatccccgcggctcgctcgctctcgctttcggtggcttctcctctccttcttggctcacgggctctgtcccgggtcgctccctagccacgcgccgccctccaggaatctccctcgtcttctcctgtctctcccgcgcactcctcagcccagtaccagctccaaatgcaggtcgtgccatctccgcccagtgcagccgtcagagtcccggtctccgctccccaggctgctgtcccctgtcttggctgcctcgggctatgtccacggccgggcacccagcaccccagctcgtccgcctcggtcagcgcttagccttgcggtctcccctggctcgtttccctcggtctccacgccagcccgccccgcttgctcccgcttcgctgcactccttgctcctcagtctgggctccgggtcctgccccagtcttcctccggggggttccgtcctcaacacgcccctagggcccccagcagtccggccttggtaccctctccccgtccggatccgcagggtcccccccgcgcggggtccgccctcaggtccgcgccgctctccccgggtccgcccctcgcgcccgctccctccctgctcgcccttcccctggctccgtccgcaaccgcccggtccggggcgctttcactcaccctcgctcggcgcgggcagcagcagcaacagcagcggcagcaggagccggggccagagcggggcgggcgggcggcgcggagacgcggcgcgctgcacagccatggggctctcggtcagctcggctcggcgacgcgcggctcccgggcctctcgcggctcacagcgtcccgcggggccggcgccggggccggggctggggctccggccggggccgagcccag

SEQ ID NO: 77811 - DNA, 151 bp, Homo sapiens; identical to SEQ ID NO: 35762
  misc_feature 1..151: note = chr15:65670634-65670785
  misc_feature 1..151: note = hyper
  source 1..151: mol_type = genomic DNA

SEQ ID NO: 77812 - DNA, 564 bp, Homo sapiens
  misc_feature 1..564: note = chr15:65713759-65714323
  misc_feature 1..564: note = hyper
  source 1..564: mol_type = genomic DNA
ctctggcccagcagccgagacccagcctcgcggcggcctccagcttaatccgctgttggggctggaaaggggcgtgtctttgtagggacagaaggggtccgaggagttcccggcactttcccacccgctgtttggttttcctggagatgggcctggggctggccaggcggaggctccttccccccgcctccctcccacgtggcctggctgagtctctctggaaagccgcagcagctggagagaaatccccctccccacccccacctccaagtccctccccgactctccccggacacatcctcagctcccccctccgcggggaaggcaagaactaggcgaacaaagcggccagcccatccccctcccagccctgccacctacactccccatgagccgcccccaaacgcacaccggacaggaagcgacagagctgtgggtggaagccgcagccctagacacacacccttggggacttcgctatcccctccccagccctttctccagcttggacaactctgacttaccccgtacccactccgcactgggctgcggactggatgaggc

SEQ ID NO: 77813 - DNA, 84 bp, Homo sapiens
  misc_feature 1..84: note = chr15:65714747-65714831
  misc_feature 1..84: note = hyper
  source 1..84: mol_type = genomic DNA
aggcaaggcagagcccgccccgcgaaagccaccgacaccgcagctacccgccccgccgatgccacgccgcgaccatggcacgca

SEQ ID NO: 77814 - DNA, 395 bp, Homo sapiens
  misc_feature 1..395: note = chr15:65715098-65715493
  misc_feature 1..395: note = hyper
  source 1..395: mol_type = genomic DNA
tcgctcctgcctctccgggcgcccgcccttaccgcgcgcggccaacaggcagaaggtcaacgcgaggagcccgcggccgcggccggcgtccccccgcgccatggggctgggctcgggccgccgccgccgccgccgcctccccgtgcttcggccgccgccgcggggggagagcgcgccgggcgtcagtggcccggggaggcgcggcgccgcgggcgggggcgcggcctcgggggcccgggcccgagctggggccggcgcgggggccagggccgctgccgcctcacccgcccctccatcgccatcttgggcgagcggcccgggagggggcgcccggcgagtgtggccaccctggccccgccggggaccctgcgcccgcgcgccacggccctgcgcct

SEQ ID NO: 77815 - DNA, 165 bp, Homo sapiens
  misc_feature 1..165: note = chr15:65715513-65715678
  misc_feature 1..165: note = hyper
  source 1..165: mol_type = genomic DNA
cgggtctgtgtcccggtgcctcgccctctccgggtcgccgcgggcccccgtgaggccgcctgttgctgggtctgtctcttagtctccccgtctctgagtcttctggtctctctgcctcagcgtctctatttcttctccctgttgctgcctcggggtctccacctc

SEQ ID NO: 77816 - DNA, 95 bp, Homo sapiens
  misc_feature 1..95: note = chr15:65826384-65826479
  misc_feature 1..95: note = hypo
  source 1..95: mol_type = genomic DNA
tctcaaaaaaaaaaaaaaagaaaagaaaccagtggttctggctctggatgaagcacttcatttatttgttcagtaaaaatcgtttatggagtacc

SEQ ID NO: 77817 - DNA, 103 bp, Homo sapiens; identical to SEQ ID NO: 44285
  misc_feature 1..103: note = chr15:65862091-65862194
  misc_feature 1..103: note = hypo
  source 1..103: mol_type = genomic DNA

SEQ ID NO: 77818 - DNA, 30 bp, Homo sapiens
  misc_feature 1..30: note = chr15:65946844-65946874
  misc_feature 1..30: note = hypo
  source 1..30: mol_type = genomic DNA
tctgccccaaacacacgctgcaattttgtc

SEQ ID NO: 77819 - DNA, 83 bp, Homo sapiens
  misc_feature 1..83: note = chr15:66017661-66017744
  misc_feature 1..83: note = hypo
  source 1..83: mol_type = genomic DNA
tgccctttgataaatcgcttaaaaatctaagctttggtttccttgtcagaagggttaataagaactacctcggctgggcgcgg

SEQ ID NO: 77820 - DNA, 33 bp, Homo sapiens; identical to SEQ ID NO: 44286
  misc_feature 1..33: note = chr15:66147762-66147795
  misc_feature 1..33: note = hypo
  source 1..33: mol_type = genomic DNA

SEQ ID NO: 77821 - DNA, 30 bp, Homo sapiens
  misc_feature 1..30: note = chr15:66198204-66198234
  misc_feature 1..30: note = hypo
  source 1..30: mol_type = genomic DNA
aggtgcaactgaaatcgaaagatgaattca

SEQ ID NO: 77822 - DNA, 41 bp, Homo sapiens
  misc_feature 1..41: note = chr15:66596944-66596985
  misc_feature 1..41: note = hypo
  source 1..41: mol_type = genomic DNA
aagatattttatggccgggcgtgacggcttatgcctataat

SEQ ID NO: 77823 - DNA, 192 bp, Homo sapiens; identical to SEQ ID NO: 44287
  misc_feature 1..192: note = chr15:66598802-66598994
  misc_feature 1..192: note = hypo
  source 1..192: mol_type = genomic DNA

SEQ ID NO: 77824 - DNA, 104 bp, Homo sapiens
  misc_feature 1..104: note = chr15:66647729-66647833
  misc_feature 1..104: note = hypo
  source 1..104: mol_type = genomic DNA
caaattggagttagacgatctttaaaatctcactaattctaaatttcggttaccataaatataaaagcaaagcatcggctgggcgcggtggctcacgccggtaa

SEQ ID NO: 77825 - DNA, 97 bp, Homo sapiens
  misc_feature 1..97: note = chr15:66649671-66649768
  misc_feature 1..97: note = hypo
  source 1..97: mol_type = genomic DNA
catagcagaatgcttcgaactcagagttttatgaattgtttattgaataataagctgagaaaagaggtggtaaagagaggaaaaatagggctgaaca

SEQ ID NO: 77826 - DNA, 30 bp, Homo sapiens; identical to SEQ ID NO: 44288
  misc_feature 1..30: note = chr15:66788210-66788240
  misc_feature 1..30: note = hypo
  source 1..30: mol_type = genomic DNA

SEQ ID NO: 77827 - DNA, 30 bp, Homo sapiens
  misc_feature 1..30: note = chr15:66789348-66789378
  misc_feature 1..30: note = hypo
  source 1..30: mol_type = genomic DNA
tctcactatattgcccgggctgaggggctg

SEQ ID NO: 77828 - DNA, 26 bp, Homo sapiens
  misc_feature 1..26: note = chr15:66798718-66798744
  misc_feature 1..26: note = hypo
  source 1..26: mol_type = genomic DNA
agataaggccgggcgcgatggttcac

SEQ ID NO: 77829 - DNA, 185 bp, Homo sapiens
  misc_feature 1..185: note = chr15:66963175-66963360
  misc_feature 1..185: note = hypo
  source 1..185: mol_type = genomic DNA
cagggttgtgaaatgcgtgagtgtatgtgaagcgctgagacagtgcctggcacattagtaagtgctggacgtgtttgctccttctaggtctacatttttagcagagggaatagcaagggcaaaggccctgaggtgggaaacacgttccaggaatgggaagaaggttaggacgacacaaggggagt

SEQ ID NO: 77830 - DNA, 62 bp, Homo sapiens
  misc_feature 1..62: note = chr15:66963672-66963734
  misc_feature 1..62: note = hypo
  source 1..62: mol_type = genomic DNA
ccagcctgaggtgcccgcctcccaccgcaccgcctgctgtgatcagccggagccttccatct

SEQ ID NO: 77831 - DNA, 72 bp, Homo sapiens; identical to SEQ ID NO: 44292
  misc_feature 1..72: note = chr15:66964011-66964083
  misc_feature 1..72: note = hypo
  source 1..72: mol_type = genomic DNA

SEQ ID NO: 77832 - DNA, 33 bp, Homo sapiens
  misc_feature 1..33: note = chr15:66995234-66995267
  misc_feature 1..33: note = hyper
  source 1..33: mol_type = genomic DNA
caacttttgaaggctcgccggcccatgtggggt

SEQ ID NO: 77833 - DNA, 30 bp, Homo sapiens
  misc_feature 1..30: note = chr15:67322314-67322344
  misc_feature 1..30: note = hypo
  source 1..30: mol_type = genomic DNA
aagatgagctcaattcgggagatgcccaat

SEQ ID NO: 77834 - DNA, 39 bp, Homo sapiens; identical to SEQ ID NO: 44293
  misc_feature 1..39: note = chr15:67457364-67457403
  misc_feature 1..39: note = hypo
  source 1..39: mol_type = genomic DNA

SEQ ID NO: 77835 - DNA, 81 bp, Homo sapiens; identical to SEQ ID NO: 15907
  misc_feature 1..81: note = chr15:67545405-67545486
  misc_feature 1..81: note = hypo
  source 1..81: mol_type = genomic DNA

SEQ ID NO: 77836 - DNA, 30 bp, Homo sapiens
  misc_feature 1..30: note = chr15:68074740-68074770
  misc_feature 1..30: note = hypo
  source 1..30: mol_type = genomic DNA
agggcaccgaggaatcgatttttgtcttgt

SEQ ID NO: 77837 - DNA, 141 bp, Homo sapiens
  misc_feature 1..141: note = chr15:68112086-68112227
  misc_feature 1..141: note = hyper
  source 1..141: mol_type = genomic DNA
cggcctcccaccaaatccggaccctctccagcctcagtctctggtccgcaacaggagtgaggtgggcccggagctctgagcaccttctcaccggctccaaggcccccgccttctcctcacttttggtctcgggttggggcc

SEQ ID NO: 77838 - DNA, 164 bp, Homo sapiens
  misc_feature 1..164: note = chr15:68112276-68112440
  misc_feature 1..164: note = hyper
  source 1..164: mol_type = genomic DNA
cgcgccgggctctgccctatgtggccgttggattaatatccagatattaagtaaacactaaattagcaaaactacaagaaaattttacagccctttgcatttggcaatcattgagtgttaattagaaattcattacaattaaaaccctgcctaaacagggcctg

SEQ ID NO: 77839 - DNA, 176 bp, Homo sapiens
  misc_feature 1..176: note = chr15:68112498-68112674
  misc_feature 1..176: note = hyper
  source 1..176: mol_type = genomic DNA
cgtaccccgtgattatccccaatcctctttatactgtactaattatgtaaattaaacctaattaactgacgaaaactgccgttaattcaactagtaaaagatatgtgcttgcggaggaggcgcgtccgcgcagcctcagcccaagccggagcccaaatggacgccaaacccggggc

SEQ ID NO: 77840 - DNA, 30 bp, Homo sapiens
  misc_feature 1..30: note = chr15:68112976-68113006
  misc_feature 1..30: note = hyper
  source 1..30: mol_type = genomic DNA
cttcctcctctacatcgtctaatgagggcg

SEQ ID NO: 77841 - DNA, 1295 bp, Homo sapiens
  misc_feature 1..1295: note = chr15:68113226-68114521
  misc_feature 1..1295: note = hyper
  source 1..1295: mol_type = genomic DNA
gcccttgttgagaatcggctctgcaatcggtaaagtgcggtccgcggtgatattaacccgccggacgccggcccatagtagagccccagctcctacccccacgacctgctccccggtgcccagccctgagcagcggggcttccccagcctctgtccacgcgcctttctccagctcagaccagggacaggagctgggtgggtctcctggcactggccagagcgcggggagctgtccgtagcttggtgctgaacggggacgcagagtcgacgctgcacaccccctggtgcggggcggtaccctttgtctaagaggtcctgggggccccccgcggccgggctgctggaaacggaggcgtctttggccctcgctgtacaacagaggcaggacaggcaggtcctgctcagggggacccagcccatcctctctttcctcccaccccccggcaccctgggggcgtcctggctccaggatcgttgtcaccaccaggccgaattctgagatgccttttaaaaaatcattaggaggctaagaataattaccgaacgagattgtaattatggggtgggggagcctgggccgagggagagggaatgagctggcggggacttgggggcagctctcggactgggaaggaaaataggttcctgtgttctccccggggaaggtgtgggaggaaagacagcgggatagttggagcgggacagaggcacagcctgggaaagacacccgaatggaggggccagaggcagaaagaaaggggccgagcgggttccaggactcccctgggagaaaagggaaaggcagggagatccgagacagaaagaccggaaccgaggagggggaagagggcaagaacgcgatctaaaagagaccctcagaggagacagagcccacaaacttgggagaggttttcggggcctaggagaacggtaacctacgtcagccagggtagccgggaagaaggcaaaggagtctgtgggctgggcctgccctctcctcagtcccttcaccaggcctgagctatcggttcgcgcttccagagtcccttcccagggtctctgcgagccaggagggaaaggaagagaggggagaagtggaggaaaaggggagacacgccccagaggagttggaacgcaggagggaaaggggaccatacccggtagcccgagggaaaaacgaggcgagaggggagaaggcgaccccgcgctgctacccgcggaagatttatggcgcctcccgggttccaaggacaggctgcgttcgtcgctgctgccaccgccggtagtcgccgtgg

SEQ ID NO: 77842 - DNA, 192 bp, Homo sapiens
  misc_feature 1..192: note = chr15:68114819-68115011
  misc_feature 1..192: note = hyper
  source 1..192: mol_type = genomic DNA
aaagaatggtgaagacggagagaccgactgagacaggaaagggatggagagaaacggagctttgaggagagagaggaggtacccaggggcgtctgtagcatcagaggactggacctcccccttggggaaactggcttagcagcgttgagagcgtagttaacctcagatcactcccaacgatgacttggctcc

SEQ ID NO: 77843 - DNA, 1371 bp, Homo sapiens
  misc_feature 1..1371: note = chr15:68115216-68116587
  misc_feature 1..1371: note = hyper
  source 1..1371: mol_type = genomic DNA
cccaggtccctgtcccggtctctggtgaccctactggttcccgagggccactctaggctccaccaccctggccctcgcctgcggccggaaagtgaagtactcctccctgcgcccgttcctcttgagtcccccttagccccatcacccggttttggcccagaccaaaactggctccttggccgggagcactgggccctccccacttcgttcttggggacaaactttatggccccagggcctttcctccctcctggcctctccagctagagcgggacgcaggtgcagggtgctggacgcaggtgtgcggccgcttacctggggcgtgcaggccttgggctgcggggaggcggcgggcgccgcgcgtggcccgcgggcgggcggacccggggagggcgctagcgactgcgcgggcggtgggtgtggcgccccggctctcagctgtcaggcgcgcctgccccgccactcgggctgtgaccgcgccgtccccgccgccgcgccatgcgctccaggcttcggcctcttcttccggccagtccccggcctcggggtcaacggctcagggttcgcatctccgcgcccggggtcccggcgccccgtgcccgctgagagcgggaggggccgcgggtgggagcgcggagaaccagggagcacggctgtgcgcgcgcgcggggaggggccgcgccgtcacccggagagcccggcggatcccggactcccgcccgccgctcctcccgccgcgcacctccgctcaccgctcgcccggctccagccgccgccgcactgtgagtacccacgtccggtagcccgccgcccccgcgctctgctcctgcagcttttttttcgtttagttctgatttgggctcctgtggctgttgtttttatgattatacctaaagacaccaccgcctcgctcccaccactgccagtctcccgcttcgctgccctccccaagctcgtccatctagctccgggagccgacgggggttcctcaagctgctctggctgctgctccttgtcgctgcatatggctcttcgcctgtgctttccgctttggcccccgaaattccgttcctttcctagggacccccttcttctgactccgggcccggacccccctcctctcactcagggaaaaccgcgcagggacccaggaccctcaactggggtacgctctcggctcgggcgctgtcttcactgtatgcgggccaggcatagttgccgatttcgagaaaccgagaagctgtcatttcccagcgctgcgcgccctccagccacctccaggagggcgcgaggcttgtcagccggggagttaggacagtgtttttgcctcctacaatgatataaaggacttcaacgcgaaataagggtcaa

SEQ ID NO: 77844 - DNA, 30 bp, Homo sapiens
  misc_feature 1..30: note = chr15:68116962-68116992
  misc_feature 1..30: note = hyper
  source 1..30: mol_type = genomic DNA
tgtggctgggtcaggcgacctagagggccc

SEQ ID NO: 77845 - DNA, 1481 bp, Homo sapiens
  misc_feature 1..1481: note = chr15:68117203-68118684
  misc_feature 1..1481: note = hyper
  source 1..1481: mol_type = genomic DNA
ggaagcccagagccccgaatcctgcagttggcccgagtgggaaacgtatatctgaaggaggaaagctcaaggagtgggcgactggaagctaagaagtggatcccaacaaagttccttgagaacctctctgtcccacacgttgacctcggtggaaaccagctttggtctggaatacagctaaaaatgcagaaaatgtggttagaactgcaggatcctggtctcactaatagctggaaagaaaacggtttatatatccagccgaaatctttctgctcaacgaacgcgggcgccagccgtgagaggagaagctcgggtttgtggaaactggcaatgttgtcccctgaagccggctcgggcaccaagctgggtgcggtgggggccgcgctaggtccgggtgcgcaccgagcgctttggagagggtcaggttcagcaccgcgaacagcggtagcctccgcctctctccttccctggcagacacggttccctcctccttctcctcacccccctccttctcttcacccccctctaccccctgctgtctggagatgggcagtgaccgcccctcccccctccccacccctccttgcactgcccccgcccgcccgcgtgcatgcgcgactgagcagaggggcggccgatccccgaagtccgggcttcaggacccgggccggcagcaccggctgcgagggttgccgaaggcgcacggatctgggcgctgaaaaagccaggatttggcaatggctttgctgtgtggccttgggcaagtcactctgcgtatctgggtttcacttccttcccaatccgaaaacgggattgggttccttgcagcccgggcattcctgaggtctcctttaccccttctcctcccccaagccccgggggctgttgttaacggcgccaacatgggtctgagtaacaaaagacgcctgtccagggggtgaatgagtttggactccccactgccaagtatcccccgcgcgcccaactcggagcgccctgctgggcgggcccgagcctcggcggcggcgctgaaaatggctcatctgctctctgctttctctatttcgcaggagcggcggcatggaggctctcaccactcagctggggccggggcgcgagggcagttcctcgcccaactccaagcaggagctgcagccgtactcgggctccagcgctctcaaacccaaccaggtgggcgagacgtcgctgtacggggtgcccattgtgtcgctggtcatcgacggccaggagcgcctatgcctggcgcagatctccaacaccctcctcaagaactacagctataatgagatccacaaccgccgcgtggccctgggcatcacgtgcgtgcagtgcacgccggtacagctggagattctgcgtcgggccggggccatgcccatctcgtcgcgccgctgcggcatgatcactaagcgagaggccgaacgcctgtgcaagtcgttcctgggcgagcacaaaccacc

SEQ ID NO: 77846 - DNA, 246 bp, Homo sapiens
  misc_feature 1..246: note = chr15:68118929-68119175
  misc_feature 1..246: note = hyper
  source 1..246: mol_type = genomic DNA
cggccacagacgaactgagccatgcttgggaggacgtcaaggccatgtttaatggcggcacgcgcaagcggaccttctccctacaaggaggcggcggaggcggtgccaatggcgggtcgggtgggcaggggaagggtggtgctggcggcggtggcggcggtggcccagggtgcggtgcagagatggccccaggcccgccgccccacaaaagcctgcgctgtggcgaagatgaggctgccgggcctc

SEQ ID NO: 77847 - DNA, 775 bp, Homo sapiens; identical to SEQ ID NO: 35774
  misc_feature 1..775: note = chr15:68119578-68120353
  misc_feature 1..775: note = hyper
  source 1..775: mol_type = genomic DNA

SEQ ID NO: 77848 - DNA, 329 bp, Homo sapiens
  misc_feature 1..329: note = chr15:68120630-68120959
  misc_feature 1..329: note = hyper
  source 1..329: mol_type = genomic DNA
cgcgctgcgaaactgggcccacccgcaccctccagtgagggtttcgaagggaagggaagctgggggcggcgggaggactggggaacttgtgtgctttgtttttgttgatgggaatggggaggagaccggctgagactgccagacacagagacagaaaaggggtgtggagaaagaaagaggaggtaagaaaggaacccagagccagagaaaagcgctcgcccgggtgggcatcagagccccaaggaagaggagaagagaggacagtgtggcctctccctgagtcgggccccagcagtaccgggtccccggaatctcccaccaccccaact

SEQ ID NO: 77849 - DNA, 809 bp, Homo sapiens; identical to SEQ ID NO: 1217
  misc_feature 1..809: note = chr15:68121149-68121958
  misc_feature 1..809: note = hyper
  source 1..809: mol_type = genomic DNA

SEQ ID NO: 77850 - DNA, 261 bp, Homo sapiens
  misc_feature 1..261: note = chr15:68122469-68122730
  misc_feature 1..261: note = hyper
  source 1..261: mol_type = genomic DNA
ggcagtatccgggtcacggtttctttgcctctcttgaaattcggtttgttgccttcaagagccagataaggaagacaatcactcgcccgccgatgatttggaaacgaggaaatcctatccagaccaaaggagtatctcccagccaagtcctgcaaatacagacagaggtgagccagcccttgaacccatcgctctccaccgcacccaggagctgggacccaggtcgcccaggttcccagaggcttgcgagaaaggctttta

SEQ ID NO: 77851 - DNA, 1021 bp, Homo sapiens
  misc_feature 1..1021: note = chr15:68125223-68126244
  misc_feature 1..1021: note = hyper
  source 1..1021: mol_type = genomic DNA
gattgaacttcttatcgcggcaatttccatggtttctaaattaaaaatcgaggcgtaaaattacctgggaagtaatgcctaagtttgctttaattttggttagatccatctgcctttaagcgccatcccaggccatttccttcctccgccagtctgcagttaggagctccggtaccccctcccccatccctggagttgtttctgcgcggagcttagccctggggagaggaggaagcccgggctgtgaccccggcctttcggagggtggtctgcgtttcctcactggcccctccccttgtcttccagataccctgtgtaacgaactcgaccaggagcggaaggcgcgctatgccatccagcagaaattgaaaggtgcggaagccgggaaacaaagataggaggggtgctgggtgccggccgtgctgtcgactgaatgaatgaatagtgggactagtgaggaaggccacgatccacgtggatcaggatctgtgagggagaaaagtgggaactgattttaacgggaagattattctaggatggtgggggtaaaaagaaagagccccttgggctttggacgtcagaaaaatctgccttctattaccaattctggctttgagcaggttgactcctctcttactgtgcctcagtttccttttctgtaaaatggggctactgaaccagagcagtggttctgaatcaccagcttttgtcctaccctcctgcctcctcctgatccgctcggttgagattccctgaccccaaagggttggtaaggccggggaggggaaagggtggactgcgcggtgaggtgagcctggagaggcgcccagagtgaccctcgcgactgtctccccagaagcccacgacgccctgcaccatttctcctgcaagatgctgacgccccgccactgcactggcaactgctccttcaagccaccgctgttgccctagggccggcctggccgcacccctgcgccctcaagccatgctgctccttgtaaatacccgctgctgcggtggc

SEQ ID NO: 77852 - DNA, 100 bp, Homo sapiens
  misc_feature 1..100: note = chr15:68126468-68126568
  misc_feature 1..100: note = hyper
  source 1..100: mol_type = genomic DNA
ggcgggaggggagagcgccccctcccattgtatagccttgaacccgattgtgaatacaatgtagcaacttcgctggcgcctgccccgcactccccgtccc

SEQ ID NO: 77853 - DNA, 224 bp, Homo sapiens
  misc_feature 1..224: note = chr15:68126905-68127129
  misc_feature 1..224: note = hyper
  source 1..224: mol_type = genomic DNA
tcacttctggggctacggaggtgggagtgcaccggcggagcggggcggcggaacaccgtgcaacaggtgggggtgggagccgccccgcgggttctggggctcccagggtcagaatcgggcctgctcaagtgggcagcagcgagcactcaacctctccactgtgccctccagacacactcagttttcccccacagggcactccctctccgcgtttaggaccctcc

SEQ ID NO: 77854 - DNA, 1010 bp, Homo sapiens
  misc_feature 1..1010: note = chr15:68127492-68128502
  misc_feature 1..1010: note = hyper
  source 1..1010: mol_type = genomic DNA
ggagggagccccgtccgcattttctgttcggtccattttagttcgagaggggctaaggactcgccgggcctcggctggggcgtccgacgtccgggtcacggttggcaaggcctcccagcggcctcagtttccacagcgcacctcctgcttgggctacagacgacgctgcaaattgcagaacactctttgcagggaggagagtgtggatggagtgggagagagctcacggcacagggaatcattcagccttggctttcatttctcgccctcggctggctagtgggggtcccgggttgagcccttcttttatctttcctgggtctccgtttcggcctctatgaaataacacgcaggcctccgtccatgcggctcgtagaaggcgggcggcaggccccgcgccaccggccagcagctcgggaccgggagccctgggctgagggggccgggaagtttcgtggcgggttgtcttggtgggccttggacggagccggctagtaggggcgtgctctgggcctccccgaagctgtgcagacgaggagtcccgctgcgcggtacagccaggaagccagtccctagagtcctttgcgctgggggtcggagccttggagtcccaggatgttccgacggctaagaccagagcggacacaaaggagataacaatgaagagggcgccggcaaatggcgaagcatcgcctccggacaggccatctccgggcagggcccctctagggagcgggaacgtttcatatgcatgggacccaccagatccgctttccgctggaccggtggcgaaactgaggtccagagaggaagagactggagtctccaggccgcgccagggcccgcggaactgcgacggggcgggacagcgcgggtgtgggagtttgccggcccctttccccaccgcggattgcacctttggaagctgcacttttcttctctgtaaaatgggcatcaccattaccacccaggcaggaagttccgtggctgcggctcgacagaggagccag

SEQ ID NO: 77855 - DNA, 250 bp, Homo sapiens
  misc_feature 1..250: note = chr15:68260400-68260650
  misc_feature 1..250: note = hyper
  source 1..250: mol_type = genomic DNA
ccaaagctctgcatacgttgccctggcaaggtcagaccctttggctgcaacacgtccgtcaagaagccaggcaaatctagcatgcaaactaggatcattttcgggcgttggggcccccccgcttgaaatctggtttccatgttcacaaaacgcagcccgactggtggaactcgcgactccagacgcagagaagctgtgggcagaggcggaggcagagggtgggaatgcagcctggcgttggagtggggag

SEQ ID NO: 77856 - DNA, 241 bp, Homo sapiens
  misc_feature 1..241: note = chr15:68549380-68549621
  misc_feature 1..241: note = hyper
  source 1..241: mol_type = genomic DNA
ctgcctggtgccatgcggttgggccgcgggcccaagggaaagagagacacctggcctgacttctgcaggcctctccccgccagcgagcgcacggcagcggtgcccaggggctggaggcagcggaacgcacgcgcccggcgtcgctgagggcttgcgccagccccagagtacccgcgtgcccgagggagcgcgcccgcctctggctccgagcttgggggaggggcggcgtgagggagggagg

SEQ ID NO: 77857 - DNA, 65 bp, Homo sapiens; identical to SEQ ID NO: 35785
  misc_feature 1..65: note = chr15:68569420-68569485
  misc_feature 1..65: note = hyper
  source 1..65: mol_type = genomic DNA

SEQ ID NO: 77858 - DNA, 80 bp, Homo sapiens
  misc_feature 1..80: note = chr15:68569712-68569792
  misc_feature 1..80: note = hyper
  source 1..80: mol_type = genomic DNA
agccctcccacatttcgggaactcagaaacgccgcccttttcctgaaatggaccctccgagtacgcgcaaccccttccct

SEQ ID NO: 77859 - DNA, 30 bp, Homo sapiens
  misc_feature 1..30: note = chr15:68631675-68631705
  misc_feature 1..30: note = hypo
  source 1..30: mol_type = genomic DNA
gagaggaaatgcccccggggatgctcttca

SEQ ID NO: 77860 - DNA, 810 bp, Homo sapiens
  misc_feature 1..810: note = chr15:68723523-68724333
  misc_feature 1..810: note = hyper
  source 1..810: mol_type = genomic DNA
tcagggctggcttcccgctcccagccgcgcgcccctcgggccggaggttcctgccgcgccccgacacctggagtgcattaggcggcggcgcgcgtctaggcgacggcggctttccccagattattgaataattgcataattccgagcgcgggttgggaggcaatgccgggtccctaccccgggtgtcaggtaacgtttcgggggtcctgcgctgcgcgactgtgtcccgccgctgctggccgggcagacgagagctagcccccgcctaccggccatcgccccggggctttgctctgtctttggccggaggcactctgcgcagccctcacccccacccttcagccctccggggccgccgcgcccggctctccaaactttgagatgcttccccggagccaggcaggagggcagccagggcacactctcttggcgctgattcccttccccagccggggccgtgcgccctcggcgctcccgggacacccgagtgcccctggcagccgtgcgggaaccccggcatgggccttggaggcacctaaggcgcccaggagggccaccagatctgggagcttttcaactcaagcctcttcaactcttcccaaacacaccaaagagtcccggctttcaatagccttcgcacctccctctttagcgaaacttgactgaaccgctagactggggccagtccctgggggacccacgtccccaagagcagctgaggtctgaccctgggaggagggtcgcgtcccgatcctggccgctggatccaagccccgagggcccagggagggactccgagaggcaagggga

SEQ ID NO: 77861 - DNA, 49 bp, Homo sapiens
  misc_feature 1..49: note = chr15:68851848-68851897
  misc_feature 1..49: note = hyper
  source 1..49: mol_type = genomic DNA
gtggtgagggggtagcggggagggcgaagttgaccgtgccaagccggcc

SEQ ID NO: 77862 - DNA, 53 bp, Homo sapiens
  misc_feature 1..53: note = chr15:68870354-68870407
  misc_feature 1..53: note = hyper
  source 1..53: mol_type = genomic DNA
cccctccaccctctccgcggttctgtatctgcggaaaccggttctgctcaggt

SEQ ID NO: 77863 - DNA, 265 bp, Homo sapiens; identical to SEQ ID NO: 35787
  misc_feature 1..265: note = chr15:68870820-68871085
  misc_feature 1..265: note = hyper
  source 1..265: mol_type = genomic DNA

SEQ ID NO: 77864 - DNA, 134 bp, Homo sapiens
  misc_feature 1..134: note = chr15:68871386-68871520
  misc_feature 1..134: note = hyper
  source 1..134: mol_type = genomic DNA
cggggctgacatcagcgacgagcggcgggcgagcgccgacgagcggtccctgcgcgctgcccgcccggagcgcagcccccaggctcggccgagccgccggcggggcgcggggagcgagccgggagctgccggac

SEQ ID NO: 77865 - DNA, 87 bp, Homo sapiens
  misc_feature 1..87: note = chr15:68871739-68871826
  misc_feature 1..87: note = hyper
  source 1..87: mol_type = genomic DNA
cgcctctcttgctgccggatccgctcgagtcactccggcccccaaggactgcggaggccagggggaggatgccgctctggcagcccc

SEQ ID NO: 77866 - DNA, 30 bp, Homo sapiens
  misc_feature 1..30: note = chr15:69109310-69109340
  misc_feature 1..30: note = hyper
  source 1..30: mol_type = genomic DNA
ctggaaaacatcatgcgatgtattccaaag

SEQ ID NO: 77867 - DNA, 198 bp, Homo sapiens
  misc_feature 1..198: note = chr15:69136224-69136422
  misc_feature 1..198: note = hyper
  source 1..198: mol_type = genomic DNA
acatacacacacacacgtgtgtgtgtttcggggctgctcaggaggacaggcggctctgcgctgcggctgtggtgggctccgtgcacaccgcgctaggctcatagggcggctggcaggtccagagagcggcgtgggagcagctgctgccacggtggcagcggagatgaaggtgtcagcctgacgcgggcggctcctgag

SEQ ID NO: 77868 - DNA, 30 bp, Homo sapiens
  misc_feature 1..30: note = chr15:69265691-69265721
  misc_feature 1..30: note = hypo
  source 1..30: mol_type = genomic DNA
agtaccctggacctgcgacagaatccttgc

SEQ ID NO: 77869 - DNA, 17 bp, Homo sapiens
  misc_feature 1..17: note = chr15:69324757-69324774
  misc_feature 1..17: note = hypo
  source 1..17: mol_type = genomic DNA
tttttttttctgagacg

SEQ ID NO: 77870 - DNA, 192 bp, Homo sapiens
  misc_feature 1..192: note = chr15:69366538-69366730
  misc_feature 1..192: note = hyper
  source 1..192: mol_type = genomic DNA
tctcgctgcccggggcgctctgcgctgcgcgcccagtggggacagcacgccgccccgggagtctccaggcgcgggaggtcccagcagattttgcataaagggaggaatcgagtccagagaacaaacaagatactggaggtggtggcacggagaggattgattcggtttgcaaccctacgaggtcgtggccgc

SEQ ID NO: 77871 - DNA, 36 bp, Homo sapiens
  misc_feature 1..36: note = chr15:69367021-69367057
  misc_feature 1..36: note = hyper
  source 1..36: mol_type = genomic DNA
aaagagaaaggagggcgttttcgccaccctcttgct

SEQ ID NO: 77872 - DNA, 152 bp, Homo sapiens
  misc_feature 1..152: note = chr15:69591361-69591513
  misc_feature 1..152: note = hyper
  source 1..152: mol_type = genomic DNA
tgtccactggactcccgagacccttggaacccaggtaacccggggcgggactccccgccgcgcgccgcctccccacctcccggtccacgcgcacccgccctccgcggcagccccagccgccctgcgcccgtggagcccgttgagcctgggtg

SEQ ID NO: 77873 - DNA, 93 bp, Homo sapiens
  misc_feature 1..93: note = chr15:69754330-69754423
  misc_feature 1..93: note = hypo
  source 1..93: mol_type = genomic DNA
tttactttcacagcacgcaccttccaggctcctccgcacaggtacaggtttgaggcgggaaccagatgaggacgaaggcggagatgctgttgg

SEQ ID NO: 77874 - DNA, 30 bp, Homo sapiens; identical to SEQ ID NO: 15908
  misc_feature 1..30: note = chr15:70075720-70075750
  misc_feature 1..30: note = hypo
  source 1..30: mol_type = genomic DNA

SEQ ID NO: 77875 - DNA, 38 bp, Homo sapiens
  misc_feature 1..38: note = chr15:70347537-70347575
  misc_feature 1..38: note = hypo
  source 1..38: mol_type = genomic DNA
ctgccgggcgtgcctcgggatgccggggcctgccaggg

SEQ ID NO: 77876 - DNA, 120 bp, Homo sapiens
  misc_feature 1..120: note = chr15:70617030-70617150
  misc_feature 1..120: note = hypo
  source 1..120: mol_type = genomic DNA
gaagatcccactctccggctccagggatgagcatgtgcctcaggcctggtccatcggggccttgcatcccgcccgtggccttggtgattggttcagagatgggaacgagatcacatctgg

SEQ ID NO: 77877 - DNA, 30 bp, Homo sapiens
  misc_feature 1..30: note = chr15:70708037-70708067
  misc_feature 1..30: note = hypo
  source 1..30: mol_type = genomic DNA
tatgtcttgaagccccggtttctcccagca

SEQ ID NO: 77878 - DNA, 217 bp, Homo sapiens
  misc_feature 1..217: note = chr15:70877477-70877694
  misc_feature 1..217: note = hyper
  source 1..217: mol_type = genomic DNA
gcaaagacagagcagcgggacccgggcgaatccgcgcccgtccctgcccaggctgcccgggttccgccgctgggcgaccccagcatttcctttgaagtctgaagctctcttatccccgggcccctgcctcccggtaccgccgatgcgcagcgattgccaggcaggtctccgccgggctgggagagccgccgccgaccctgtgcgggcccctcccctt

SEQ ID NO: 77879 - DNA, 46 bp, Homo sapiens
  misc_feature 1..46: note = chr15:71054883-71054929
  misc_feature 1..46: note = hyper
  source 1..46: mol_type = genomic DNA
caactaaagaggccccgactactccttggcgcgcacactgaggccg

SEQ ID NO: 77880 - DNA, 43 bp, Homo sapiens; identical to SEQ ID NO: 35791
  misc_feature 1..43: note = chr15:71055227-71055270
  misc_feature 1..43: note = hyper
  source 1..43: mol_type = genomic DNA

SEQ ID NO: 77881 - DNA, 123 bp, Homo sapiens
  misc_feature 1..123: note = chr15:71055857-71055980
  misc_feature 1..123: note = hyper
  source 1..123: mol_type = genomic DNA
cctgcctgccacctgcgggccccgggcagcagacgtcgacaggcctgaggcggggctcccctcccgtagccaattgacccgctgccctggcgggggcgtggcaaaccgcgaccaatcggaatg

SEQ ID NO: 77882 - DNA, 18 bp, Homo sapiens
  misc_feature 1..18: note = chr15:71117912-71117930
  misc_feature 1..18: note = hypo
  source 1..18: mol_type = genomic DNA
tttttttttttgagacgg

SEQ ID NO: 77883 - DNA, 219 bp, Homo sapiens
  misc_feature 1..219: note = chr15:71145980-71146199
  misc_feature 1..219: note = hyper
  source 1..219: mol_type = genomic DNA
aggcccctcagatcccggccgccagccctgggagcctcggttgggcgacgaagctgcgggctggggcaccggctgcctccacgggccggttctgactcaggggctcggcccggagctgcttccccggcggcggggctgactcaaccccctctgcccgaggagttgtcgcgcgcagtcagcgccccgaactcgcgcgcggcccggcgccccctcggggcc

SEQ ID NO: 77884 - DNA, 328 bp, Homo sapiens
  misc_feature 1..328: note = chr15:71146426-71146754
  misc_feature 1..328: note = hyper
  source 1..328: mol_type = genomic DNA
tggctcgcgggactgcggcgccgccggggtcctcacgccgcaaggcccagccagccggtcggcagcgactgcgacgagggggcgggggcggtgcgagcgcgcctgccgctcggcccaggggagggacaggggtcgcggcgccccgccccgcgccgccgccgccgccgccgccgccgccaccaccccgaccgctagtggagcgcccgcgcaggcggggcctcggaggtggagggcggctttccggagctcctccgacggaggcccgtcccggaaggatccccgcgacccccgatcactccctccgtcttttcgccgctgtggggcccca

SEQ ID NO: 77885 - DNA, 30 bp, Homo sapiens
  misc_feature 1..30: note = chr15:71184469-71184499
  misc_feature 1..30: note = hyper
  source 1..30: mol_type = genomic DNA
tgcctccgtaccagtcggcgcggcaacccc

SEQ ID NO: 77886 - DNA, 30 bp, Homo sapiens
  misc_feature 1..30: note = chr15:71185265-71185295
  misc_feature 1..30: note = hyper
  source 1..30: mol_type = genomic DNA
ccgggctgcgaacaacgtaagttgggcctt

SEQ ID NO: 77887 - DNA, 442 bp, Homo sapiens
  misc_feature 1..442: note = chr15:71408156-71408598
  misc_feature 1..442: note = hyper
  source 1..442: mol_type = genomic DNA
cccagtgggtgtgtccggggcgccgcgggctgcgccgctccgggctcggggagccagcgcgcgcctggtccgtgcggacggctgcgcctccttctctggttctcttccttgctgggagtcttgctctgtgctggcgccggcgctcatccctccaccctcgactctagggacagtcttaaactctagggacaatccacctcagtcgtccccgggtcggggccccgtgctccccgggtcgggtcggaggggaccggcgagtgcacacccagcccgtgcgccccccacctcagcctcgcctccctcccgcctggggcccgagagccgggcaagtctcggtcagcgctccttgagtcctggcctggggcctcggatctgtgtgtctgtctgtctcagtttagttgctgcaacccagcgagcgcctggagcccgagtggatgggttg

SEQ ID NO: 77888 - DNA, 30 bp, Homo sapiens
  misc_feature 1..30: note = chr15:72040931-72040961
  misc_feature 1..30: note = hypo
  source 1..30: mol_type = genomic DNA
gggtgagtgtgatggcgggcagagcgccgg

SEQ ID NO: 77889 - DNA, 225 bp, Homo sapiens
  misc_feature 1..225: note = chr15:72102723-72102948
  misc_feature 1..225: note = hypo
  source 1..225: mol_type = genomic DNA
agggcaggagggccccgggggaccttgggcagcccgggaaccagcatggggtagcaggactgaccggctcccggggcaccttggtaatgctgcaggtgtggccagttgatcccctgtggagacagtaaagattaagaggatcataaactgcgtccagcggctgccccgggagaaatctcctcaagccagagcctgtgctgtgaggggcttcgggaccttggggca

SEQ ID NO: 77890 - DNA, 17 bp, Homo sapiens
  misc_feature 1..17: note = chr15:72411795-72411812
  misc_feature 1..17: note = hypo
  source 1..17: mol_type = genomic DNA
tggaggtcatttagccg

SEQ ID NO: 77891 - DNA, 197 bp, Homo sapiens; identical to SEQ ID NO: 44301
  misc_feature 1..197: note = chr15:72412112-72412309
  misc_feature 1..197: note = hypo
  source 1..197: mol_type = genomic DNA

SEQ ID NO: 77892 - DNA, 30 bp, Homo sapiens; identical to SEQ ID NO: 44302
  misc_feature 1..30: note = chr15:72462639-72462669
  misc_feature 1..30: note = hypo
  source 1..30: mol_type = genomic DNA

SEQ ID NO: 77893 - DNA, 249 bp, Homo sapiens
  misc_feature 1..249: note = chr15:72476661-72476910
  misc_feature 1..249: note = hyper
  source 1..249: mol_type = genomic DNA
tcagtggctccaaagcggcgcccgcggcggcactgatcccgcccggctggccccagctgaccctttgcaggaggctggtggtcacagccagagcttgcgcaggccggggagctgccaggagtgccgcagccgtgcccccacctgctgggctcccgggaaaaggagcgcgcgcccctctgagccccttcctggtgcagtgcgtgtaccaagcgtggtaactggcctggctgaggacgcccgcgtggggac

SEQ ID NO: 77894 - DNA, 147 bp, Homo sapiens
  misc_feature 1..147: note = chr15:72490031-72490178
  misc_feature 1..147: note = hyper
  source 1..147: mol_type = genomic DNA
cggaacccccgagaccggcccccgggccgcaaccccttacccgccctcctcggtggcctcgctccggcttaaagcggtcatcccggcgcctgcacccagcgccccgaccgcgcgccgggacccagcgcccgccggaccccgcccgcc

SEQ ID NO: 77895 - DNA, 766 bp, Homo sapiens
  misc_feature 1..766: note = chr15:72564641-72565407
  misc_feature 1..766: note = hyper
  source 1..766: mol_type = genomic DNA
gggcccgatctatgccgcccggccgccgggcctgagtgaagcctgtccagcctaggaggggccctcagaacctcccggtccaagcctctcacttcgtccacccctgcggagacggggcgagccccgcacccttcccgtggcccggccgcaccgccctgtgcccgtggtggcggccacacaggccagcctggcgagtactcacggcgaccccgggccgcgcgcggccgcagccgacgggacgagcggcccgggacgccccgcgggggcggagcggcaggccaaggggcgggggccgggcctggcgggcgaggtcgcgcaccccacgcctcgtcgttccgtcacgggcgcgctcagccactctgcgcacgctcgcgcggtgacacgatggcacgtggcccgctcctgaccaacagcctgacggcctgctcctgggcgcgcctcagcagccgacgccagccttgagacgcctgcgcggcggtcgctagtcgggaaagggtgcggagtggggggtggcgcctgcgccgtgggtaggggaggcagtggagaaggaagagggactctgggggagtgcggggagccttccaaaggagaatacttgcatttagcgccccgagtggttgggaggaacaagcaggaagggcaacccaggttgcctgtaggccgggagggagtcccctcgccggaggttggggccggcaggtagagactgagggaagtcctgaggccttgctgactgcaggattctctggttcgacaatggaagtcg

SEQ ID NO: 77896 - DNA, 399 bp, Homo sapiens
  misc_feature 1..399: note = chr15:72581446-72581845
  misc_feature 1..399: note = hypo
  source 1..399: mol_type = genomic DNA
tcggggggatttgggcggagcggggggcccacctggataaggggagagcccgttattgtagagcgtgtcggagcccggctggccattggtctggggggtcagagggccgaatccattgaccccgatgggcgccggaagacctgggagggtgccagggccgctgccaggcggggagttggctgctgatggcggaaaaggtctgagagtcaggccgccaccccgccccgcccggcccctcccaggcgcgccccagtccctgggggccgtacctgccgcgggcaacagaggcgcagctaccaggctaaaggccgccacgtgttgcatctgggccgccactgccgccaccgggcctaggcctgggccctgtgccgccgccagcagggccgcctggtgctgcag

SEQ ID NO: 77897 - DNA, 125 bp, Homo sapiens
  misc_feature 1..125: note = chr15:72743646-72743771
  misc_feature 1..125: note = hypo
  source 1..125: mol_type = genomic DNA
gatatctgctgagggcgactccaaggcagcggagctgaccgccacctcactggccactgtggggacttgcctgatggagccatgccagccagaagccactggggataccacgtgccagctcttat

SEQ ID NO: 77898 - DNA, 29 bp, Homo sapiens
  misc_feature 1..29: note = chr15:72768983-72769012
  misc_feature 1..29: note = hypo
  source 1..29: mol_type = genomic DNA
tcagccaccgtgcccggcctgtagaagat

SEQ ID NO: 77899 - DNA, 177 bp, Homo sapiens
  misc_feature 1..177: note = chr15:73611026-73611203
  misc_feature 1..177: note = hyper
  source 1..177: mol_type = genomic DNA
actagctgtccttcccgcatcagggaacagaggagacagtgactgaggaccccgcagcgaatgccccacccacacaggcttcctctcagcggggcctgtccccactgcttccccacagccccagaggccaggcctcagccattcagacgcgggggaggtgatcgcagcacagggccg

SEQ ID NO: 77900 - DNA, 92 bp, Homo sapiens
  misc_feature 1..92: note = chr15:73615572-73615664
  misc_feature 1..92: note = hypo
  source 1..92: mol_type = genomic DNA
agtcccaggcctccccgggccccgggtggcgcgggagatggctgggcagcctgcggggagcgggcgcctggctgcagcggggtgagcagggg

SEQ ID NO: 77901 - DNA, 121 bp, Homo sapiens
  misc_feature 1..121: note = chr15:73617637-73617758
  misc_feature 1..121: note = hypo
  source 1..121: mol_type = genomic DNA
cctcccgcaggggctcgcttagctcgcccaggatgctctcctcgtcgaacatcttgccctggtagcggtgctcgtagtagtcgtggatgcgctgccgggtgtcgggcgggagcttgtgaaa

SEQ ID NO: 77902 - DNA, 30 bp, Homo sapiens
  misc_feature 1..30: note = chr15:73639194-73639224
  misc_feature 1..30: note = hyper
  source 1..30: mol_type = genomic DNA
gcttgcacaggtctccgaaagccaggccct

SEQ ID NO: 77903 - DNA, 727 bp, Homo sapiens; identical to SEQ ID NO: 12210
  misc_feature 1..727: note = chr15:73659600-73660327
  misc_feature 1..727: note = hyper
  source 1..727: mol_type = genomic DNA

SEQ ID NO: 77904 - DNA, 278 bp, Homo sapiens; identical to SEQ ID NO: 35801
  misc_feature 1..278: note = chr15:73660446-73660724
  misc_feature 1..278: note = hyper
  source 1..278: mol_type = genomic DNA

SEQ ID NO: 77905 - DNA, 132 bp, Homo sapiens; identical to SEQ ID NO: 35802
  misc_feature 1..132: note = chr15:73660793-73660925
  misc_feature 1..132: note = hyper
  source 1..132: mol_type = genomic DNA

SEQ ID NO: 77906 - DNA, 292 bp, Homo sapiens
  misc_feature 1..292: note = chr15:73661569-73661861
  misc_feature 1..292: note = hyper
  source 1..292: mol_type = genomic DNA
accaagctctgggctcgcctttccctggcatttttgcccctcagctgggtctccgactttcctcttgggaggcgaccgggttcgtctggatgcagagtcccggccttcccgcaaccctcctggagagggggcttccggaaatgcgccgcgtcggggaggctcccacggttttcctgtgacatgggcagggtgcgaaccccgcgccagtctttcccctgcaaagcctcgcagcagccaggcaaggagggcgtggggaaacagggagacacgcacagggcgcgcgggtgggacc

SEQ ID NO: 77907 - DNA, 30 bp, Homo sapiens; identical to SEQ ID NO: 44306
  misc_feature 1..30: note = chr15:73919229-73919259
  misc_feature 1..30: note = hypo
  source 1..30: mol_type = genomic DNA

SEQ ID NO: 77908 - DNA, 337 bp, Homo sapiens
  misc_feature 1..337: note = chr15:74044686-74045023
  misc_feature 1..337: note = hyper
  source 1..337: mol_type = genomic DNA
ggggtcgggaatgagcgagggtccggcagatttggggctccgaggccacaggtgaccggggcgcggggaggccgaggagacgccgggcaggtcccagcgcgtgagccaaagtcggagggctgggagggcgccgggatcccctcagcccacgcccggcattccccgggctctgcaccgtccgggattcgctctgtccagtccagatcggccgggtccgtgttccgctggggtctgccctgccctaccccgcccggagtgagctggcaccgccgggcgcccgggacgcgctcagcccggacccagaacgtccgtgccccggcacccgcggcgtccggag

SEQ ID NO: 77909 - DNA, 169 bp, Homo sapiens
  misc_feature 1..169: note = chr15:74045074-74045243
  misc_feature 1..169: note = hyper
  source 1..169: mol_type = genomic DNA
cgctcccacggctcagttcacgttccgaaaggtccggaatccaccgggtccccgaggaggggcgatgtcagccgcggggacccggtccccgccgggcccagccgagagcgcgcgaagccgggggccccggccgggctgggttcggcggcccgggcgcaggcgggagcag

SEQ ID NO: 77910 - DNA, 243 bp, Homo sapiens
  misc_feature 1..243: note = chr15:74045655-74045898
  misc_feature 1..243: note = hyper
  source 1..243: mol_type = genomic DNA
tggctccgcttgcctcggcgctgtcagggaaggggccggcccgccgcgccgggagggagcttttaaagcgacacacacgcctcccaaccccgagggccaagcgtgcgagccaggggggtctcgccacccgggcgagggggaagggtctcgctggcggggctggaggcggactgaccggaccccacgccggctgacctggggcgcggagggacagcgttctggggacttcgttcctttcccacc

SEQ ID NO: 77911 - DNA, 137 bp, Homo sapiens
  misc_feature 1..137: note = chr15:74219483-74219620
  misc_feature 1..137: note = hyper
  source 1..137: mol_type = genomic DNA
ctttggccaggtgcccgacaactggcgcgaggtggccgtcggggacagcacgggcatggcccgggcccgcacctccgtctcccagcaacggcacgggggctccgcctcctcggtctcggcttcggccttcgccagca

SEQ ID NO: 77912 - DNA, 38 bp, Homo sapiens
  misc_feature 1..38: note = chr15:74264561-74264599
  misc_feature 1..38: note = hypo
  source 1..38: mol_type = genomic DNA
caggcgtgagccaccacgcccagcggacaatgctttct

SEQ ID NO: 77913 - DNA, 143 bp, Homo sapiens
  misc_feature 1..143: note = chr15:74392457-74392600
  misc_feature 1..143: note = hyper
  source 1..143: mol_type = genomic DNA
cagacaacctcaacccgtttccggagccactggcgccccctcattcccgctccagcagcccatgcccgcttcacccctggtgcctcatacatcgcgcgaggaagccagggcccgggaatttctttttccggtcccgccaggtc

SEQ ID NO: 77914 - DNA, 293 bp, Homo sapiens
  misc_feature 1..293: note = chr15:74420441-74420734
  misc_feature 1..293: note = hyper
  source 1..293: mol_type = genomic DNA
aactgtcattattaacgttataaacattagacccgcttctgcgcgccggacggcgccggacgaggtgcgcgcagtcttctagctgagctcggaggcagatccagaagtcgcggctcccaccccaggcctcggcggactctgcctggggcgactcgggctccagccctgcccgggcgggcactgggctctccagggtcgaaggcaggggtaaggggcgtctttcccccagggcagcctccgggaacaaaagcatttgctgtagagtgagctagagcctccgggcccgcgggagt

SEQ ID NO: 77915 - DNA, 940 bp, Homo sapiens
  misc_feature 1..940: note = chr15:74421979-74422919
  misc_feature 1..940: note = hyper
  source 1..940: mol_type = genomic DNA
cgtcgctgaaagaaatgtcggggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttgagaggctgtgaagatatggggggcagatatgggagaaatgctcgggcctgaagtccccagcccaccgtgctcaagagtagcggacgttttgccaccatccttgtctgtgctactgtctgctgcagcttccgtgccccgttctcctggagcaggcaagacctggagtgaggtgcttgggtgcgctcgagagagcttccccctgctccacctgtcccgcggtgcgcgcaggccaacgcgtcgggcagtgggcttcaagcgctggtttagccacaaaagaccagaagtaaagagttccggcttaagaggctgggcagggctgcggtgggctggggaggggggtgtcccttcccagcacgccctgcagggctgtgcgttctggtgtcgggttagactagcaggcggggcgggggggttggggcggcggggcgggggagactagggcttatatcagcccagatccaggcaaaaatggtagggagggtgcggcgctctgctaacactatcaattatgcatcatgttgaacgtggcttcggggaggaggcggctagcagcggggggtgcgggagggaagggtccgcgcgagctcggctgcgcgcagctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaat

SEQ ID NO: 77916 - DNA, 86 bp, Homo sapiens
  misc_feature 1..86: note = chr15:74428149-74428235
  misc_feature 1..86: note = hyper
  source 1..86: mol_type = genomic DNA
ccctttcaatccctactcccagaagccgggattcgtggcaacccctagtttttagttccaaagcctcctgccggcagggaaccaaa

SEQ ID NO: 77917 - DNA, 386 bp, Homo sapiens
  misc_feature 1..386: note = chr15:74428737-74429123
  misc_feature 1..386: note = hyper
  source 1..386: mol_type = genomic DNA
gagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtc

SEQ ID NO: 77918 - DNA, 307 bp, Homo sapiens
  misc_feature 1..307: note = chr15:74658090-74658397
  misc_feature 1..307: note = hyper
  source 1..307: mol_type = genomic DNA
gtgagctcgggtgaacgcagcgagcgagggcagaggccagcagaggcgaggagtggatgctgcagggccgcaggccgggcagagaaacgcataccgggtcgctccctgcttcgccgccgcctcctggcagggccagcgaagccagtgctccagcgcccccgtaacacctcaaagcgcacggagtccgtgttggggaacttggcggcagagtgactgggacctaggacctgcggtggggccgccgccgcctccgcggggccgagcgcctggacctcgccctgaggtaaacgcgggtcgacccgggggg

SEQ ID NO: 77919 - DNA, 52 bp, Homo sapiens; identical to SEQ ID NO: 4248
  misc_feature 1..52: note = chr15:74658501-74658553
  misc_feature 1..52: note = hyper
  source 1..52: mol_type = genomic DNA

SEQ ID NO: 77920 - DNA, 41 bp, Homo sapiens
  misc_feature 1..41: note = chr15:74658554-74658595
  misc_feature 1..41: note = hyper
  source 1..41: mol_type = genomic DNA
ccaaacttgaccacgctgcgaccttttcactctgtgctctg

SEQ ID NO: 77921 - DNA, 157 bp, Homo sapiens
  misc_feature 1..157: note = chr15:74679719-74679876
  misc_feature 1..157: note = hypo
  source 1..157: mol_type = genomic DNA
gagggctgggagcctcggggaagcggtggcttttcagctgagagagcgagaaacattggctgaagtggagttggtgccccactttccaggagggctgcccactgcccgcagggcccccggtcagggcgggagggctcggcaccgagaggtccaccga

SEQ ID NO: 77922 - DNA, 30 bp, Homo sapiens
  misc_feature 1..30: note = chr15:74686156-74686186
  misc_feature 1..30: note = hypo
  source 1..30: mol_type = genomic DNA
tactttagctttccacggttctaacagatt

SEQ ID NO: 77923 - DNA, 104 bp, Homo sapiens
  misc_feature 1..104: note = chr15:74790274-74790378
  misc_feature 1..104: note = hypo
  source 1..104: mol_type = genomic DNA
gcctacagaggagagcgagtacttatctttttagtactttttattctggtgagcctctcaccagcaaattctttctttttttttttgagtcagagtcttgctct

SEQ ID NO: 77924 - DNA, 17 bp, Homo sapiens
  misc_feature 1..17: note = chr15:74818772-74818789
  misc_feature 1..17: note = hypo
  source 1..17: mol_type = genomic DNA
taataactcctttgccg

SEQ ID NO: 77925 - DNA, 46 bp, Homo sapiens
  misc_feature 1..46: note = chr15:74903896-74903942
  misc_feature 1..46: note = hypo
  source 1..46: mol_type = genomic DNA
aggtccttctctgcccgcctccagtcccgctcgggggccctgttgg

SEQ ID NO: 77926 - DNA, 30 bp, Homo sapiens
  misc_feature 1..30: note = chr15:74911209-74911239
  misc_feature 1..30: note = hypo
  source 1..30: mol_type = genomic DNA
tgtggtagtgttcaccgtccccacccaggg

SEQ ID NO: 77927 - DNA, 188 bp, Homo sapiens
  misc_feature 1..188: note = chr15:74911445-74911633
  misc_feature 1..188: note = hypo
  source 1..188: mol_type = genomic DNA
ctcttcaggagcaaccgggaagccccagcagccccatggctggaggtggctggctgtgtgtttagcagggctctctgttcctcgtggcctagatgcatcactgtaagcgataccgctcccctgaaccagacccgtacctgagctaccgatggaagaggaggaggtcctacagtcgggaacatgaaggg

SEQ ID NO: 77928 - DNA, 30 bp, Homo sapiens
  misc_feature 1..30: note = chr15:74953756-74953786
  misc_feature 1..30: note = hypo
  source 1..30: mol_type = genomic DNA
ataaagttttattggcgcacagtcatggtc

SEQ ID NO: 77929 - DNA, 35 bp, Homo sapiens
  misc_feature 1..35: note = chr15:75018960-75018995
  misc_feature 1..35: note = hyper
  source 1..35: mol_type = genomic DNA
agggccagcctcgcgcgcggcgtggggttggggtg

SEQ ID NO: 77930 - DNA, 214 bp, Homo sapiens
  misc_feature 1..214: note = chr15:75118706-75118920
  misc_feature 1..214: note = hyper
  source 1..214: mol_type = genomic DNA
cctctcccgggagagcgaccccaccaccgcaggccctaatcctctgtcagcagtgcccagcggagctcggcgttgaaggaggcacgtgggggaggcgggagtggggagcgggcacgtggtccagccttctcagccccgtgctgccccccgcccccagtgaggaggggtttggggaggtgggggcgggcccgggcgggggcgggcggcgggcggt

SEQ ID NO: 77931 - DNA, 171 bp, Homo sapiens
  misc_feature 1..171: note = chr15:75119374-75119545
  misc_feature 1..171: note = hyper
  source 1..171: mol_type = genomic DNA
tgacacccaaaaccccgctccagcatcatgctccggccaagggggagtggggggaggggcgaccggacgagggaccgaccggagcctgggacgaggaagggggtgcacgtgcgtttctgacgaaacgataatcccttaatccgatctggtcccagccgcctatgtcttcca

SEQ ID NO: 77932 - DNA, 30 bp, Homo sapiens
  misc_feature 1..30: note = chr15:75134683-75134713
  misc_feature 1..30: note = hypo
  source 1..30: mol_type = genomic DNA
gaggaggttctccaccgatgccttgttcag

SEQ ID NO: 77933 - DNA, 101 bp, Homo sapiens; identical to SEQ ID NO: 44311
  misc_feature 1..101: note = chr15:75143124-75143225
  misc_feature 1..101: note = hypo
  source 1..101: mol_type = genomic DNA

SEQ ID NO: 77934 - DNA, 87 bp, Homo sapiens
  misc_feature 1..87: note = chr15:75205464-75205551
  misc_feature 1..87: note = hypo
  source 1..87: mol_type = genomic DNA
gccgtctcaaacaaaacaaacaaaaaaaagttacccagcctcaggtatccctttacagcaacacactaaacccgtttaagacaaagg

SEQ ID NO: 77935 - DNA, 21 bp, Homo sapiens
  misc_feature 1..21: note = chr15:75248822-75248843
  misc_feature 1..21: note = hyper
  source 1..21: mol_type = genomic DNA
gcccggcgccaggtctgcgaa

SEQ ID NO: 77936 - DNA, 30 bp, Homo sapiens; identical to SEQ ID NO: 35815
  misc_feature 1..30: note = chr15:75250808-75250838
  misc_feature 1..30: note = hyper
  source 1..30: mol_type = genomic DNA

SEQ ID NO: 77937 - DNA, 369 bp, Homo sapiens
  misc_feature 1..369: note = chr15:75251045-75251414
  misc_feature 1..369: note = hyper
  source 1..369: mol_type = genomic DNA
tcctgggagtggctgcggcgactggaccttggcaccgcaatgtgtgaatggctgaccccctccccgtctcctggtgggatcaggaaccctcggggtatgctccgaaccgggacttcggtctcggtccagtctccatgggccccacacagcggtgggggctggaggcacagcagccttgggaagaaacaaagactgtccgcagcgcgtagcggggcgtggagaaccgagggctgtgtaaggtcaggccctgagaaaaagcccccgaaaggctggaagttacgttggaacgggctggttgtggaaggagcgagctctccgtccccgggagtatgcaagtttgggctgcacgatcacttggaagggattggg

SEQ ID NO: 77938 - DNA, 333 bp, Homo sapiens; identical to SEQ ID NO: 35817
  misc_feature 1..333: note = chr15:75251478-75251811
  misc_feature 1..333: note = hyper
  source 1..333: mol_type = genomic DNA

SEQ ID NO: 77939 - DNA, 30 bp, Homo sapiens
  misc_feature 1..30: note = chr15:75288351-75288381
  misc_feature 1..30: note = hyper
  source 1..30: mol_type = genomic DNA
gcgttccctggaaaccggccttctggagat

SEQ ID NO: 77940 - DNA, 15 bp, Homo sapiens
  misc_feature 1..15: note = chr15:75470896-75470911
  misc_feature 1..15: note = hyper
  source 1..15: mol_type = genomic DNA
ctgtggggggtgggg

SEQ ID NO: 77941 - DNA, 15 bp, Homo sapiens
  misc_feature 1..15: note = chr15:75471217-75471232
  misc_feature 1..15: note = hyper
  source 1..15: mol_type = genomic DNA
cggtttccccatctg

SEQ ID NO: 77942 - DNA, 30 bp, Homo sapiens
  misc_feature 1..30: note = chr15:75516785-75516815
  misc_feature 1..30: note = hypo
  source 1..30: mol_type = genomic DNA
ctgctgtctgaggcccgccatgctgggcca

SEQ ID NO: 77943 - DNA, 50 bp, Homo sapiens
  misc_feature 1..50: note = chr15:75990686-75990736
  misc_feature 1..50: note = hypo
  source 1..50: mol_type = genomic DNA
ctgggggctgaatgccggctctgtgagagcatggacgggccaggtgtgct

SEQ ID NO: 77944 - DNA, 122 bp, Homo sapiens
  misc_feature 1..122: note = chr15:76005149-76005271
  misc_feature 1..122: note = hyper
  source 1..122: mol_type = genomic DNA
gggagctgagtggagcgagcgcggctctgctcctgggcgcgggccggctccgggtgtccgcgcacttaactccgggggcggggcaggcgcagacccgcgcgcccgctcgggtttcaggcttg

SEQ ID NO: 77945 - DNA, 38 bp, Homo sapiens
  misc_feature 1..38: note = chr15:76012901-76012939
  misc_feature 1..38: note = hypo
  source 1..38: mol_type = genomic DNA
cctaggaagtgatgccgtgcccttctcacgcagcctat

SEQ ID NO: 77946 - DNA, 56 bp, Homo sapiens
  misc_feature 1..56: note = chr15:76195506-76195562
  misc_feature 1..56: note = hypo
  source 1..56: mol_type = genomic DNA
gccattttactcattcgaaactttaaacctgaagattacaacgagttaactaagtt

SEQ ID NO: 77947 - DNA, 86 bp, Homo sapiens
  misc_feature 1..86: note = chr15:76197435-76197521
  misc_feature 1..86: note = hypo
  source 1..86: mol_type = genomic DNA
ttacaggcgtgagccaccgcgcccggcatgttgggccttttaagtatccacattttcactattaacaacaacgctgtgcagaacct

SEQ ID NO: 77948 - DNA, 100 bp, Homo sapiens
  misc_feature 1..100: note = chr15:76351669-76351769
  misc_feature 1..100: note = hyper
  source 1..100: mol_type = genomic DNA
gaggtgttttcccctcggtggcctccaagcgcagcgggcactgcgtgccatccgctccctcaccgggcgccccgcgcggatgaaacggagcaactgggaa

SEQ ID NO: 77949 - DNA, 30 bp, Homo sapiens
  misc_feature 1..30: note = chr15:76372926-76372956
  misc_feature 1..30: note = hypo
  source 1..30: mol_type = genomic DNA
attgagccctcctgccgtcctctcattagg

SEQ ID NO: 77950 - DNA, 30 bp, Homo sapiens; identical to SEQ ID NO: 15913
  misc_feature 1..30: note = chr15:76510088-76510118
  misc_feature 1..30: note = hypo
  source 1..30: mol_type = genomic DNA

SEQ ID NO: 77951 - DNA, 23 bp, Homo sapiens
  misc_feature 1..23: note = chr15:76627514-76627537
  misc_feature 1..23: note = hyper
  source 1..23: mol_type = genomic DNA
aggtggaggcggagctcaaaagc

SEQ ID NO: 77952 - DNA, 463 bp, Homo sapiens
  misc_feature 1..463: note = chr15:76627575-76628038
  misc_feature 1..463: note = hyper
  source 1..463: mol_type = genomic DNA
cgcggggccggtgaggaacgttcaccgtggaccatggtcgaataatgttagcgtgcactcggggcctcgccctagccttctgcaaagcctcggcctgcgccctcggctgcatccgtttcgacgccaaccaacctcatgctcttagtagaacggcagtagcgaccgcgccctcaggcccacaagcccgaaggtctgggcagggtctggaatggcggtggagacactttatccgcaggcgtttcacctcgcgccccacccaggcgcacaccaagttcttggtactccttttaatgggaaaacaagaacagacaccatggttggataaatgttatttataattcatgggccggtctttgaaccctttcaaacaaaacccacagcgatttctttgaaagaatgcctggactgtgctcagagctctcagattttctcaggaccaacgagccgccgcctcgcagatacc

SEQ ID NO: 77953 - DNA, 699 bp, Homo sapiens
  misc_feature 1..699: note = chr15:76628327-76629026
  misc_feature 1..699: note = hyper
  source 1..699: mol_type = genomic DNA
gaggggcagcagcagcggcagcagcagcaaggatggagtcaggacccgtcccagtcccgggtgagcgcttttggatctgggttctggctcaacccacgtaatgccccaatctaaagttttctacgtgtgtgtggataggaaagtctaaatagagtttatcagaacccaggtggtcattctctacactctctctagcttggacccgaagaacaaaggcacatgagaggagaaaggtgaccagctggacgatgacggtcacgtccaaacggatcccccttgtcctcggctctctcgtcctgagagtgggtttaatttttttttttttaatttatataagaagggagctcttaaaggagagccatctccaccctcaggtatccatcacccagctccagcgcgcctgggaaaaccgccccgaaagtccaagaggaagctcagagttgtaacggccgcggagccagctcggcggtgacgcaaggtccagtccagattgccaggcccggggcatgagagaggatccttgtaggtttcggaggtgggggggctgcactccattgttcactccgggccaatcagggttggcccacttcctcccagccaatctcccttcacccccagcctccaacccaacccaccccgcccatcagcccctggatccccatcacctcccccgcatccccggcagttctggggaagctt

SEQ ID NO: 77954 - DNA, 58 bp, Homo sapiens; identical to SEQ ID NO: 4253
  misc_feature 1..58: note = chr15:76629162-76629220
  misc_feature 1..58: note = hyper
  source 1..58: mol_type = genomic DNA

SEQ ID NO: 77955 - DNA, 430 bp, Homo sapiens
  misc_feature 1..430: note = chr15:76629665-76630095
  misc_feature 1..430: note = hyper
  source 1..430: mol_type = genomic DNA
gtctgagaggatgagcggggactgccgaaagacgatgtgtctgtgttgggataggaggcagccgctgtgagtgggagtgtgtgagcggaaatgccaggacagcaccgttaggtgttgatatccaggcgtccgcagtgcctgtgtatttactctcttcttagtttcgtgtttgcgtttagtttcaagacacgtcgacaaaacgactgtcattaatgaatgtaataacgaaatatttggggtgggggacagaagaaaccttcagcaatccacaagatactggtttttcgtttccaatgccctggacctttagagagctcatcatctttccttatggtcgcaagtcttgaaagaaagagcaagagagcgagcgggttgggttggggctggagtagccgaggccggcctgggtccgggcagtcaggcctgacgc

SEQ ID NO: 77956 - DNA, 29 bp, Homo sapiens
  misc_feature 1..29: note = chr15:76630096-76630125
  misc_feature 1..29: note = hyper
  source 1..29: mol_type = genomic DNA
gccccgcgcccttccccggcagagaagcc

SEQ ID NO: 77957 - DNA, 490 bp, Homo sapiens; identical to SEQ ID NO: 35828
  misc_feature 1..490: note = chr15:76630519-76631009
  misc_feature 1..490: note = hyper
  source 1..490: mol_type = genomic DNA

SEQ ID NO: 77958 - DNA, 15 bp, Homo sapiens
  misc_feature 1..15: note = chr15:76632131-76632146
  misc_feature 1..15: note = hyper
  source 1..15: mol_type = genomic DNA
gccctcgtaggcccc

SEQ ID NO: 77959 - DNA, 286 bp, Homo sapiens
  misc_feature 1..286: note = chr15:76632517-76632803
  misc_feature 1..286: note = hyper
  source 1..286: mol_type = genomic DNA
cgaaatcgggccccggggggctgggccacccggaggttgggctcggggcgggtgggtggcggcccctcgctaacctctggcctcaccctgtcctggcagacgctgggtcgggccggcagcccgcgttgcgcccgcacgtgcacaagcagacggagaagacgacccgcgtgcggactgtgctgaacgagaagcagctgcacactctgcggacctgctacgccgccaacccgcggcccgacgctctcatgaaggagcagctggtggagatgaccggcctgagcccgcg

SEQ ID NO: 77960 - DNA, 30 bp, Homo sapiens
  misc_feature 1..30: note = chr15:76633746-76633776
  misc_feature 1..30: note = hyper
  source 1..30: mol_type = genomic DNA
gggtacagccctaggcggtgggggaggggg

SEQ ID NO: 77961 - DNA, 48 bp, Homo sapiens
  misc_feature 1..48: note = chr15:76634240-76634288
  misc_feature 1..48: note = hyper
  source 1..48: mol_type = genomic DNA
aggccattccagttccgaaagctctctcgccttcgtaattattctatt

SEQ ID NO: 77962 - DNA, 159 bp, Homo sapiens; identical to SEQ ID NO: 35830
  misc_feature 1..159: note = chr15:76634951-76635110
  misc_feature 1..159: note = hyper
  source 1..159: mol_type = genomic DNA

SEQ ID NO: 77963 - DNA, 161 bp, Homo sapiens
  misc_feature 1..161: note = chr15:76635575-76635736
  misc_feature 1..161: note = hyper
  source 1..161: mol_type = genomic DNA
gaagtggagggggtcgggggtggcccgggtgggagggagctgggaatggcccctggatatgccgtgcccaggtcacttggtgtgacatttcaaacccctgcgacttgttttcttgaaaactggctttagtgatcgcaggaaataaccgagagatactgaat

SEQ ID NO: 77964 - DNA, 180 bp, Homo sapiens; identical to SEQ ID NO: 35831
  misc_feature 1..180: note = chr15:76638317-76638497
  misc_feature 1..180: note = hyper
  source 1..180: mol_type = genomic DNA

SEQ ID NO: 77965 - DNA, 271 bp, Homo sapiens
  misc_feature 1..271: note = chr15:76638855-76639126
  misc_feature 1..271: note = hyper
  source 1..271: mol_type = genomic DNA
gctgcggcccctcagcctctggagagccggggggcggccctcgccccggcagaaagcaacctgtggcggcactgcgtccccgcgagctacaaccagacgcggccgcgctcacctgggcgttgcgctcccccgagccccggagagtttagaagccgtaaaagcccggggagctggagcttaaatcgcccggaccgggccggggcgcccgaaagcagtgaactcgagacccccaggaaccgcgtgcgccgggaggcaccgggacgctcccggg

SEQ ID NO: 77966 - DNA, 30 bp, Homo sapiens
  misc_feature 1..30: note = chr15:77198053-77198083
  misc_feature 1..30: note = hyper
  source 1..30: mol_type = genomic DNA
cacttgacaggagcacgctgggctgcgctg

SEQ ID NO: 77967 - DNA, 26 bp, Homo sapiens
  misc_feature 1..26: note = chr15:77448975-77449001
  misc_feature 1..26: note = hypo
  source 1..26: mol_type = genomic DNA
atcttggctcccgaaataaaataatt

SEQ ID NO: 77968 - DNA, 78 bp, Homo sapiens
  misc_feature 1..78: note = chr15:77852833-77852911
  misc_feature 1..78: note = hypo
  source 1..78: mol_type = genomic DNA
agggaggcagatggtggtattaatcctcatatcgcggggggtgtacaacctcctgttatggttcgtaacatttagggt

SEQ ID NO: 77969 - DNA, 247 bp, Homo sapiens
  misc_feature 1..247: note = chr15:77906751-77906998
  misc_feature 1..247: note = hypo
  source 1..247: mol_type = genomic DNA
cgcgatgcacaggtacgtgccgttgtcctgtacctgggcgtagcgcacctccagcgtgccatcagggaagactgtgagccgcccattgctcttggctgagaccaggtgctttcggggtgagagccagaggatggcgggcggcgggtcgccatcggcccggcacacaaactgcaccgtgtggccctcgtccacaaacacctgctgggccttgcggtcccggatgcgggcgcggcggcaggtgaagtag

SEQ ID NO: 77970 - DNA, 39 bp, Homo sapiens
  misc_feature 1..39: note = chr15:77908085-77908124
  misc_feature 1..39: note = hypo
  source 1..39: mol_type = genomic DNA
cagcgcggtcctgggcggagcactcgcagcggggcgggc

SEQ ID NO: 77971 - DNA, 444 bp, Homo sapiens
  misc_feature 1..444: note = chr15:77924553-77924997
  misc_feature 1..444: note = hyper
  source 1..444: mol_type = genomic DNA
gcaaccccaggagggcgcagccagggccgatggcggcccccaggggcactcgccgcggggctgcccgctcggggctcggccgcggccgcctggctcacctgcatctcgggcgcgccttcggtccgctcggctcggtcaccaatcgcatgtctctccagccggcccgaccaggccccagcccctgcccagccccctcctccgtttcctcctcctccgacacctccgcccggcagtccgcgcgccctcgcggggctggctgtccgtctgtccgccccgcgcgggcgggagccgagccggagccggggccggggctcgggagtggggaggcgggaggccgcggccccggcgggcggatgggcgggcgcgctcaggccgcgggacaggggctgcgcgagcctgcttctgccccctgggccggcccggagccgccgccgccgcctctgc

SEQ ID NO: 77972 - DNA, 260 bp, Homo sapiens
  misc_feature 1..260: note = chr15:77925465-77925725
  misc_feature 1..260: note = hyper
  source 1..260: mol_type = genomic DNA
tgcgcaggcgaggggcgcaccagccaggcgctccagctctgcacacggccgcgcccctccgggtccggggctctgggcgagtcccgggccagccgggtgtcggggagtccggcgtgcggtcctccctgggtgtatgcgcgcacaccgttgtgtgtgatttttgtgttgccacatgcgtgtgcatgtgagcgcgcgagtgtgtttacacgtgttaactgggctgtggacgaacacacgcacgaggacggacagggctccct

SEQ ID NO: 77973 - DNA, 258 bp, Homo sapiens
  misc_feature 1..258: note = chr15:77927171-77927429
  misc_feature 1..258: note = hyper
  source 1..258: mol_type = genomic DNA
cccgacaggaatagacgctcgctggctcctgcgtaaaggctccgccaggcacccggcgggcgcgcagacccgctggggggcgggggcgggggcgagggctattcctggtgcggtgactgacgcaggcaaggcgcggccaccacatctctccgcccccgactcacctgctccctgcctcagtgatctcggcggagaaatgggggagagcccactcattccaccccgctaacccccaggtgctaccggaggaagctgggg

SEQ ID NO: 77974 - DNA, 442 bp, Homo sapiens
  misc_feature 1..442: note = chr15:78111427-78111869
  misc_feature 1..442: note = hyper
  source 1..442: mol_type = genomic DNA
agccccaagcgtgcacgccccccacggacgcgcacccagcaccccacccccgccgctgcccccgaggctcccgcccaatcagaggccgcgcgcgccgcgccgccggcgggcagacacaccggctccccggcctgcgcccctgcggccctggccccgctgcagcgtcccggcccggccacactcaccgtcccgggcgcgccgtccgcgcgcggctccgctccgggccggcatcccccggctcggctgcctccggtccccgctccggcctcggttcccgctccgcagggctcggctccgcgatggtggccgcggcggcgagcgcggcagggagggcgtgtgtatgcgcgtgagagcgcgcagcgtgtgcatgtgcgtgtgcgcgggagggtcccggctcccctgcgcgtcccgctcctgcctcctgctcgccacgatgcgatgc

SEQ ID NO: 77975 - DNA, 461 bp, Homo sapiens
  misc_feature 1..461: note = chr15:78111916-78112377
  misc_feature 1..461: note = hyper
  source 1..461: mol_type = genomic DNA
cgcacacacgcgcacacccaggcgcgcacacccggctccgcactcccgactcgccctcctggagcgctcacaaagaccccctgccgggacggccggagcctgcggagcgcggccctgggcccctccgggacccgccggccttaggtgccccgctgctccccgtagggaccccgcgggcggcccggctcccgcaccctgcctggccgggccgcggccgcgctcccagcccgaacctgggcccaggtgccgactcgggcttctcgcactcccgcgggaagcgccggccccctccgcggcgccgccgcccttctcccccccttccagtccggcctctccggcgcctccctgccttgtcccacctgcccagcccggtcctcgttctccccgctgctctccgtctgtctcgccgccgccctctcccgcgccccttcctccccaccgccctgcgctgcctctcacat

SEQ ID NO: 77976 - DNA, 408 bp, Homo sapiens
  misc_feature 1..408: note = chr15:78236748-78237156
  misc_feature 1..408: note = hyper
  source 1..408: mol_type = genomic DNA
tcgggagcggagtagcggtggacttttctcacgcccgcacacactgtttgcggagaggccagggcagacaacctccacccgtttccggagccactggcgccccctcattcccgctccagcagcccatgcctcgcttcacccctggtgcctcatcatcgcaccaggaagccagggcccgggaatttctttttccggtccgacagggtcaactgagtcgacgatcacttgacttggactaacggcctctgggagggcggggcctgctcgagtgaggccgggagcggaccgcagcccgctggaggtgccgggggcgaaatgctggcgtctcctcctccgtctcccagaatccttccctggaaaaaaacagcatccaccgtcagtttaactgaggaccgaattaaggcatta

SEQ ID NO: 77977 - DNA, 30 bp, Homo sapiens; identical to SEQ ID NO: 44317
  misc_feature 1..30: note = chr15:78252931-78252961
  misc_feature 1..30: note = hypo
  source 1..30: mol_type = genomic DNA

SEQ ID NO: 77978 - DNA, 48 bp, Homo sapiens
  misc_feature 1..48: note = chr15:78277490-78277538
  misc_feature 1..48: note = hypo
  source 1..48: mol_type = genomic DNA
gggggcctctcctgccgggccatgctctgcatccgcagcatggggctg

SEQ ID NO: 77979 - DNA, 79 bp, Homo sapiens
  misc_feature 1..79: note = chr15:78327585-78327664
  misc_feature 1..79: note = hyper
  source 1..79: mol_type = genomic DNA
aagaaaacctctttccggtggaggtctgcacagtttaaaatgtctaactaaaacagtaataactcgttcgacattcgtt

SEQ ID NO: 77980 - DNA, 30 bp, Homo sapiens
  misc_feature 1..30: note = chr15:78486343-78486373
  misc_feature 1..30: note = hypo
  source 1..30: mol_type = genomic DNA
gggcctgcttcaggccgagctccaggtcaa

SEQ ID NO: 77981 - DNA, 166 bp, Homo sapiens
  misc_feature 1..166: note = chr15:78501776-78501942
  misc_feature 1..166: note = hypo
  source 1..166: mol_type = genomic DNA
ctgaagagatggcaacgtgtgcttccggggcgaggcctcctgtgccgggcagacagaggcgtgtgaatgctgcagaactcgtcctactgactttggatccttggttacagctctctgggatagccaggtagaagctgcctccactttgggccgcaatgttaccaaa

SEQ ID NO: 77982 - DNA, 30 bp, Homo sapiens; identical to SEQ ID NO: 44320
  misc_feature 1..30: note = chr15:78503615-78503645
  misc_feature 1..30: note = hypo
  source 1..30: mol_type = genomic DNA

SEQ ID NO: 77983 - DNA, 56 bp, Homo sapiens
  misc_feature 1..56: note = chr15:78506312-78506368
  misc_feature 1..56: note = hypo
  source 1..56: mol_type = genomic DNA
gaacaggggtctccacggcctgctctgaagccaggatgctacgtacacaaggttta

SEQ ID NO: 77984 - DNA, 43 bp, Homo sapiens
  misc_feature 1..43: note = chr15:78556892-78556935
  misc_feature 1..43: note = hyper
  source 1..43: mol_type = genomic DNA
ccggtggctctagtgcggtggagccaggcgtggaagtcggtcc

SEQ ID NO: 77985 - DNA, 168 bp, Homo sapiens
  misc_feature 1..168: note = chr15:78557205-78557373
  misc_feature 1..168: note = hyper
  source 1..168: mol_type = genomic DNA
acccggacaagaacccggatgagggcgagaaggtgcggggcggcgcggggcacgggccgggctcccgaggggccaagggttattaagccaggagcattgaaggcgacgggaaacctgagccgcgtttgttggggaggctgtcgccaggcgcctcggggccaggccggg

SEQ ID NO: 77986 - DNA, 23 bp, Homo sapiens
  misc_feature 1..23: note = chr15:78571000-78571023
  misc_feature 1..23: note = hypo
  source 1..23: mol_type = genomic DNA
cttttttttttgagacggagtct

SEQ ID NO: 77987 - DNA, 214 bp, Homo sapiens
  misc_feature 1..214: note = chr15:78596058-78596272
  misc_feature 1..214: note = hypo
  source 1..214: mol_type = genomic DNA
ccaccgcgcccggccactgtttacactattgttgcagtagctgctgccatcaccgggctgcggcagggaggcacagctggggctgcatgctggtggatgcctcccccttctgagttggggagagctccccaggtgctgctgcagccgcccaaacagcagttgcagatccaggcctcctgctttacggagcaggcagggtcgccaccctcctggg

SEQ ID NO: 77988 - DNA, 167 bp, Homo sapiens
  misc_feature 1..167: note = chr15:78609740-78609907
  misc_feature 1..167: note = hypo
  source 1..167: mol_type = genomic DNA
tctggacactcacagcgtgctgctccgagcactgccatgccaggtgacttcactctcctgattttgaagatccctgtttccatgcctctccttcggtgaatcatatgttctgggcctgacctggatccccagtcctgacacccagcccagcacgggagctcagtgaa

SEQ ID NO: 77989 - DNA, 30 bp, Homo sapiens
  misc_feature 1..30: note = chr15:78617409-78617439
  misc_feature 1..30: note = hypo
  source 1..30: mol_type = genomic DNA
acacccaggggtctgcgcacacaatgttat

SEQ ID NO: 77990 - DNA, 163 bp, Homo sapiens
  misc_feature 1..163: note = chr15:78632506-78632669
  misc_feature 1..163: note = hyper
  source 1..163: mol_type = genomic DNA
tccccagttggagagcgggtgcccgcacctctggaggctgaggcacaactgggctgggagttgagcgcataccgagtaggggctgcgggggagcgggggcagggccggcggggcggggccagaagcccggcggggttgggggcgctctcctagtgactcaagg

SEQ ID NO: 77991 - DNA, 711 bp, Homo sapiens
  misc_feature 1..711: note = chr15:78632683-78633394
  misc_feature 1..711: note = hyper
  source 1..711: mol_type = genomic DNA
cgcaaagcgccagtctccgccttgcgagctcagagtgtgcccgctgcgccgccgctgtccgtacctgccgccgccgccaccgccaccatgcccaacttcgccggcacctggaagatgcgcagcagcgagaatttcgacgagctgctcaaggcactgggtaagctggtgcagagggcgcgccccgacggggagatgcggcccggaggtgccctggtcccggaagtgccccggtcctggagggggtggaagttggggagcccaggcaggagggagtccccggggcaatagatcgccttgtctcccaggcgcaccgggtctcggagaagctggtagagatcccggaacccacgcgttcagcgaacgtttgctgaatgtttggcgccctcctcgatggtgcggactttatctcgtgctagatcatagcgaggagagattactggagagcaaggaggatcagggacttaaatttggagactcaaatttgggaccaggctctgccacgaattcactgtgcaactcgaggaaagtcacttaccctctctgtgcctcagtctctcatctcgaaaacaagggcgagggcagggaaacgagtggatcaattttaaggcccctttctaaagttagggtatgaccagtgcccgaccggtcccgagactggcggcgaggccccgtgacccaagcctgtggtgcaccctgcgcaggtgtgaacgc

SEQ ID NO: 77992 - DNA, 141 bp, Homo sapiens; identical to SEQ ID NO: 35841
  misc_feature 1..141: note = chr15:78912231-78912372
  misc_feature 1..141: note = hyper
  source 1..141: mol_type = genomic DNA

SEQ ID NO: 77993 - DNA, 587 bp, Homo sapiens
  misc_feature 1..587: note = chr15:78912441-78913028
  misc_feature 1..587: note = hyper
  source 1..587: mol_type = genomic DNA
cggcttcccccagcaggctcctctggagagcgggaggaagacaggaggcgctctcccggtggagggtccctcagcgacgcagccaggagcgctaggaggctacaaccggaggagaggctggcgctccagctccagccccagtcccgaagcgactcccctcttcccgaggtggccttggccaagtcttcagccatctccgtcaaatgaggaggtgggcgggatgcagacggtggagcgggaggcttgggcgcgccagtttgggagccagtgcgcggggcagggcgacgggcagcgcggggacgcgaatccccaactcctgcgcccaagacgaaggacccggtctcgacctccccatcacccggcgcgtaccagcgcccgctcagtgactcccaggtttggtggtggctaggggtgggaggtgagccgaaagggaaaaagccaccccacccaagtcgccgccgggctggagccagtctgcgcgggttccgagtccccggcgacggcgccagccctctccgctcgcccgcgcggtgttctcgccggcagcccctccggaccccgcgccccttctcgggcgcccgtccctc

SEQ ID NO: 77994 - DNA, 376 bp, Homo sapiens
  misc_feature 1..376: note = chr15:78913094-78913470
  misc_feature 1..376: note = hyper
  source 1..376: mol_type = genomic DNA
cggcgacagcgccaggggcagcgagagcgggccagagcccatggctggtggccgggctggccgcggacccggacggtcgggagcgggcgcggcggtcgcagagacggcctctccccgcgcggctccagcgcagaccccagacctggagccgtgcgggcggagacgcgcggggctcctctccgcttcgccgccgctgggtttccagcgccctcggacccgcgggaggacaggaaccatccggagtgaagctgcgccaggcgcgggcgggcgggcgggcgtgcgcggggcggggcgtacgtgcggtaggggaaggggctccaggtcccagtccccagcgccgggcgagctccttctccgccgggctgggtgctccggc

SEQ ID NO: 77995 - DNA, 212 bp, Homo sapiens
  misc_feature 1..212: note = chr15:78913480-78913692
  misc_feature 1..212: note = hyper
  source 1..212: mol_type = genomic DNA
cgaccagatctgagcaggtgctgtcaccaccaccaggaaggagagggactcagtttctgtcccaggtttccggggcgtgtgcagctcccgcagggggttgggaccaccgggctaggcgggcgccgtaggagagacgctaacacaccctgggaaggacgccttgtgtatctcatgctattaaataattgttaaatattttagccgggagcagt

SEQ ID NO: 77996 - DNA, 312 bp, Homo sapiens
  misc_feature 1..312: note = chr15:78933373-78933685
  misc_feature 1..312: note = hyper
  source 1..312: mol_type = genomic DNA
tcagcccaacccaggcgcccctccctccttccccgaaaagaactcaccgcgcccgcaaagggcgaccaggaagaaaaggaccagggaaggcgcgcgcctcatggccggcggggccgggtggcagccgccgcgagctccgctgtggggtcacagggcacccgtgagccgcgcggtcgagtgagcgccggtcctggcccccgaggtttgctggcggggcggcgctcactaggaccccgcggagagccccgccgagccccgcccactcagggatgtactgggcccgctgctccgccccgacgccccctgggtggt

SEQ ID NO: 77997 - DNA, 68 bp, Homo sapiens; identical to SEQ ID NO: 44323
  misc_feature 1..68: note = chr15:79055979-79056047
  misc_feature 1..68: note = hypo
  source 1..68: mol_type = genomic DNA

SEQ ID NO: 77998 - DNA, 71 bp, Homo sapiens
  misc_feature 1..71: note = chr15:79057076-79057147
  misc_feature 1..71: note = hypo
  source 1..71: mol_type = genomic DNA
ggcagatcccatccccgccaggcctccacagccaggaaactacccacctaggctagcgagacctcagcaag

SEQ ID NO: 77999 - DNA, 92 bp, Homo sapiens
  misc_feature 1..92: note = chr15:79059735-79059827
  misc_feature 1..92: note = hypo
  source 1..92: mol_type = genomic DNA
cacagcccaggtggccggacagggtacatggcggttgcaaggggtttcagtagggggccggggaaggtgttcacaggcgggtggctccaggg

SEQ ID NO: 78000 - DNA, 102 bp, Homo sapiens
  misc_feature 1..102: note = chr15:79064055-79064157
  misc_feature 1..102: note = hypo
  source 1..102: mol_type = genomic DNA
gaggaagtacttctccgggtcctcgctccgcagtgccaggaagttggcagcctcggcaacctcttggatgcggatctcgcgtgcgcccgctgggatcagccc

SEQ ID NO: 78001 - DNA, 41 bp, Homo sapiens
  misc_feature 1..41: note = chr15:79103265-79103306
  misc_feature 1..41: note = hyper
  source 1..41: mol_type = genomic DNA
ccagaagcgcggcttcgctcccggcccggcccgaccccgac

SEQ ID NO: 78002 - DNA, 30 bp, Homo sapiens
  misc_feature 1..30: note = chr15:79104054-79104084
  misc_feature 1..30: note = hyper
  source 1..30: mol_type = genomic DNA
ccggttgaggacccccggaaagaatctgga

SEQ ID NO: 78003 - DNA, 27 bp, Homo sapiens
  misc_feature 1..27: note = chr15:79163864-79163891
  misc_feature 1..27: note = hypo
  source 1..27: mol_type = genomic DNA
agagggaaactccgtctcagaaagaaa

SEQ ID NO: 78004 - DNA, 900 bp, Homo sapiens; identical to SEQ ID NO: 1224
  misc_feature 1..900: note = chr15:79382098-79382998
  misc_feature 1..900: note = hyper
  source 1..900: mol_type = genomic DNA

SEQ ID NO: 78005 - DNA, 269 bp, Homo sapiens; identical to SEQ ID NO: 35848
  misc_feature 1..269: note = chr15:79382999-79383268
  misc_feature 1..269: note = hyper
  source 1..269: mol_type = genomic DNA

SEQ ID NO: 78006 - DNA, 56 bp, Homo sapiens; identical to SEQ ID NO: 35849
  misc_feature 1..56: note = chr15:79383328-79383384
  misc_feature 1..56: note = hyper
  source 1..56: mol_type = genomic DNA

SEQ ID NO: 78007 - DNA, 708 bp, Homo sapiens; identical to SEQ ID NO: 35850
  misc_feature 1..708: note = chr15:79383438-79384146
  misc_feature 1..708: note = hyper
  source 1..708: mol_type = genomic DNA

SEQ ID NO: 78008 - DNA, 243 bp, Homo sapiens
  misc_feature 1..243: note = chr15:79502049-79502292
  misc_feature 1..243: note = hyper
  source 1..243: mol_type = genomic DNA
ggggcggggagggctcgccgggaaatcaaacgtccatttacatcttgtcctgcaaagcttcatcaaaacttctttgccggccagtcacgtccccttatcacttttccagcccagctttgtgactgtaagtgttggacggagaactgataagggtaggtgattgacactcacagcctccggaacccccgcgccgcctgcacttgcgtgatggggaaaacctggcgttcccgctctgggtgcccg

SEQ ID NO: 78009 - DNA, 720 bp, Homo sapiens; identical to SEQ ID NO: 35852
  misc_feature 1..720: note = chr15:79574779-79575499
  misc_feature 1..720: note = hyper
  source 1..720: mol_type = genomic DNA

SEQ ID NO: 78010 - DNA, 481 bp, Homo sapiens
  misc_feature 1..481: note = chr15:79575852-79576333
  misc_feature 1..481: note = hyper
  source 1..481: mol_type = genomic DNA
aaggggaagaaaggtcgtcagtttttgcagaaacctgtgaggaactggcggtgagaggttatgatcctgaaaatgtgcacgaaattgtaaaaagtaggcacctaagcatttctgagaaatgatgggagaagcacttaccgccctggtttcacctgacccccatgctcggccttctggaagatgcccacagacactggcaataatggacgctggcacactctgccggcgcggccggagccccggagttcagcacctcggacagagcccgagccccgccgcccgaggcgcacagtgagcgtggaacagcccggctccctagcccccggccaacgctgctctcagttcagggcagctacgtaacaccgcccctagctccgcgccagaaagggctctcgaatcgcaaaagcaaacgtgttcgatttctgatctgcttctaactgcttcccgtgactgcagaaggaagaggcggagtgtaaagata

SEQ ID NO: 78011 - DNA, 30 bp, Homo sapiens
  misc_feature 1..30: note = chr15:79672460-79672490
  misc_feature 1..30: note = hypo
  source 1..30: mol_type = genomic DNA
ggaggggccggatcacgaggtcaggagttc

SEQ ID NO: 78012 - DNA, 69 bp, Homo sapiens
  misc_feature 1..69: note = chr15:79724051-79724120
  misc_feature 1..69: note = hyper
  source 1..69: mol_type = genomic DNA
cttgccactgggggccgcagtcaccttcagcataggggagtggggagacgcgaaccccgcgggtggctc

SEQ ID NO: 78013 - DNA, 210 bp, Homo sapiens; identical to SEQ ID NO: 4263
  misc_feature 1..210: note = chr15:79724351-79724561
  misc_feature 1..210: note = hyper
  source 1..210: mol_type = genomic DNA

SEQ ID NO: 78014 - DNA, 187 bp, Homo sapiens; identical to SEQ ID NO: 4264
  misc_feature 1..187: note = chr15:79724606-79724793
  misc_feature 1..187: note = hyper
  source 1..187: mol_type = genomic DNA

SEQ ID NO: 78015 - DNA, 634 bp, Homo sapiens; identical to SEQ ID NO: 35857
  misc_feature 1..634: note = chr15:79724863-79725497
  misc_feature 1..634: note = hyper
  source 1..634: mol_type = genomic DNA

SEQ ID NO: 78016 - DNA, 24 bp, Homo sapiens
  misc_feature 1..24: note = chr15:80217740-80217764
  misc_feature 1..24: note = hypo
  source 1..24: mol_type = genomic DNA
gagccaccgcgcctggccagtgat

SEQ ID NO: 78017 - DNA, 30 bp, Homo sapiens
  misc_feature 1..30: note = chr15:80279955-80279985
  misc_feature 1..30: note = hypo
  source 1..30: mol_type = genomic DNA
tggaacaagaatccacgctctaatatgcct

SEQ ID NO: 78018 - DNA, 30 bp, Homo sapiens
  misc_feature 1..30: note = chr15:80473548-80473578
  misc_feature 1..30: note = hypo
  source 1..30: mol_type = genomic DNA
gcactgttctagctgcggggcgctcctacc

SEQ ID NO: 78019 - DNA, 30 bp, Homo sapiens
  misc_feature 1..30: note = chr15:80513587-80513617
  misc_feature 1..30: note = hypo
  source 1..30: mol_type = genomic DNA
gaaaatcataatgcccgccaagaacagttt

SEQ ID NO: 78020 - DNA, 30 bp, Homo sapiens; identical to SEQ ID NO: 35858
  misc_feature 1..30: note = chr15:80543967-80543997
  misc_feature 1..30: note = hyper
  source 1..30: mol_type = genomic DNA

SEQ ID NO: 78021 - DNA, 133 bp, Homo sapiens; identical to SEQ ID NO: 35859
  misc_feature 1..133: note = chr15:80544203-80544336
  misc_feature 1..133: note = hyper
  source 1..133: mol_type = genomic DNA

SEQ ID NO: 78022 - DNA, 302 bp, Homo sapiens; identical to SEQ ID NO: 35860
  misc_feature 1..302: note = chr15:80544364-80544666
  misc_feature 1..302: note = hyper
  source 1..302: mol_type = genomic DNA

SEQ ID NO: 78023 - DNA, 149 bp, Homo sapiens
  misc_feature 1..149: note = chr15:80624470-80624619
  misc_feature 1..149: note = hypo
  source 1..149: mol_type = genomic DNA
gccctccagtaccaccgccccgtcccctccccaaccagttcccgcggggaccaacaggacagaagaagctggcagctgcggggggcaaggctggggactcagattccaggtgtttcaggttgtagctgcccagccggcaaggtaggcgc

SEQ ID NO: 78024 - DNA, 225 bp, Homo sapiens
  misc_feature 1..225: note = chr15:80696318-80696543
  misc_feature 1..225: note = hyper
  source 1..225: mol_type = genomic DNA
ggcttctccctcacccgctccgccctggcctcctggcctgggcacggcgcccctgggtaaagcgcgcccggacacctggggcgtgggcgtgcgggggcagcccgggctaggcgagcgcgggagaggcgcctgcggtcccagcccggccaggcccgagcacctgcgcgagcccgagggagcgcccggccctctgcccccgccagtcgccggcgcccaacttggggg

SEQ ID NO: 78025 - DNA, 30 bp, Homo sapiens
  misc_feature 1..30: note = chr15:80697219-80697249
  misc_feature 1..30: note = hyper
  source 1..30: mol_type = genomic DNA
tttctcttccggtcccggcttttgtggcat

SEQ ID NO: 78026 - DNA, 69 bp, Homo sapiens
  misc_feature 1..69: note = chr15:81072720-81072789
  misc_feature 1..69: note = hyper
  source 1..69: mol_type = genomic DNA
tcgccgctctgggaacgaaggccagtgacattctggaatggaccccaagggatgcgtgtgctcatgaga

SEQ ID NO: 78027 - DNA, 115 bp, Homo sapiens
  misc_feature 1..115: note = chr15:81073160-81073275
  misc_feature 1..115: note = hyper
  source 1..115: mol_type = genomic DNA
gtggccctgggtctccggggaagtcgtgcgctttcttcccagacccaaggcgttggggcgctgggaaagaggaaagggactgagagtccgctggggccctcggtattaccactca

SEQ ID NO: 78028 - DNA, 30 bp, Homo sapiens
  misc_feature 1..30: note = chr15:81198888-81198918
  misc_feature 1..30: note = hypo
  source 1..30: mol_type = genomic DNA
gcacaccaggcatggcgatgagtaagcagc

SEQ ID NO: 78029 - DNA, 21 bp, Homo sapiens
  misc_feature 1..21: note = chr15:81282983-81283004
  misc_feature 1..21: note = hypo
  source 1..21: mol_type = genomic DNA
aaaaaaaccaaaggccgcacg

SEQ ID NO: 78030 - DNA, 21 bp, Homo sapiens
  misc_feature 1..21: note = chr15:81283124-81283145
  misc_feature 1..21: note = hypo
  source 1..21: mol_type = genomic DNA
aaaaaacgcttcattctttat

SEQ ID NO: 78031 - DNA, 30 bp, Homo sapiens
  misc_feature 1..30: note = chr15:81771801-81771831
  misc_feature 1..30: note = hypo
  source 1..30: mol_type = genomic DNA
agctgacatctgccccggcagtgtctggta

SEQ ID NO: 78032 - DNA, 169 bp, Homo sapiens
  misc_feature 1..169: note = chr15:82042432-82042601
  misc_feature 1..169: note = hypo
  source 1..169: mol_type = genomic DNA
gaggtccgaaagagccggccgaggtagagtggagaagaaggctgccttggctgggtgcaggcggcatcttctgcaccaggtggaggacaggcagctttgcacaactgaacatccctgagccagccggcctctgagcatcttgcgctggcagtgccgggcaaagctcccg

SEQ ID NO: 78033 - DNA, 19 bp, Homo sapiens
  misc_feature 1..19: note = chr15:82097045-82097064
  misc_feature 1..19: note = hypo
  source 1..19: mol_type = genomic DNA
ttttttttttttagacgga

SEQ ID NO: 78034 - DNA, 19 bp, Homo sapiens
  misc_feature 1..19: note = chr15:82097326-82097345
  misc_feature 1..19: note = hypo
  source 1..19: mol_type = genomic DNA
cgcccggcctggcttttat

SEQ ID NO: 78035 - DNA, 60 bp, Homo sapiens
  misc_feature 1..60: note = chr15:82156125-82156185
  misc_feature 1..60: note = hypo
  source 1..60: mol_type = genomic DNA
gggagagagagggggcgggagagagagggggcgggggagagagagcgagctctcatgttt

SEQ ID NO: 78036 - DNA, 219 bp, Homo sapiens
  misc_feature 1..219: note = chr15:82205602-82205821
  misc_feature 1..219: note = hypo
  source 1..219: mol_type = genomic DNA
ttatgcgaagccacacggaagaaattaagcagaactcaaagctgtctgactccagcgttcatgcttggaacactaactaccctctactagttcattagaggcaactgggtaaaagtggaactaggtgtgcccgtgataaagcctgtgattaagtagttaaaatgaggatggattccggtaagccaaacgtacacataaggtttacggcactacagcctc

SEQ ID NO: 78037 - DNA, 23 bp, Homo sapiens
  misc_feature 1..23: note = chr15:82231172-82231195
  misc_feature 1..23: note = hypo
  source 1..23: mol_type = genomic DNA
tcttcataaccttggcgtaggcc

SEQ ID NO: 78038 - DNA, 82 bp, Homo sapiens
  misc_feature 1..82: note = chr15:82231255-82231337
  misc_feature 1..82: note = hypo
  source 1..82: mol_type = genomic DNA
caaattgagcttcattaaatgaagactgtctatttatcaagacaccattaagagagtgaaaggcaagcgactgagtgggaga

SEQ ID NO: 78039 - DNA, 713 bp, Homo sapiens
  misc_feature 1..713: note = chr15:82336570-82337283
  misc_feature 1..713: note = hyper
  source 1..713: mol_type = genomic DNA
cgttctctggcatgccggtcacctcgaacaccggctccttatcccggctgggcgtcacgatgtacgtgtgcgtctgctgctggatgcgcttgattgtggcgcctttgggccccaccacgagccccaccacgcggtagggtacccgcacttggatggtggtctgcccgggcaggttgggcggcccaggcaccgcgccgttgagtgccgtgttcttattccgggaggcgcggatcatggagaagtgctcggcagcagagatgatctccctccgagccatggccacatcctccttcctgcccgtcacaacaaagacaggctcctccccgcgaactggggtcttgatgtaagtattggtcttcgcccgcagcgctttgattttacaacctacgaaccagggtgcggaggagggagtgggagagagagacagacacgcccattatcctggggtaaccgcggggaccggggacagcccgcgtccaggacagcgagacggcaggacaagagatgggcggaaagggggcgtctccctcactgacctcgggccgcgccacgggctgggcagcggatcccacccgcgaggcgctcgaggaacagcccattggctgcctggccctcccccagtgactgcagtcgtcccgaaccaaacccgagaatcccagaaaagtcatctggggagatgccgctgggatccagctgggcgcgccgtcagctct

SEQ ID NO: 78040 - DNA, 329 bp, Homo sapiens
  misc_feature 1..329: note = chr15:82339878-82340207
  misc_feature 1..329: note = hyper
  source 1..329: mol_type = genomic DNA
atcctcacagagggacgtcttcccaaaacaatgaggccatgcggccgcagccgcacacgggctgactggggagatctcgtggtgccgcggggcggtcccggggctcgaaggcagaggctcccctaggtgtgccctgcctgaccccggctacaggaacgagcgctgtgggcctcggtttctcacccgtaaaatgaagaaaataatccccgcctttaccacctcgtgggtcgttcggaagattaaatgcgacagtggatgggcgcgcgcttacaaatcagtagacagttccgcaagcgcctttacttttgagaacgcggtggtgcagctcc

SEQ ID NO: 78041 - DNA, 30 bp, Homo sapiens
  misc_feature 1..30: note = chr15:82396478-82396508
  misc_feature 1..30: note = hypo
  source 1..30: mol_type = genomic DNA
tacaataatgcagaccgaaccctgcaactg

SEQ ID NO: 78042 - DNA, 438 bp, Homo sapiens; identical to SEQ ID NO: 35864
  misc_feature 1..438: note = chr15:83314955-83315393
  misc_feature 1..438: note = hyper
  source 1..438: mol_type = genomic DNA

SEQ ID NO: 78043 - skipped

SEQ ID NO: 78044 - DNA, 409 bp, Homo sapiens; identical to SEQ ID NO: 4268
  misc_feature 1..409: note = chr15:83316231-83316640
  misc_feature 1..409: note = hyper
  source 1..409: mol_type = genomic DNA

SEQ ID NO: 78045 - DNA, 437 bp, Homo sapiens
  misc_feature 1..437: note = chr15:83316641-83317078
  misc_feature 1..437: note = hyper
  source 1..437: mol_type = genomic DNA
gggctgacgggctgaccggccagccggcgggcgagagacgcgcacgcacgtgggcactatttttgcagcgggccgcgcgcagccccgcaccccggcagcttatgaagctcctacgagccgctcctcggagccgccccccggccggatgcggagcacctgtgtcggccccgcccgggccctcgcctccgccccctcgcgccccgcccctcctagcaggccgagccgaggagggctccgccgcccacccggaacccggcggggactgccgccgctgctagccacagctgccccctggggggccagagacctaagcctgagcgcgccatcacctaagtgacccttgccgagtcactgtctgccctgggcctcagtttccctcttaacgaaagagggcacgatttacaagcccctgcgagcggcggcgatcgcttcgtcag

SEQ ID NO: 78046 - DNA, 700 bp, Homo sapiens; identical to SEQ ID NO: 35867
  misc_feature 1..700: note = chr15:83348912-83349612
  misc_feature 1..700: note = hyper
  source 1..700: mol_type = genomic DNA

SEQ ID NO: 78047 - DNA, 70 bp, Homo sapiens
  misc_feature 1..70: note = chr15:83349671-83349741
  misc_feature 1..70: note = hyper
  source 1..70: mol_type = genomic DNA
cgatcagcaggttacagagtttccggtagtttttgtgaatcaggtcgatgcgctccgggcagacctcctc

SEQ ID NO: 78048 - DNA, 86 bp, Homo sapiens
  misc_feature 1..86: note = chr15:83378001-83378087
  misc_feature 1..86: note = hyper
  source 1..86: mol_type = genomic DNA
ccaacccgcctagcacgaaaaaggaagggaacccctaacgcaacgccgcaaaccggagaaacacctggaaccggagggtttctcct

SEQ ID NO: 78049 - DNA, 754 bp, Homo sapiens
  misc_feature 1..754: note = chr15:83378288-83379042
  misc_feature 1..754: note = hyper
  source 1..754: mol_type = genomic DNA
gcctcgcccggtccccggccccaaccctcccgcgagcttcctggcgggctccctcaccgcttgtagtcggaggagaagatgccgccgctcgcggggtcgtggccgtactcgggctccccggggccagcggagccgcccttgtcttcgctgtaggcgggggcggccgacatggggcggccagggagacttcgccgaggaggaggttgcggggccggaggccggctggagcggaggaagggaaggcgggccggtccggtccgggctggcgaaggcggcggcgcggcaggggttcagcagaggctgcagtgtgcagcggcggaggctgcgcgcggatttctcaatcagggccgcgcgctgaggtcttaaaggcaccggcgccagccgagcggagggcgtgtccgcgaggaggcgacaggggcggtgcgtcagggcctggccccgcccatccctaggaaatgccctcttcagggcgtcttctgccctttaaagcgacttggctcgtctccagatctaaaggtgggcgagtctgctggacggacgctgggaccgtcttgcaggggatgtggaatagctgcccccacccccgaccacctggcctcggcgggacgggcctctggggctccgctctccccagacgcacgcgcggatgctcacccacgccgtggagggaaagcgggaactggaaagaaggctgtgcccgcaggctgggggttctagagcgggaaggggtcaccgcacccgaggaccggcctca

SEQ ID NO: 78050 - DNA, 30 bp, Homo sapiens
  misc_feature 1..30: note = chr15:83390208-83390238
  misc_feature 1..30: note = hypo
  source 1..30: mol_type = genomic DNA
aaccctgaactttctcgaccaatatctttt

SEQ ID NO: 78051 - DNA, 453 bp, Homo sapiens
  misc_feature 1..453: note = chr15:83620954-83621407
  misc_feature 1..453: note = hyper
  source 1..453: mol_type = genomic DNA
caggggcgaagagaccgcggaatggccgaggcaggaggccggccagggcaccggtccccgtcaggtgcccccgtgcccgggctgtatgggaggggaagggccacgggctccgcgcccaggccagggtgcccctgctgggtgtccgcgtgccccggcggagggcgcgggtcaggtggccccagactcccgggcgcagagtgtgcgctcgctccggcttggggaggcgggggccggcccgccgggaggctccgagcccggttacgccagccgcggccccgcagtccctccggaggggcgcgcggagagcgcgcggcgcgggctcactcaccccatctccggcgctgctccggcggccgctccgacggggcctctcgcgctcgctctccgcccgctcggcagccgctccccgcgcggcacatgcggcggcccgtgcgcgcccggctcagccccggc

SEQ ID NO: 78052 - DNA, 29 bp, Homo sapiens
  misc_feature 1..29: note = chr15:83622331-83622360
  misc_feature 1..29: note = hypo
  source 1..29: mol_type = genomic DNA
agtcaagggacaggtcgggcgcggtggct

SEQ ID NO: 78053 - DNA, 76 bp, Homo sapiens
  misc_feature 1..76: note = chr15:83655953-83656029
  misc_feature 1..76: note = hypo
  source 1..76: mol_type = genomic DNA
ccaccgcgcctggccttagagcacttttactccaattctttccttgaataagactcttatgcgccaccctccccta

SEQ ID NO: 78054 - DNA, 28 bp, Homo sapiens
  misc_feature 1..28: note = chr15:83775821-83775849
  misc_feature 1..28: note = hyper
  source 1..28: mol_type = genomic DNA
gccaggtttaaaaaccggatgccggctc

SEQ ID NO: 78055 - DNA, 112 bp, Homo sapiens; identical to SEQ ID NO: 35874
  misc_feature 1..112: note = chr15:83775890-83776002
  misc_feature 1..112: note = hyper
  source 1..112: mol_type = genomic DNA

SEQ ID NO: 78056 - DNA, 116 bp, Homo sapiens; identical to SEQ ID NO: 4273
  misc_feature 1..116: note = chr15:83776022-83776138
  misc_feature 1..116: note = hyper
  source 1..116: mol_type = genomic DNA

SEQ ID NO: 78057 - DNA, 112 bp, Homo sapiens; identical to SEQ ID NO: 4274
  misc_feature 1..112: note = chr15:83776157-83776269
  misc_feature 1..112: note = hyper
  source 1..112: mol_type = genomic DNA

SEQ ID NO: 78058 - DNA, 37 bp, Homo sapiens; identical to SEQ ID NO: 4275
  misc_feature 1..37: note = chr15:83776270-83776307
  misc_feature 1..37: note = hyper
  source 1..37: mol_type = genomic DNA

SEQ ID NO: 78059 - DNA, 385 bp, Homo sapiens; identical to SEQ ID NO: 4276
  misc_feature 1..385: note = chr15:83776332-83776717
  misc_feature 1..385: note = hyper
  source 1..385: mol_type = genomic DNA

SEQ ID NO: 78060 - DNA, 187 bp, Homo sapiens
  misc_feature 1..187: note = chr15:83776768-83776955
  misc_feature 1..187: note = hyper
  source 1..187: mol_type = genomic DNA
cgcgccaggtgcccggggtcacaggcgtcaatacggccatgcccctgccctggaggggcccaggggccggtggggagcggaacaaacacggacactacgaacctggccgtgtcagctcgtttgtgccttgttctttttgcatctcacgggaacgtttccatgtatggactttcgcatacttatcatt

SEQ ID NO: 78061 - DNA, 378 bp, Homo sapiens; identical to SEQ ID NO: 35880
  misc_feature 1..378: note = chr15:83875705-83876083
  misc_feature 1..378: note = hyper
  source 1..378: mol_type = genomic DNA

SEQ ID NO: 78062 - DNA, 282 bp, Homo sapiens; identical to SEQ ID NO: 35881
  misc_feature 1..282: note = chr15:83876201-83876483
  misc_feature 1..282: note = hyper
  source 1..282: mol_type = genomic DNA

SEQ ID NO: 78063 - DNA, 556 bp, Homo sapiens
  misc_feature 1..556: note = chr15:83876654-83877210
  misc_feature 1..556: note = hyper
  source 1..556: mol_type = genomic DNA
cgctcccctccccttccctcccgcgcgggccggttaattcctaggtacacggccggctttcgcggagaaaccgagcgcgccagcccggcttctcggctggcgggcgggcggtgggcgcgtcctcccccagcaccgaagcccgcgccgggcgggcgggagtgcctactccggaggacgcccgccgcctgctctcttttgttcttggcccggagctgcctgccgcagcccagccaatcaccacccggccgcccccttcccctcccgtccgtgccactctgggggttctccccactcgcgccccccgctcccacgcccacctcccgctgactcgaccctctcctggctacccccagccagccacttccgcggctgctctctggtgagtgggggacaaaggcgctccaggcctgggggacggcggcgcgaggggaccctctgctgggcaccaagctgccggaaagagcaccgctccggagtcagcgaccttattggattcttgccccaggtctgcccttaacaatgcagtgtgacccacctagggcgagctatttaatcg

SEQ ID NO: 78064 - DNA, 332 bp, Homo sapiens
  misc_feature 1..332: note = chr15:83951781-83952113
  misc_feature 1..332: note = hyper
  source 1..332: mol_type = genomic DNA
accaggggacgttaccgaacccccgagcgtctgatgccccccgccccccaaccacacacaacttcactcacacaattaaggctgggagatggcattccacttaactgtcagactcggagcggtggcagccccgcagccacaaagagatgccttaaatgagaagaacatgtttctacaccgcatttgtgaaagtttggctcggagctacgcgctgattaatatcagatctccttcactcgcctcgccacaatcttgtcacatctggctgacaaatcccgaggaactccggcaaagccaggcggcggcggggctccgggtctgggcggcggctc

SEQ ID NO: 78065 - DNA, 54 bp, Homo sapiens; identical to SEQ ID NO: 35884
  misc_feature 1..54: note = chr15:83952768-83952822
  misc_feature 1..54: note = hyper
  source 1..54: mol_type = genomic DNA

SEQ ID NO: 78066 - DNA, 34 bp, Homo sapiens; identical to SEQ ID NO: 35885
  misc_feature 1..34: note = chr15:84034378-84034412
  misc_feature 1..34: note = hyper
  source 1..34: mol_type = genomic DNA

SEQ ID NO: 78067 - DNA, 30 bp, Homo sapiens
  misc_feature 1..30: note = chr15:84063249-84063279
  misc_feature 1..30: note = hypo
  source 1..30: mol_type = genomic DNA
tcatgtgggcaatcacgttttcacttattt

SEQ ID NO: 78068 - DNA, 98 bp, Homo sapiens; identical to SEQ ID NO: 35886
  misc_feature 1..98: note = chr15:84115713-84115811
  misc_feature 1..98: note = hyper
  source 1..98: mol_type = genomic DNA

SEQ ID NO: 78069 - DNA, 42 bp, Homo sapiens; identical to SEQ ID NO: 1229
  misc_feature 1..42: note = chr15:84115812-84115854
  misc_feature 1..42: note = hyper
  source 1..42: mol_type = genomic DNA

SEQ ID NO: 78070 - DNA, 408 bp, Homo sapiens
  misc_feature 1..408: note = chr15:84115931-84116339
  misc_feature 1..408: note = hyper
  source 1..408: mol_type = genomic DNA
cgacccccaggacatccccacgcccagcttcccaggccggtcttctgcgcggctcaagtagcccaggtctccacgcaacaatgaagcgtgggcggccccagcagcttcatttgcatatcgccgcggcttggccaatgggctgcgcaggggctttggaacgcagtgttgccatcggcgtgcgcgcgtgtgtgcgagtgtgacagcggctgtggctgtggccgtggccgtgggaggcgggcccggcggagcccagccgcggggggaccggcccgggctcccgctccccgagcgcgtcgcggccgcgtggcccagccgagccttgagaccaccccgcccctgccggtcgcagtcgcgatgtcggtggccgggctgaagaagcagttccacaaagccagccaggtagggagg

SEQ ID NO: 78071 - DNA, 176 bp, Homo sapiens; identical to SEQ ID NO: 35889
  misc_feature 1..176: note = chr15:84116377-84116553
  misc_feature 1..176: note = hyper
  source 1..176: mol_type = genomic DNA

SEQ ID NO: 78072 - DNA, 113 bp, Homo sapiens; identical to SEQ ID NO: 35890
  misc_feature 1..113: note = chr15:84116651-84116764
  misc_feature 1..113: note = hyper
  source 1..113: mol_type = genomic DNA

SEQ ID NO: 78073 - DNA, 68 bp, Homo sapiens
  misc_feature 1..68: note = chr15:84116828-84116896
  misc_feature 1..68: note = hyper
  source 1..68: mol_type = genomic DNA
cgaaatggccccgtctggactgtgcccggctccccggctggggctctctaccgcggtccttcccctcc

SEQ ID NO: 78074 - DNA, 92 bp, Homo sapiens
  misc_feature 1..92: note = chr15:84225557-84225649
  misc_feature 1..92: note = hypo
  source 1..92: mol_type = genomic DNA
gctggtgtggttgatcgctgctgggctcactcacctgttgccggtcagctgccaggtgagctgagggcttgatggcccgaggttgctcaggt

SEQ ID NO: 78075 - DNA, 121 bp, Homo sapiens; identical to SEQ ID NO: 35892
  misc_feature 1..121: note = chr15:84322476-84322597
  misc_feature 1..121: note = hyper
  source 1..121: mol_type = genomic DNA

SEQ ID NO: 78076 - DNA, 220 bp, Homo sapiens
  misc_feature 1..220: note = chr15:84322993-84323213
  misc_feature 1..220: note = hyper
  source 1..220: mol_type = genomic DNA
ggggctgcacgtcccagatacttctgcggcgcaaggtgggtgcaccgagctcggcgcagggcggcccctcaggggtcgggggaaggcgctccccagagggagtaagacttggagcagtggcctctctaagcaagttgggggtctccaagcagagtcggggcgtgccacgcgggccccagggggcctcaggactggggtgctcctcactgctgggcacctc

SEQ ID NO: 78077 - DNA, 36 bp, Homo sapiens
  misc_feature 1..36: note = chr15:84543445-84543481
  misc_feature 1..36: note = hypo
  source 1..36: mol_type = genomic DNA
tcccagccacaccaccgagaacgtgcagcaagacaa

SEQ ID NO: 78078 - DNA, 49 bp, Homo sapiens
  misc_feature 1..49: note = chr15:84582058-84582107
  misc_feature 1..49: note = hypo
  source 1..49: mol_type = genomic DNA
ctgaggacagtgagacgacttacgactgggagtacgctgggttcacccc

SEQ ID NO: 78079 - DNA, 89 bp, Homo sapiens; identical to SEQ ID NO: 35894
  misc_feature 1..89: note = chr15:84748531-84748620
  misc_feature 1..89: note = hyper
  source 1..89: mol_type = genomic DNA

SEQ ID NO: 78080 - DNA, 788 bp, Homo sapiens
  misc_feature 1..788: note = chr15:84748678-84749466
  misc_feature 1..788: note = hyper
  source 1..788: mol_type = genomic DNA
cgtcccttcatctccgggggacggccactctcagggttcccgaggagcccgctccgtgcacctaggccctaggtcggctcccaagccctggcccgccgctacaccagcggtttcttacccgcaagtacaaatgtgacacagacaccagctcctcgtgctcttggctcccagggtttctttcaccgcgcctcagcacctgcagcttctccactcttacagcgcccgccgtcgtcaaggcaacagagggatgcccggtgacagactcggcgccggcttccggcgccgtaagagaagcgtccgcgcgggcgttctggacccgcagagttctcggcgtttccgaagctcttggtgtggccgggacccgggagaaggagcagggctggtggggctgctgcagccggtgagtgtgtgctggcgctgggggctggaacctcctaggccagtctctgggcggtgccgcaggaccctgctcgctgcggctctgaggcggaaacaggggctggggccgagcgcgggctggaagctttggtccctggagtgtcgcttccagtctggggccgaggcggtcgcctgtgtagacccgggatcctcaaatagaacgaatccgggaccctgcagaaatgaagggcatgtagtgtagaggtttttcctttttatttagaaaggaatgaaagaccgacagtgcacctgcttggatagtaagcacgtgacccaaaactttgttggggctctatgggcaggaataaagctgggtatttgacctcgcgcgaggacgagcgagaatgtca

SEQ ID NO: 78081 - DNA, 89 bp, Homo sapiens
  misc_feature 1..89: note = chr15:84950082-84950171
  misc_feature 1..89: note = hypo
  source 1..89: mol_type = genomic DNA
gtgggggtgaacgtgcgtgccggcaccggcatggcagctaacaccccttcctccaggtgaacctgcaggagctgcggggcaggtgttgc

SEQ ID NO: 78082 - DNA, 196 bp, Homo sapiens
  misc_feature 1..196: note = chr15:85143051-85143247
  misc_feature 1..196: note = hypo
  source 1..196: mol_type = genomic DNA
aaaaaaaaaagcagtcatttcattgcaggtgcctccagtaattgctcagtgcaaacatacataactattctatcacagaccattaagggtgtctctctccatttttagattttccgcttgagtttccaggtagtttctcacctgttttcaagcagggttggggcagccgtttcttcaacagcgccagccgtaaaac

SEQ ID NO: 78083 - DNA, 30 bp, Homo sapiens
  misc_feature 1..30: note = chr15:85200338-85200368
  misc_feature 1..30: note = hypo
  source 1..30: mol_type = genomic DNA
ctcccatgcaggatccggggatggccccag

SEQ ID NO: 78084 - DNA, 30 bp, Homo sapiens
  misc_feature 1..30: note = chr15:85681092-85681122
  misc_feature 1..30: note = hypo
  source 1..30: mol_type = genomic DNA
gacgaaatgaagctgcggaacctccgacca

SEQ ID NO: 78085 - DNA, 40 bp, Homo sapiens
  misc_feature 1..40: note = chr15:85728807-85728847
  misc_feature 1..40: note = hypo
  source 1..40: mol_type = genomic DNA
gttttccacggtgttcatggatttccgtgacttgaaccta

SEQ ID NO: 78086 - DNA, 27 bp, Homo sapiens
  misc_feature 1..27: note = chr15:85886665-85886692
  misc_feature 1..27: note = hypo
  source 1..27: mol_type = genomic DNA
gattttaacttgcgttagtgaactaat

SEQ ID NO: 78087 - DNA, 30 bp, Homo sapiens
  misc_feature 1..30: note = chr15:86251040-86251070
  misc_feature 1..30: note = hyper
  source 1..30: mol_type = genomic DNA
aaaatcacatctgctcgtgtttttcctcct

SEQ ID NO: 78088 - DNA, 30 bp, Homo sapiens
  misc_feature 1..30: note = chr15:86606387-86606417
  misc_feature 1..30: note = hypo
  source 1..30: mol_type = genomic DNA
gggtgaggagatattcgttgccactcctgg

SEQ ID NO: 78089 - DNA, 37 bp, Homo sapiens
  misc_feature 1..37: note = chr15:87115915-87115952
  misc_feature 1..37: note = hypo
  source 1..37: mol_type = genomic DNA
cagggcacaggagtccgaccatcgccacagctgctcc

SEQ ID NO: 78090 - DNA, 30 bp, Homo sapiens
  misc_feature 1..30: note = chr15:88649077-88649107
  misc_feature 1..30: note = hypo
  source 1..30: mol_type = genomic DNA
ctcaataccttctcacgtgagcaccattca

SEQ ID NO: 78091 - DNA, 38 bp, Homo sapiens
  misc_feature 1..38: note = chr15:88783191-88783229
  misc_feature 1..38: note = hypo
  source 1..38: mol_type = genomic DNA
cagccctcggtgatgcgcatgcacgccaaagcttaata

SEQ ID NO: 78092 - DNA, 30 bp, Homo sapiens
  misc_feature 1..30: note = chr15:88798166-88798196
  misc_feature 1..30: note = hyper
  source 1..30: mol_type = genomic DNA
ccagtccccagccctcgatctgtcctctcc

SEQ ID NO: 78093 - DNA, 90 bp, Homo sapiens
  misc_feature 1..90: note = chr15:88798564-88798654
  misc_feature 1..90: note = hyper
  source 1..90: mol_type = genomic DNA
cgtccaaagtctccccgcgagcagccagctcgcaacttgtttacttgtcagcatgttttgctgtttccaaatggaaatagttaaacacct

SEQ ID NO: 78094 - DNA, 265 bp, Homo sapiens
  misc_feature 1..265: note = chr15:88798724-88798989
  misc_feature 1..265: note = hyper
  source 1..265: mol_type = genomic DNA
cgctgccgcctctgccaaagaatcgaacctcgtctactttattccacttgagcgtggccaaactgttgctatttagtggggagcaaaaaaaaacaatttgcaccatcgaaacgagccagcaactggttgggaggcgggcggtagctgggccccgcgtgccctcggcggccggggtcctctccggggagaggcacacacacgcatagccggatcgcgcctcgccagggccggagtcacctggaatgcgcagccggagagcatctcc

SEQ ID NO: 78095 - DNA, 963 bp, Homo sapiens
  misc_feature 1..963: note = chr15:88799036-88799999
  misc_feature 1..963: note = hyper
  source 1..963: mol_type = genomic DNA
cgagctggggcgggcggagggccggctcccggccgcgggtgggcaggagggagacgcagagcgcgggggaggcaggctggggagcggccgcctgacttacatggaagtgatattccttgagatgtccgtgatgttgatactggcgttcccattgctgttccctgaatcctgcccttccaggagggggaagaggttcccatcgtccggccgccggcaattgatctcagtcttgctgcagacacaatttgcagggcaagccagcacggagcccacatagtccagccagacgcttcccagcaagaaaatccgccagaaactacacttggctgggcaaagagagacatccatctccgatcgctgcttctaaaaaagaggaggaggagaggagaggggggtggggtggggggagtggggagagcagggggggaaggaaacaaagacggcgagggaggggggaagggggagggggggcctctgcctttgaaacgccgagcgatcagatgcaaaatccttcagcgtctgaaaccatcgcggacgccgccgccgccgccgccgccgccgggtgggagccgcgaggagcgcctagtggcgcggtctgccgggcatggtggccggctcggcgatcgctgactcgccgggtccgggggctctggaagcgaggcgcgctctccgactccgagactttgcagggttgcaacagacggtggggaggcaaaaaaaaaaaaggaaaaggaaaaaatggtgctaaagtcaccaagtcccacctactgggcagaattaaaacggacacaccacgcacctgcaaaacacacacactcactctcacacatacacacacccggagcccgaggaaaggaagagaaggaagatgcagtaggagctgcagcagccgccgcgaatggctcgccgcgcggctgcagaaatgtacaagtgctccgagccttacgaaacgcacgggttatc

SEQ ID NO: 78096 - DNA, 302 bp, Homo sapiens; identical to SEQ ID NO: 1234
  misc_feature 1..302: note = chr15:88800000-88800302
  misc_feature 1..302: note = hyper
  source 1..302: mol_type = genomic DNA

SEQ ID NO: 78097 - DNA, 592 bp, Homo sapiens; identical to SEQ ID NO: 35898
  misc_feature 1..592: note = chr15:88800412-88801004
  misc_feature 1..592: note = hyper
  source 1..592: mol_type = genomic DNA

SEQ ID NO: 78098 - skipped

SEQ ID NO: 78099 - DNA, 152 bp, Homo sapiens; identical to SEQ ID NO: 35900
  misc_feature 1..152: note = chr15:88801088-88801240
  misc_feature 1..152: note = hyper
  source 1..152: mol_type = genomic DNA

SEQ ID NO: 78100 - DNA, 30 bp, Homo sapiens; identical to SEQ ID NO: 35901
  misc_feature 1..30: note = chr15:88801449-88801479
  misc_feature 1..30: note = hyper
  source 1..30: mol_type = genomic DNA

SEQ ID NO: 78101 - DNA, 38 bp, Homo sapiens; identical to SEQ ID NO: 44336
  misc_feature 1..38: note = chr15:89142361-89142399
  misc_feature 1..38: note = hypo
  source 1..38: mol_type = genomic DNA

SEQ ID NO: 78102 - DNA, 30 bp, Homo sapiens; identical to SEQ ID NO: 44337
  misc_feature 1..30: note = chr15:89145873-89145903
  misc_feature 1..30: note = hypo
  source 1..30: mol_type = genomic DNA

SEQ ID NO: 78103 - DNA, 92 bp, Homo sapiens
  misc_feature 1..92: note = chr15:89147588-89147680
  misc_feature 1..92: note = hyper
  source 1..92: mol_type = genomic DNA
agcccggggaggggacgggactggctctggtgtctcttctggtccgggcacaactggattcagcactaatgacggactctaccccagcggag

SEQ ID NO: 78104 - DNA, 1726 bp, Homo sapiens
  misc_feature 1..1726: note = chr15:89147722-89149448
  misc_feature 1..1726: note = hyper
  source 1..1726: mol_type = genomic DNA
cgcggaccggcaccccctcccccaaagctgttgccatggccacaggggacatttgatgtgaagcgcggctcccccctctccactcgctttctccgctcgccttcaggatgacgtcatgaacatccgtggccctgacaggccacccgtgggttggtctcagctttaaagcagctgttctcctctggcccggcagccgcggcgactgtgtttgcacccggcggaccatgccaggactacggacccggacaggactgatggcctcagagaggcaagtattcaaggggcacttcacaaacagcttcctcaaaccccaccccctcccccgcactgcgctgctacttgcactgcggctcctggggggaagcaaagtaccggcagctgggtggtgaggggctttcttccagaaagaaacggagagcaagtggtcttcctccctagccgcggcgacccatgccaggtaaaaatcccagccgaggtccccggtcccgtcccctcctccaggtcaagggctcgggactggagaagcagccaactggagctgatattcgggaagctaagcctgaggctgctctggagggccggagaagcgagcggccaggcttggcacccgccaaatgtgccttgccaaaatgaagaggaaggaaggcgactccggagcccagcaggtgagcgctcctacgggatgctgggcaggctagaggtgtgggggcgtctggttccagtacctgcccggggcgacgcggaaacccagcttgcagtttgtttcgctcggtcccgcgcccagtaggagaaagacggccccacagcctcgcgggagccggctctcgcaacccagccgccccaagcccgccgtcgcccctcctcccgcgcttctcgcccctgattctagatgcagctgacttgttgcatgcagaagagcagctgggttcggcgttccaagcctctcctctttgctttgcctgccaccagatctgagcgccaggctggccagcacccagagagcccagagccgcaggaaaaaatgtgaaaagtaccaggagaccactgggtaatcgccccagtgcaaagggcctttcttcctacccaccgcaattgcagcaaataactccagggaggggaatcagaggcgccggggattgcgccctgggagagccctatctgctgaaagagagcgcctaatgccgttacttcccagtgtagcctttccactcggcagaccaagcgcctctccttcgagtcgctacccgcttggagtcggctcagaatcaggctgctaaaggtccctggagcccctcccccagcgaatccgagcctgcagcttcagcaccagaggctggacagcgccccggccctagggtgcccatggtcggtgcctgcgcacggctcggcctcccagcccacgccacttgcgctcgcggcccctcagaccccacgcggaggaggtcaggaggtgacacaggttcgcggaagaaagcgggactcatcttcctcatttctccagggatttaggtgtgggattctaggagagcattctctctcgctctggccacgaccagtggaaaaacttggcgccaaatttaggcagtggtgcggggagcagaggcacgattgcaggcggtgagcaaaggggcaagcgggacagaggatctactgtgagccccaggctctggtgttccgtgaaaaatcgccacatttaaatcctgcgctcccccgtgctccctctcgc

SEQ ID NO: 78105 - DNA, 69 bp, Homo sapiens
  misc_feature 1..69: note = chr15:89195448-89195517
  misc_feature 1..69: note = hypo
  source 1..69: mol_type = genomic DNA
gacaggctgttgtggcgtgaggccaagctggaccactgcaggcgtgtctccctgcgggtgctgagtgag

SEQ ID NO: 78106 - DNA, 606 bp, Homo sapiens
  misc_feature 1..606: note = chr15:89248377-89248983
  misc_feature 1..606: note = hyper
  source 1..606: mol_type = genomic DNA
gggagccccctccaccgggcgtcggggccctggaccccacagcaggggcggggaggctgacgggggcgcagcttttcctcctgagtgttcgctgcccgggctggcggcgcggagccggcccgccgccgtctgcccctctgcccggcccttttttccagcagttctgccaagaggagcggggtgcggggcaggagatgaggaaggaggaggagaagaaaagggagaggagaggaggagacgcaaagggaagggaggggtgggaagggaagaggaggcaaagggtggggagaggaggggaggggaggagaggagaggggaggggagggactggatcgggcgccaatcccgcccgccgcgcgccgcccgggctccctcgggctctcatttaccccggccgctggcagcgggacccaggcgccttgccgcctcgctgcggccgcttggtccccacgccgccccctccgcaggcgacgaggcctgcagaccggactgggcagccactcgggcgcccgcggcggtgggcatcatcatgcttcccgggcaaacagcacttccagccagagggttcgcggggcctgcactgaactctctcgactctcactgtgg

SEQ ID NO: 78107 - DNA, 90 bp, Homo sapiens
  misc_feature 1..90: note = chr15:89312794-89312884
  misc_feature 1..90: note = hyper
  source 1..90: mol_type = genomic DNA
cgggcctgtcccgagcctcctgtaagctgcttctgcgccctgaacgctgcctgttgtcccctccagagcgcctcgcggctcctcctcctc

SEQ ID NO: 78108 - DNA, 324 bp, Homo sapiens; identical to SEQ ID NO: 35905
  misc_feature 1..324: note = chr15:89346003-89346327
  misc_feature 1..324: note = hyper
  source 1..324: mol_type = genomic DNA

SEQ ID NO: 78109 - DNA, 448 bp, Homo sapiens; identical to SEQ ID NO: 35906
  misc_feature 1..448: note = chr15:89346346-89346794
  misc_feature 1..448: note = hyper
  source 1..448: mol_type = genomic DNA

SEQ ID NO: 78110 - DNA, 422 bp, Homo sapiens; identical to SEQ ID NO: 35907
  misc_feature 1..422: note = chr15:89346881-89347303
  misc_feature 1..422: note = hyper
  source 1..422: mol_type = genomic DNA

SEQ ID NO: 78111 - DNA, 30 bp, Homo sapiens
  misc_feature 1..30: note = chr15:89383259-89383289
  misc_feature 1..30: note = hypo
  source 1..30: mol_type = genomic DNA
agagccatctctacacgctacaccctcgac

SEQ ID NO: 78112 - DNA, 57 bp, Homo sapiens
  misc_feature 1..57: note = chr15:89390579-89390636
  misc_feature 1..57: note = hypo
  source 1..57: mol_type = genomic DNA
gctccaggccgcctacgaagcaggctatgagcagtgtgacgccggctggctgcggga

SEQ ID NO: 78113 - DNA, 208 bp, Homo sapiens
  misc_feature 1..208: note = chr15:89422160-89422368
  misc_feature 1..208: note = hypo
  source 1..208: mol_type = genomic DNA
ccaaacccacaggcccgcgcttggctattccactcacccttgagggcagtagcgaagcagaatacatcatagcggtgcaggcggcggtggcgggggccgtagcttcgcacgccaggtgccaggcccgggccaccgcagggctgccggggcaacatgatggggtactgcaccgtggcatcctgcagccagcccgcgttgcaccagtcca

SEQ ID NO: 78114 - DNA, 218 bp, Homo sapiens
  misc_feature 1..218: note = chr15:89437619-89437837
  misc_feature 1..218: note = hyper
  source 1..218: mol_type = genomic DNA
tgccaggtgcatgtccgcactgggccttccgtgagtacaagtcccccaggtaccagcaggaggcagcatcgcccgcgaggtctgcacgagcgctgctcccagcgagaaatttgacatccctgtccctgtttgcacaaggcttgatctccgcctttgaaacctgcagcccccaggagaatgaaaaccggaggtgtttcccaatccgctggcccgggcgg

SEQ ID NO: 78115 - DNA, 91 bp, Homo sapiens
  misc_feature 1..91: note = chr15:89438330-89438421
  misc_feature 1..91: note = hyper
  source 1..91: mol_type = genomic DNA
ccgaccctggacagacgacaggggagagagccaagcggaccctggcaggaagggggctggaggcggacggtggtctcggaggccacggggt

SEQ ID NO: 78116 - DNA, 84 bp, Homo sapiens
  misc_feature 1..84: note = chr15:89438779-89438863
  misc_feature 1..84: note = hyper
  source 1..84: mol_type = genomic DNA
agggcagaaaggaagcggcagcagaaaaacccccgcgctcccgccagaccagccccttaaaggaacacgcgcacctttccctcc

SEQ ID NO: 78117 - DNA, 20 bp, Homo sapiens
  misc_feature 1..20: note = chr15:89448511-89448531
  misc_feature 1..20: note = hypo
  source 1..20: mol_type = genomic DNA
taataaatcattcatcgggg

SEQ ID NO: 78118 - DNA, 39 bp, Homo sapiens
  misc_feature 1..39: note = chr15:89651830-89651869
  misc_feature 1..39: note = hypo
  source 1..39: mol_type = genomic DNA
tctgctctgtttgttcgtgctttccgcactgtaagttgt

SEQ ID NO: 78119 - DNA, 30 bp, Homo sapiens
  misc_feature 1..30: note = chr15:89760580-89760610
  misc_feature 1..30: note = hypo
  source 1..30: mol_type = genomic DNA
agttaaacttaggtgcgggtgaggggcagg

SEQ ID NO: 78120 - DNA, 449 bp, Homo sapiens
  misc_feature 1..449: note = chr15:89876378-89876827
  misc_feature 1..449: note = hypo
  source 1..449: mol_type = genomic DNA
agcagacctccacgtcgaacaccagggcccgctcctcggggatggccacgggtacggcctccccctcggggccgtaccgggtccagccctccgcccaggcccaagccgggggcttcgggggcagctgggcctgcaacagcaagttggccgcctccaggtagggcaggctctgcttctgggccaggaggcggaagtgctggtccaggttgtccccgtagaggggcggcaggcgcagctccacgtcgggcaagggcacggctggctgcccccagagcccgtgcttctgcaggtgctcgacgctgcggcgcaccgcggcctcgccaggcatctcccctccttgcccgaagatttgctcgtgcagccctctcgagagcatctggatgtccaatgggttgtgccgcagctgcccgccctccgaggatagcacttgcggctgctgaggctgctgt

SEQ ID NO: 78121 - DNA, 208 bp, Homo sapiens
  misc_feature 1..208: note = chr15:89876887-89877095
  misc_feature 1..208: note = hypo
  source 1..208: mol_type = genomic DNA
gacgcggggacggagctggagacccagcgccccggagctggaaccggccctggcccgacggtggcgccggccaccttcctccagagcaggcggctcatggttggtgcagggacccccacgctgggagtcagaacacctggctttgggctccagcttggcttcttttactggctggaagacgtggagagagacacgtcctgtctctgct

SEQ ID NO: 78122 - DNA, 498 bp, Homo sapiens
  misc_feature 1..498: note = chr15:89903388-89903886
  misc_feature 1..498: note = hyper
  source 1..498: mol_type = genomic DNA
atttgggcagcaccccggaagaggcttgcaggataggacacagcccacaagaatcatccgaggctgcaccgtgaccagcccctcaagacagagcgagacccaaataacccccgcgggcggacccgcagcgttctgtgactccaccgcggagtccaaaaggcagctgagggtgggagcggaggggaagggaggggggccacaggcgctcgggcgagggaggcgcgtcaatgggccgcaggggccggatcggtggcctaatggattcaggcctgcacggcagaggcgcacccggcggcctgcccgcgctctcaatagcggacaatggagtcccggggtgacctgaacaaagaatttggaagtagttaaactgcagaacacgttctcggcctgggtgcctcctttcaaaaggagcgctgggagaagaaaagaaagcactggggggtgaagggagtgagaaaatgcccaggggaaaagttggtaggtcgccctagttgccgc

SEQ ID NO: 78123 - DNA, 107 bp, Homo sapiens
  misc_feature 1..107: note = chr15:89904905-89905012
  misc_feature 1..107: note = hyper
  source 1..107: mol_type = genomic DNA
gcttctgtctcccttcgaccgatcgccccctatcctgaagctttccaatgtcatcttggagccccaaagtttcctggggcctccgcgttgtgcgtcccagaacccct

SEQ ID NO: 78124 - DNA, 145 bp, Homo sapiens
  misc_feature 1..145: note = chr15:89905745-89905890
  misc_feature 1..145: note = hyper
  source 1..145: mol_type = genomic DNA
cagagaagcggcgcgcggccaggagcccccgctccgccactgccgtgcctgcctcccgcagctgtctgccatgcgctcgccggggcaggggcgcccggagggcggctagagctgggcctgagcccgggaacgcgcctgatcaggg

SEQ ID NO: 78125 - DNA, 145 bp, Homo sapiens; identical to SEQ ID NO: 35911
  misc_feature 1..145: note = chr15:89906124-89906269
  misc_feature 1..145: note = hyper
  source 1..145: mol_type = genomic DNA

SEQ ID NO: 78126 - DNA, 194 bp, Homo sapiens
  misc_feature 1..194: note = chr15:89908822-89909016
  misc_feature 1..194: note = hyper
  source 1..194: mol_type = genomic DNA
gcatctgaactgaatcgaaatcaggcttttaattctttctcccaaagccccaacccgccctaggcttgcaggccggcctccgcgcgcggttaccgcgagtctcgctgaggagccattttgtgcagcatcctgcttaaatcacactccgaggggctcgttcctcgctccctcttccccctcgcttcctctctttc

SEQ ID NO: 78127 - DNA, 30 bp, Homo sapiens; identical to SEQ ID NO: 12296
  misc_feature 1..30: note = chr15:89909322-89909352
  misc_feature 1..30: note = hyper
  source 1..30: mol_type = genomic DNA

SEQ ID NO: 78128 - DNA, 1800 bp, Homo sapiens
  misc_feature 1..1800: note = chr15:89910390-89912190
  misc_feature 1..1800: note = hyper
  source 1..1800: mol_type = genomic DNA
ccgacctgcgctcaccgggacacttaattcttcctccaatccctggtctctgccgcgtgggctagatctactgcaagtgctgggcatggggaaaggaagagagaagttaaaggtgaaatggcttctgctctcggcctctccgtgagcgctctcggccctcctgtggagatcgccacgtcctatcacacgcgtccctaaaccttgtcactcgagcattcttgtctcccaaactctgatggtccgcagtgggtactgggctccctgggccctgggaggaagacggaggagtttgggtgaaagatcagacggtgcgcagccctgaggcttctgagggcagagggtgcgcttccttgccctcggggcggggaagccgtgaacgccgaggccattgtaaggctgggtggtgcggagcgcgggaagggggctgggatttgaatgggagcctgtgattggccgatccctggactgacgtcacttccccgcggggcgattagcctgcgagaggagggccggcggtccagtgcgctgggggcggccggggcgctcgaggctctctaagcgctccgcgcgggtgccctacgtgagccccgggacgccgtcgaggcaggccggcagcgccggtgccaggacgcacggaacggggagcaggggagaaatgcgccgggagggcgagggaggaagggaactgggcgggggctgcgggcctaggtggcgggagtcagcgtgtgcgtgtgtctgtccatcccctctggctctccgcgtgcgccccaggatccgggcacggcgtccgctcaggctcccgcgctcggcaggcagcagcacgtggagcccacggcgcggcagcggcactggctaagggaggcccgtttctctctttggttatctagctgtatgagtgccacagagccgtcataaagctagataaccgaaagtagaaatgattctcacaacttctgcgtgcgagcgcccgccccaccgaccgccccggcccggcccgcaagagccagaggagccgagaggagcccagcgccggcccagcggactccagctcgacggagcggccgcgccccgaccaggtacctgacctcggctctctctctggggacacttgcagtgccagctttcccccagtcctcctctttcctggtcccccacccctatcccccagcgccggagcaggaaccccaaagtggagcgggccggggagagggagggggttggggttgcagaggggtcgctggaaggggaaggcgccagccttcgccttcaccccataaatcaggctggaacaatccgctcccggagccgtggacggggattttgggatgcaaatgcgatgggagagagacagcggtcggtagggggtgggtggagggagtgaatggggtgggctgggggctgccctgccgctaacaatgcggcctttatcgaattattcgacgagtcagcccctgagcgccattagcatacggctggggggttgccggagcttcgcccctcggtgaggtcaagttcttgataatttgatcacttttcacgggctctggcagctgcctttgtgtgcagttggggggtctgtgtgcagcgtgaagcggagcagaactggcggggagtgcgctcaatggcaaggggccagggcaggggcctccctccccgacgggtcggccctgccctgcatacaaaccaagagccggcgggtgggcgggaggaaccgagctcagtctcccgctacctctacgccagccccgaccgggctgctcctgcccaagcctccccaacttcccgcgaggttaaggtgca

SEQ ID NO: 78129 - DNA, 30 bp, Homo sapiens
  misc_feature 1..30: note = chr15:89912514-89912544
  misc_feature 1..30: note = hyper
  source 1..30: mol_type = genomic DNA
tcccaagctccccagcgagtggctgtagac

SEQ ID NO: 78130 - DNA, 699 bp, Homo sapiens
  misc_feature 1..699: note = chr15:89913180-89913879
  misc_feature 1..699: note = hyper
  source 1..699: mol_type = genomic DNA
tcctactttggtccccggttctcctcagagataatcatgggcagaaggttttctgaatccctttgtaccccacctccattttgaaaggccagtttccctttttttctgacaggaggctggtgaagggtgactagagtgtttcgggattcacgaggctatgggctgcatcccttgggccgtccctcccttcccaatgcacctgggagcctgtgtgctgatggtgacctcatttcggaggaaaccggagcagcacttcctgcccccttgccctgcactccctgccttcctccctcaccggccaacgggtgtgggcaaaccctgggccccgggcttcgatcttcccctcccaccacccctacccgtttgctgtgttgcaagaactagtccttcacttgccagggtggctttgcagcttcccagcagtgtctacacagttcagatgagtgttgttgttaaacaccactgtcccataccatctgggcaggtctgaaacccgagttgagggtctgatgaaggaggagtctgtgcgggagggcaacgcggcattttcccgctttctacgaaaatctgttgatgcaaacctcccgcttcagagaaagatcgcggcagcagggctgcggagggcgatgagcatgccagttctaatctccaggagcccatcccacaccttccttaaacggccctcggagagaggccaga

SEQ ID NO: 78131 - DNA, 315 bp, Homo sapiens; identical to SEQ ID NO: 35916
  misc_feature 1..315: note = chr15:89914135-89914450
  misc_feature 1..315: note = hyper
  source 1..315: mol_type = genomic DNA

SEQ ID NO: 78132 - DNA, 619 bp, Homo sapiens
  misc_feature 1..619: note = chr15:89914866-89915485
  misc_feature 1..619: note = hyper
  source 1..619: mol_type = genomic DNA
cgagccggcctgttcgctggctcgggcgcccggttccgggctgggcaaggagcgcttggccatgagccgcgggacagcccaggcgggacggatgcgccctccagggcccaggcgaggccgcgcggtgcagaaccgccgggatttctccaacccgggtatgcgcacccacagcagcggcctttggaggccgcggcgccattttagtggccttccttcccccttggcatctgtcgtgtatggtgtggctgggtgtccccagctccccccatcccgctctgactttggctgccccctccgccagcctggatagagtgaccaatcagctctgacctagggtgggatgcgcgtcaccatggcgacggctagggcgccctggcagtgctgcccatcgcagagggcaagtcttcactccgcctagatgggtgtgaagggaaggtggggacaggtgggggggaggggcggatggagggaggccgtgatgcctcgtccgcattcccaccccattttgcctagggtcagttcagctgggtcaggcaggggacaaatggatggtgtggaaggggcctgggtaggggcctgggtttgtcctggggcggctcttccacgagtcctctcatcc

SEQ ID NO: 78133 - DNA, 132 bp, Homo sapiens
  misc_feature 1..132: note = chr15:89918751-89918883
  misc_feature 1..132: note = hyper
  source 1..132: mol_type = genomic DNA
agccctgttctcacccgaggtctgttaatgagctggggacaggtgagcctcacacgttccaacttggctgccttcagcggcatccaggagcagtggtgagctattaatggaaggtgccggctttgtgctaat

SEQ ID NO: 78134 - DNA, 99 bp, Homo sapiens
  misc_feature 1..99: note = chr15:89921939-89922038
  misc_feature 1..99: note = hyper
  source 1..99: mol_type = genomic DNA
ccaagattcacacctcgtctacaccagggcaccgcctgggcctacggccttccgaacccgaagcgcccgcagcccagagctggcatcaggccatcaggc

SEQ ID NO: 78135 - DNA, 269 bp, Homo sapiens
  misc_feature 1..269: note = chr15:89922499-89922768
  misc_feature 1..269: note = hyper
  source 1..269: mol_type = genomic DNA
ggtaagagcccccctgactgggctgcccaccccgggcaggggcggaaacggccttccccgcgtggggaacaatggcgttattttggagtctgcaaccgcgagcgcttcaagctctttgattattttcgaggagtgttaggtgcgtggctaactcccgcgttttcttggaaccacgaagcccaaaatggcgagcgggccgtggccgccctcctggggctgagtgtggtccggagcgctgagagtggccagggagccgtgggcctccatcg

SEQ ID NO: 78136 - DNA, 1149 bp, Homo sapiens; identical to SEQ ID NO: 35920
  misc_feature 1..1149: note = chr15:89942626-89943775
  misc_feature 1..1149: note = hyper
  source 1..1149: mol_type = genomic DNA

SEQ ID NO: 78137 - DNA, 125 bp, Homo sapiens
  misc_feature 1..125: note = chr15:89945164-89945289
  misc_feature 1..125: note = hyper
  source 1..125: mol_type = genomic DNA
ctgacctacctagtgcgtgtgtttagattcccgatgattcatcactgacacgctgatgtcagaggagcctgggaagatgtttacatctttttaaaaaagggaaagcgaaacgtttttctgcaaaa

SEQ ID NO: 78138 - DNA, 39 bp, Homo sapiens; identical to SEQ ID NO: 35922
  misc_feature 1..39: note = chr15:89949371-89949410
  misc_feature 1..39: note = hyper
  source 1..39: mol_type = genomic DNA

SEQ ID NO: 78139 - DNA, 326 bp, Homo sapiens; identical to SEQ ID NO: 1240
  misc_feature 1..326: note = chr15:89949616-89949942
  misc_feature 1..326: note = hyper
  source 1..326: mol_type = genomic DNA

SEQ ID NO: 78140 - DNA, 501 bp, Homo sapiens; identical to SEQ ID NO: 35924
  misc_feature 1..501: note = chr15:89950236-89950737
  misc_feature 1..501: note = hyper
  source 1..501: mol_type = genomic DNA

SEQ ID NO: 78141 - DNA, 296 bp, Homo sapiens
  misc_feature 1..296: note = chr15:89951081-89951377
  misc_feature 1..296: note = hyper
  source 1..296: mol_type = genomic DNA
ggatttaagtaccttggcgaggcagcgcaggcggctgttctaatcgccgtctccaagtacctgctcatgaataaacaccaaccccatttatcaggtacttagcgctcattgtgaaggggaaattggcccttttctgaaattgtctatccacaacccatctgcgcagttctggttgcagaattcccctcacccttgagacacacacacacacacacacacacacacacacacacacacacactcgcaacacgaggctcctccaagctaagataaactcgcttttcttccggtaagtg

SEQ ID NO: 78142 - DNA, 988 bp, Homo sapiens
  misc_feature 1..988: note = chr15:89951465-89952453
  misc_feature 1..988: note = hyper
  source 1..988: mol_type = genomic DNA
cggaatgcagggccttaggaaagccctgtccggcgttccagccacaggggtcacacttgcatcaacatgcgggcacgctgccccttgggtaccccaaacattgagcaaaatattggaaaggtggaccgaggtgtctgtggtgcctgccagcattggtcgggtgggccccagctgtaccctgggttcccctactttcccccagttgggccccacatctgggtctggctcttaagtcttgggcatatgggatagagaatttaaggatccagatactttgcaatccccgggctagtaggaggaaaagtggctcctctgggaacccggatgggccgaacagcagcttccggcagaggccctcaggtttcagagttctccaagtggggagaagggcggcctgctcagcccgcgcacccgtggcagcaccacagagggaataaaagcagggtaaacaatttgaagatccccacgaaggcaagagagtaaatttacaaactcatttgcgtccggaatacttgcttctttttcactcatacattccttctaaaatgtgggctttctgtgtacatgggcgcgcattcccaggactcggttccctgggtggaattcacccaggaatacaatcgattttctgaacctgcgtaaggccacaggcagctctgaaaatgaaagcgtttgctaagtgggggagatctcaccgatcgaacgtttaaaaatggctttgtcttcattcagctctcccgatttattctgtgttttacaaatagaagctcagagcttctgtcgcccagtccttgcatgactcatggcggtggccacacgggtttcagggataacgggatgtttagaaaatcgctgcatatcggagtttcctagcacgttccatttatactgaacgcaggcggccgctgaaaatccagcctcgactcttgctaatgactgggtaggaccctcggggtcctgcgacggtgctggagggtgttcccggctc

SEQ ID NO: 78143 - DNA, 431 bp, Homo sapiens
  misc_feature 1..431: note = chr15:89952699-89953130
  misc_feature 1..431: note = hyper
  source 1..431: mol_type = genomic DNA
cgctccaaacacagatgctcatttttggaatattctagaaaaataacaagatcttgtttgtcgttatgattcacgggaggtaactgatgggagggccatttacatgagggcagacactgtggggcgaaggtgacttctggacgtaggctttaaagtaggaacggctccaaattcccaatatctccggccttaccggttgcaaatcggacccctgcgggaaaaccagacacttctgtttcgtggctttcgggctgcctccagcccacgcaggctcgtttagtccccgtggagtcagccccgagccttcctagtcctggaacaagggctccaggtcgcggccgcgggaagccgccaagagggcggggagtagggattccctccagctccgcagggcatctcacaagcgccttcttctgcgccatctccccacc

SEQ ID NO: 78144 - DNA, 645 bp, Homo sapiens
  misc_feature 1..645: note = chr15:89954197-89954842
  misc_feature 1..645: note = hyper
  source 1..645: mol_type = genomic DNA
gcttaactcccatgacgtcagatcaccacttagagcgtcttgatgcccaggctagaaggatctcggttgcaccagctttccccactgcagtttcaggttttgtcccgacagactttcagcaagcggcttagctcagccctggcgctgccttccaggaaagaggggcagcagcagcctcggctgagccgggtgcccttgtgggctatctggtgggggctcgcgggtccttgccttctctgcctggggtaggtgggaggtaggttcttgaacttcccggggcttctccctggcacactttggctgccacatcacggatggaaacgctgaggccaatgggctcaggttcgctagcagcaggcagccggccctggtgtgcccgctgtggcctgggtgctctgcatacccccgcgcgcgcttgctctgtgtggggggctggcagataggggtgttcctaggggccacgcggggggaagggggtggcggggccggtcttgcgcttcccacgctccatctgttcagttcactctggtggtctctgttccagtctggcctagggatccctggctccccacggccaagccgagaactagcgggcgcaggttgcattgtgcagactcccggggtcaggtcgcagggtcacgtgca

SEQ ID NO: 78145 - DNA, 184 bp, Homo sapiens; identical to SEQ ID NO: 35932
  misc_feature 1..184: note = chr15:89955001-89955185
  misc_feature 1..184: note = hyper
  source 1..184: mol_type = genomic DNA

SEQ ID NO: 78146 - DNA, 54 bp, Homo sapiens; identical to SEQ ID NO: 35933
  misc_feature 1..54: note = chr15:89956300-89956354
  misc_feature 1..54: note = hyper
  source 1..54: mol_type = genomic DNA

SEQ ID NO: 78147 - DNA, 151 bp, Homo sapiens; identical to SEQ ID NO: 35934
  misc_feature 1..151: note = chr15:89956422-89956573
  misc_feature 1..151: note = hyper
  source 1..151: mol_type = genomic DNA

SEQ ID NO: 78148 - DNA, 221 bp, Homo sapiens
  misc_feature 1..221: note = chr15:89959838-89960059
  misc_feature 1..221: note = hyper
  source 1..221: mol_type = genomic DNA
gtgcttttgaaccaacgcagacctacagggccgacttcctgagggcgaatgtcgctttgctgcagcggggcacgggtttggttcccggcggggcctggcctgggaagcgcggggctgagggcgatgcccggccgctatcccgagtcggtgcgtgcctatgctgcaggagggccaccaggagctctgcttctccgctgcacccggctcggagcaggcactca

SEQ ID NO: 78149 - DNA, 148 bp, Homo sapiens
  misc_feature 1..148: note = chr15:89962805-89962953
  misc_feature 1..148: note = hyper
  source 1..148: mol_type = genomic DNA
aactcgggctgcctccgttggggtcaccgacagaggctcacttgttcaggcacttcctgggtcagcctttccgcctctgagacgggctctcccatctcagatgggagattctgcctggaagggaagtagtccacgccatcatcattcc

SEQ ID NO: 78150 - DNA, 629 bp, Homo sapiens
  misc_feature 1..629: note = chr15:90039431-90040060
  misc_feature 1..629: note = hyper
  source 1..629: mol_type = genomic DNA
tctgacaatttcccacgcatgccctgcagaggccggcgagatgcggagtccgcggctgcagggtagatcccctcctctgcccagctctgggccgagcccttggccaggtggggaccggcgcggatatgcctccgctgggcctgcaggcggcgagacttacttgggtagcgatagtagaattcgttctccatgtcgctcaagttcttgtgcgtcctctctgaccaccagtgggcgtcggcctcgaagtcgtagcgcacgaacaccccgaagagaatcaccataatcacctgcaggagcaggcaggtgagcggcagccgccagcggaggttggtgttccaggccatgctgcaggggtgcctggccgggctggcagcgggcggttcggacgctcggaggccggcggggcttttgagacccgggcaggggggcggggcggccacgtggggcacggagcagctgactcgggcaccgcccgcgcgctcgcccaactggcaggggcccaacccaagccgagggccccaaaagattccccgcgtcgggctgggggacagcggcaggagcagaggctaaggcagtgggcaggaggatcagggtgccccaaattctgtgtgtcccgttgatactggggc

SEQ ID NO: 78151 - DNA, 329 bp, Homo sapiens
  misc_feature 1..329: note = chr15:90109270-90109599
  misc_feature 1..329: note = hypo
  source 1..329: mol_type = genomic DNA
tttctcatcttaattaaaatatcttgagtttactagttggctgggacacaacactcgccacctcgccacacttgttttttgtttttttttttctggagcagtttagccaactgaaaacaatttcaatccaatcactgatgtaaaccgaaggtatgagagccataacccaggttcgatttttgcttttttacaaatatgcttttcaggggtagaaattccatgctattaggctgttcttaaacttttccattagaaaaatgccataggaatgcagaaaagggtgtggtaattccgcctggggaattcaggaagagcgagagagaagctac

SEQ ID NO: 78152 - DNA, 257 bp, Homo sapiens
  misc_feature 1..257: note = chr15:90198157-90198414
  misc_feature 1..257: note = hyper
  source 1..257: mol_type = genomic DNA
acccctccgcgtgagcgttccgagcccggtgcagtcccggcttccgcgcgcccctgctctccgcacagcgctcccgctccgaaggtgctctgacaaccccgcaggcgctattcggagccggggcagggcagctggggctggaggcggcgggcgcgggacggagctccatgaaagttggaagaagtgattacaaatcgggacccgactctcgcagccttggcgctcgcccctccacgcaggcccgggatgccggcctc

SEQ ID NO: 78153 - DNA, 102 bp, Homo sapiens
  misc_feature 1..102: note = chr15:90293464-90293566
  misc_feature 1..102: note = hyper
  source 1..102: mol_type = genomic DNA
ggagagacggaacagcgcagccctcaagcactggtggccttgtgcgggtgtccgcgctcgtgggctccactctcagggggcccctagcgaggggagacccag

SEQ ID NO: 78154 - DNA, 62 bp, Homo sapiens
  misc_feature 1..62: note = chr15:90304847-90304909
  misc_feature 1..62: note = hypo
  source 1..62: mol_type = genomic DNA
gcctgggacctcatacgagctgcctggttcaggcccttggctagctccgggtgctccatctg

SEQ ID NO: 78155 - DNA, 158 bp, Homo sapiens; identical to SEQ ID NO: 35939
  misc_feature 1..158: note = chr15:90319855-90320013
  misc_feature 1..158: note = hyper
  source 1..158: mol_type = genomic DNA

SEQ ID NO: 78156 - DNA, 25 bp, Homo sapiens
  misc_feature 1..25: note = chr15:90320089-90320114
  misc_feature 1..25: note = hyper
  source 1..25: mol_type = genomic DNA
cgtggccccgcagaggcgcagacgc

SEQ ID NO: 78157 - DNA, 46 bp, Homo sapiens
  misc_feature 1..46: note = chr15:90349846-90349892
  misc_feature 1..46: note = hypo
  source 1..46: mol_type = genomic DNA
aggccaggcagagaacggagcagccccaggccgggcttatatcccc

SEQ ID NO: 78158 - DNA, 177 bp, Homo sapiens; identical to SEQ ID NO: 12318
  misc_feature 1..177: note = chr15:90357883-90358060
  misc_feature 1..177: note = hyper
  source 1..177: mol_type = genomic DNA

SEQ ID NO: 78159 - DNA, 348 bp, Homo sapiens
  misc_feature 1..348: note = chr15:90358102-90358450
  misc_feature 1..348: note = hyper
  source 1..348: mol_type = genomic DNA
cgtctttttaaagggaagtaaccggacccgaccactactccacccgattcacccctagcgggccgcccgcccgcagctccgcccgggctcctcccccgtccgcccgcggcttcccgggagccccccagggctcctccgctcctccgacggcccggccttccccccggggcctgggatgcaccagggctcctgctgcccccgacggggtccctgtcgccgcagcccgcgggacccgccggccacatctggacggcatctgccgcgggggaggggctcagagcctcgccctgagtgtcccgcagggagccttgtgcatccggggcaggaagccagcgcatcccgtgcaga

SEQ ID NO: 78160 - DNA, 157 bp, Homo sapiens
  misc_feature 1..157: note = chr15:90455810-90455967
  misc_feature 1..157: note = hyper
  source 1..157: mol_type = genomic DNA
caggggcgccgggagcggcggactggaggggcggactgaaggcggagaggcggctttggcaaccccagttttcccccacccgcatcccacccccccacccgatcctgttgcggggttcgagccggggcaggggaggccgacccgaggccgtgagccc

SEQ ID NO: 78161 - DNA, 30 bp, Homo sapiens; identical to SEQ ID NO: 44342
  misc_feature 1..30: note = chr15:90501049-90501079
  misc_feature 1..30: note = hypo
  source 1..30: mol_type = genomic DNA

SEQ ID NO: 78162 - DNA, 149 bp, Homo sapiens
  misc_feature 1..149: note = chr15:90501280-90501429
  misc_feature 1..149: note = hypo
  source 1..149: mol_type = genomic DNA
actcttctacctgtccggagggcctctctgccccttcctcccacatgctctaagcttggaggaggagttgctaagtgttaattgggtcctgtttggcagcggatggggtcactgtgttgaacatacctcatgcccgatgctccctaggc

SEQ ID NO: 78163 - DNA, 218 bp, Homo sapiens
  misc_feature 1..218: note = chr15:90541900-90542118
  misc_feature 1..218: note = hypo
  source 1..218: mol_type = genomic DNA
ttggtgcttatgtaccggacaccatgctaggtgtggggtttgagcctcacaacaaactgtgaagcaggtatttttatccctattttacagaaaagttagagaggttgacttgcccaggaatatgcagcaggtaagcctgggcccttaaactaagacactgtctctgcaatccacaggtcttcttacctgcattttatatgtcccgaaattaagtcgaa

SEQ ID NO: 78164 - DNA, 58 bp, Homo sapiens
  misc_feature 1..58: note = chr15:90630550-90630608
  misc_feature 1..58: note = hypo
  source 1..58: mol_type = genomic DNA
tccctccctgagcctcggagctgagccaaatgcactctaatagcgaccttcccagggt

SEQ ID NO: 78165 - DNA, 43 bp, Homo sapiens; identical to SEQ ID NO: 44345
  misc_feature 1..43: note = chr15:90667422-90667465
  misc_feature 1..43: note = hypo
  source 1..43: mol_type = genomic DNA

SEQ ID NO: 78166 - DNA, 82 bp, Homo sapiens; identical to SEQ ID NO: 15920
  misc_feature 1..82: note = chr15:90703242-90703324
  misc_feature 1..82: note = hypo
  source 1..82: mol_type = genomic DNA

SEQ ID NO: 78167 - DNA, 29 bp, Homo sapiens
  misc_feature 1..29: note = chr15:90741425-90741454
  misc_feature 1..29: note = hypo
  source 1..29: mol_type = genomic DNA
ggcgtgagccaccgcgcctggctggtaaa

SEQ ID NO: 78168 - DNA, 30 bp, Homo sapiens
  misc_feature 1..30: note = chr15:90747910-90747940
  misc_feature 1..30: note = hypo
  source 1..30: mol_type = genomic DNA
ttcccagcctggccacgtggggagaaacaa

SEQ ID NO: 78169 - DNA, 30 bp, Homo sapiens
  misc_feature 1..30: note = chr15:90753833-90753863
  misc_feature 1..30: note = hypo
  source 1..30: mol_type = genomic DNA
tgacatgacttaatccgtttaaagggctga

SEQ ID NO: 78170 - DNA, 296 bp, Homo sapiens
  misc_feature 1..296: note = chr15:90755756-90756052
  misc_feature 1..296: note = hypo
  source 1..296: mol_type = genomic DNA
actgaccccaaggtgcgccagcccctcgcaggaagtaaagtgcagaaacacctccacccctgcacaaagagcacctaggagtgagtgcgcaagcgtggacaagccctgcggtaccgtgtacacacacacacacacacacacaccacaggcaagctcaggcagggtccttcacagacgtctgcagtcactctggaggtgacccaagcacctgggcccttagacagtaacaccactcacaccgagcacagaccagctcgcgcccacaacacgagcctgtgacacgcaagtctctgttt

SEQ ID NO: 78171 - DNA, 30 bp, Homo sapiens
  misc_feature 1..30: note = chr15:90835095-90835125
  misc_feature 1..30: note = hypo
  source 1..30: mol_type = genomic DNA
attctagtggggccccggttatgcctcttc

SEQ ID NO: 78172 - DNA, 158 bp, Homo sapiens
  misc_feature 1..158: note = chr15:90859564-90859722
  misc_feature 1..158: note = hypo
  source 1..158: mol_type = genomic DNA
aactatgagatttaccgagccacatggcctggagatggaaacatcctcagggaatggtctggtgccagagactgttcccttaatgggcttttactgttcccttagtgggcttttactactgtgtgtttgattcgcttcatatacacacaggcaacttg

SEQ ID NO: 78173 - DNA, 80 bp, Homo sapiens
  misc_feature 1..80: note = chr15:90866273-90866353
  misc_feature 1..80: note = hypo
  source 1..80: mol_type = genomic DNA
taaggaaaagaccaccgcagtggctcagtgctcttgctgacgtgccccactgcacttttctgcaacgttccttctttcta

SEQ ID NO: 78174 - DNA, 36 bp, Homo sapiens
  misc_feature 1..36: note = chr15:90891911-90891947
  misc_feature 1..36: note = hypo
  source 1..36: mol_type = genomic DNA
gagcatgtgaaaatgcgttgacggtgtgtgcggtgt

SEQ ID NO: 78175 - DNA, 100 bp, Homo sapiens
  misc_feature 1..100: note = chr15:90896116-90896216
  misc_feature 1..100: note = hypo
  source 1..100: mol_type = genomic DNA
tcccctcctcagtggcgctgtctccagcaagtgggccctgcagctgtgttttgtaatgaatgtagaaataaaaattatactcaaaactcttttttttttt

SEQ ID NO: 78176 - DNA, 98 bp, Homo sapiens
  misc_feature 1..98: note = chr15:91185735-91185833
  misc_feature 1..98: note = hypo
  source 1..98: mol_type = genomic DNA
agaaccactgatctccgtccgcaccgaaggcgggcccggagtgggaggctcggcctggggcggcggcaccggagagggcacctcgatgcctgctctga

SEQ ID NO: 78177 - DNA, 132 bp, Homo sapiens
  misc_feature 1..132: note = chr15:91189343-91189475
  misc_feature 1..132: note = hypo
  source 1..132: mol_type = genomic DNA
acctgggccagctcccgccgtgtcccagctgctccccattccgtcccatggcccgtcgcgccttccccagcgtccctatgccttacgaggtcctgtttccacgtcaacctgaccttccgcaaggacttgctg

SEQ ID NO: 78178 - DNA, 25 bp, Homo sapiens
  misc_feature 1..25: note = chr15:91313690-91313715
  misc_feature 1..25: note = hypo
  source 1..25: mol_type = genomic DNA
ccaccgtgcccggccaatccccaca

SEQ ID NO: 78179 - DNA, 27 bp, Homo sapiens
  misc_feature 1..27: note = chr15:91366968-91366995
  misc_feature 1..27: note = hypo
  source 1..27: mol_type = genomic DNA
atagaccctggccaacggatgaaatga

SEQ ID NO: 78180 - DNA, 214 bp, Homo sapiens
  misc_feature 1..214: note = chr15:91409404-91409618
  misc_feature 1..214: note = hypo
  source 1..214: mol_type = genomic DNA
tcacatataactcatcgctatcacagcccctctccttgctcacccgcctcgctgaggggctcctgagaacctccgtagaggtctccatcagccaaaaagcatctgcaccgtcagagagggcccctcactgccgctcgcagtgctccctgctgccacgtgcagccccttgagcatgagcctgttgacacaggttggcacacggtgtctggcttct

SEQ ID NO: 78181 - DNA, 191 bp, Homo sapiens
  misc_feature 1..191: note = chr15:91427788-91427979
  misc_feature 1..191: note = hyper
  source 1..191: mol_type = genomic DNA
ggggcctggaggagcggtgggagctgggggcgcggcaggcaggggcagagcaggcgttccgagggccagagacccacccaggtgggggtaggggccgcggaagggcggggatggccgcaggggcagggctcaggctgtgggcgcctgaggcttcagctggggcaggcttggcctgtcgaggacctgggcaa

SEQ ID NO: 78182 - DNA, 61 bp, Homo sapiens
  misc_feature 1..61: note = chr15:91500770-91500831
  misc_feature 1..61: note = hypo
  source 1..61: mol_type = genomic DNA
gagaagcaagcggagcgggaccccttaatgcgactgtagctgacgacggtctcccttgctc

SEQ ID NO: 78183 - DNA, 30 bp, Homo sapiens
  misc_feature 1..30: note = chr15:91504803-91504833
  misc_feature 1..30: note = hypo
  source 1..30: mol_type = genomic DNA
aagacccagtggagacgatggcaaaggggc

SEQ ID NO: 78184 - DNA, 863 bp, Homo sapiens
  misc_feature 1..863: note = chr15:91642936-91643799
  misc_feature 1..863: note = hyper
  source 1..863: mol_type = genomic DNA
tcctgatgaggcaaacgagaacaaagcagtcgaacagcaccatgatcgacgatactttgggggcggcgtgatcagaggattccccttcccgggaacttgcgtctagtcctctgacgcatcctagttcggagtgggtggaagggcatgtggagtccacagcgccccctcgccctaggcggggtggagacagcgagacgacgcccatgatcagctggttacaaaactcgaggaataagaagtttaatatttattggtctgcaaatccggagaccttgcggcctcactggtcctccttccctctgagctatctccacacccagccttcgatcagaaggagatttagaagcagagctgcccgcagcgaatacttttaatgcccgggccgggaagaaagcgggttaggatctgatcccgctgagtagaggacccaggagcctcccgccccgcgtgctctgtagcgcgggggcgcgctgcgcgctgcgcctgggcggctggcgggggcggcgtgggcgcggtgatgcaggtgtgacacccgccggcgcctgcctccgcccggatcgcccagctccgcgttagccggagctgcacgcggggctgccggggcggacgctgctctgcctgcatccggaggcggccgccagcggatttgccacccaggtaggggactgcgttgctcgctgcggtgcaaccgacccagccggggcgcggaccccgcgtgcgccagggctcccagactcgcctgcctgggctgaaatatacacgctcgcacagctgagtgctgttcatagtaaatggcacaaaagatcggagagtcttgaaaaaccggcgcagaaaagcaaggacttgcccgctgcctggagctg

SEQ ID NO: 78185 - DNA, 201 bp, Homo sapiens
  misc_feature 1..201: note = chr15:92456345-92456546
  misc_feature 1..201: note = hypo
  source 1..201: mol_type = genomic DNA
ttcgtttctgaacagcggcaaacacctggtgttttaaaagtaacagtctaatcacataactagggctgagtgatctgcaagctggccttgacttgtctagaaagcacaatagaaataggagttgggatcagaatgccagagatagagggtgtcacagatgtcataaccctgctctgcagagcttgccgaaggccagggctg

SEQ ID NO: 78186 - DNA, 361 bp, Homo sapiens
  misc_feature 1..361: note = chr15:92459330-92459691
  misc_feature 1..361: note = hypo
  source 1..361: mol_type = genomic DNA
agctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgacctcatctgccgcaaccggacggctaccaacatgatgtacttgctgctcattggggcccaggtgctcctgggcatcggtgctacccctgtgcagcccctgggcgtctcctacatcgacgaccacgtgcggaggaaggactcctcgctctatataggta

SEQ ID NO: 78187 - DNA, 30 bp, Homo sapiens
  misc_feature 1..30: note = chr15:92687159-92687189
  misc_feature 1..30: note = hypo
  source 1..30: mol_type = genomic DNA
cgatgtggggagccacgtggcctgcagcag

SEQ ID NO: 78188 - DNA, 221 bp, Homo sapiens
  misc_feature 1..221: note = chr15:92701704-92701925
  misc_feature 1..221: note = hypo
  source 1..221: mol_type = genomic DNA
tggttatggaggggacgcataatggatgtggagcactctatacagtcctgggtagggggtagttaatgatactacttagcatgacagttgccagtcacactgtcacagtctcccatttgtctatggggaaccagctccttgcagggactgcctgagtttttgtttggtccaactgagtgacgaacatataaggatgtggggctgggcgtgaaaatgagtca

SEQ ID NO: 78189 - DNA, 30 bp, Homo sapiens
  misc_feature 1..30: note = chr15:92911893-92911923
  misc_feature 1..30: note = hypo
  source 1..30: mol_type = genomic DNA
atcactccccaccttcgtcatctccctgca

SEQ ID NO: 78190 - DNA, 80 bp, Homo sapiens
  misc_feature 1..80: note = chr15:92936360-92936440
  misc_feature 1..80: note = hyper
  source 1..80: mol_type = genomic DNA
acccggcgtcagcaccgcgagggcggagggaaggcgggcgctgagtctcccattggggttctagccgagggttccagcca

SEQ ID NO: 78191 - DNA, 992 bp, Homo sapiens
  misc_feature 1..992: note = chr15:92936662-92937654
  misc_feature 1..992: note = hyper
  source 1..992: mol_type = genomic DNA
ctgcctggctgaaaccgccttctcgccgcgcgctgggggctgtccccaggtgttggtctttgtgtcgagaaaactttgcgaggaggcgagggagctggacaaagagcgggcgagggagggcgtttgccagcctgaggggtgcgccgggcggtgcgcgcacttccctgggctcagctccgtacccggtcgctcgcggtggccagagcccagtctctctaggccaggagtggcgtccggctgcatccccgcgccctcgggagctgaataaagccaggcgggagaagcaaaggctagcgcctggacgctggagttggtgggaggaggcgagcagaggcgcggagcaaagctgtcaaactgcgcgcggagccgggcgcggggcgggggaagggagaggagggagggaggggcaggcgggagccgggagggagcgagcgggctcgccgcgcctgagcaacccctgcctgtcgctgccgctgccgctgccgctgccgccgccggcccggactcgtccggagcgcagggtgtctgcccagctgcgcgcggcgcgcggaggctccggcgtccgccgctgcgccctccggcccctgctcctcgcgccggcccgcgtgggtcccggcgggcgcgaacccaccatgcagctgcagttccggagctggatgctggccgcgctcacgctgctcgtggtcttcctcatcttcgcagacatctcagagatcgaagaagaaatcgggtaaatagctgctcccaggcccgtgccacgagccctggcgggatctctccctccttctgtactctccaccctccgaccccctttgtgtgcgccgcgccccgctgtagctccgctggagagatggggacggtttggcagaaggtggcggcgacaggggcccgggacggtttggggagaggagggtgggggcgcggctgctgtggggtgtccccgggcggggttcacgggaagcccccagctggcccgcgtcgggaagcggact

SEQ ID NO: 78192 - DNA, 39 bp, Homo sapiens; identical to SEQ ID NO: 35949
  misc_feature 1..39: note = chr15:92937696-92937735
  misc_feature 1..39: note = hyper
  source 1..39: mol_type = genomic DNA

SEQ ID NO: 78193 - DNA, 325 bp, Homo sapiens; identical to SEQ ID NO: 35950
  misc_feature 1..325: note = chr15:92937736-92938061
  misc_feature 1..325: note = hyper
  source 1..325: mol_type = genomic DNA

SEQ ID NO: 78194 - DNA, 172 bp, Homo sapiens
  misc_feature 1..172: note = chr15:92938122-92938294
  misc_feature 1..172: note = hyper
  source 1..172: mol_type = genomic DNA
cgccgcccggtgggcttctgggccctcaggcgggcgatctggcgctttttttctcccgacctcgccagaggtagggtgggaccgcgagcccggatcctcccggctccggacttcctggagtgcgcacttgaggcgcgggacgcaccggctgtgtgtcccaggggctgagact

SEQ ID NO: 78195 - DNA, 219 bp, Homo sapiens
  misc_feature 1..219: note = chr15:92938315-92938534
  misc_feature 1..219: note = hyper
  source 1..219: mol_type = genomic DNA
cggctcgccgggccgggcccctctccggaacctccaaagggcggtagacgacaggtggggaggcagccggggttctgaggaggcccgaggagagcttcctggccctgggcaaggggaaggtgaggtctcaaagagggcagaaggtctcttcttctgtgggatttgtgctctgccaggcgctcttctcgagtcccgcgccgcgtgcgcccctcctttgtc

SEQ ID NO: 78196 - DNA, 193 bp, Homo sapiens
  misc_feature 1..193: note = chr15:93160460-93160653
  misc_feature 1..193: note = hypo
  source 1..193: mol_type = genomic DNA
aattgtatatgtagacgtaaaaacagcatgcatgcccctccaccaccaagcctttttcatttccaagcttttctctaatcaccaggatccaaacacctccagcccagctcccatccccgccctcctcctcagccttgggcccacccacctctgtcttcacaaaaggtgccccgctggccggcaccacagaaaa

SEQ ID NO: 78197 - DNA, 649 bp, Homo sapiens
  misc_feature 1..649: note = chr15:93198390-93199039
  misc_feature 1..649: note = hyper
  source 1..649: mol_type = genomic DNA
ccccacccactctcccgggcagggcaggaggcacacggctggctggggcgcaccagggcacctgtgcgtgcaggtggggcgggcgcgcggcgacagcaggttggcgatgccgccctgtcggccggcgggggaaggaagagggcgggagggcccacctgaagacgcgcagcagcaggcaggcgatgaggagggtggtaaaggcgaacgccacgatcacggctgccttgagggtgggtaggtcgcggaggaggatggaaatgcgggtcaccaaggcgtcgccactgctgttggagctggagctgccgctgccgcccgccgccccagacccaaaccgggtggtgttcccgggccccgggccgggcggtggccgcgactcgcgctcgggttcgggccacggcgcggagacggactcggctctgctggcgcgggcggcgggagcggccaggagcgcgagcagcagcagcggcaggagcggggcgggcagcggcacggcgcgcatagtgcggtgggtcggcacaggatcgggcagggcgcgcgcggctgagctccaggatccgcaccagcacggaggcctgcaccgggggatcctgcggcggaggcggctgcgcggtgcttggcaggaagctgcggcgcccggaagagcccgcgc

SEQ ID NO: 78198 - DNA, 346 bp, Homo sapiens
  misc_feature 1..346: note = chr15:93257518-93257864
  misc_feature 1..346: note = hyper
  source 1..346: mol_type = genomic DNA
cagggccggggagagcggggagaggggagcgggagttatcatttcacggacgcgatgtttcgtcccctttgatgaagcgttctggagatgggcagtggcgacactcgcccatatacgcaacggctgagtgcactccatgccaccgaactggttaagatggtaaattttctgttgtgtgtattcaaccacaattttttaagccactttctccgttctttcattgagaactccggggatcaaagaagaacgccagctgcggtggaccgctgaggaatggccggagtccgggcgcgagcgccgcttcccctcgccctcctcctctcccttcccgcggcccctggaggcc

SEQ ID NO: 78199 - DNA, 160 bp, Homo sapiens
  misc_feature 1..160: note = chr15:93360190-93360350
  misc_feature 1..160: note = hypo
  source 1..160: mol_type = genomic DNA
aggtaagattgataccgtattcatttttatgttcctaggatccattgcaaagtgatacacgtgcacatacacatttttttaagtcagttttaatctctttacattttttaagagttaatggatggatggccaggcgcggtggctcatgcctataatccca

SEQ ID NO: 78200 - DNA, 141 bp, Homo sapiens
  misc_feature 1..141: note = chr15:93364648-93364789
  misc_feature 1..141: note = hypo
  source 1..141: mol_type = genomic DNA
tgtctcgggggaaaaaaaaaaaaaaaaacttacacctagatctgatcttatggcaccactataattattattagattataaattccttggggataggaactttgtttcttatccatctttgtatcccgaaagtggctctgc

SEQ ID NO: 78201 - DNA, 340 bp, Homo sapiens
  misc_feature 1..340: note = chr15:93594841-93595181
  misc_feature 1..340: note = hypo
  source 1..340: mol_type = genomic DNA
tgaaaaccagcagcccgcagtggcctcgtggggccgctcagaatatgccaggttctggagtcacccgggcctggggcaaattctagctcagcattccagctgactacgcacttggggtgggaaggtcacttggcctcttagagcatcaggctccccatttgtgaagtggagctatgcctgccaggccgggctggctcgaggaaggagggaggaagctgagacccacccccttgggatgctcagggagggtgctcctgtgtccccgctccgctccgtcttcccccattcccaggcacccgaggccctctcagcctctcagtgtccacgcagggcagagaca

SEQ ID NO: 78202 - DNA, 98 bp, Homo sapiens
  misc_feature 1..98: note = chr15:93595410-93595508
  misc_feature 1..98: note = hypo
  source 1..98: mol_type = genomic DNA
tgtgaaagctcttctcgtaatggcagatctcggggctgtccgagcgctcctggctgtctccggccggtgggagcgtgcgcaggcgtggctgcgaggtg

SEQ ID NO: 78203 - DNA, 589 bp, Homo sapiens
  misc_feature 1..589: note = chr15:93609289-93609878
  misc_feature 1..589: note = hypo
  source 1..589: mol_type = genomic DNA
gcaactgagggaggccgggggatgaatcggcgaaacttacgtaggttgggggcataacagctgcccttcacgggcacctccccgggcccagttacattagcggcttctgcacccttctctccttccacgacatcaaattccacagtctcctcatctccaacgctgcgcagaaacttcctgggcttcttttaatagctgtctggtgaacaaagacatcttccttggcgtcattcctgtggatgaatccgtaaccattccggacgttgaaccatttgacagtgcccaggactcggagtgccagcagcaccagcttgttcgcgtgactccaggtgggggaaacggggggcgggggtttccaaggccgccgtcgttgccagggctgccgccgggttgccacgggtgcgggggccaggcaccaagggggtcccatcccagcagcggggcccgaggcgactccgcccctgccaccgccctccccgccacctgctttctggggcttccctgcgggcactggtaccaccaccgctaccaccccgggcatcgtcgccgtggggactgccgtcaccaccgccgccgcctccacctcgct

SEQ ID NO: 78204 - DNA, 84 bp, Homo sapiens
  misc_feature 1..84: note = chr15:93615607-93615691
  misc_feature 1..84: note = hyper
  source 1..84: mol_type = genomic DNA
ccagctcatttgagccgagtccgtgggtgtccccgcgtggccaaatgggtggaaacgagacgaggtctccggggagggggctgt

SEQ ID NO: 78205 - DNA, 478 bp, Homo sapiens
  misc_feature 1..478: note = chr15:93615901-93616379
  misc_feature 1..478: note = hyper
  source 1..478: mol_type = genomic DNA
tgcgccctccccacacggctccatctcacggcaactcgggcagggtgcccctctccgggtccccaagggcaggcatcgcacccacgacggggtgcgggagaaacaaaagacccgtggaaataggaggcggggtccggaggaggtccggagaacttgagcccggactcactcgcgcacatctggcccagcattgaggggcggcccagggacccggccccgcgcgcccggccggcagtgccttacctgcggggaagctgcagagaaggaaggcgagggtcggccagaatcccagggctgaacgtcctgcccctctccccatacccatccatccagctcggcctgttaccactagcctctccctggaagaagagttcagaaaaaaagaagaaaataaatcacgctgcgaagaaagggcagcctcgctccgccggcgggagcagcgagccgggaggctccgtccacctcggccgcgggcgcc

SEQ ID NO: 78206 - DNA, 357 bp, Homo sapiens
  misc_feature 1..357: note = chr15:93616396-93616753
  misc_feature 1..357: note = hyper
  source 1..357: mol_type = genomic DNA
cgcgccgccccccgcgcgcccctccctcgccatccatcactcggttctccgccaatgtcgacgcggccccgcgccccagccgcctgcgcaccgccccctcgcgctcgggtttcagcgaggccggcgaggtagccggaggcggccgggcggggacccaggctgcccggccgcagcgctcgccgtgaggacctcggaaaaccacggccctagatcagagggcgcgccacgctccccgaccctcgcgccatctccagcccgcggctgtccttgcaaaccaggcccagcacccttgggaggccgcagggcatgaggcggggcaggacgcccccttaatcccctccacgaatatccaatcca

SEQ ID NO: 78207 - DNA, 1098 bp, Homo sapiens; identical to SEQ ID NO: 35956
  misc_feature 1..1098: note = chr15:93631632-93632730
  misc_feature 1..1098: note = hyper
  source 1..1098: mol_type = genomic DNA

SEQ ID NO: 78208 - DNA, 535 bp, Homo sapiens; identical to SEQ ID NO: 35957
  misc_feature 1..535: note = chr15:93632731-93633266
  misc_feature 1..535: note = hyper
  source 1..535: mol_type = genomic DNA

SEQ ID NO: 78209 - DNA, 30 bp, Homo sapiens
  misc_feature 1..30: note = chr15:93689707-93689737
  misc_feature 1..30: note = hypo
  source 1..30: mol_type = genomic DNA
actagctggctccgccgcctctccctgggg

SEQ ID NO: 78210 - DNA, 39 bp, Homo sapiens
  misc_feature 1..39: note = chr15:93792256-93792295
  misc_feature 1..39: note = hypo
  source 1..39: mol_type = genomic DNA
aaaaaaaaaaaaaagtgagaacagcgacagtacatgcaa

SEQ ID NO: 78211 - DNA, 156 bp, Homo sapiens
  misc_feature 1..156: note = chr15:93798049-93798205
  misc_feature 1..156: note = hypo
  source 1..156: mol_type = genomic DNA
tcacttttggagtgtcggagacactttacgtcggtgctcctctaagtatgttccatggaccagtgcttcctgagagctatttgttaatgggttggcaggagaagtacggagatagagtgcttaggaatttccatagcatctcgatattgccagacc

SEQ ID NO: 78212 - DNA, 185 bp, Homo sapiens
  misc_feature 1..185: note = chr15:93820319-93820504
  misc_feature 1..185: note = hypo
  source 1..185: mol_type = genomic DNA
tcaatattccgccctcgaggaggtggagcgtaactcctctctcctttcatgtgggctgtgcatcgggacttccatccagagagtacagtgtggaaggaggaactccaaaggagtacggtggagacacctgacaaacaccacctcaatcaggtggtcaaggttaagagcaacgaaccatgctaact

SEQ ID NO: 78213 - DNA, 33 bp, Homo sapiens; identical to SEQ ID NO: 44362
  misc_feature 1..33: note = chr15:93902389-93902422
  misc_feature 1..33: note = hypo
  source 1..33: mol_type = genomic DNA

SEQ ID NO: 78214 - DNA, 30 bp, Homo sapiens; identical to SEQ ID NO: 15927
  misc_feature 1..30: note = chr15:94347602-94347632
  misc_feature 1..30: note = hypo
  source 1..30: mol_type = genomic DNA

SEQ ID NO: 78215 - DNA, 30 bp, Homo sapiens
  misc_feature 1..30: note = chr15:94347911-94347941
  misc_feature 1..30: note = hypo
  source 1..30: mol_type = genomic DNA
atgtcccttggcatacgtagcactctgttt

SEQ ID NO: 78216 - DNA, 157 bp, Homo sapiens
  misc_feature 1..157: note = chr15:94443196-94443353
  misc_feature 1..157: note = hypo
  source 1..157: mol_type = genomic DNA
agctaggcgcggagccgcaaggggtgtgtgggtgaacgagcgcagggaccggcaacagccatacataccggctgctgcagtggggctggcagctccaggcgccagcacagttgtggctctgcgtgaggctggaccagatggacggcatgtggattct

SEQ ID NO: 78217 - DNA, 40 bp, Homo sapiens; identical to SEQ ID NO: 44364
  misc_feature 1..40: note = chr15:94478454-94478494
  misc_feature 1..40: note = hypo
  source 1..40: mol_type = genomic DNA

SEQ ID NO: 78218 - DNA, 197 bp, Homo sapiens
  misc_feature 1..197: note = chr15:94495950-94496147
  misc_feature 1..197: note = hypo
  source 1..197: mol_type = genomic DNA
ataataagatgtatgcgaggttcactcatgcaacccactgtgccattgggaaatgcaggaatgggcatgcaggactttcatagctcagatatgctcaggagcaagtcatgcagcacaattgactagtaggaaacaaaagggagaggggatggtatcagtagaatgagagacggggaaaataccgactccaagggatg

SEQ ID NO: 78219 - DNA, 19 bp, Homo sapiens
  misc_feature 1..19: note = chr15:94557099-94557118
  misc_feature 1..19: note = hypo
  source 1..19: mol_type = genomic DNA
tttttttttttgagacgga

SEQ ID NO: 78220 - DNA, 30 bp, Homo sapiens
  misc_feature 1..30: note = chr15:94736260-94736290
  misc_feature 1..30: note = hypo
  source 1..30: mol_type = genomic DNA
gccattaagaaaatgcgtattaaagccaca

SEQ ID NO: 78221 - DNA, 33 bp, Homo sapiens
  misc_feature 1..33: note = chr15:94774077-94774110
  misc_feature 1..33: note = hyper
  source 1..33: mol_type = genomic DNA
attacagcaggaaagcggcgtaaaaaaaagtag

SEQ ID NO: 78222 - DNA, 23 bp, Homo sapiens
  misc_feature 1..23: note = chr15:94778186-94778209
  misc_feature 1..23: note = hypo
  source 1..23: mol_type = genomic DNA
agccctggtggtggtcgggcaca

SEQ ID NO: 78223 - DNA, 30 bp, Homo sapiens; identical to SEQ ID NO: 44365
  misc_feature 1..30: note = chr15:94925846-94925876
  misc_feature 1..30: note = hypo
  source 1..30: mol_type = genomic DNA

SEQ ID NO: 78224 - DNA, 64 bp, Homo sapiens; identical to SEQ ID NO: 35958
  misc_feature 1..64: note = chr15:95388665-95388729
  misc_feature 1..64: note = hyper
  source 1..64: mol_type = genomic DNA

SEQ ID NO: 78225 - DNA, 22 bp, Homo sapiens
  misc_feature 1..22: note = chr15:95507939-95507961
  misc_feature 1..22: note = hypo
  source 1..22: mol_type = genomic DNA
ccgcgcccggccaagttctggt

SEQ ID NO: 78226 - DNA, 125 bp, Homo sapiens
  misc_feature 1..125: note = chr15:95634811-95634936
  misc_feature 1..125: note = hypo
  source 1..125: mol_type = genomic DNA
aaatgtcaccacgttcgcctatttgcaatgcaaatctccaggctttggcatctgagattgatgtccctagtatgaatgtacttagttgctgggctggagctgagtggaaacgacacaggtctctt

SEQ ID NO: 78227 - DNA, 30 bp, Homo sapiens
  misc_feature 1..30: note = chr15:96663096-96663126
  misc_feature 1..30: note = hypo
  source 1..30: mol_type = genomic DNA
tgttgttgttgttgtcgctgttgctgtttg

SEQ ID NO: 78228 - DNA, 105 bp, Homo sapiens
  misc_feature 1..105: note = chr15:96864500-96864605
  misc_feature 1..105: note = hyper
  source 1..105: mol_type = genomic DNA
aaataaataaacaaacgtaggtagctatcagttgctttagggagcgcagatatttaggaaaaggccaggagcgggaaaaggaagaagaaacgaaaaagattctcc

SEQ ID NO: 78229 - DNA, 268 bp, Homo sapiens
  misc_feature 1..268: note = chr15:96864954-96865222
  misc_feature 1..268: note = hyper
  source 1..268: mol_type = genomic DNA
gtcctggggcttcctcggtgcctgtcacccagccccctgccttcctcctcggcctcagatgtcgtcccacctgcccacgagcagggaacctggaacccactctcccggcagtccccagcgggttccgccacccggcggccgcccctgacaccgagtgggtgggaggaagaggcagctggcggggatgggccattgagacctcttgaaaaatattaaaagacaggatgggtagagatttctccgggagaaagttcgagggtgcatcggg

SEQ ID NO: 78230 - DNA, 30 bp, Homo sapiens
  misc_feature 1..30: note = chr15:96865796-96865826
  misc_feature 1..30: note = hyper
  source 1..30: mol_type = genomic DNA
aaatcgttcgagccccggctatttgtgtgt

SEQ ID NO: 78231 - DNA, 75 bp, Homo sapiens
  misc_feature 1..75: note = chr15:96874258-96874333
  misc_feature 1..75: note = hyper
  source 1..75: mol_type = genomic DNA
cctatgtgtgtgaggcggcggcggcagcagcagcagcagcggctccggcggcggcagcagcggcagcagcgactt

SEQ ID NO: 78232 - DNA, 84 bp, Homo sapiens
  misc_feature 1..84: note = chr15:96876537-96876621
  misc_feature 1..84: note = hyper
  source 1..84: mol_type = genomic DNA
ttctttgtgtttctgcgagagcgactctcccggtccggagtcagataacagcctgggcccgagcctcgccggctttccccggcc

SEQ ID NO: 78233 - DNA, 30 bp, Homo sapiens
  misc_feature 1..30: note = chr15:96883798-96883828
  misc_feature 1..30: note = hyper
  source 1..30: mol_type = genomic DNA
tctgtgtgaaattgacgagatctttaaaaa

SEQ ID NO: 78234 - DNA, 74 bp, Homo sapiens; identical to SEQ ID NO: 35961
  misc_feature 1..74: note = chr15:96884425-96884499
  misc_feature 1..74: note = hyper
  source 1..74: mol_type = genomic DNA

SEQ ID NO: 78235 - DNA, 30 bp, Homo sapiens
  misc_feature 1..30: note = chr15:96889448-96889478
  misc_feature 1..30: note = hyper
  source 1..30: mol_type = genomic DNA
tctggccaggcagttcggctgcaactttca

SEQ ID NO: 78236 - DNA, 295 bp, Homo sapiens
  misc_feature 1..295: note = chr15:96897310-96897605
  misc_feature 1..295: note = hyper
  source 1..295: mol_type = genomic DNA
ctggtccctcccagccgatgtcctggagcccccattcacaaaacccctcctggaagaggacacacacccacccacccacacacacacacacacaccccacacacgcactacgagaaggggagtttgatcttgtctcattggcgtctcgggtctgaaaggaaaatcgtttgggtaaacagccaagcttccaggcttaacgcccggctcccgcccccgcccctccatcccctcctgcctcccccactcgccttcaaccccacccgccacccacactcggctccgcagccgggccccg

SEQ ID NO: 78237 - DNA, 240 bp, Homo sapiens
  misc_feature 1..240: note = chr15:96897853-96898093
  misc_feature 1..240: note = hyper
  source 1..240: mol_type = genomic DNA
ccgtgcggctggctgcgcctaggagttccgccacgggtccgacggggcaccctgggtccccgcagcccgtcacaggcgtttgcacatttgtgtgcacgaccactggcgggggcgttgagcctctgctagccgcctcgggctccgcacacccttgggtgattacccggcccccacctccctccaagcgacctcggctccaggaaaaggctttaatctgctattaagcgttttccaaagttt

SEQ ID NO: 78238 - DNA, 43 bp, Homo sapiens
  misc_feature 1..43: note = chr15:96903332-96903375
  misc_feature 1..43: note = hyper
  source 1..43: mol_type = genomic DNA
cgggcataggaggctcgagctctatcggcgtccagcccgccct

SEQ ID NO: 78239 - DNA, 326 bp, Homo sapiens; identical to SEQ ID NO: 35964
  misc_feature 1..326: note = chr15:96911366-96911692
  misc_feature 1..326: note = hyper
  source 1..326: mol_type = genomic DNA

SEQ ID NO: 78240 - DNA, 241 bp, Homo sapiens
  misc_feature 1..241: note = chr15:96911763-96912004
  misc_feature 1..241: note = hyper
  source 1..241: mol_type = genomic DNA
cgctgggatccatctcctcagccccggtttcccgctctgcgagcgggggaagaacctgggaactgcaggatccgccacctcggtttttcagacacagcctctggcctctttccttggcctgccaaacctttgttcacttctctcacccgttgtctgctctgctctatccctcagcagggttctcgtttggacaagagggcccaatcctttgctttgctactcctcgcgtcttgtagaccct

SEQ ID NO: 78241 - DNA, 490 bp, Homo sapiens
  misc_feature 1..490: note = chr15:96952609-96953099
  misc_feature 1..490: note = hyper
  source 1..490: mol_type = genomic DNA
actttctcccgcaaccgcgccccggaccgcagtaatcccggcggggcagggccggggagctggggacggggtggtctttagggtggcggcttcccccgaccccggacccgggaaccggccgccggcgcggggcgcgatctgcactgccggtcccacaggagttaaaccccgaggcagacaaaagggaggccgccgcggctcctttgctcggctgtcagttgaaaagagaaccgccgccctctggacttcaactcccgacggaaaaggcattttattatgggttatgacaagttgcagagagacgcggacaactcagtaagaaggagcggcgagcggaatcaaaaatgctcgagatgtttgcaagacagagcgaacacggcttcaaatgacaggtgttagcaggactccagacgggatctgcgggatcggccgggtgggagccgcaccgcacggcgccgggtcggggagagaacccggcctggggaggccg

SEQ ID NO: 78242 - DNA, 158 bp, Homo sapiens
  misc_feature 1..158: note = chr15:96953131-96953289
  misc_feature 1..158: note = hyper
  source 1..158: mol_type = genomic DNA
cgcgcggcccggagccgaccccgcctcctcttccgaaagtcctaagtcaggacagcggcagatcgtcccagaaaatcagcgccaactccctctgctcaaatttgctactttgtgttttagttccaggcgggaagtctacactgcgctccctcccagcc

SEQ ID NO: 78243 - DNA, 67 bp, Homo sapiens
  misc_feature 1..67: note = chr15:96959305-96959372
  misc_feature 1..67: note = hyper
  source 1..67: mol_type = genomic DNA
atgaagccacagcctcgaccagccctgacagtaaaacggagtgagcatgtggcggccccggggcaag

SEQ ID NO: 78244 - DNA, 242 bp, Homo sapiens; identical to SEQ ID NO: 35969
  misc_feature 1..242: note = chr15:96959719-96959961
  misc_feature 1..242: note = hyper
  source 1..242: mol_type = genomic DNA

SEQ ID NO: 78245 - DNA, 318 bp, Homo sapiens
  misc_feature 1..318: note = chr15:96960508-96960826
  misc_feature 1..318: note = hyper
  source 1..318: mol_type = genomic DNA
gccgcggacgccaggcgcgagcgcaaggttaaagtcaaaagctctgcctgggccagcactcaagacggtcctggcaccaacgcctttcatttttgcctgtttgcaagcggggaaagtggagtcctcaatcatagcgaggagcttttcttaagccacaaagcacacgggcgcaaacatcctcgctgctaactcagggcaattgtcttcctattttctcgttcctgacccccaagtttcaccggtgggaagtcatcgaagatctcccttttaccaccagctctacggggtcgcttttctcttaagcgccctgtgagggtc

SEQ ID NO: 78246 - DNA, 180 bp, Homo sapiens; identical to SEQ ID NO: 44366
  misc_feature 1..180: note = chr15:97006353-97006533
  misc_feature 1..180: note = hypo
  source 1..180: mol_type = genomic DNA

SEQ ID NO: 78247 - DNA, 30 bp, Homo sapiens
  misc_feature 1..30: note = chr15:97395096-97395126
  misc_feature 1..30: note = hypo
  source 1..30: mol_type = genomic DNA
cattaagtattagaacgcagatcacagaac

SEQ ID NO: 78248 - DNA, 30 bp, Homo sapiens
  misc_feature 1..30: note = chr15:97894937-97894967
  misc_feature 1..30: note = hypo
  source 1..30: mol_type = genomic DNA
aggccaaacttgtgacggttaaaaattcac

SEQ ID NO: 78249 - DNA, 30 bp, Homo sapiens; identical to SEQ ID NO: 44367
  misc_feature 1..30: note = chr15:98417575-98417605
  misc_feature 1..30: note = hypo
  source 1..30: mol_type = genomic DNA

SEQ ID NO: 78250 - DNA, 24 bp, Homo sapiens
  misc_feature 1..24: note = chr15:98454971-98454995
  misc_feature 1..24: note = hypo
  source 1..24: mol_type = genomic DNA
cacccggcccggcacatttatttt

SEQ ID NO: 78251 - DNA, 114 bp, Homo sapiens
  misc_feature 1..114: note = chr15:98504114-98504228
  misc_feature 1..114: note = hyper
  source 1..114: mol_type = genomic DNA
ggcggccgtgggtgccgagggccgcgtgaagagcctgggtctggtgttcgaggacgagcgcaagggctgctattccagcggcgagacagtggccgggcacgtgctgctggaggc

SEQ ID NO: 78252 - DNA, 41 bp, Homo sapiens
  misc_feature 1..41: note = chr15:98776804-98776845
  misc_feature 1..41: note = hypo
  source 1..41: mol_type = genomic DNA
ggattacaggcgtgagccaccgtgcccggcccagctgggtg

SEQ ID NO: 78253 - DNA, 372 bp, Homo sapiens; identical to SEQ ID NO: 35973
  misc_feature 1..372: note = chr15:98836021-98836393
  misc_feature 1..372: note = hyper
  source 1..372: mol_type = genomic DNA

SEQ ID NO: 78254 - DNA, 114 bp, Homo sapiens
  misc_feature 1..114: note = chr15:98961307-98961421
  misc_feature 1..114: note = hypo
  source 1..114: mol_type = genomic DNA
ggagtgttttcaaaacgatgtagcgaaaccaccgcggaggtaaaaggtcgattgttcccagccacagccgctctgtggggacgactttatagcgcagcccggccagtaccgaca

SEQ ID NO: 78255 - DNA, 109 bp, Homo sapiens; identical to SEQ ID NO: 35974
  misc_feature 1..109: note = chr15:98965273-98965382
  misc_feature 1..109: note = hyper
  source 1..109: mol_type = genomic DNA

SEQ ID NO: 78256 - DNA, 302 bp, Homo sapiens
  misc_feature 1..302: note = chr15:98971690-98971992
  misc_feature 1..302: note = hyper
  source 1..302: mol_type = genomic DNA
ctgggggcaccgactcggggctgcggacctcggagcgcgcccggcgggctttggtttgggcaaggctgccatcgtgtggccgccgtgggtatttccctcggaaagcggccgggcagcgagcaggcgcccgcgcctcttctttttacgggagtccgcgctctccgcaagtctgtcctgagatcgccgttttctcccaccagccagaatggggctcactgctgcaacccgggtctcagtcttctccagggcacctcctgggccgtgccccgagccttgactgcggcaggcggtgttttttcctc

SEQ ID NO: 78257 - DNA, 254 bp, Homo sapiens
  misc_feature 1..254: note = chr15:99091118-99091372
  misc_feature 1..254: note = hyper
  source 1..254: mol_type = genomic DNA
ggctggtccctggggcgcacagagaagttgtgacagataattgacgtgatcgggaggggcgtccaggcagacctcatgtgacttctaaaaccaacccacaaatctgaagcgtggcttgcgtggtcagccgcctgcctggcacccggtgaacagtttctcccggactctctgcatctagccccaaagaatctaagattctttgtctagaaaagtgccctggtcttccctggcacccttcgcggtgggtttccttg

SEQ ID NO: 78258 - DNA, 55 bp, Homo sapiens
  misc_feature 1..55: note = chr15:99091608-99091663
  misc_feature 1..55: note = hyper
  source 1..55: mol_type = genomic DNA
ggcccccgcctcctccgtcctccgcgattcggacatgacacggtcctccgcgaag

SEQ ID NO: 78259 - DNA, 30 bp, Homo sapiens
  misc_feature 1..30: note = chr15:99168900-99168930
  misc_feature 1..30: note = hypo
  source 1..30: mol_type = genomic DNA
acctcagagtcctcacgtataaaatggggt

SEQ ID NO: 78260 - DNA, 90 bp, Homo sapiens; identical to SEQ ID NO: 44371
  misc_feature 1..90: note = chr15:99183400-99183490
  misc_feature 1..90: note = hypo
  source 1..90: mol_type = genomic DNA

SEQ ID NO: 78261 - DNA, 39 bp, Homo sapiens
  misc_feature 1..39: note = chr15:99192902-99192941
  misc_feature 1..39: note = hyper
  source 1..39: mol_type = genomic DNA
aagtgagtatgtgcccgccgcccgcggccactgcgggaa

SEQ ID NO: 78262 - DNA, 37 bp, Homo sapiens
  misc_feature 1..37: note = chr15:99193206-99193243
  misc_feature 1..37: note = hyper
  source 1..37: mol_type = genomic DNA
aagttggtgccggggcgggctccgcggttcccgggcc

SEQ ID NO: 78263 - DNA, 138 bp, Homo sapiens; identical to SEQ ID NO: 35976
  misc_feature 1..138: note = chr15:99193529-99193667
  misc_feature 1..138: note = hyper
  source 1..138: mol_type = genomic DNA

SEQ ID NO: 78264 - DNA, 95 bp, Homo sapiens; identical to SEQ ID NO: 35977
  misc_feature 1..95: note = chr15:99193974-99194069
  misc_feature 1..95: note = hyper
  source 1..95: mol_type = genomic DNA

SEQ ID NO: 78265 - DNA, 260 bp, Homo sapiens
  misc_feature 1..260: note = chr15:99250288-99250548
  misc_feature 1..260: note = hypo
  source 1..260: mol_type = genomic DNA
tacaagtcacagtgacggttctccagtgtagagtagattgattgccctgtgtccttcaggcagggtgcagtagtaagttattgatacttggctgctgagctgtcgttcaggccttggcaactgacgctctgcagaacggaccaggagtgtgcggtggtggagtccggctggcctgggttgcagatttaactttcgcctctgcctctgtgtgcctctgggctgtaagctttagtttgcacggttaacggggatggcctctc

SEQ ID NO: 78266 - DNA, 127 bp, Homo sapiens
  misc_feature 1..127: note = chr15:99254559-99254686
  misc_feature 1..127: note = hypo
  source 1..127: mol_type = genomic DNA
gggtgtgtgtgaaatcgttgagcctactcgattttgtcgtgctgttgcgcggttttcacttggcactgtcctttaaactccttctgtgccgtgactctgcagtgtctggcagcgtagtagactctac

SEQ ID NO: 78267 - DNA, 18 bp, Homo sapiens
  misc_feature 1..18: note = chr15:99295597-99295615
  misc_feature 1..18: note = hypo
  source 1..18: mol_type = genomic DNA
tagagtgtttattaacga

SEQ ID NO: 78268 - DNA, 30 bp, Homo sapiens
  misc_feature 1..30: note = chr15:99347955-99347985
  misc_feature 1..30: note = hypo
  source 1..30: mol_type = genomic DNA
tttaagatggagtttcgctggagtgcaatt

SEQ ID NO: 78269 - DNA, 30 bp, Homo sapiens
  misc_feature 1..30: note = chr15:99428631-99428661
  misc_feature 1..30: note = hypo
  source 1..30: mol_type = genomic DNA
tttccttctcctccccgtgttgtctcatgg

SEQ ID NO: 78270 - DNA, 47 bp, Homo sapiens
  misc_feature 1..47: note = chr15:99454637-99454684
  misc_feature 1..47: note = hypo
  source 1..47: mol_type = genomic DNA
tctcatcagcttcaccgtttactacaaggaagcgtgagtttctgctt

SEQ ID NO: 78271 - DNA, 81 bp, Homo sapiens
  misc_feature 1..81: note = chr15:99456350-99456431
  misc_feature 1..81: note = hypo
  source 1..81: mol_type = genomic DNA
cccgcccaacaaggacgtggagcccggcatcttactacatgggctgaagccctggactcagtacgccgtttacgtcaaggc

SEQ ID NO: 78272 - DNA, 54 bp, Homo sapiens
  misc_feature 1..54: note = chr15:99460214-99460268
  misc_feature 1..54: note = hypo
  source 1..54: mol_type = genomic DNA
cagtagccactgagacggagccgaaaaagatgacaggttcggtgaagtgagtcc

SEQ ID NO: 78273 - DNA, 38 bp, Homo sapiens; identical to SEQ ID NO: 44377
  misc_feature 1..38: note = chr15:99484067-99484105
  misc_feature 1..38: note = hypo
  source 1..38: mol_type = genomic DNA

SEQ ID NO: 78274 - DNA, 132 bp, Homo sapiens; identical to SEQ ID NO: 15933
  misc_feature 1..132: note = chr15:99484456-99484588
  misc_feature 1..132: note = hypo
  source 1..132: mol_type = genomic DNA

SEQ ID NO: 78275 - DNA, 30 bp, Homo sapiens
  misc_feature 1..30: note = chr15:99501229-99501259
  misc_feature 1..30: note = hypo
  source 1..30: mol_type = genomic DNA
ctgttaccattttaacgctgcctaattttg

SEQ ID NO: 78276 - DNA, 123 bp, Homo sapiens
  misc_feature 1..123: note = chr15:99503981-99504104
  misc_feature 1..123: note = hypo
  source 1..123: mol_type = genomic DNA
ccctgatagaacacacgcaggagcagagtcccctccccctccaggctgccctctcaacttctccctcacctccttccctaggggtagacagagatgtaccaaaccttccggctggaaagccca

SEQ ID NO: 78277 - DNA, 30 bp, Homo sapiens; identical to SEQ ID NO: 44379
  misc_feature 1..30: note = chr15:99506147-99506177
  misc_feature 1..30: note = hypo
  source 1..30: mol_type = genomic DNA

SEQ ID NO: 78278 - DNA, 30 bp, Homo sapiens
  misc_feature 1..30: note = chr15:99507385-99507415
  misc_feature 1..30: note = hypo
  source 1..30: mol_type = genomic DNA
atggaatggatgcaccgcaaataatgcatt

SEQ ID NO: 78279 - DNA, 30 bp, Homo sapiens; identical to SEQ ID NO: 44380
  misc_feature 1..30: note = chr15:99974913-99974943
  misc_feature 1..30: note = hypo
  source 1..30: mol_type = genomic DNA

SEQ ID NO: 78280 - DNA, 30 bp, Homo sapiens; identical to SEQ ID NO: 44381
  misc_feature 1..30: note = chr15:99981097-99981127
  misc_feature 1..30: note = hypo
  source 1..30: mol_type = genomic DNA

SEQ ID NO: 78281 - DNA, 34 bp, Homo sapiens
  misc_feature 1..34: note = chr16:1009722-1009756
  misc_feature 1..34: note = hypo
  source 1..34: mol_type = genomic DNA
tgggtggacaattctcgcacgtgcaccagggctg

SEQ ID NO: 78282 - DNA, 183 bp, Homo sapiens
  misc_feature 1..183: note = chr16:10133318-10133501
  misc_feature 1..183: note = hyper
  source 1..183: mol_type = genomic DNA
tgtttgtttgaaaatcgagacgctaaactctaagtcttttgctgaagctcctctccctaggggcaggatgggagcaaggcttaccaaggctgccacctacagaacagagggcagcgaggactgcgcagcagcgggagggaccggtggcgttgggcgcggggagggtctgcgcggggagggtcc

SEQ ID NO: 78283 - DNA, 64 bp, Homo sapiens; identical to SEQ ID NO: 36065
  misc_feature 1..64: note = chr16:10133502-10133566
  misc_feature 1..64: note = hyper
  source 1..64: mol_type = genomic DNA

SEQ ID NO: 78284 - DNA, 132 bp, Homo sapiens
  misc_feature 1..132: note = chr16:1018120-1018252
  misc_feature 1..132: note = hypo
  source 1..132: mol_type = genomic DNA
ggcagcacatggaaacgcccaggcccgcggtgggaaggagccagccccaggacggatgcaaagtcaggttgaatgcagaggcctgtcgctggcagccggcctctccaggtctggcttcgaagcttccccgac

SEQ ID NO: 78285 - DNA, 42 bp, Homo sapiens
  misc_feature 1..42: note = chr16:1022772-1022814
  misc_feature 1..42: note = hypo
  source 1..42: mol_type = genomic DNA
tgttccagcttccagcgctccgggctccggctctgcatttgc

SEQ ID NO: 78286 - DNA, 2534 bp, Homo sapiens
  misc_feature 1..2534: note = chr16:10274265-10276799
  misc_feature 1..2534: note = hyper
  source 1..2534: mol_type = genomic DNA
catagtcgccactgacggtccctgcaaggtgaagagtgagaggcagggccgcggtgagcaaggcgaccagaagaaagggattaccaacttggcttcctgctctaggagccaggcatggaactcagcagcaggataggctgctgggatcacggactccattccgagtccccgacgccatccacatccctcgatccatctctaactctatccacaactccaattcgagctaattctccatcccccagccccttctcgcatccagcttcctcatcccctgtctccaggcacttccccatccccatctctgtccatatcccccaccgcattccccaagttcgccgcgggccacagaccctaagcgccgcgcgtgttctgtaccccaccaagctcctaggtgcacagaataaaccctccatccaacccctcccacctgggatagagaggaccaagttatcaaccccgccccctgctggcgcggagcgaactacagaccccgcagggcgtgcggaggcggcacccagaccccgcgtcccagcttgagagctcagctagttggctgaccccgccccctacgagcccgtcgtgtgcaccacacactttgctctacgcccagccccaactacagacccggctcctctcagtcagagtacaccccaagtgcttgggagtgaggacgctgcctggtgggcccaggctccgctgtgcctggggaacttggggctcgccccacctcgagccaaggggccgtggagagtccttcacccctacacgcgcgcgtgcacacacacgtgcacacacacacgcacacacacatgttcacacacacacaccctctctcacgcgcgccgtgtgcaatgctgaattctggagagtaggcgcgtccccccgcgggccagcgcgtaggagctggcaaagaacgtgcgtagggggaaaggtaggctcccaagaagctcccagacggacgtggactgtacagcccctccctagcctttctactgcgggcgctgttgccaagtcctaggtgcacgtgggcagtgggccgcacacgctcataggcacgcgcgcttttctgcgcacttcctcagactgctgtagcggtgcccacggccagccggagtcctcacatgtcctcaggtggtgcacacgcatgaactgcggcaggtgcacagccctgcgtacctgcaaataccagcacggtcgtgcacgcgtgccctgacgcgcgcctctcgggacggacgctgctggagccgggggaagttgaggcgaactccaagaggcctcgacgttcctgggtaagcgccgcggagcgcggagccgcagcgccccctggtgcccctcctgcacttcgccgctgggctccctcccgctttccctctccctctctagcctgatccctctcccgctctccctccggtcgagtctccctcctccccggcccaaggagccctgatctccctctgggacgtacctgtagcccgagaaggtcgaggatgcagtggggcgcgctgcgcgcacgagcatctcggccgcctcagcagccaccgggtttagcgggttcccgcatgctgcggccccagcgcgctcccctggctgtcccgcgctgtccgcatcgcccccacggggggcggctatcccagccggaggctctgcagcagggctctaacggggcggaggagagaaggagaggcagggtcagcccaccaacgaggggagggagggttgaggggaaggctgcagtctgcagtgctcacaagcccccctatgcgcccaggggggctagacaagaggggggaagctgaagcccgatgcccacgacgcccccagtgcggatcctcagcccctgtggctgatagcgggagctccactccagggtgcacaggagaatgggagccccaggttggccacccacgagaagctaactgggcacctccacccgcaccccctaccacctccccagcgccggctgctgggagttgtgcgaccgggagctgctgagcgagggaggtagggagagaaagaggaggtaacgagggtgggggggcgctggctgagtttgtgacgagccagcagtaggagagggggagggaaggacgcgggctcccgcggtcccggttccccgagggaggtggatctttcccacgcagcgaccctcttgtgatcctgccgcttcctccctcttcaggcctcccacctccccccttcccaagggggcctcccaggcccggcgtcccgcgctagcactcaccgcagcctctctccacatagttctcagcagtggccgctcctggtcatctccagggctgatggctgcggccgcgattctcagcgctcacccggtcccatgatccggccaagccctaggagctcccctccaagatccctagctccgcttcctgccccactccggacggcaactgcccggtcctctgagcgcgccggagcaccctctccgcaacccagctccgggctggtgtgtttgagggcgagtgtgtgtgtgagtgtgggagcgcgctcgcgtgtggccggggatcccc

SEQ ID NO: 78287 - DNA, 251 bp, Homo sapiens; identical to SEQ ID NO: 4324
  misc_feature 1..251: note = chr16:10276800-10277051
  misc_feature 1..251: note = hyper
  source 1..251: mol_type = genomic DNA

SEQ ID NO: 78288 - DNA, 340 bp, Homo sapiens
  misc_feature 1..340: note = chr16:10277071-10277411
  misc_feature 1..340: note = hyper
  source 1..340: mol_type = genomic DNA
cgctcaagcccaagaggcttcgagctccggcgggcgaaagcgtctcctgcccgcagcctctctcctaggtgggtcgagacagaccccgcagtccctcggcggcgacgcggagcgcggccacccgttccgagagcgcacggcggcaaataaggccaggataggtggctggctggcgacgggggcgcctgcggcggcgcgcgctgctgtccgtggtgttggaaccacgctctccgcccgctcccgggcgtctggtgcggctgaagaatcaattattcagatctctgctaccgcttcctcctcccccagtgcctcgcgctgggtacagttatccccctccacg

SEQ ID NO: 78289 - DNA, 414 bp, Homo sapiens
  misc_feature 1..414: note = chr16:1030443-1030857
  misc_feature 1..414: note = hyper
  source 1..414: mol_type = genomic DNA
cggaccagctccttctgccgaccgggccggggagaccgcgtggctcagtggctgcagcggccaccggcccgggcgtgggggctttgagggcaccggcgcggtaggtcacccgggtttcgcgggccgcaagctcggagacgcgcgtgtcccgcgttggctgcctgacccggaatggcgcagccccttcgcctccagcgcgctggttgaaaggatccgagccaccctcggggacggccgggccgaggccacctcgcggggcggccttgggcggggacccggacccgcggttggacgttcgcctcggggggggcaatgtcccctctccgaccccgcggtccccaccagggcggcacaccccgccctctccccgcctccgcaggcgcccagggctcacaggctcggagcggcctccgc

SEQ ID NO: 78290 - DNA, 199 bp, Homo sapiens
  misc_feature 1..199: note = chr16:1031067-1031266
  misc_feature 1..199: note = hyper
  source 1..199: mol_type = genomic DNA
ctccacgctcgcactcgtatgggcagggcggcccggggtcccccagctccgagccgcggccccttgaagcgcgttacctggacgtgcgctgtccgcagactctggacgagctgggcctgggcgctgcgcggcggaaccgaccctgtcctggaccgcaggcagcagctgaccccgcgccaccggcctgcgggcgagacct

SEQ ID NO: 78291 - DNA, 138 bp, Homo sapiens
  misc_feature 1..138: note = chr16:1031386-1031524
  misc_feature 1..138: note = hyper
  source 1..138: mol_type = genomic DNA
tgtgtcgggggaggggcccgaggacccgcttcctagctgagcgtcaggacggggggcggactctcaggagccgcgcggcgcccgcagaggagaggaagcgccggagacccccctgctcccacccggcctccctgcccc

SEQ ID NO: 78292 - DNA, 706 bp, Homo sapiens
  misc_feature 1..706: note = chr16:1031741-1032447
  misc_feature 1..706: note = hyper
  source 1..706: mol_type = genomic DNA
taaagaaacttgttgcgggtcccgcagcgggacccgagcctcggcggcggcggcggcggcggcaggggcgagggtcggggccaccgcgcggcgacctcgggtcccggagcgaccgcagggcagccccgggcgccggccccggtgcgcgtctcctgtgcgcgcccctccgcgcgcggccccgatgctggacatgagcgaggcccgctcccagccgccctgcagcccgtccggcaccgccagctccatgtcgcacgtggaggactcggactcggacgcgccgccgtctcccgccggctccgagggcctgggccgcgcgggggtcgcggtggggggcgcccggggcgacccggcggaggcggcggacgagcgcttcccggcctgcatccgcgacgccgtgtcgcaggtgctcaagggctacgactggagtctggtgcccatgccggtgcgcggcggcggcggcggcgcgctcaaagccaagccgcatgtgaagcggcccatgaacgcattcatggtgtgggcgcaggcggcgcgccgcaagctggccgaccagtacccgcacctgcacaacgccgagctcagcaagacgctgggcaagctgtggcggtgagtgccggcgccccgggggcggggttcgggaccttggccgcccctggtctcggactgcgagcgggggcctggagggcgcagagctcgcggaggtggtggc

SEQ ID NO: 78293 - DNA, 30 bp, Homo sapiens
  misc_feature 1..30: note = chr16:1034635-1034665
  misc_feature 1..30: note = hypo
  source 1..30: mol_type = genomic DNA
ctggccggccccacccgccccacagaaggg

SEQ ID NO: 78294 - DNA, 37 bp, Homo sapiens
  misc_feature 1..37: note = chr16:1035437-1035474
  misc_feature 1..37: note = hypo
  source 1..37: mol_type = genomic DNA
ggcccagtgtgtgtgaccagggcgggaggggccccag

SEQ ID NO: 78295 - DNA, 30 bp, Homo sapiens
  misc_feature 1..30: note = chr16:1039445-1039475
  misc_feature 1..30: note = hypo
  source 1..30: mol_type = genomic DNA
ggagatgcagcccagcgctgcccccaagct

SEQ ID NO: 78296 - DNA, 168 bp, Homo sapiens
  misc_feature 1..168: note = chr16:1040337-1040505
  misc_feature 1..168: note = hypo
  source 1..168: mol_type = genomic DNA
tcaaagtgaaactggcgaagaaagggccggcctcacgagaccccggggactcagacccagtgagcgcacctcttgctgcctcctgctgtgtctggggcatccacaccgccaccccgcgggaaggcaggacgagctgcttgccaggtgacctcccgtgcctcagtttcc

SEQ ID NO: 78297 - DNA, 265 bp, Homo sapiens
  misc_feature 1..265: note = chr16:10479701-10479966
  misc_feature 1..265: note = hyper
  source 1..265: mol_type = genomic DNA
gccccggtggctgaccggaagaagcgcccacggaggcgaaccccaggcgcccctcagcctacttccatttcccctcgcgacccttcgccccgcccactctagctggctgtgcctgactggctgggctgccgcatattcgcgctgccattggtccataatcagctgggggtgggcgtagggagacctacttcagcaggtcctggccggaccagcattgttaacggctgcggttcgaagtggctgtgggtattgctgcggctggtgc

SEQ ID NO: 78298 - DNA, 369 bp, Homo sapiens
  misc_feature 1..369: note = chr16:10479967-10480336
  misc_feature 1..369: note = hyper
  source 1..369: mol_type = genomic DNA
tcgtcgctctaggtacgttggggccgggcgagtgtcctgcgagagcggcgattggcggggtggcggctctaggagcgtcggtcgcctctctgagggccggccccggaggcctcggagcgccgggcctaccggacgtttgcggcgaagctgccctgactgaaaagcgtccgcggggccgtctgacaggtccgggaagaggcccctgaggggcggacgggcgcgtctccaccgttttcgcagagggatactggtgaagcgggagtggtgtgcggcctcaggtccgggcggcactggggttagggactgcggagggaagtggtgcgtgttttttgtcctgaggggtaagtaaaagctcgctcttgtccggaa

SEQ ID NO: 78299 - DNA, 30 bp, Homo sapiens
  misc_feature 1..30: note = chr16:1050321-1050351
  misc_feature 1..30: note = hypo
  source 1..30: mol_type = genomic DNA
gcacagcgcactccccgtggcctcggctgg

SEQ ID NO: 78300 - DNA, 30 bp, Homo sapiens
  misc_feature 1..30: note = chr16:1052148-1052178
  misc_feature 1..30: note = hypo
  source 1..30: mol_type = genomic DNA
gccctcctggcccagcggaatgctggcacc

SEQ ID NO: 78301 - DNA, 372 bp, Homo sapiens
  misc_feature 1..372: note = chr16:1052442-1052814
  misc_feature 1..372: note = hypo
  source 1..372: mol_type = genomic DNA
tctgatgtccctccccggtgaagggacccgcacatgtgcacctgccgcagccccgatgtccctccccgggtgaaggaacccacggacgtggctcatccataccgcggaacgtgagccatgaaaaggggcagcctcggctcagccaccgcagggaaggactcgacacacgccgagcagaagaggccaggcctgagaggccacctgcgattccatctgcggaaatgccagaaagggaggtccgcagacgcaagagctggactggggggacggccgaggggcgaggggtttccttccggatgaaattgccccagaacgacatgcagggcgtggggaggtggctgcaagatactgcggccccgctggatgccacag

SEQ ID NO: 78302 - DNA, 30 bp, Homo sapiens
  misc_feature 1..30: note = chr16:1053812-1053842
  misc_feature 1..30: note = hypo
  source 1..30: mol_type = genomic DNA
cttagaggagggacacggggggctgcgacc

SEQ ID NO: 78303 - DNA, 94 bp, Homo sapiens
  misc_feature 1..94: note = chr16:1061426-1061520
  misc_feature 1..94: note = hypo
  source 1..94: mol_type = genomic DNA
gcggcagggcagagacgcagggcaaagcggcagggcagagacgtagggcagagcggcagggcagagacacagggcagagcggcagggcagagat

SEQ ID NO: 78304 - DNA, 32 bp, Homo sapiens; identical to SEQ ID NO: 44449
  misc_feature 1..32: note = chr16:1062412-1062444
  misc_feature 1..32: note = hypo
  source 1..32: mol_type = genomic DNA

SEQ ID NO: 78305 - DNA, 30 bp, Homo sapiens
  misc_feature 1..30: note = chr16:1062655-1062685
  misc_feature 1..30: note = hypo
  source 1..30: mol_type = genomic DNA
gagtgctgtggagcacggggaagggccatg

SEQ ID NO: 78306 - DNA, 30 bp, Homo sapiens
  misc_feature 1..30: note = chr16:1067752-1067782
  misc_feature 1..30: note = hypo
  source 1..30: mol_type = genomic DNA
gaggtggcctctcatcgtggctttgatttg

SEQ ID NO: 78307 - DNA, 112 bp, Homo sapiens
  misc_feature 1..112: note = chr16:1071854-1071966
  misc_feature 1..112: note = hypo
  source 1..112: mol_type = genomic DNA
tccttccctagggagcgggagtcttcacacgtcccctgggggtctggcacctcaagtataagcaccccctgcgatcggcccctcccacaccccagcgcgggcccagctgctc

SEQ ID NO: 78308 - DNA, 153 bp, Homo sapiens
  misc_feature 1..153: note = chr16:10721492-10721645
  misc_feature 1..153: note = hypo
  source 1..153: mol_type = genomic DNA
tgcacttctccttgtcgatgcagagggtgttggccttgatggcgagctcgtgctccagccggcacttggtcatgaccagcagctgcagcgtgtcctgtgtctcccgcagccgcagcttgagggtctgcagggtgtcgtcgatggtgaacacct

SEQ ID NO: 78309 - DNA, 136 bp, Homo sapiens
  misc_feature 1..136: note = chr16:1072992-1073128
  misc_feature 1..136: note = hypo
  source 1..136: mol_type = genomic DNA
cccttcccgctcctccgagtcccagcacctacgtccgtgaagtgggcagagtagaaaccactactcgggcctcgcggagcagagtgggggcactgggtggggcggggggcacggggcgggccgggcctagggaggg

SEQ ID NO: 78310 - DNA, 42 bp, Homo sapiens; identical to SEQ ID NO: 44451
  misc_feature 1..42: note = chr16:1073516-1073558
  misc_feature 1..42: note = hypo
  source 1..42: mol_type = genomic DNA

SEQ ID NO: 78311 - DNA, 30 bp, Homo sapiens
  misc_feature 1..30: note = chr16:1075075-1075105
  misc_feature 1..30: note = hypo
  source 1..30: mol_type = genomic DNA
gcctgggtgttcacacggctccagctccac

SEQ ID NO: 78312 - DNA, 51 bp, Homo sapiens; identical to SEQ ID NO: 44452
  misc_feature 1..51: note = chr16:1076434-1076485
  misc_feature 1..51: note = hypo
  source 1..51: mol_type = genomic DNA

SEQ ID NO: 78313 - DNA, 104 bp, Homo sapiens
  misc_feature 1..104: note = chr16:1077555-1077659
  misc_feature 1..104: note = hypo
  source 1..104: mol_type = genomic DNA
tatttctgagatcaacgcctgcctcagggaacagttgttcccgtgctattttttacccccgtgggctgcgagttctggaacgttccaaacgacagtgacaacgg

SEQ ID NO: 78314 - DNA, 63 bp, Homo sapiens
  misc_feature 1..63: note = chr16:1077886-1077949
  misc_feature 1..63: note = hypo
  source 1..63: mol_type = genomic DNA
gaaggccagagaccccggcatgccctcgggggaggagggaggtggggccggttggtctggggc

SEQ ID NO: 78315 - DNA, 85 bp, Homo sapiens
  misc_feature 1..85: note = chr16:10804580-10804665
  misc_feature 1..85: note = hypo
  source 1..85: mol_type = genomic DNA
agtaatattatcctctccctccccgcctagatattaggaacaatgtctcaggaaagatgtacaccagttgcgatgttggaagtca

SEQ ID NO: 78316 - DNA, 217 bp, Homo sapiens; identical to SEQ ID NO: 15968
  misc_feature 1..217: note = chr16:1081773-1081990
  misc_feature 1..217: note = hypo
  source 1..217: mol_type = genomic DNA

SEQ ID NO: 78317 - DNA, 42 bp, Homo sapiens
  misc_feature 1..42: note = chr16:1089124-1089166
  misc_feature 1..42: note = hypo
  source 1..42: mol_type = genomic DNA
aatgtctgtcctctgcgtgtatcaggccgggttgagggggtg

SEQ ID NO: 78318 - DNA, 30 bp, Homo sapiens; identical to SEQ ID NO: 44455
  misc_feature 1..30: note = chr16:1089739-1089769
  misc_feature 1..30: note = hypo
  source 1..30: mol_type = genomic DNA

SEQ ID NO: 78319 - DNA, 30 bp, Homo sapiens
  misc_feature 1..30: note = chr16:1090322-1090352
  misc_feature 1..30: note = hypo
  source 1..30: mol_type = genomic DNA
cgccgaggtcccccccgaagttcccccctg

SEQ ID NO: 78320 - DNA, 103 bp, Homo sapiens
  misc_feature 1..103: note = chr16:1090678-1090781
  misc_feature 1..103: note = hypo
  source 1..103: mol_type = genomic DNA
gtgtgattaggaaagcggggctttggctgtgggaccacagagccccagtaggagcccccgccccagcacagtgaacccaggacaacgtcggggctgcctgagt

SEQ ID NO: 78321 - DNA, 30 bp, Homo sapiens; identical to SEQ ID NO: 44456
  misc_feature 1..30: note = chr16:1092742-1092772
  misc_feature 1..30: note = hypo
  source 1..30: mol_type = genomic DNA

SEQ ID NO: 78322 - DNA, 53 bp, Homo sapiens
  misc_feature 1..53: note = chr16:1096684-1096737
  misc_feature 1..53: note = hypo
  source 1..53: mol_type = genomic DNA
tccccccaccgtgcccgcggtgccctcctccgcccgcgcggctggtggcaggg

SEQ ID NO: 78323 - DNA, 89 bp, Homo sapiens
  misc_feature 1..89: note = chr16:1101018-1101107
  misc_feature 1..89: note = hypo
  source 1..89: mol_type = genomic DNA
cagatgaatcacctgcgcaaagccacttagcacttcgcaggggccccgaagcccggtgtcggcaaggtgtccgtcgctggagcaggggt

SEQ ID NO: 78324 - DNA, 81 bp, Homo sapiens
  misc_feature 1..81: note = chr16:1103110-1103191
  misc_feature 1..81: note = hypo
  source 1..81: mol_type = genomic DNA
gggtgtgtgcccggccgtgcactttgggtctggtgagcgtggctgaggggcacagctgctcttggtcggggctgcagtgag

SEQ ID NO: 78325 - DNA, 23 bp, Homo sapiens
  misc_feature 1..23: note = chr16:11102871-11102894
  misc_feature 1..23: note = hypo
  source 1..23: mol_type = genomic DNA
tacattcacgttgtataaccatc

SEQ ID NO: 78326 - DNA, 30 bp, Homo sapiens
  misc_feature 1..30: note = chr16:1111359-1111389
  misc_feature 1..30: note = hypo
  source 1..30: mol_type = genomic DNA
ggctcccagagctgacgtgcaaataaattg

SEQ ID NO: 78327 - DNA, 30 bp, Homo sapiens
  misc_feature 1..30: note = chr16:11118524-11118554
  misc_feature 1..30: note = hypo
  source 1..30: mol_type = genomic DNA
tctgtgtcctcagtgcgtggtgctggacca

SEQ ID NO: 78328 - DNA, 46 bp, Homo sapiens
  misc_feature 1..46: note = chr16:1111971-1112017
  misc_feature 1..46: note = hypo
  source 1..46: mol_type = genomic DNA
agcccaggaacaccacgggtggctggcagtgcggagcggtagggcc

SEQ ID NO: 78329 - DNA, 72 bp, Homo sapiens
  misc_feature 1..72: note = chr16:1113889-1113961
  misc_feature 1..72: note = hypo
  source 1..72: mol_type = genomic DNA
ccgtacgtcacccagcgccacgcttctgcacccacgcagagccacgccccacctgtgcgttcatgctgactt

SEQ ID NO: 78330 - DNA, 30 bp, Homo sapiens
  misc_feature 1..30: note = chr16:11140587-11140617
  misc_feature 1..30: note = hypo
  source 1..30: mol_type = genomic DNA
caagactatgcccaccgtgctgttctgaag

SEQ ID NO: 78331 - DNA, 30 bp, Homo sapiens
  misc_feature 1..30: note = chr16:11167520-11167550
  misc_feature 1..30: note = hypo
  source 1..30: mol_type = genomic DNA
cctgcctgcccttgtcgcccctgcctggat

SEQ ID NO: 78332 - DNA, 39 bp, Homo sapiens
  misc_feature 1..39: note = chr16:1116820-1116859
  misc_feature 1..39: note = hypo
  source 1..39: mol_type = genomic DNA
actgggtagcaggggcggatttctcgtgaatggcttggc

SEQ ID NO: 78333 - DNA, 30 bp, Homo sapiens
  misc_feature 1..30: note = chr16:11178655-11178685
  misc_feature 1..30: note = hypo
  source 1..30: mol_type = genomic DNA
cctgcccttgttcagcgcctctcgaagaca

SEQ ID NO: 78334 - DNA, 30 bp, Homo sapiens
  misc_feature 1..30: note = chr16:1118971-1119001
  misc_feature 1..30: note = hypo
  source 1..30: mol_type = genomic DNA
gcgtgaagcacctcccgggatgaaccaggg

SEQ ID NO: 78335 - DNA, 45 bp, Homo sapiens
  misc_feature 1..45: note = chr16:11232618-11232663
  misc_feature 1..45: note = hypo
  source 1..45: mol_type = genomic DNA
aggcgcaccctcattcgattttgactgctgcgatcatctggtcaa

SEQ ID NO: 78336 - DNA, 30 bp, Homo sapiens
  misc_feature 1..30: note = chr16:11245768-11245798
  misc_feature 1..30: note = hypo
  source 1..30: mol_type = genomic DNA
gacgggtgaggaacccgggaagtgagagct

SEQ ID NO: 78337 - DNA, 30 bp, Homo sapiens
  misc_feature 1..30: note = chr16:1125274-1125304
  misc_feature 1..30: note = hypo
  source 1..30: mol_type = genomic DNA
gcctgtggagcccctcgctgggctctgggc

SEQ ID NO: 78338 - DNA, 161 bp, Homo sapiens
  misc_feature 1..161: note = chr16:11283033-11283194
  misc_feature 1..161: note = hypo
  source 1..161: mol_type = genomic DNA
ctagaaaggcaggaacgcagcgtgacggtgccatacccagagggcctgcctgggcagcccccagaggccttcaaagctacactggagagcttggccgagggaccaatggcaatggcacacactgaagtgttttacacaaaaaaaaccgcctggctggatgt

SEQ ID NO: 78339 - DNA, 420 bp, Homo sapiens
  misc_feature 1..420: note = chr16:1128947-1129367
  misc_feature 1..420: note = hypo
  source 1..420: mol_type = genomic DNA
ggacgctggtggggccggcgccctcggcaggggcccgggcggtgctggtgcccgtgctgtacctgctggtgtgtgcggccgggctgggcgggaacacgctggtcatctacgtggtgctgcgcttcgccaagatgaagaccgtcaccaacatctacattctcaacctggcagtggccgacgtcctgtacatgctggggctgcctttcctggccacgcagaacgccgcgtccttctggcccttcggccccgtcctgtgccgcctggtcatgacgctggacggcgtcaaccagttcaccagtgtcttctgcctgacagtcatgagcgtggaccgctacctggcagtggtgcacccgctgagctcggcccgctggcgccgcccgcgtgtggccaagctggcgagcgccgcggcctgggtcctgt

SEQ ID NO: 78340 - DNA, 30 bp, Homo sapiens
  misc_feature 1..30: note = chr16:11354746-11354776
  misc_feature 1..30: note = hypo
  source 1..30: mol_type = genomic DNA
ccttgggatctttgtcgtggcctattcact

SEQ ID NO: 78341 - DNA, 38 bp, Homo sapiens
  misc_feature 1..38: note = chr16:11407112-11407150
  misc_feature 1..38: note = hypo
  source 1..38: mol_type = genomic DNA
gtatgtgtccaggtgcgccaggtcgtgcagagcatatc

SEQ ID NO: 78342 - DNA, 65 bp, Homo sapiens
  misc_feature 1..65: note = chr16:1142015-1142080
  misc_feature 1..65: note = hypo
  source 1..65: mol_type = genomic DNA
gaatggcccctcggccgtgagggcgagtacctgggtgagcaaccgggctccgaccaccccatgag

SEQ ID NO: 78343 - DNA, 34 bp, Homo sapiens
  misc_feature 1..34: note = chr16:114441-114475
  misc_feature 1..34: note = hypo
  source 1..34: mol_type = genomic DNA
agaggcaagagcatccgggcggtggagacagaga

SEQ ID NO: 78344 - DNA, 30 bp, Homo sapiens
  misc_feature 1..30: note = chr16:1148193-1148223
  misc_feature 1..30: note = hypo
  source 1..30: mol_type = genomic DNA
cctcagcaagacccccgactccacccctct

SEQ ID NO: 78345 - DNA, 30 bp, Homo sapiens
  misc_feature 1..30: note = chr16:11484000-11484030
  misc_feature 1..30: note = hypo
  source 1..30: mol_type = genomic DNA
agcctcttcagtgcccgtgagaacgtggcc

SEQ ID NO: 78346 - DNA, 198 bp, Homo sapiens
  misc_feature 1..198: note = chr16:1155071-1155269
  misc_feature 1..198: note = hypo
  source 1..198: mol_type = genomic DNA
cacggtcatggtgtccgaggcatgacacagctgcggctccggggccagcagcaggcgggtctcagcggcggtgctaccacctcccactcaggctccaacttccagccgcgcgtgtcctacggctgccgcccaccctgtgtgtgtggagtccctttgtgtgcactgtgccgcggcctcggtctccgctgcccactgctg

SEQ ID NO: 78347 - DNA, 38 bp, Homo sapiens
  misc_feature 1..38: note = chr16:11568836-11568874
  misc_feature 1..38: note = hypo
  source 1..38: mol_type = genomic DNA
acagataaaaggttaaatatttgcgcagctattctatg

SEQ ID NO: 78348 - DNA, 232 bp, Homo sapiens
  misc_feature 1..232: note = chr16:1157293-1157525
  misc_feature 1..232: note = hypo
  source 1..232: mol_type = genomic DNA
gaattctgggctctgcgacctctcagcctctgcctccaggtgccctggggtgcggcgggggcactgccgcatcgagctcccaggctgacgggacacagactcacccgtgaccgcagtcggccctgcaggctgacggacaggacttgactgagtgcctgtctgagacagggggctgggcccttgacccctgcagccacagagccccgcagccctcagccggctcagggggtga

SEQ ID NO: 78349 - DNA, 46 bp, Homo sapiens
  misc_feature 1..46: note = chr16:1164458-1164504
  misc_feature 1..46: note = hypo
  source 1..46: mol_type = genomic DNA
tctccctgtggaagacgcatcctcggtgaatcgtggggatcccacc

SEQ ID NO: 78350 - DNA, 225 bp, Homo sapiens
  misc_feature 1..225: note = chr16:1166553-1166778
  misc_feature 1..225: note = hypo
  source 1..225: mol_type = genomic DNA
gcaactccagtgcatcggagggacgccaggtctgcgggcggcaggcagatagcctggccaggccctcacatgcccaccgccagcaccagcctggaaatggacctggaggggccgggctccacccggcacttagaccaaagagccctgaaaatagacgcagagaaaatcagccacggctcccaggccccagaggtcctcccgggagcaggacgtggcctggagcca

SEQ ID NO: 78351 - DNA, 30 bp, Homo sapiens
  misc_feature 1..30: note = chr16:11703494-11703524
  misc_feature 1..30: note = hypo
  source 1..30: mol_type = genomic DNA
tcccggctgcgtgaccgtgagcaagttact

SEQ ID NO: 78352 - DNA, 169 bp, Homo sapiens
  misc_feature 1..169: note = chr16:1171138-1171307
  misc_feature 1..169: note = hypo
  source 1..169: mol_type = genomic DNA
ctaagcccctttccccggagccccgagcccggccggggaaggtgtcgagtcagtggcagagtggaggtgagggcgcgtttcaggggcgacacccctccacgcacccgtagtggccaagcccacctccgggggttcccgggccccagagtggacacgagtgcccaggggg

SEQ ID NO: 78353 - DNA, 102 bp, Homo sapiens
  misc_feature 1..102: note = chr16:11712029-11712131
  misc_feature 1..102: note = hypo
  source 1..102: mol_type = genomic DNA
atttatttattctgtcttttacctccagctatttttgtttcttctctccatttatgcccaaacttttcccccttggaagagacattccgttctgccactgtg

SEQ ID NO: 78354 - DNA, 155 bp, Homo sapiens
  misc_feature 1..155: note = chr16:1173250-1173405
  misc_feature 1..155: note = hypo
  source 1..155: mol_type = genomic DNA
gttctgagcagcccccggcacctggggccgatctacaggtgcattttgtacatagaatctgacccacaggttgtttgttggataaggggaaaatcccggaatccaggaggcccgtgcgccttcacctccggcctcccgcgcgccttcacctccgg

SEQ ID NO: 78355 - DNA, 30 bp, Homo sapiens
  misc_feature 1..30: note = chr16:11770160-11770190
  misc_feature 1..30: note = hypo
  source 1..30: mol_type = genomic DNA
cggcccggaagtccacggctgagccaggat

SEQ ID NO: 78356 - DNA, 23 bp, Homo sapiens
  misc_feature 1..23: note = chr16:11843326-11843349
  misc_feature 1..23: note = hypo
  source 1..23: mol_type = genomic DNA
ggcgcggtggctcaacgtagtcc

SEQ ID NO: 78357 - DNA, 30 bp, Homo sapiens
  misc_feature 1..30: note = chr16:11853255-11853285
  misc_feature 1..30: note = hypo
  source 1..30: mol_type = genomic DNA
gttttggctaaaactcgctcagccccctta

SEQ ID NO: 78358 - DNA, 42 bp, Homo sapiens; identical to SEQ ID NO: 44603
  misc_feature 1..42: note = chr16:11853669-11853711
  misc_feature 1..42: note = hypo
  source 1..42: mol_type = genomic DNA

SEQ ID NO: 78359 - DNA, 25 bp, Homo sapiens
  misc_feature 1..25: note = chr16:1186732-1186757
  misc_feature 1..25: note = hypo
  source 1..25: mol_type = genomic DNA
gggtgcggtggctcacgcctgtcat

SEQ ID NO: 78360 - DNA, 30 bp, Homo sapiens
  misc_feature 1..30: note = chr16:1187602-1187632
  misc_feature 1..30: note = hypo
  source 1..30: mol_type = genomic DNA
ccctgctctccatcacggtgggtgaatccg

SEQ ID NO: 78361 - DNA, 30 bp, Homo sapiens
  misc_feature 1..30: note = chr16:11879750-11879780
  misc_feature 1..30: note = hypo
  source 1..30: mol_type = genomic DNA
aggcgtgagccaccgcgcctggccgttttg

SEQ ID NO: 78362 - DNA, 36 bp, Homo sapiens
  misc_feature 1..36: note = chr16:1188922-1188958
  misc_feature 1..36: note = hypo
  source 1..36: mol_type = genomic DNA
tgccaagagctccgcttcccacgtcctcaccaacgc

SEQ ID NO: 78363 - DNA, 179 bp, Homo sapiens
  misc_feature 1..179: note = chr16:1195670-1195849
  misc_feature 1..179: note = hypo
  source 1..179: mol_type = genomic DNA
tgaccccggcccctccgcacaggcccccgccccgggtctggctcagctggttcctcagatgtccctgggcggcctggcaccttctctgaggagcccccgggtgaaattcccccaaaaacacacactctaggcccacgcgtggtcatctgtggttccaagggcctcgcctggccgagccg

SEQ ID NO: 78364 - DNA, 34 bp, Homo sapiens
  misc_feature 1..34: note = chr16:1196701-1196735
  misc_feature 1..34: note = hypo
  source 1..34: mol_type = genomic DNA
gagctcacacacggacggacggctcacccactta

SEQ ID NO: 78365 - DNA, 30 bp, Homo sapiens
  misc_feature 1..30: note = chr16:1198450-1198480
  misc_feature 1..30: note = hypo
  source 1..30: mol_type = genomic DNA
cccaagcccagcctccgcctgcagcccctc

SEQ ID NO: 78366 - DNA, 30 bp, Homo sapiens
  misc_feature 1..30: note = chr16:1199021-1199051
  misc_feature 1..30: note = hypo
  source 1..30: mol_type = genomic DNA
acaaaggtgagagcccgccatgcttcgggg

SEQ ID NO: 78367 - DNA, 42 bp, Homo sapiens
  misc_feature 1..42: note = chr16:12012089-12012131
  misc_feature 1..42: note = hypo
  source 1..42: mol_type = genomic DNA
gggcttatcggtgtgagccaccacacccggcagagtttgcct

SEQ ID NO: 78368 - DNA, 27 bp, Homo sapiens
  misc_feature 1..27: note = chr16:1202546-1202573
  misc_feature 1..27: note = hyper
  source 1..27: mol_type = genomic DNA
cgcgggcacacccgggacacacacgcg

SEQ ID NO: 78369 - DNA, 519 bp, Homo sapiens; identical to SEQ ID NO: 36008
  misc_feature 1..519: note = chr16:1203265-1203784
  misc_feature 1..519: note = hyper
  source 1..519: mol_type = genomic DNA

SEQ ID NO: 78370 - DNA, 156 bp, Homo sapiens; identical to SEQ ID NO: 36009
  misc_feature 1..156: note = chr16:1203807-1203963
  misc_feature 1..156: note = hyper
  source 1..156: mol_type = genomic DNA

SEQ ID NO: 78371 - DNA, 109 bp, Homo sapiens; identical to SEQ ID NO: 12362
  misc_feature 1..109: note = chr16:1204002-1204111
  misc_feature 1..109: note = hyper
  source 1..109: mol_type = genomic DNA

SEQ ID NO: 78372 - DNA, 180 bp, Homo sapiens; identical to SEQ ID NO: 36011
  misc_feature 1..180: note = chr16:1204128-1204308
  misc_feature 1..180: note = hyper
  source 1..180: mol_type = genomic DNA

SEQ ID NO: 78373 - DNA, 30 bp, Homo sapiens
  misc_feature 1..30: note = chr16:1207059-1207089
  misc_feature 1..30: note = hypo
  source 1..30: mol_type = genomic DNA
tgctgcccggactcccggggttcctgactc

SEQ ID NO: 78374 - DNA, 38 bp, Homo sapiens
  misc_feature 1..38: note = chr16:1207490-1207528
  misc_feature 1..38: note = hypo
  source 1..38: mol_type = genomic DNA
gcgctggggctgtcacgctgctccgcgggcgtcccccg

SEQ ID NO: 78375 - DNA, 55 bp, Homo sapiens
  misc_feature 1..55: note = chr16:1209218-1209273
  misc_feature 1..55: note = hypo
  source 1..55: mol_type = genomic DNA
cctgagccctgtgaccgaggcatggtcggggcccctcggacggtggggtgggccc

SEQ ID NO: 78376 - DNA, 16 bp, Homo sapiens
  misc_feature 1..16: note = chr16:12130487-12130503
  misc_feature 1..16: note = hypo
  source 1..16: mol_type = genomic DNA
gcgggttttctgtttt

SEQ ID NO: 78377 - DNA, 51 bp, Homo sapiens
  misc_feature 1..51: note = chr16:12132399-12132450
  misc_feature 1..51: note = hypo
  source 1..51: mol_type = genomic DNA
tacggacaccgcaggcgctaattggcaggtgagctgcgctttaaatagacc

SEQ ID NO: 78378 - DNA, 41 bp, Homo sapiens
  misc_feature 1..41: note = chr16:1213983-1214024
  misc_feature 1..41: note = hypo
  source 1..41: mol_type = genomic DNA
cgcccctgccccagccgaggagcagccgatgggtgcggcct

SEQ ID NO: 78379 - DNA, 30 bp, Homo sapiens
  misc_feature 1..30: note = chr16:1214993-1215023
  misc_feature 1..30: note = hypo
  source 1..30: mol_type = genomic DNA
agggtgatttgtctccgtggggttctgggg

SEQ ID NO: 78380 - DNA, 155 bp, Homo sapiens
  misc_feature 1..155: note = chr16:1216382-1216537
  misc_feature 1..155: note = hypo
  source 1..155: mol_type = genomic DNA
ccctgcagaggaggccgcgcagcgtacaaggccctctggccagcccggcaccaactcattcctgttgttggtcttttcccagttttattgagaggtaatttatccaccacctaactcgccaatgaagggtccaattcggtcgttctccctgtatc

SEQ ID NO: 78381 - DNA, 30 bp, Homo sapiens
  misc_feature 1..30: note = chr16:1216945-1216975
  misc_feature 1..30: note = hypo
  source 1..30: mol_type = genomic DNA
aattgctgggtcaggcggaaacagtgttga

SEQ ID NO: 78382 - DNA, 321 bp, Homo sapiens
  misc_feature 1..321: note = chr16:1217182-1217503
  misc_feature 1..321: note = hypo
  source 1..321: mol_type = genomic DNA
gcccctgacctgccccgtggggatgaaacgggctctttgcggggggcctgtggggtatgggcctcctgtcagcagcccgtcccggtgggtggggcttgccggccgcccgcgaatgtcaggaaccttggattcctgacacacgggtgcgggggcgatatcggcgcggagcgggcggggtggcgcccgggccgcgggtgggagaatctggcgtgtgtgtttgcacggcatccatccctccatccgtcctctggagaatttcaacacccacacttggaataaaaaaaaaaattattaatgagcttggtgcggttgccatgggaa

SEQ ID NO: 78383 - DNA, 30 bp, Homo sapiens
  misc_feature 1..30: note = chr16:12177673-12177703
  misc_feature 1..30: note = hypo
  source 1..30: mol_type = genomic DNA
gcttcactcacatcccgccaagtggcttcc

SEQ ID NO: 78384 - DNA, 307 bp, Homo sapiens
  misc_feature 1..307: note = chr16:1217833-1218140
  misc_feature 1..307: note = hypo
  source 1..307: mol_type = genomic DNA
ggggcgtggcctggccgtccgtccgcggggcccgggctgcccatggcagcaggtgctcagtaagcactcgccccaccagtgcgtggagcacgtggggcctcaggagccaggcctgttccccggggctgcctggaggcggccgcttgtccccaaggcctggtgaccgcacctctgtctgccctaggccttcgagttgggggacattttgtaaggagccgctgtgcctaggccagagatgttttcggaaggggtgcctgtaccccgagaggtggaccagaattcccctggggcacggtggcgggagacc

SEQ ID NO: 78385 - DNA, 30 bp, Homo sapiens
  misc_feature 1..30: note = chr16:1218638-1218668
  misc_feature 1..30: note = hypo
  source 1..30: mol_type = genomic DNA
tgcatcgtgctcggccgagttggccctgtg

SEQ ID NO: 78386 - DNA, 215 bp, Homo sapiens
  misc_feature 1..215: note = chr16:1220501-1220716
  misc_feature 1..215: note = hypo
  source 1..215: mol_type = genomic DNA
gacgtaccccgacaccggcctgcggacccccacaagcccagtggccgtcagccttgggattttggggttttccaactttaatcagggaatgtctgtctcccctgcatgagtgatctgtggagcctggtcggcatcctgattgtcatgccgaccgagtttgtggggccctcctcgtgcccccacgatctggacagggatttcggggtgagggaagc

SEQ ID NO: 78387 - DNA, 30 bp, Homo sapiens; identical to SEQ ID NO: 44469
  misc_feature 1..30: note = chr16:1222610-1222640
  misc_feature 1..30: note = hypo
  source 1..30: mol_type = genomic DNA

SEQ ID NO: 78388 - DNA, 30 bp, Homo sapiens
  misc_feature 1..30: note = chr16:1227328-1227358
  misc_feature 1..30: note = hypo
  source 1..30: mol_type = genomic DNA
agccgccggcaccctcggagacagcctgaa

SEQ ID NO: 78389 - DNA, 151 bp, Homo sapiens; identical to SEQ ID NO: 15975
  misc_feature 1..151: note = chr16:1228780-1228931
  misc_feature 1..151: note = hypo
  source 1..151: mol_type = genomic DNA

SEQ ID NO: 78390 - DNA, 342 bp, Homo sapiens
  misc_feature 1..342: note = chr16:1230012-1230354
  misc_feature 1..342: note = hypo
  source 1..342: mol_type = genomic DNA
gcgtgagccaccatgcccggcccggccttgttttttaatatacatctggttgccgggtgatactgagggggccgggctctgcaggcacagggctgaggggcgtcgtgtggatggacggccagcccgttgggtgccctggctgggtccctgtccctgcacaccgggtcagccggctcctgggtgcacaggcaggtggtgtgcgtccgcattgcagaacacggggcgttgcaggccggagctgggttttcacacagattgagaccaggcgtcgcccacagagcataatgtgaggcgagagggactcgggctgctgtgggctggggaggacggtcccatagctgg

SEQ ID NO: 78391 - DNA, 656 bp, Homo sapiens
  misc_feature 1..656: note = chr16:1236485-1237141
  misc_feature 1..656: note = hypo
  source 1..656: mol_type = genomic DNA
cgtcctgagtgccctcgtcttgtccctctccacggcgttctcatcctccggcgattccctgggaacgtctctgtacctctgcacacgtgcccacacacatgcccctcgagatggcctgcactgtggcttctgtcgtgaatgtggtcacgtgtcctccgtgactcgctcctcctgccccgtgtgccctggacctggctcggtcccgatgcccgtggcaccaccgcctcctcaacgggtggccacgtaatgcttcctggccggtgaatgtgccacggcagtggagatattctgcccttctagctcttctgtatacaagcagtgcgccctggttctcagggccgtgaccaccaccatgaccggcagacttcagggcggtccgtcccactcccgtggcctcgagggtcctttggagctgccgcggttctgagtgggggtggacacggacacagggctggttcccggggatctcctgtaccacccactgactcccagggtctgcggctggcccggcccctcctgggtctcttgatgtgggaccaaagctgttgcttcctctgcggcagaggcgatggagtccctcagagcccgcgaccgtcccctccgcactgcgggctgatagcgcctgtgggaatgggcttccccggtgaatacacata

SEQ ID NO: 78392 - DNA, 39 bp, Homo sapiens
  misc_feature 1..39: note = chr16:1245806-1245845
  misc_feature 1..39: note = hypo
  source 1..39: mol_type = genomic DNA
aggtcctccgggtgccgggctggccggttctatgcctgc

SEQ ID NO: 78393 - DNA, 36 bp, Homo sapiens
  misc_feature 1..36: note = chr16:1247968-1248004
  misc_feature 1..36: note = hypo
  source 1..36: mol_type = genomic DNA
tacctcctgaaaagccgctgccggtcctccccaccg

SEQ ID NO: 78394 - DNA, 570 bp, Homo sapiens
  misc_feature 1..570: note = chr16:1248352-1248922
  misc_feature 1..570: note = hypo
  source 1..570: mol_type = genomic DNA
gaggtggagacctggcgccccgctggatgcacgtcagaccccagggtgtcagtgtccctggaggccggtggtggtaggaggggagtcccgatcacactaggggtgcgggaaaatcaccagggggtggcccgagtcagtgtgcagtgggcgtggacacccactgtgaacagtggacggggctcgggggtcccgggaggggctgcagccccgaggacactcctgcagggcttagcagtgccaatcctggccctgctgcccacaggcatgcggatcctggtcactctgctgctggatacgctgcccatgctcgggaacgtccttctgctgtgcttcttcgtcttcttcattttcggcatcgttggcgtccagctctgggctggcctcctgcggaaccgctgcttcctggacagtgcctttgtcaggtgcccaggccccacccccgtgaggcccctgcccagatggccctgcccaccatgcagataacgcaccatgtggctccaccgccccacgtggctctgcccaccgtgcagtcacccgccccgccactgctgtccccgtcatggctccgtc

SEQ ID NO: 78395 - DNA, 272 bp, Homo sapiens
  misc_feature 1..272: note = chr16:1250262-1250534
  misc_feature 1..272: note = hypo
  source 1..272: mol_type = genomic DNA
aacctgaccttcctgcggccgtactaccagacggaggagggcgaggagaacccgttcatctgctcctcacgccgagacaacggcatgcagaagtgctcgcacatccccggccgccgcgagctgcgcatgccctgcaccctgggctgggaggcctacacgcagccgcaggccgagggggtgggcgctgcacgcaacgcctgcatcaactggaaccagtactacaacgtgtgccgctcgggtgactccaacccccacaacggtgccatcaactt

SEQ ID NO: 78396 - DNA, 142 bp, Homo sapiens
  misc_feature 1..142: note = chr16:1251693-1251835
  misc_feature 1..142: note = hypo
  source 1..142: mol_type = genomic DNA
tggtggtgattgccacgcagttctcggagacgaagcagcgggagagtcagctgatgcgggagcagcgggcacgccacctgtccaacgacagcacgctggccagcttctccgagcctggcagctgctacgaagagctgctgaa

SEQ ID NO: 78397 - DNA, 51 bp, Homo sapiens; identical to SEQ ID NO: 44477
  misc_feature 1..51: note = chr16:1253065-1253116
  misc_feature 1..51: note = hypo
  source 1..51: mol_type = genomic DNA

SEQ ID NO: 78398 - DNA, 119 bp, Homo sapiens
  misc_feature 1..119: note = chr16:1255901-1256020
  misc_feature 1..119: note = hypo
  source 1..119: mol_type = genomic DNA
ccccggggccatcagcggataagcggcttttgaggtgcttccgcagctgttcatgcaccttgatgcagccataccctctcccatctgtgggatgcagcacaggccgctgtggctccctg

SEQ ID NO: 78399 - DNA, 359 bp, Homo sapiens
  misc_feature 1..359: note = chr16:1259060-1259419
  misc_feature 1..359: note = hypo
  source 1..359: mol_type = genomic DNA
ctggggccccagtggcgcctggagcagccggcgctccagctggagcagcctgggccgtgcccccagcctcaagcgccgcggccagtgtggggaacgtgagtccctgctgtctggcgagggcaagggcagcaccgacgacgaagctgaggacggcagggccgcgcccgggccccgtgccaccccactgcggcgggccgagtccctggacccacggcccctgcggccggccgccctcccgcctaccaagtgccgcgatcgcgacgggcaggtggtggccctgcccagcgacttcttcctgcgcatcgacagccaccgtgaggatgcagccgagcttgacgacgactcggaggacgtgagtg

SEQ ID NO: 78400 - DNA, 102 bp, Homo sapiens
  misc_feature 1..102: note = chr16:1259773-1259875
  misc_feature 1..102: note = hypo
  source 1..102: mol_type = genomic DNA
ggacccaagagcacccgctcacctggccccgtggactccagcacgggtcactctgccgtcaccagcgtagggaagggggaggctccacggtatgggccccag

SEQ ID NO: 78401 - DNA, 221 bp, Homo sapiens
  misc_feature 1..221: note = chr16:1260220-1260441
  misc_feature 1..221: note = hypo
  source 1..221: mol_type = genomic DNA
catggtggatatttccgagtgggcaccccttctcacaccgcagggaccggggctgaagtggaggcgtggccagggctgtcctgcaacccccatccactctgccatccacgccgccccgccccacctctcacccgcccccgcccacccaggttccgcgtctcctgccagaaggtcatcacacacaagatgtttgatcacgtggtcctcgtcttcatcttcct

SEQ ID NO: 78402 - DNA, 67 bp, Homo sapiens
  misc_feature 1..67: note = chr16:1260766-1260833
  misc_feature 1..67: note = hypo
  source 1..67: mol_type = genomic DNA
gtgccattggccctccgcaggtggtggccctggggctgctgtccggcgagcacgcctacctgcagag

SEQ ID NO: 78403 - DNA, 30 bp, Homo sapiens
  misc_feature 1..30: note = chr16:1261095-1261125
  misc_feature 1..30: note = hypo
  source 1..30: mol_type = genomic DNA
tttgctgagctctgccggcgcctggcagct

SEQ ID NO: 78404 - DNA, 582 bp, Homo sapiens
  misc_feature 1..582: note = chr16:1261601-1262183
  misc_feature 1..582: note = hypo
  source 1..582: mol_type = genomic DNA
gccaggtgggctgggcggccgggcgggagctgggggtctccaggacaccctggagcgagagggccggcgaccccagctctaaccctcgccagtgaccctggctctggccctcaggccctgatgtcgctgttcgtgctgtcatccaaggatggatgggtgaacatcatgtacgacgggctggatgccgtgggtgtcgaccagcaggtgcgcacaggcgggtcgagctgggtcacctcagggtctcccgcgagcggctgccttggcctctggggactcggggggccatcctgggtagggcccctggcggggcaggcgggcggggacccaccgcctctgtgccacagcctgtgcagaaccacaacccctggatgctgctgtacttcatctccttcctgctcatcgtcagcttcttcgtgctcaacatgttcgtgggcgtcgtggtcgagaacttccacaagtgccggcagcaccaggaggcggaggaggcgcggcggcgagaggagaagcggctgcggcgcctagagaggaggcgcaggagtaaggcgctcccggtggcggtggcggtggcgggtcggtacctgt

SEQ ID NO: 78405 - DNA, 47 bp, Homo sapiens; identical to SEQ ID NO: 44481
  misc_feature 1..47: note = chr16:1262447-1262494
  misc_feature 1..47: note = hypo
  source 1..47: mol_type = genomic DNA

SEQ ID NO: 78406 - DNA, 38 bp, Homo sapiens
  misc_feature 1..38: note = chr16:1262762-1262800
  misc_feature 1..38: note = hypo
  source 1..38: mol_type = genomic DNA
ggacacccagagcaacgaggggccgcccacacccctgc

SEQ ID NO: 78407 - DNA, 33 bp, Homo sapiens
  misc_feature 1..33: note = chr16:1263717-1263750
  misc_feature 1..33: note = hypo
  source 1..33: mol_type = genomic DNA
tgcaggagccaggagcgccgggcggccctcctg

SEQ ID NO: 78408 - DNA, 30 bp, Homo sapiens
  misc_feature 1..30: note = chr16:1264397-1264427
  misc_feature 1..30: note = hypo
  source 1..30: mol_type = genomic DNA
cgttttgtgtggagccgaggatggccgtgg

SEQ ID NO: 78409 - DNA, 183 bp, Homo sapiens
  misc_feature 1..183: note = chr16:1265150-1265333
  misc_feature 1..183: note = hypo
  source 1..183: mol_type = genomic DNA
ccgcaggctttcccacggaggtctgcagaagcaacgctgctgagccgaggcggggaccccagacgtgtgcgctgagcctccggccacacaggtggaaccagctggacctggccatcgtgctgctgtcactcatgggcatcacgctggaggagatagagatgagcgccgcgctgcccatcaacc

SEQ ID NO: 78410 - DNA, 97 bp, Homo sapiens
  misc_feature 1..97: note = chr16:1265614-1265711
  misc_feature 1..97: note = hypo
  source 1..97: mol_type = genomic DNA
ctcagcgcaggcccccggaagacggggttgcagggagcgcctcgccgtccccctctccccctcactcgtttctctggtccctcggttgtgtggtggc

SEQ ID NO: 78411 - DNA, 40 bp, Homo sapiens
  misc_feature 1..40: note = chr16:1266380-1266420
  misc_feature 1..40: note = hypo
  source 1..40: mol_type = genomic DNA
cagccttggagggtgcgccgcccagcggggcagtgtgtgc

SEQ ID NO: 78412 - DNA, 30 bp, Homo sapiens; identical to SEQ ID NO: 44483
  misc_feature 1..30: note = chr16:1267184-1267214
  misc_feature 1..30: note = hypo
  source 1..30: mol_type = genomic DNA

SEQ ID NO: 78413 - DNA, 869 bp, Homo sapiens
  misc_feature 1..869: note = chr16:1267696-1268565
  misc_feature 1..869: note = hypo
  source 1..869: mol_type = genomic DNA
gccccagcccaggtgcggcagcaggggcctcggcccaggggctccgacctcacacccagggtcaccctctgccaggcagggcgaaccgccagggcctcgtcatccacatcctccgggctatcctgcctctgggctccccaaggggcatgtggaggctgggtgcatgtcccgcctccacccggagcgggctcggctgaccgggcggggtctccctccccgcagagtgcagtgaagacaacccctgcgagggcctgagcaggcacgccaccttcagcaacttcggcatggccttcctcacgctgttccgcgtgtccacgggggacaactggaacgggatcatgaaggtacccgccgcggccatgcctctggcacctggcagccccagcggtttttcaggctctcccaggaacgggtcggatccgtccttgcagggcagggggaaggggacggcactgccagggtggcacccgcgggtgggtgtggaccccggcccacagctgtcccccaccgcaggacacgctgcgcgagtgctcccgtgaggacaagcactgcctgagctacctgccggccctgtcgcccgtctacttcgtgaccttcgtgctggtggcccagttcgtgctggtgaacgtggtggtggccgtgctcatgaagcacctggaggagagcaacaaggaggcacgggaggatgcggagctggacgccgagatcgagctggagatggcgcagggccccgggagtgcacgccgggtggacgcggacaggcctcccttgccccaggagagtccgggcgccagggacgccccaaacctggttgcacgcaaggtgtccgtgtccaggatgctctcgctgcccaacgacagctacatgtt

SEQ ID NO: 78414 - DNA, 252 bp, Homo sapiens
  misc_feature 1..252: note = chr16:1270197-1270449
  misc_feature 1..252: note = hypo
  source 1..252: mol_type = genomic DNA
aggaggccgaggcctcggacccagccgacgaggaggtcagccacatcaccagctccgcctgcccctggcagcccacagccgagccccatggccccgaagcctctccggtggccggcggcgagcgggacctgcgcaggctctacagcgtggatgctcagggcttcctggacaagccgggccgggcagacgagcagtggcggccctcggcggagctgggcagcggggagcctggggaggcgaaggcctggggcc

SEQ ID NO: 78415 - DNA, 517 bp, Homo sapiens
  misc_feature 1..517: note = chr16:1271155-1271672
  misc_feature 1..517: note = hypo
  source 1..517: mol_type = genomic DNA
agcaggagtagctgccgggccccacgagcctccgtccgttctggttcgggtttctccgagttttgctaccagccgaggctgtgcgggcaactgggtcagcctcccgtcaggagagaagccgcgtctgtgggacgaagaccgggcacccgccagagaggggaaggtaccaggttgcgtcctttcaggccccgcgttgttacaggacactcgctgggggccctgtgcccttgccggcggcaggttgcagccaccgcggcccaatgtcaccttcactcacagtctgagttcttgtccgcctgtcacgccctcaccaccctccccttccagccaccaccctttccgttccgctcgggccttcccagaagcgtcctgtgactctgggagaggtgacacctcactaaggggccgaccccatggagtaacgcgcccggccccgatgcgaatcaggcctcccctacatctgggggcgttggccgcgagattcccattgacacctttgtttcgtgtgcttttaaat

SEQ ID NO: 78416 - DNA, 38 bp, Homo sapiens; identical to SEQ ID NO: 44487
  misc_feature 1..38: note = chr16:1272194-1272232
  misc_feature 1..38: note = hypo
  source 1..38: mol_type = genomic DNA

SEQ ID NO: 78417 - DNA, 114 bp, Homo sapiens
  misc_feature 1..114: note = chr16:12758831-12758945
  misc_feature 1..114: note = hypo
  source 1..114: mol_type = genomic DNA
cggcggtgaccaccacgactcggagcccgtgggggtctctgcccagctggcatccaatggcagatgacaccaccatgtcgaggttctggtaggtacccccggcattcctgtggt

SEQ ID NO: 78418 - DNA, 30 bp, Homo sapiens
  misc_feature 1..30: note = chr16:12798468-12798498
  misc_feature 1..30: note = hypo
  source 1..30: mol_type = genomic DNA
cggggcctctacctgcgtggatgaacttgt

SEQ ID NO: 78419 - DNA, 30 bp, Homo sapiens; identical to SEQ ID NO: 44488
  misc_feature 1..30: note = chr16:1288468-1288498
  misc_feature 1..30: note = hypo
  source 1..30: mol_type = genomic DNA

SEQ ID NO: 78420 - DNA, 108 bp, Homo sapiens
  misc_feature 1..108: note = chr16:12897794-12897902
  misc_feature 1..108: note = hyper
  source 1..108: mol_type = genomic DNA
ctagtgctgcctgggcggagcggaggcgccagcggcccctctgggatcgacctgcgcgcctggcgagtggagactgtctagggcacgcgtgggcggggataaggcttt

SEQ ID NO: 78421 - DNA, 30 bp, Homo sapiens
  misc_feature 1..30: note = chr16:12956299-12956329
  misc_feature 1..30: note = hypo
  source 1..30: mol_type = genomic DNA
ccactgctcacctcccgctcacccaccgct

SEQ ID NO: 78422 - DNA, 71 bp, Homo sapiens
  misc_feature 1..71: note = chr16:12971895-12971966
  misc_feature 1..71: note = hypo
  source 1..71: mol_type = genomic DNA
ttttcttcttcctcgcgcttctagcgttgatataaataagcacttatagaaggactcgatttctctttttt

SEQ ID NO: 78423 - DNA, 30 bp, Homo sapiens
  misc_feature 1..30: note = chr16:1297961-1297991
  misc_feature 1..30: note = hypo
  source 1..30: mol_type = genomic DNA
atccatgcactcacacgtgcacacagatgc

SEQ ID NO: 78424 - DNA, 1385 bp, Homo sapiens
  misc_feature 1..1385: note = chr16:12994419-12995804
  misc_feature 1..1385: note = hyper
  source 1..1385: mol_type = genomic DNA
cggggagctggaattcgctaggagagagagggcagatttggaaacacagaggagacgggaggctggaagctgaggaagcaaggcagagctctgcagcccccggtgaggatttccggggggatccgtggggacaggggccagccagctccagagaccgatgcgcgggctccaggtccgggagggtggctgaggctgggtgcccaggccttgcgctgcgccagatccgggagcgcagaggcggcgccgcggtgttccctcctgtggagcgcagaaaacgctgcgggggcgaagagggacagaaagcggcaggttcgagaggctgggggacttccaaggaaagaccttccaggacacgccatagcctcggccttgttcggctgtcccctcttacccccgaccttctttgattcgttcatcccgagcccctctcccccggagggtgcttatccctggctcaggggcttgccacctgtccttcccagctccgcctgggtccttgcttgggcccagagagttgagccatgcgggttgcgctcagggctggagggcgcagccgggaagggcaaggaggccccgcacgcctgggaggggcgatcctgaccagactgcacccagtctgtcttggagtgaaagccatttagtctgtccccatcctctccgagtcatccttcccctgatgcacagatttcggccgccgctcctgcacacgcaccggtgaaaaagctacgagctgagccgcctctgcgctctggacagggctgagccgcgcctcctacccagagagggcgcgggaggtcctgccgcggttttccacctgcctggaaatccgagcggctcctctagcctcggctgctgccgagctcgctcctccccgtccgctcgcctggctcagctctgcacgccccccagctagctcccgctctagtcacctcttccccgcgcccccgcccctctagagctcgcgcccgcccccccccacccgcgcctcctctgcccgccctcctccccctcccccttccctcctgccctcccttcattccacaagtgtcgcttcgctctcttcagcgcacttggcgagctggtgaggtgagagggatactgcgagagggctaggggcggccagtccggggctgccggccaaggctaggcgctgccagcccgattctcctctgctctccacccccgcctcacccagtggccggccggacctgcaccccgcgcttgaccccgctcatcctccccccgcccggccgggcgcgctcctccccggccggcccctcggcgcgcggcgcgctggaggcgaacgcgggctgaggcgaacgcgggctgagccgagcgcagtggccgccgaccaccgagcgccccgcgccgctccctgcatgtgc

SEQ ID NO: 78425 - DNA, 1630 bp, Homo sapiens; identical to SEQ ID NO: 36076
  misc_feature 1..1630: note = chr16:12996073-12997703
  misc_feature 1..1630: note = hyper
  source 1..1630: mol_type = genomic DNA

SEQ ID NO: 78426 - DNA, 27 bp, Homo sapiens
  misc_feature 1..27: note = chr16:13064659-13064686
  misc_feature 1..27: note = hypo
  source 1..27: mol_type = genomic DNA
tgtgagccaccgcgcctggccggggca

SEQ ID NO: 78427 - DNA, 64 bp, Homo sapiens
  misc_feature 1..64: note = chr16:1307000-1307064
  misc_feature 1..64: note = hypo
  source 1..64: mol_type = genomic DNA
cggagaccttccccccggggatgccgtgctgggtcactggctggggcgacgtggacaataatgg

SEQ ID NO: 78428 - DNA, 30 bp, Homo sapiens
  misc_feature 1..30: note = chr16:1307785-1307815
  misc_feature 1..30: note = hypo
  source 1..30: mol_type = genomic DNA
cgggctctgcacccccgtgccatggagccc

SEQ ID NO: 78429 - DNA, 318 bp, Homo sapiens
  misc_feature 1..318: note = chr16:1312397-1312715
  misc_feature 1..318: note = hypo
  source 1..318: mol_type = genomic DNA
tttgggcccacagcccgagtccttccccagcctccacccaacacgccccgaacatcctgatcgctccccagccagtcacccagcactggtccttcggggtgagctccagcgagaccggggagagcttgaccgtcctgacattagcggctcagatcatggggctcaccagctggagcagggccacatccgcacccagccccgcagtgacatagttggggtggacgatgatccggctgacgttcagcagcccccggcccccgtagagatacacgtccccagcgtggatccggtagatggacgggtcggtgtccttcctgg

SEQ ID NO: 78430 - DNA, 133 bp, Homo sapiens; identical to SEQ ID NO: 44491
  misc_feature 1..133: note = chr16:1315371-1315504
  misc_feature 1..133: note = hypo
  source 1..133: mol_type = genomic DNA

SEQ ID NO: 78431 - DNA, 30 bp, Homo sapiens
  misc_feature 1..30: note = chr16:1316065-1316095
  misc_feature 1..30: note = hypo
  source 1..30: mol_type = genomic DNA
aggggtcctgggctgcggggggctggggga

SEQ ID NO: 78432 - DNA, 33 bp, Homo sapiens
  misc_feature 1..33: note = chr16:1321465-1321498
  misc_feature 1..33: note = hypo
  source 1..33: mol_type = genomic DNA
ggtgctggggatggccgtcgtgtagcaggtggc

SEQ ID NO: 78433 - DNA, 432 bp, Homo sapiens
  misc_feature 1..432: note = chr16:1323678-1324110
  misc_feature 1..432: note = hypo
  source 1..432: mol_type = genomic DNA
ggactcacgtgtagacgccaatgctgggccgatcactgtaaaatccccagctcactactcccgcctggagccaggtacccttcttcttgcagaccagggggctgcctgagtcaccctgtggagcagagaaggcccagcttgaccagagacccaggaccctgcacatccaagtccagcatcggagccgcagacaggaaaagagatggcaggagagaggcgccaggtctcaccttccaggtgcggcggcccgtgcggccggcacagatcatgtcatcctggatgaactttctgtctccagcaccaggaaaagcatcgtaggtctgccgctcacagtctgcattgctcagtgtgaggaccttcacctgctgcgggcggtaaggaggcggcagcatatctgcagagacaagccacgggtggcgggagcagctcagg

SEQ ID NO: 78434 - DNA, 30 bp, Homo sapiens
  misc_feature 1..30: note = chr16:13266811-13266841
  misc_feature 1..30: note = hypo
  source 1..30: mol_type = genomic DNA
cttttttgtgattgccgtgtgctcccaagt

SEQ ID NO: 78435 - DNA, 51 bp, Homo sapiens
  misc_feature 1..51: note = chr16:1329677-1329728
  misc_feature 1..51: note = hypo
  source 1..51: mol_type = genomic DNA
gacagctagctcatccgtgggctctgggaacccgggcggggaggctgagct

SEQ ID NO: 78436 - DNA, 36 bp, Homo sapiens
  misc_feature 1..36: note = chr16:1330337-1330373
  misc_feature 1..36: note = hypo
  source 1..36: mol_type = genomic DNA
agcagctcccacagccgacgccgagggcagagggcc

SEQ ID NO: 78437 - DNA, 280 bp, Homo sapiens
  misc_feature 1..280: note = chr16:1330636-1330916
  misc_feature 1..280: note = hypo
  source 1..280: mol_type = genomic DNA
ttgggctcatggtcccgctcagcagaaacaacacactcaagctccaacggaagccagaagggaatcacagggctgcagtgctatagaacgtgacgttcccaaaattaaagacgggagctccaacaaataggagaaaaagccatctagaaaagaagcaacagccacactgaagccgtgggtcacactgagagctgtgccttctgtcccaacctgcgatgggtgttggggagaggacagctagctcatccttgggctatgggaaccccggggggtcggaggc

SEQ ID NO: 78438 - DNA, 156 bp, Homo sapiens
  misc_feature 1..156: note = chr16:13676585-13676741
  misc_feature 1..156: note = hypo
  source 1..156: mol_type = genomic DNA
atttgtttatattctaactacagccccagaaagatagtcatcattaatccctactttacagaggaggaacccggggcttagagaagggaattgaactgcccaggctcatattgctaggagttagccaagctgcgtatgaaacgactacctcttctg

SEQ ID NO: 78439 - DNA, 93 bp, Homo sapiens
  misc_feature 1..93: note = chr16:13687295-13687388
  misc_feature 1..93: note = hypo
  source 1..93: mol_type = genomic DNA
cggtgtgatcatcatcgaaccatgacctgacactcctagtgagtgtggggagaacccctctgcccatctacctggaacaatatgagctataaa

SEQ ID NO: 78440 - DNA, 324 bp, Homo sapiens; identical to SEQ ID NO: 36012
  misc_feature 1..324: note = chr16:1382374-1382698
  misc_feature 1..324: note = hyper
  source 1..324: mol_type = genomic DNA

SEQ ID NO: 78441 - DNA, 324 bp, Homo sapiens; identical to SEQ ID NO: 36013
  misc_feature 1..324: note = chr16:1382818-1383142
  misc_feature 1..324: note = hyper
  source 1..324: mol_type = genomic DNA

SEQ ID NO: 78442 - DNA, 308 bp, Homo sapiens
  misc_feature 1..308: note = chr16:1383678-1383986
  misc_feature 1..308: note = hyper
  source 1..308: mol_type = genomic DNA
gtgcctcggcgtccccgagctggtgccgagcgcagcgccccaggagcccccccatccccgcgccggcccacggtaagtgccgcgggctgcggccagtgctgttgggccgccgtctgggctcggccccgcgccccaacccggacggaccgacggccgccgcccccttggtccgggtcccccaggaggcacgggggtggcctccgaggcggggggcggtgggaaggtctcgacgtcccctcggccctggggaaactgaggccgcgcatgcttggaggggcggggtctcgggggcatttcccctccgaacg

SEQ ID NO: 78443 - DNA, 78 bp, Homo sapiens
  misc_feature 1..78: note = chr16:1384020-1384098
  misc_feature 1..78: note = hyper
  source 1..78: mol_type = genomic DNA
cggagcggacggggagggtatccgggcgctggcgacggcctcccccgcacttgagccgccaagcgaggcttcgacccc

SEQ ID NO: 78444 - DNA, 312 bp, Homo sapiens
  misc_feature 1..312: note = chr16:1384458-1384770
  misc_feature 1..312: note = hyper
  source 1..312: mol_type = genomic DNA
gggcagggagggggtcggtgagcagagggaggagggagcgctgcgcagacacgggcgaggggaggaagaaggcgcctcgggctccggtctcctgcgctcctgctgggcgccagcggctggaccttggcagccgtctgaggcttcggggagcccaaggccaccggcagcgcttgttagaatgcagattcccggggttcgactggaatgagaccccggggagcagcgtttgcagcgggcccgccaggtgacctgcacctgggcaccgccatcggcttcgcaggggccatctggaggagtcggtgagaccaggga

SEQ ID NO: 78445 - DNA, 30 bp, Homo sapiens
  misc_feature 1..30: note = chr16:1390516-1390546
  misc_feature 1..30: note = hypo
  source 1..30: mol_type = genomic DNA
aggtgcacacagacacgcacacacacacac

SEQ ID NO: 78446 - DNA, 527 bp, Homo sapiens
  misc_feature 1..527: note = chr16:1391705-1392232
  misc_feature 1..527: note = hypo
  source 1..527: mol_type = genomic DNA
agcctgtctggagagcgggtgcttgtggcctggtccctgctgcttctggactccctgaccccggcctgggcagagcctcgccggggaccctcatgggcatctctgttctccttgtagcgagattgaggatgtgagcacggaccagctgcacctggacatctggtacaggcccctgcgccatgcagggcggcggggatgcacaccttttgcgggggagcaggacggactcagggcccggctgcgggctccagacaagccaggtcctcccctgtccccaccagggatcatgacgacgatgtatccctggtagaagcgtgcaggaagctgaatgaagtcatcggcctgaagggcatgggcaggtatgactgctgggacctttctacccatcacccgtgccctcagcttggtcatggggcccggcgggcagtggctccccaggagccatcagcgtgatgctcaccacctgtggtggccaggtacttcaaacagatcgtcaagtcagcccgcgcaaacgggacagcaggacc

SEQ ID NO: 78447 - DNA, 30 bp, Homo sapiens
  misc_feature 1..30: note = chr16:1394474-1394504
  misc_feature 1..30: note = hypo
  source 1..30: mol_type = genomic DNA
caaccgtgagtggtacgacaggatcctgaa

SEQ ID NO: 78448 - DNA, 30 bp, Homo sapiens; identical to SEQ ID NO: 44496
  misc_feature 1..30: note = chr16:1397121-1397151
  misc_feature 1..30: note = hypo
  source 1..30: mol_type = genomic DNA

SEQ ID NO: 78449 - DNA, 437 bp, Homo sapiens
  misc_feature 1..437: note = chr16:1397422-1397859
  misc_feature 1..437: note = hypo
  source 1..437: mol_type = genomic DNA
aactgcagccccacacgggctgtgtccttgagcatgaggtggccccacgggcagtcaggtctccaagtgccagcgctgaccaccagcacccaggggcccctcctgatgcgcttccccctgcagaggctgaaggaggagctgcggctgcacaaatgttccacccgcgagtgcatcgagcagttctacctggacaagctcaaacaggtagggaggcgccagggacagggtgctgcctccgaggctcccagagcccagctgcgctcacccgcctttccgcagaggaccctggagcagaaccggtttggacgcctgagcgtccgttgccattacgaggcggctgagcagcggctggccgtggaggtgctgcacgccgcggacctgctccccctggacgccaacggtgagttgcagcggggacgggtcgggtggtggtggga

SEQ ID NO: 78450 - DNA, 30 bp, Homo sapiens
  misc_feature 1..30: note = chr16:13977355-13977385
  misc_feature 1..30: note = hypo
  source 1..30: mol_type = genomic DNA
acaccaccacccaaccgtaatctctaatgc

SEQ ID NO: 78451 - DNA, 112 bp, Homo sapiens
  misc_feature 1..112: note = chr16:1400845-1400957
  misc_feature 1..112: note = hypo
  source 1..112: mol_type = genomic DNA
gaaagtctgtagggccggccatagttcacggggttggcggccaccaggtagggcaacaggcgcaagtggctccctcgcatcttcccaaacggtgtctcgtccagcctggccc

SEQ ID NO: 78452 - DNA, 30 bp, Homo sapiens
  misc_feature 1..30: note = chr16:1404083-1404113
  misc_feature 1..30: note = hypo
  source 1..30: mol_type = genomic DNA
aggctcacttccctgcggctcagaagccat

SEQ ID NO: 78453 - DNA, 32 bp, Homo sapiens
  misc_feature 1..32: note = chr16:1407453-1407485
  misc_feature 1..32: note = hypo
  source 1..32: mol_type = genomic DNA
agtcacccagcacctcgtgtgtatttcgactt

SEQ ID NO: 78454 - DNA, 151 bp, Homo sapiens
  misc_feature 1..151: note = chr16:1407785-1407936
  misc_feature 1..151: note = hypo
  source 1..151: mol_type = genomic DNA
tgacagtcatgagccaccgcgcctggcctcgactttattattaatacggtaaaactacagagagtttgaaacatcagtctggggcgtcctcctctaaccagtgcacttgctgctgcagcgcaggcccttcaggggacggggatgggggcca

SEQ ID NO: 78455 - DNA, 364 bp, Homo sapiens
  misc_feature 1..364: note = chr16:1417076-1417440
  misc_feature 1..364: note = hypo
  source 1..364: mol_type = genomic DNA
ccagagcaggactcacgccgtccaccgcctccaggtccaggcgcagctgactctgcagcgagtgcagcttcggcaggggaatggtgccgatgtccccacagccccgcagccccggcagtgtggaggctacgcccaggccctccagctcctcctgcagctgcttcacctgtgcctccacctcctccttcttctgcagcgccagctgccggtcgctatcggccacacgggcacgctccttggcctcctgcgcctctcgctgccaggcatcgcagacctgaaacccagggcccgtctcagcaccccccacctcacctgtgccacctgcagaccctcttgcctgtgtcaccagcgatcctcccctccc

SEQ ID NO: 78456 - DNA, 431 bp, Homo sapiens
  misc_feature 1..431: note = chr16:1417675-1418106
  misc_feature 1..431: note = hypo
  source 1..431: mol_type = genomic DNA
gactcctcccactgccggatcttcctcttggcctcgtccagctgccgcctgacccgggccagctcagctccgtttggacttgcactcgaagaggatggggggccggcactcaggatgggggaggggctgggggagaagctgccggaaacaaagtcccagatgctcccggggacaccgttcaaacctgagtgtgaaacggtcgatgacggcccagccctgctgtgctcgcggcctggtgggattggtgggtgctatgccccaggccccaccgctacgtgggcaccctctggggctcacctgccctggcagcaggggtgcagccacgcctgccccttgccccactcctggaccccaccaggctcaggaagaggcgctgacagtgacacctgccccggccggtctccccaccagatctacgccttcctggccac

SEQ ID NO: 78457 - DNA, 30 bp, Homo sapiens
  misc_feature 1..30: note = chr16:1424439-1424469
  misc_feature 1..30: note = hypo
  source 1..30: mol_type = genomic DNA
gtcctcacctgggaccgatggtccctccat

SEQ ID NO: 78458 - DNA, 284 bp, Homo sapiens
  misc_feature 1..284: note = chr16:1425400-1425684
  misc_feature 1..284: note = hypo
  source 1..284: mol_type = genomic DNA
cccagactcaaccctcgtccacacgccagccgtgagggaatttccggggcgtggaggccgggctgtggcgccacctggcaacactgtccttccccatcccgtcacagaggcagcagggcccagggcagagaacctgaacccctggggcgtccgggacggcacacggcgcatgcgggagtggcctccactcccacggagacaccgttccaatgaagcttttagggactttcgaaggtcttatccagaaactagagtaacaggttgggggtcggggcagccaggcc

SEQ ID NO: 78459 - DNA, 57 bp, Homo sapiens; identical to SEQ ID NO: 15935
  misc_feature 1..57: note = chr16:142626-142683
  misc_feature 1..57: note = hypo
  source 1..57: mol_type = genomic DNA

SEQ ID NO: 78460 - DNA, 794 bp, Homo sapiens; identical to SEQ ID NO: 44503
  misc_feature 1..794: note = chr16:1428113-1428907
  misc_feature 1..794: note = hypo
  source 1..794: mol_type = genomic DNA

SEQ ID NO: 78461 - DNA, 266 bp, Homo sapiens
  misc_feature 1..266: note = chr16:1430200-1430466
  misc_feature 1..266: note = hypo
  source 1..266: mol_type = genomic DNA
cttaaatacagaatccgctcatttcttctattccgtgctccagtcacagtacacctacaacctgaaggaaactgtactattaacacaaggaaaaaacgacccagtctacacaccagctttgtccaaaaccctctacaacagctaataaaatacacacgcagccaggcgggcctacacctggggccagacagtcccgggagccatgggcagggagtccctgagcctggggcgcaggagtgccctggggtcagcgggcaggacactgc

SEQ ID NO: 78462 - DNA, 30 bp, Homo sapiens
  misc_feature 1..30: note = chr16:14359651-14359681
  misc_feature 1..30: note = hypo
  source 1..30: mol_type = genomic DNA
ataagatggcaatctcggatctacaaggtg

SEQ ID NO: 78463 - DNA, 32 bp, Homo sapiens; identical to SEQ ID NO: 44607
  misc_feature 1..32: note = chr16:14464204-14464236
  misc_feature 1..32: note = hypo
  source 1..32: mol_type = genomic DNA

SEQ ID NO: 78464 - DNA, 44 bp, Homo sapiens
  misc_feature 1..44: note = chr16:14615356-14615400
  misc_feature 1..44: note = hypo
  source 1..44: mol_type = genomic DNA
gttaaatatatgtaacgggccgggcacggtggctcacgcctgta

SEQ ID NO: 78465 - DNA, 39 bp, Homo sapiens
  misc_feature 1..39: note = chr16:1469293-1469332
  misc_feature 1..39: note = hypo
  source 1..39: mol_type = genomic DNA
aaaaaaaaaggaaaacgaaactttttttttttttttgag

SEQ ID NO: 78466 - DNA, 98 bp, Homo sapiens
  misc_feature 1..98: note = chr16:1469572-1469670
  misc_feature 1..98: note = hypo
  source 1..98: mol_type = genomic DNA
aagtgctgggattacaggcgtcagccaccgcgcccgaccggaaaaggaaacttttaaaaatagctgctggtgcaactaacttacgtgctctggtaaac

SEQ ID NO: 78467 - DNA, 88 bp, Homo sapiens
  misc_feature 1..88: note = chr16:14724470-14724558
  misc_feature 1..88: note = hypo
  source 1..88: mol_type = genomic DNA
tattaagaaaaagagcggggcgatgtaatagagaataatgggatccgggtgcggtggctcacgcctgtaagcctaacactttgggaac

SEQ ID NO: 78468 - DNA, 102 bp, Homo sapiens
  misc_feature 1..102: note = chr16:14725771-14725873
  misc_feature 1..102: note = hypo
  source 1..102: mol_type = genomic DNA
tgaactgggaagcagcgtattaataaatctgtataaataactgtttaatgggggcctggcgccatgactcacacctgtaatcccagcgttttcgggggctga

SEQ ID NO: 78469 - DNA, 102 bp, Homo sapiens
  misc_feature 1..102: note = chr16:14726113-14726215
  misc_feature 1..102: note = hypo
  source 1..102: mol_type = genomic DNA
tcaaaaacaaacaacaacaacaaaacaaaaccaaataatcagcataagttctagacgctgtgacctagacgctgggaaggggcgaaacgtggtgataagaaa

SEQ ID NO: 78470 - DNA, 30 bp, Homo sapiens; identical to SEQ ID NO: 44610
  misc_feature 1..30: note = chr16:14728494-14728524
  misc_feature 1..30: note = hypo
  source 1..30: mol_type = genomic DNA

SEQ ID NO: 78471 - DNA, 48 bp, Homo sapiens; identical to SEQ ID NO: 44611
  misc_feature 1..48: note = chr16:14761842-14761890
  misc_feature 1..48: note = hypo
  source 1..48: mol_type = genomic DNA

SEQ ID NO: 78472 - DNA, 91 bp, Homo sapiens
  misc_feature 1..91: note = chr16:1477599-1477690
  misc_feature 1..91: note = hypo
  source 1..91: mol_type = genomic DNA
gctaattcatccacccgtcccccagggggtccccatatcccaccctcgcccctccggccacccctgggttccccttcgctgcctgcttgga

SEQ ID NO: 78473 - DNA, 367 bp, Homo sapiens
  misc_feature 1..367: note = chr16:1486290-1486657
  misc_feature 1..367: note = hypo
  source 1..367: mol_type = genomic DNA
gtggcagggtgagcccggtgctgggccaggcccgggctcagggggaacaggtctgtcacgataccaggggattgtggagagtagcgtggggaccggcccagcccagtaacggtcagcagagcccctgcccctctcccagggcctggaggctgtacctggccttgccttcggcggaaatcctgaggtctgagtcgctcttatgaagcaggcacttgtcggagacactctctatctgaacacagagccgggagcggcgggcagccccagggcgccatctaggaccagccttggcctcgacccacacagggagagggaggaggggagaggacaaggtgcagggagaagggtcccacgccacctccaaggc

SEQ ID NO: 78474 - DNA, 129 bp, Homo sapiens
  misc_feature 1..129: note = chr16:1487040-1487169
  misc_feature 1..129: note = hypo
  source 1..129: mol_type = genomic DNA
gaccacacaggtgcccgagggaggcagggcaggccccggtgggacccagccccgaaacgcagggtgtcgcccacgtttgcagccgcgctcgcgtgtcggtggatgagcgggaaccggggggcggcgcct

SEQ ID NO: 78475 - DNA, 49 bp, Homo sapiens
  misc_feature 1..49: note = chr16:1487580-1487629
  misc_feature 1..49: note = hypo
  source 1..49: mol_type = genomic DNA
ccagctcgggcctcacgggctgcagatgctgggccgaggctgctcagcg

SEQ ID NO: 78476 - DNA, 150 bp, Homo sapiens
  misc_feature 1..150: note = chr16:1487901-1488051
  misc_feature 1..150: note = hypo
  source 1..150: mol_type = genomic DNA
ctgcccggccagctgcgccacggatgcctccagagcccggctcttctctcggagctgcaggggacaggtgggcacggggaggcctggctgagcgcccatcccgtgtgcgtgggagaccccgttggggacatgttgcgctaccccctcacc

SEQ ID NO: 78477 - DNA, 30 bp, Homo sapiens; identical to SEQ ID NO: 44506
  misc_feature 1..30: note = chr16:1488680-1488710
  misc_feature 1..30: note = hypo
  source 1..30: mol_type = genomic DNA

SEQ ID NO: 78478 - DNA, 498 bp, Homo sapiens
  misc_feature 1..498: note = chr16:1491115-1491613
  misc_feature 1..498: note = hypo
  source 1..498: mol_type = genomic DNA
tctcaaaacaaaaaacgagtgtcggcctggctttgctgcctctggccctagagagcactcagacacccggactcagggaaaggcagacgccctcatgagcggcagctcccccacacctggcaccttgggaatcctcagcccagcacccctgcctgctccacacggccactcagtaacttcctgaagggcagtgagagggaggctgccggctccgggcagtggagctatgtgggtggcagctgggtgccccggcagtcctggcccctcacccagcgtactgcctgatgcgcacgggagctggctgcagtccccggtctctatttgtggagctcagacccgggctgctgaaatgtgcagctgcccgttccctccccacccacagcggaggcccctgctgaggccacagcaggagggggagccactccagccccgtgggtgggaccctggcttctaggaactcgtgtcctcgaggaaggtgaactccgctttgtgtgcagg

SEQ ID NO: 78479 - DNA, 117 bp, Homo sapiens
  misc_feature 1..117: note = chr16:1493574-1493691
  misc_feature 1..117: note = hypo
  source 1..117: mol_type = genomic DNA
agccctgcagctgcacgcgggcccgcacctggagcagctcccgcagcaggctccgcgtggcgcgctcacagcgctgcttgtgctcccgcaggcaggccacctcggcctgcagctcca

SEQ ID NO: 78480 - DNA, 48 bp, Homo sapiens
  misc_feature 1..48: note = chr16:15052961-15053009
  misc_feature 1..48: note = hypo
  source 1..48: mol_type = genomic DNA
taaattacttcattacgttgatgcttcatcatccgtggaagctgtgac

SEQ ID NO: 78481 - DNA, 35 bp, Homo sapiens
  misc_feature 1..35: note = chr16:15191537-15191572
  misc_feature 1..35: note = hypo
  source 1..35: mol_type = genomic DNA
tatcgcccaatttaagaagccgaacattaactagg

SEQ ID NO: 78482 - DNA, 24 bp, Homo sapiens
  misc_feature 1..24: note = chr16:1523806-1523830
  misc_feature 1..24: note = hypo
  source 1..24: mol_type = genomic DNA
aggcgcagtggctcacgcctgtaa

SEQ ID NO: 78483 - DNA, 24 bp, Homo sapiens
  misc_feature 1..24: note = chr16:1524070-1524094
  misc_feature 1..24: note = hypo
  source 1..24: mol_type = genomic DNA
gtgaaactccgtctcaaaaaaaaa

SEQ ID NO: 78484 - DNA, 174 bp, Homo sapiens
  misc_feature 1..174: note = chr16:15241215-15241389
  misc_feature 1..174: note = hypo
  source 1..174: mol_type = genomic DNA
atgaaatcatcaccacggcttctcagagcctcaatttcctggtctgtaaaatgagaccaggagtggctgcaaccctgcagtgccgtgatgagctatggagagacaagaacacagagggctcagcgcagggcccggcgtggccaccgcggggagagggtgcggactcttcctaga

SEQ ID NO: 78485 - DNA, 86 bp, Homo sapiens
  misc_feature 1..86: note = chr16:1541511-1541597
  misc_feature 1..86: note = hypo
  source 1..86: mol_type = genomic DNA
gcaccagcatggacccgtgccttcaatggctccaggagatgcctgccacacaagcaaaatcttagtccctgcgagggccttctgtg

SEQ ID NO: 78486 - DNA, 259 bp, Homo sapiens
  misc_feature 1..259: note = chr16:15489930-15490189
  misc_feature 1..259: note = hyper
  source 1..259: mol_type = genomic DNA
cgccaacttcaactacgtgtggctgcgcctgctggagcgcgcgctcccgggccgagcgccgcacgccctgctggccaagttgctgtgcgaccaggtggtcggtgcgcccatcgcggtctcggccttctatgtcggtgaggggccgggaggggacctggggggtgggacccagtattgggggactggaggctgggactcggggatcaagcggctggagggagggcgctgcaggagcctggggacccgggcaggagccggg

SEQ ID NO: 78487 - DNA, 36 bp, Homo sapiens
  misc_feature 1..36: note = chr16:15522286-15522322
  misc_feature 1..36: note = hypo
  source 1..36: mol_type = genomic DNA
ttatttattgctgggcgtggtggctcacgcctgtaa

SEQ ID NO: 78488 - DNA, 808 bp, Homo sapiens
  misc_feature 1..808: note = chr16:15528335-15529143
  misc_feature 1..808: note = hyper
  source 1..808: mol_type = genomic DNA
ccccttctgggtacccgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaagtgagtactggggcggggggcggggggccggggacagctggggatccatgcgcctgcgcgggtggtcgcgggagcgcgaggaacgccagcagtggacccagggaagcgcccccgcagcggggctggcagctcagggggatacgcagctctgcgcagcgacgcgctctccccgcgaacaaaagggggggaccctccgggctgagcctcactgggagggttgggagatggccaggcagctaaggcaggagcctgggctcgacttaggagtcccggatccgtcagctcgcagctggtcctgtgaagtcgggtctctcccacagcccagggaggaggatcctctctccgcctgggatgcgccagggcgctggagacgcgggaccgtcctggaaagcgcccacgtccctggagaggggggagtgtctgctggttttccgcttgctttcctaccccctgcgtgaggtttcggagcgcacctgaaattcccagcttttcctccctcgccttccttgggtcggggtgggaggctt

SEQ ID NO: 78489 - DNA, 20 bp, Homo sapiens
  misc_feature 1..20: note = chr16:15552675-15552695
  misc_feature 1..20: note = hypo
  source 1..20: mol_type = genomic DNA
aaacaaagccaggtgcggtg

SEQ ID NO: 78490 - DNA, 30 bp, Homo sapiens; identical to SEQ ID NO: 44614
  misc_feature 1..30: note = chr16:15555102-15555132
  misc_feature 1..30: note = hypo
  source 1..30: mol_type = genomic DNA

SEQ ID NO: 78491 - DNA, 15 bp, Homo sapiens
  misc_feature 1..15: note = chr16:15594787-15594802
  misc_feature 1..15: note = hypo
  source 1..15: mol_type = genomic DNA
cgtgagccaccgtgc

SEQ ID NO: 78492 - DNA, 161 bp, Homo sapiens
  misc_feature 1..161: note = chr16:15595873-15596034
  misc_feature 1..161: note = hypo
  source 1..161: mol_type = genomic DNA
ctcttttatgacccccgatttacagataaggaaactgagtctcaaagaggttagggcatttgccgaggtcggccgttagaaagatgccggaccatctactcatgtctgcttgacgccaatgcctgcgtcttcacgtgctgttggtgcgtcctcctgaatta

SEQ ID NO: 78493 - DNA, 17 bp, Homo sapiens
  misc_feature 1..17: note = chr16:15600039-15600056
  misc_feature 1..17: note = hypo
  source 1..17: mol_type = genomic DNA
cttttatttttgagacg

SEQ ID NO: 78494 - DNA, 113 bp, Homo sapiens
  misc_feature 1..113: note = chr16:15604260-15604373
  misc_feature 1..113: note = hypo
  source 1..113: mol_type = genomic DNA
cttgctggcttatggcgaggattaaaagaggtgatgggcagagcaggtgcggcggtcataacgagggcaattgcaagcatatattaaacgtgacgtgccggggtaattcatcc

SEQ ID NO: 78495 - DNA, 58 bp, Homo sapiens
  misc_feature 1..58: note = chr16:15626753-15626811
  misc_feature 1..58: note = hypo
  source 1..58: mol_type = genomic DNA
ctgataaatagacctcgtgcctggtaagtgtgtttacttgctccggattaaattacac

SEQ ID NO: 78496 - DNA, 30 bp, Homo sapiens
  misc_feature 1..30: note = chr16:15628035-15628065
  misc_feature 1..30: note = hypo
  source 1..30: mol_type = genomic DNA
atgaccagtgacaatcgtctcctggctcac

SEQ ID NO: 78497 - DNA, 129 bp, Homo sapiens
  misc_feature 1..129: note = chr16:15692042-15692171
  misc_feature 1..129: note = hypo
  source 1..129: mol_type = genomic DNA
gctagcccagcagcccggggccactgcctctctagtgacggcaccagctgtgccttagtcacgcagcctgtggaataaagcagctgcctttattccacggctctcacctggagccgtggtaagagttaa

SEQ ID NO: 78498 - DNA, 37 bp, Homo sapiens
  misc_feature 1..37: note = chr16:15743162-15743199
  misc_feature 1..37: note = hypo
  source 1..37: mol_type = genomic DNA
tcctctgcataatgtcgtttgtttgtttgtctgttct

SEQ ID NO: 78499 - DNA, 28 bp, Homo sapiens
  misc_feature 1..28: note = chr16:15746797-15746825
  misc_feature 1..28: note = hypo
  source 1..28: mol_type = genomic DNA
gagagagccaccgcgcctggcctaagct

SEQ ID NO: 78500 - DNA, 170 bp, Homo sapiens
  misc_feature 1..170: note = chr16:15762561-15762731
  misc_feature 1..170: note = hypo
  source 1..170: mol_type = genomic DNA
agtgcttaggagccacgtgtggccagtgagtttccttagtggacagaggggctgcagaccatttccttcattaccaaaaggtgtgttgcactctgccagttcagagcaggtttctcgacctggctgctgttgacattggagcccggatcatcctccgttgggagggactg

SEQ ID NO: 78501 - DNA, 30 bp, Homo sapiens
  misc_feature 1..30: note = chr16:1576652-1576682
  misc_feature 1..30: note = hypo
  source 1..30: mol_type = genomic DNA
gcgggcctctagctccggctcctgctccgc

SEQ ID NO: 78502 - DNA, 30 bp, Homo sapiens
  misc_feature 1..30: note = chr16:15767710-15767740
  misc_feature 1..30: note = hypo
  source 1..30: mol_type = genomic DNA
gagagagcacgggaacgggcaggtgatctg

SEQ ID NO: 78503 - DNA, 30 bp, Homo sapiens
  misc_feature 1..30: note = chr16:1580669-1580699
  misc_feature 1..30: note = hypo
  source 1..30: mol_type = genomic DNA
gccccgtctctcccacgcggaggccacccg

SEQ ID NO: 78504 - DNA, 92 bp, Homo sapiens; identical to SEQ ID NO: 44620
  misc_feature 1..92: note = chr16:15820825-15820917
  misc_feature 1..92: note = hypo
  source 1..92: mol_type = genomic DNA

SEQ ID NO: 78505 - DNA, 30 bp, Homo sapiens
  misc_feature 1..30: note = chr16:15841780-15841810
  misc_feature 1..30: note = hypo
  source 1..30: mol_type = genomic DNA
tcgccgccaggatctcgtagcttgaaacac

SEQ ID NO: 78506 - DNA, 498 bp, Homo sapiens
  misc_feature 1..498: note = chr16:15950839-15951337
  misc_feature 1..498: note = hyper
  source 1..498: mol_type = genomic DNA
cgagctcggatctgacgcacctcccaggccggagcgtccaaatctccctgcgcgtcctcggacgcctctctttatagacccggagctgcccgcggctgggaaaggggaggaggccgaaggggtggagttggggagggtccctcgcggccccctcgccgcgccccctgcagggcgcacccccggcgggagcgcaaggagctggggcgctcgggacaagggtgcacggaacaggtgcgcaccgcacaagggcgcacggaacaggtgcgcacagggacgggagtctcagccccggccccaggcggtcgcagacgctccggatccctagagaaagggggtcgagcaggcagtgtctgtgcgggatgcttgagaacgtcttccctgagtcggttccggccgcaaaggctttaacctcttcctccccgtgtcggggctgtggtggatctgacttgacatctcccaccccacttcccattttattggcatcgcactgtctggaaa

SEQ ID NO: 78507 - DNA, 643 bp, Homo sapiens
  misc_feature 1..643: note = chr16:15951793-15952436
  misc_feature 1..643: note = hyper
  source 1..643: mol_type = genomic DNA
catcacaggctctctcgctctgtctctgccactgtctctgcatgtctgtcactctgatcattgctgtctctcgctctatcttttgtctctgtccctctcgcttctctagatctgtcgatgtatctgtctctccctcctgtctcactttgtctctggtctctgtgtctcttgctctccatctctcccgcgtgtctcactcctatctctgcgctttctctctctctcttccccaggctctccgtcttctccccgtccctccctccccgctcctgtccacgcacgcacacacaggccataaaaggaagtcgaggcggtgggctggccccgcgccaggccggggacccgcgggcagcccgggcgctccgctccccgcgcggcaccagctcctccgaggttcccgggccgggccgggccgggccggtccccctccccgggagcggcgggagcggcgggcgggagacaacccaaaaagggcaggcgcggactccttcctgcaggaattcccagcgccgcataccagctctgggctgccggctccccctgactaaatatggtgccgagtggccttcctgctccccggcgtcgggggagggggcccttcacgcagccaccggccgccgttgccccgcggggctagatgggg

SEQ ID NO: 78508 - DNA, 30 bp, Homo sapiens
  misc_feature 1..30: note = chr16:16045826-16045856
  misc_feature 1..30: note = hypo
  source 1..30: mol_type = genomic DNA
atgggcctctgtgcccggctgtttttgtgt

SEQ ID NO: 78509 - DNA, 30 bp, Homo sapiens
  misc_feature 1..30: note = chr16:16122579-16122609
  misc_feature 1..30: note = hypo
  source 1..30: mol_type = genomic DNA
ccctcctggcagtcccgggggataggtcga

SEQ ID NO: 78510 - DNA, 119 bp, Homo sapiens
  misc_feature 1..119: note = chr16:1642740-1642859
  misc_feature 1..119: note = hypo
  source 1..119: mol_type = genomic DNA
gagggacaggtgtcccggcagagtgactggtggagggacaggtgaacaccagccacacggtgcccagcactgacctccccatgaaggctggcaaggtaccctgacggagtcactggcgg

SEQ ID NO: 78511 - DNA, 37 bp, Homo sapiens
  misc_feature 1..37: note = chr16:16663469-16663506
  misc_feature 1..37: note = hypo
  source 1..37: mol_type = genomic DNA
cccaaagtgctgggattacaggcgtgagccaccccca

SEQ ID NO: 78512 - DNA, 30 bp, Homo sapiens
  misc_feature 1..30: note = chr16:1682337-1682367
  misc_feature 1..30: note = hypo
  source 1..30: mol_type = genomic DNA
gatcaccaagtacatcgactttgatcatgg

SEQ ID NO: 78513 - DNA, 30 bp, Homo sapiens
  misc_feature 1..30: note = chr16:17046472-17046502
  misc_feature 1..30: note = hypo
  source 1..30: mol_type = genomic DNA
actcaaagtgttcttcgactgccatgaaga

SEQ ID NO: 78514 - DNA, 22 bp, Homo sapiens
  misc_feature 1..22: note = chr16:17049589-17049611
  misc_feature 1..22: note = hypo
  source 1..22: mol_type = genomic DNA
accacgccggccacaacagatt

SEQ ID NO: 78515 - DNA, 30 bp, Homo sapiens
  misc_feature 1..30: note = chr16:17077914-17077944
  misc_feature 1..30: note = hypo
  source 1..30: mol_type = genomic DNA
ctctgactgccgctacgttactactattac

SEQ ID NO: 78516 - DNA, 30 bp, Homo sapiens
  misc_feature 1..30: note = chr16:17202525-17202555
  misc_feature 1..30: note = hypo
  source 1..30: mol_type = genomic DNA
ctgtggcccactcctcgtgcccagtgctac

SEQ ID NO: 78517 - DNA, 30 bp, Homo sapiens
  misc_feature 1..30: note = chr16:1725008-1725038
  misc_feature 1..30: note = hypo
  source 1..30: mol_type = genomic DNA
gggcattggtgtgggcgtgcctgacatacg

SEQ ID NO: 78518 - DNA, 30 bp, Homo sapiens
  misc_feature 1..30: note = chr16:17294271-17294301
  misc_feature 1..30: note = hypo
  source 1..30: mol_type = genomic DNA
ggtatcagggagggacggacagaccccgaa

SEQ ID NO: 78519 - DNA, 120 bp, Homo sapiens
  misc_feature 1..120: note = chr16:1729679-1729799
  misc_feature 1..120: note = hypo
  source 1..120: mol_type = genomic DNA
agagcaagactccgtctcaaaaaaaaaaaaaaccctttagatttgagggagttaggtcagtattcagtaatacttgtaaccaaataattacccgtggcagggtgcagtgactcaacggct

SEQ ID NO: 78520 - DNA, 455 bp, Homo sapiens; identical to SEQ ID NO: 44511
  misc_feature 1..455: note = chr16:1730306-1730761
  misc_feature 1..455: note = hypo
  source 1..455: mol_type = genomic DNA

SEQ ID NO: 78521 - DNA, 66 bp, Homo sapiens
  misc_feature 1..66: note = chr16:17335057-17335123
  misc_feature 1..66: note = hypo
  source 1..66: mol_type = genomic DNA
taaattccttgatagcgtttcatgcacctaatggtgcagttcctgtgttcacggcaataaacaagg

SEQ ID NO: 78522 - DNA, 30 bp, Homo sapiens; identical to SEQ ID NO: 44622
  misc_feature 1..30: note = chr16:17341523-17341553
  misc_feature 1..30: note = hypo
  source 1..30: mol_type = genomic DNA

SEQ ID NO: 78523 - DNA, 30 bp, Homo sapiens; identical to SEQ ID NO: 44512
  misc_feature 1..30: note = chr16:1734955-1734985
  misc_feature 1..30: note = hypo
  source 1..30: mol_type = genomic DNA

SEQ ID NO: 78524 - DNA, 18 bp, Homo sapiens
  misc_feature 1..18: note = chr16:17368739-17368757
  misc_feature 1..18: note = hypo
  source 1..18: mol_type = genomic DNA
ctctcagagcagggccgg

SEQ ID NO: 78525 - DNA, 30 bp, Homo sapiens
  misc_feature 1..30: note = chr16:1738302-1738332
  misc_feature 1..30: note = hypo
  source 1..30: mol_type = genomic DNA
ggtagcagacctagccggtagcagtgctag

SEQ ID NO: 78526 - DNA, 42 bp, Homo sapiens
  misc_feature 1..42: note = chr16:1738667-1738709
  misc_feature 1..42: note = hypo
  source 1..42: mol_type = genomic DNA
agtttgaaactggcttgggcaacatagcgaggcccaatctcc

SEQ ID NO: 78527 - DNA, 54 bp, Homo sapiens
  misc_feature 1..54: note = chr16:1740152-1740206
  misc_feature 1..54: note = hypo
  source 1..54: mol_type = genomic DNA
ccctgctttaggccccgccgcagcagtggggccctcaagcgggtctgaagacga

SEQ ID NO: 78528 - DNA, 386 bp, Homo sapiens
  misc_feature 1..386: note = chr16:1741726-1742112
  misc_feature 1..386: note = hypo
  source 1..386: mol_type = genomic DNA
ctcagggctggcactcggggttcctatgagaggaggtctccaaagcactgcgggggtggggtggggtggggtccggtggacgtctggttgctcagtgttctgtgatcgtttctgcagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggtatggactgcattcagacgtgacagcgcagcagcgggtatgccaggtgctctttccaaaaaggctccaaggcagatgcgacatgtttttagggagaatcatggtgggtgccgtagattatcctgg

SEQ ID NO: 78529 - DNA, 16 bp, Homo sapiens
  misc_feature 1..16: note = chr16:17566188-17566204
  misc_feature 1..16: note = hypo
  source 1..16: mol_type = genomic DNA
tgagataggcctgggc

SEQ ID NO: 78530 - DNA, 30 bp, Homo sapiens
  misc_feature 1..30: note = chr16:17659142-17659172
  misc_feature 1..30: note = hypo
  source 1..30: mol_type = genomic DNA
aagctggcgtggggccgggcgcggtggctc

SEQ ID NO: 78531 - DNA, 29 bp, Homo sapiens
  misc_feature 1..29: note = chr16:17821439-17821468
  misc_feature 1..29: note = hypo
  source 1..29: mol_type = genomic DNA
tgagatcaggccaggcgcggtggctcaca

SEQ ID NO: 78532 - DNA, 30 bp, Homo sapiens
  misc_feature 1..30: note = chr16:1782670-1782700
  misc_feature 1..30: note = hypo
  source 1..30: mol_type = genomic DNA
gatgccagcttgccccgagaacaggtggtg

SEQ ID NO: 78533 - DNA, 88 bp, Homo sapiens
  misc_feature 1..88: note = chr16:17866374-17866462
  misc_feature 1..88: note = hypo
  source 1..88: mol_type = genomic DNA
aggaatcagaagcaacgcagagctcagagaagtgggagagaattagtgcagcgtaggaaattagccttcttcctgactcctcatacac

SEQ ID NO: 78534 - DNA, 152 bp, Homo sapiens
  misc_feature 1..152: note = chr16:17913465-17913617
  misc_feature 1..152: note = hypo
  source 1..152: mol_type = genomic DNA
tataacacgatcctccggcacaccgggttgtattactcatttcatcagcatagatggaatccgatatttggctccactatcataacatacatccaagggcttatttcctccaaaagaagtacaattggaaatagcatcgattgagccaaaac

SEQ ID NO: 78535 - DNA, 30 bp, Homo sapiens
  misc_feature 1..30: note = chr16:1793857-1793887
  misc_feature 1..30: note = hypo
  source 1..30: mol_type = genomic DNA
tgcccctgagagccacgcctctactctcgg

SEQ ID NO: 78536 - DNA, 119 bp, Homo sapiens
  misc_feature 1..119: note = chr16:1807880-1807999
  misc_feature 1..119: note = hypo
  source 1..119: mol_type = genomic DNA
agggcagcaggcttccgggtcagggctcggcaacacagccctgggctggaccacggcgcctgggcctggttccctgcaggcctctgcctgggcacacggggcaccgggacctgctggag

SEQ ID NO: 78537 - DNA, 555 bp, Homo sapiens
  misc_feature 1..555: note = chr16:1813482-1814037
  misc_feature 1..555: note = hypo
  source 1..555: mol_type = genomic DNA
ctgggcacccagtgccgggaaagccacccttcccagctgggcacccggtggccgggaaaaggcgaggatgggcccaggcgggcctccctgccgtgacctcccccaggacaagcctggggcactgtgggggccgctcaccctggacagagacatcacccatcattcttccactcagcgactgcacgtcctccgcccgtcgagagcagaagcgcgagcagtaccgccaggtgcgtgagcacgtgcgtaacgacgacggccgtctgcaggcctgcggctggagcctgcccgccaagtacaagcaggtgcgggcgggcgctgcggggaccgggcggggccccgcagaggcggggcgggggtaaggggcggggcgctgtggggcggggagagggcggggcagtgctagggggtgggagaggacggcgggtggggcggggcctggcaggttcctagtgagcctcctgggcaggggtctggagggtcggagaaggagccccgcggctcccacgcccccacctgcctccagtcttgaagtggctgtgccgccagaagctggca

SEQ ID NO: 78538 - DNA, 116 bp, Homo sapiens
  misc_feature 1..116: note = chr16:1814253-1814369
  misc_feature 1..116: note = hypo
  source 1..116: mol_type = genomic DNA
gaggctggggagtgccggtgacacccgacctcggccctgcccttgcagctgtggtgtgccgcgggcgtcaacctgagcgggtggaggcccaatgaggacgacgctgggaatggagt

SEQ ID NO: 78539 - DNA, 68 bp, Homo sapiens
  misc_feature 1..68: note = chr16:1831357-1831425
  misc_feature 1..68: note = hypo
  source 1..68: mol_type = genomic DNA
cctgcccatcagagtcgtagccccagttagtggagcctgctagagccacggcccgggcatctgcgtct

SEQ ID NO: 78540 - DNA, 77 bp, Homo sapiens
  misc_feature 1..77: note = chr16:1833990-1834067
  misc_feature 1..77: note = hypo
  source 1..77: mol_type = genomic DNA
gcccagtgctggagtcttattccagaggagaagcctggaaaagcctgtccttattatcaggacggatttactacaaa

SEQ ID NO: 78541 - DNA, 36 bp, Homo sapiens
  misc_feature 1..36: note = chr16:1839644-1839680
  misc_feature 1..36: note = hypo
  source 1..36: mol_type = genomic DNA
gagcacctgggctgacgatgccggtgcctggggggg

SEQ ID NO: 78542 - DNA, 30 bp, Homo sapiens
  misc_feature 1..30: note = chr16:1844136-1844166
  misc_feature 1..30: note = hypo
  source 1..30: mol_type = genomic DNA
ctgccgccccttccccgtgccccacccagc

SEQ ID NO: 78543 - DNA, 30 bp, Homo sapiens
  misc_feature 1..30: note = chr16:1854152-1854182
  misc_feature 1..30: note = hypo
  source 1..30: mol_type = genomic DNA
tgaacttccttgttccggttgtgtgtgtcc

SEQ ID NO: 78544 - DNA, 146 bp, Homo sapiens; identical to SEQ ID NO: 44624
  misc_feature 1..146: note = chr16:18802485-18802631
  misc_feature 1..146: note = hypo
  source 1..146: mol_type = genomic DNA

SEQ ID NO: 78545 - DNA, 128 bp, Homo sapiens
  misc_feature 1..128: note = chr16:18804414-18804542
  misc_feature 1..128: note = hypo
  source 1..128: mol_type = genomic DNA
cgaagccttacttggcgagtctgaatttctattaactaagggcagagtgagggagaacaaagagctacttccgtaacattttagtatccagatagtacagcagaaacggttcccggggcaatgggtgc

SEQ ID NO: 78546 - DNA, 30 bp, Homo sapiens
  misc_feature 1..30: note = chr16:1889598-1889628
  misc_feature 1..30: note = hypo
  source 1..30: mol_type = genomic DNA
aaaacacactttctacgcagccattctcag

SEQ ID NO: 78547 - DNA, 33 bp, Homo sapiens
  misc_feature 1..33: note = chr16:18950653-18950686
  misc_feature 1..33: note = hypo
  source 1..33: mol_type = genomic DNA
ttacatgctgcaccccgcactttaaatgacctg

SEQ ID NO: 78548 - DNA, 32 bp, Homo sapiens
  misc_feature 1..32: note = chr16:18950986-18951018
  misc_feature 1..32: note = hypo
  source 1..32: mol_type = genomic DNA
gcgtgagtcaccgtgcccggccctcctgcaac

SEQ ID NO: 78549 - DNA, 40 bp, Homo sapiens
  misc_feature 1..40: note = chr16:18995550-18995590
  misc_feature 1..40: note = hyper
  source 1..40: mol_type = genomic DNA
tcccacccccgacgccgggtgctcccggctctggggaaca

SEQ ID NO: 78550 - DNA, 17 bp, Homo sapiens
  misc_feature 1..17: note = chr16:1900285-1900302
  misc_feature 1..17: note = hypo
  source 1..17: mol_type = genomic DNA
gtaaaaataacaggccg

SEQ ID NO: 78551 - DNA, 23 bp, Homo sapiens
  misc_feature 1..23: note = chr16:192028-192051
  misc_feature 1..23: note = hypo
  source 1..23: mol_type = genomic DNA
accgtgcccggcctgcataacat

SEQ ID NO: 78552 - DNA, 197 bp, Homo sapiens; identical to SEQ ID NO: 36017
  misc_feature 1..197: note = chr16:1922108-1922305
  misc_feature 1..197: note = hyper
  source 1..197: mol_type = genomic DNA

SEQ ID NO: 78553 - DNA, 142 bp, Homo sapiens
  misc_feature 1..142: note = chr16:19422024-19422166
  misc_feature 1..142: note = hyper
  source 1..142: mol_type = genomic DNA
gcctgcgggctgcttcgggccagggtcgacccgagggccagcgcaagcagcggcaacaggagcgccaggaggtgaggcgggttcgccaggagtggggccagcgcccgggctgccagcctagcaggggcgtcttggcggagcc

SEQ ID NO: 78554 - DNA, 166 bp, Homo sapiens
  misc_feature 1..166: note = chr16:19422383-19422549
  misc_feature 1..166: note = hyper
  source 1..166: mol_type = genomic DNA
tccggggaatgcacacggcctggccgccgccttcgtgcagcccgccctgcaggtgcaggaagaaaagaataatcgcacccgtttctcaggtgcttacttcaccatgtccgatccggtaagttttttatctgagcagcggcctgggtgagagcgaacatgagctttg

SEQ ID NO: 78555 - DNA, 30 bp, Homo sapiens
  misc_feature 1..30: note = chr16:19442928-19442958
  misc_feature 1..30: note = hypo
  source 1..30: mol_type = genomic DNA
ttgttttgcctctctcggggcaacttcctg

SEQ ID NO: 78556 - DNA, 30 bp, Homo sapiens
  misc_feature 1..30: note = chr16:1946488-1946518
  misc_feature 1..30: note = hypo
  source 1..30: mol_type = genomic DNA
aggctgggtgcgtggcggtggcagtcccgc

SEQ ID NO: 78557 - DNA, 30 bp, Homo sapiens; identical to SEQ ID NO: 44519
  misc_feature 1..30: note = chr16:1946973-1947003
  misc_feature 1..30: note = hypo
  source 1..30: mol_type = genomic DNA

SEQ ID NO: 78558 - DNA, 30 bp, Homo sapiens
  misc_feature 1..30: note = chr16:19485502-19485532
  misc_feature 1..30: note = hypo
  source 1..30: mol_type = genomic DNA
ctgcattaatctggccgtgccatgcatcta

SEQ ID NO: 78559 - DNA, 30 bp, Homo sapiens
  misc_feature 1..30: note = chr16:19498338-19498368
  misc_feature 1..30: note = hypo
  source 1..30: mol_type = genomic DNA
aaatgtgagtcagtccgacattgccatcaa

SEQ ID NO: 78560 - DNA, 30 bp, Homo sapiens
  misc_feature 1..30: note = chr16:19529179-19529209
  misc_feature 1..30: note = hypo
  source 1..30: mol_type = genomic DNA
gtgaaatgctcattacgatgaagatttctt

SEQ ID NO: 78561 - DNA, 23 bp, Homo sapiens
  misc_feature 1..23: note = chr16:19534847-19534870
  misc_feature 1..23: note = hypo
  source 1..23: mol_type = genomic DNA
atcacgcccggtgggttcagcaa

SEQ ID NO: 78562 - DNA, 27 bp, Homo sapiens
  misc_feature 1..27: note = chr16:19554463-19554490
  misc_feature 1..27: note = hypo
  source 1..27: mol_type = genomic DNA
ggaagtcagggaccccgaatggaggga

SEQ ID NO: 78563 - DNA, 486 bp, Homo sapiens
  misc_feature 1..486: note = chr16:19567041-19567527
  misc_feature 1..486: note = hyper
  source 1..486: mol_type = genomic DNA
gactgggaagatggccgtctttccttggtaaggaagcagcggcgggtgggctttggagaggggctgtccttacttgtgatggggtcggcctgggtctgagagtgtgaattcctctctgtcgggttctggtggtcgaccggccacccccaagttgtcttgaccgtagaatccctggccgctaccgcggtccagcggagcaatctgaagccagactggcgggttcttggttctctccccgtctgctgcctctctgcgccttccacgggcccctgtccattcattccctaaagaaaacttgagtttccaggcttccgcgtccccagaagttggcgcgggttctggggtcgctggatgagggtaatggtggactcagcttttaaagtctggacgagtcgggagatctggctgttggtcagtttcctcagctcctctgttcacctggagacttgcttttctcatctgtaaaatggccgccattcatcctat

SEQ ID NO: 78564 - DNA, 42 bp, Homo sapiens
  misc_feature 1..42: note = chr16:19568977-19569019
  misc_feature 1..42: note = hypo
  source 1..42: mol_type = genomic DNA
tacaggcgtgagctaccacacccggcccgtgctctgaacatt

SEQ ID NO: 78565 - DNA, 30 bp, Homo sapiens
  misc_feature 1..30: note = chr16:1960214-1960244
  misc_feature 1..30: note = hypo
  source 1..30: mol_type = genomic DNA
cccaccactccacagcgaggcctgcagcct

SEQ ID NO: 78566 - DNA, 36 bp, Homo sapiens
  misc_feature 1..36: note = chr16:1962525-1962561
  misc_feature 1..36: note = hypo
  source 1..36: mol_type = genomic DNA
ctgtgcaatccctgccgtcctcgcttccagagccag

SEQ ID NO: 78567 - DNA, 90 bp, Homo sapiens
  misc_feature 1..90: note = chr16:1967819-1967909
  misc_feature 1..90: note = hyper
  source 1..90: mol_type = genomic DNA
tgggaggcaggatatcgtgccgctgctccctggggcgcacgataccctccccaggaaggcgccggtcagggcggacgggccagggtgctc

SEQ ID NO: 78568 - DNA, 898 bp, Homo sapiens
  misc_feature 1..898: note = chr16:1968132-1969030
  misc_feature 1..898: note = hyper
  source 1..898: mol_type = genomic DNA
gggcgcgggggccggcgcgggggcgcgggcggccggcgggcagcggccggggagggcgcagaggcagtaggcgccgagcaccagggccacgagcagcatcggcgcgcgggacgcccgcagagcggccccttgcccggcccctgcgccctggccgcccccggccccgccgcccaggccgccgctacctgccatggggtcgcgccgctccaggcccgggagcgggggcagcaggcgggcgcgcatctcggcccgcgcgccgctcagtccgtgggtgcccggcttgtgctctgcgcccggcggtcccgcagcctgggagcgggcgcggggcgggaccgggggcggggtctggacgccctcccccctccccctcccccgcccactccgcctccgaggccactgcctgggctggacccgccggcagccgccaccacccgggcgcgactcgagctgccgggaccaccaggacgctcctgctccgagatcccaggccctggctcgcttgactccggcatcttcacctctgcgcggggaggatgcggcggcggtggccgttcgggacgcagggcagggacagggcggcgcgcgggcctcgggaccctctgtttgaagaccgatccccttccccccccaccccactccgggacgtgcgcggcaggtgcataggccaagccttggcctgcaggagcgggagcctcatcgccaggccaaggggacccaggaaaagcgtcgatccgggcactcggcctgccaagggagaaagaggccgggacagcaccctagtgtgcagagagggatcccagaacgtgtggggggagtctgcggccgggaatggcgtgcgtcctgcactcccagctgacagtcacacatcgggtcacagcctggccgctgagaggtcaag

SEQ ID NO: 78569 - DNA, 57 bp, Homo sapiens
  misc_feature 1..57: note = chr16:19708504-19708561
  misc_feature 1..57: note = hypo
  source 1..57: mol_type = genomic DNA
gattgggctctttgccgtcggctctgctgcttctgtgactgtcgctgctctaggctg

SEQ ID NO: 78570 - DNA, 18 bp, Homo sapiens
  misc_feature 1..18: note = chr16:19929829-19929847
  misc_feature 1..18: note = hypo
  source 1..18: mol_type = genomic DNA
tcccggtcggaaatttat

SEQ ID NO: 78571 - DNA, 97 bp, Homo sapiens
  misc_feature 1..97: note = chr16:20084459-20084556
  misc_feature 1..97: note = hyper
  source 1..97: mol_type = genomic DNA
acacaaagccctctacgcccccaccccatgaaagccgccccctccagatgcgcgcacaaatgcaccttcgaatccatgctcacatgcccagcccatc

SEQ ID NO: 78572 - DNA, 283 bp, Homo sapiens
  misc_feature 1..283: note = chr16:20084616-20084899
  misc_feature 1..283: note = hyper
  source 1..283: mol_type = genomic DNA
cacacacacacggtccccagctagggcacagcaacttcctttccccccgtgtggaaatatccatagttgcccttaaagcttaaactttttccgagggggcgccagggaacgcacgggggaggacgggggattctgggtagggttgcccggcacttggggttcctggcttccctccctctcccccacgcccctcacctggtaaaccgaggcacagcaagaggctgtagtagaccacgggcacgaaacccaagccgcaggccgagccgggggaccaccaagacag

SEQ ID NO: 78573 - DNA, 129 bp, Homo sapiens
  misc_feature 1..129: note = chr16:20085303-20085432
  misc_feature 1..129: note = hyper
  source 1..129: mol_type = genomic DNA
cggagtgtgtgtggggtgggagggatgcggaagaggagggggtcccagccgcctcgcttggctccactttcaggggagaagatgcagttagacctgggagccccgaaggaagaccggagtggaaaacag

SEQ ID NO: 78574 - DNA, 205 bp, Homo sapiens
  misc_feature 1..205: note = chr16:20085652-20085857
  misc_feature 1..205: note = hyper
  source 1..205: mol_type = genomic DNA
gcgaggatgctaaagcgttgtcggttttcctcgacaagggaagctgagcttgctggctctggaaagaggggtgcgtgcctccctgtgcgtgtgtgtggcgactctgggggtggccgccggtgaactgtcccctaactggagtgcgtttgaagaggatacagactggctaagagaagcccctcctgcatgccgcccttcagtcagg

SEQ ID NO: 78575 - DNA, 30 bp, Homo sapiens
  misc_feature 1..30: note = chr16:20133385-20133415
  misc_feature 1..30: note = hypo
  source 1..30: mol_type = genomic DNA
tgttactccagggaccgtctcaccaacatg

SEQ ID NO: 78576 - DNA, 30 bp, Homo sapiens
  misc_feature 1..30: note = chr16:2020979-2021009
  misc_feature 1..30: note = hypo
  source 1..30: mol_type = genomic DNA
gctaactcctcgccacggcgcacaggcaac

SEQ ID NO: 78577 - DNA, 668 bp, Homo sapiens
  misc_feature 1..668: note = chr16:2028539-2029207
  misc_feature 1..668: note = hypo
  source 1..668: mol_type = genomic DNA
tgtccaaccccagagcggcactttcagcggctcagcaggaccctccaggccgccgctttcttggacttcctgtggcacaacatgaagctccctgtgccggccgccgcccccaccccctgggaaacccataaaggcgcactgccctagccggtccggcctctctccagtccatcctgaacccctggaaaacccataaaggccgctctcctggccggctctgtctctctggactgcagtccagccccccaccctggccaacaccctacctagccagccagaagggcactggagctgatggtctcggccctgccacgcccatcccgcaccctggcctggcagagatccagcccgcggctccgcacgcttagacggtgggggtcatgcagaacaagctttactcagaggaacagcaaatggccccctcccatccctgctggccagggagatccgccctccccgctcctccccagccctgggatggcgcggtccatcccctcatcgggatcctcgcgctcactgctccgtcgtggggtgcggcacagagtccacgcaccctcgagggcggccctggcgccgtgggcgccgctccagggccctgcgtgtgacggtgcagcagcggctctggatggcgcccggcgaaggtcgggtgggcacggtggggggagggg

SEQ ID NO: 78578 - DNA, 201 bp, Homo sapiens
  misc_feature 1..201: note = chr16:20327304-20327505
  misc_feature 1..201: note = hypo
  source 1..201: mol_type = genomic DNA
gaacccgggctaggtcgatggccggtacttcactgcggacttgacttcttgagcaagactgtagggatgatgaacttttattatatcaaaatttaaatgcctggattctatctagactgctcctacaatgggcagctctggaccaagaactgtgtccagaactggttcacgctatggccctaattccgatgctgtggttat

SEQ ID NO: 78579 - DNA, 32 bp, Homo sapiens
  misc_feature 1..32: note = chr16:2033521-2033553
  misc_feature 1..32: note = hyper
  source 1..32: mol_type = genomic DNA
ccaggctctaggatccgcgacagccggcgagg

SEQ ID NO: 78580 - DNA, 201 bp, Homo sapiens
  misc_feature 1..201: note = chr16:20359734-20359935
  misc_feature 1..201: note = hyper
  source 1..201: mol_type = genomic DNA
actgtggggagactccggctgacctgtgcagtacgccaggtgacactcggggggcgctgtcaggttgtagacgtagtagccgccggcacaggccttcacctggacggacgcatcccacaggcagcagtggccgctccagtgcgcgcaggccttgcggctcacgatgccctcgtcgctggacggatgcgtgccattgagcca

SEQ ID NO: 78581 - DNA, 114 bp, Homo sapiens; identical to SEQ ID NO: 1244
  misc_feature 1..114: note = chr16:2040847-2040961
  misc_feature 1..114: note = hyper
  source 1..114: mol_type = genomic DNA

SEQ ID NO: 78582 - skipped

SEQ ID NO: 78583 - DNA, 531 bp, Homo sapiens; identical to SEQ ID NO: 1246
  misc_feature 1..531: note = chr16:2040982-2041513
  misc_feature 1..531: note = hyper
  source 1..531: mol_type = genomic DNA

SEQ ID NO: 78584 - DNA, 922 bp, Homo sapiens
  misc_feature 1..922: note = chr16:2041581-2042503
  misc_feature 1..922: note = hyper
  source 1..922: mol_type = genomic DNA
cggtgcagagtacctggcttgaatcaaccccggcttttgtcagccatgtgatcccggacaagtcacttcacctgttggggtcccaatgtcccccgcatttataaagagaataagaacaatggcgatcccacggggactttctgaggatttggtgaggggacgcatgtaaagtggctgtttaacacaatgtctgggcatagtagatgctcactaaacggcccgtgttgtcaataattactaaatacgcgagggttcgggaaagaaagaggtgacaccgccccccacccagatacgggcctgggaacgcagggacaggcccaggggcgtgggcgctcgaggcgggctcgcagaggtcgggtcgccgcagggccctgagcgccgcgccgcacgcaggtgttctccatcgccgtcttcgggcccatcgtcaacgagggctacgtgaacaccgacagcggccccgagctgcgctgcgtgttcaacgggaacgcgggcgcctgccgcttcggcgtcgcgctgggcctcggagccttcctcgcctgcgccgccttcctgctgctcgatgtgcgcttccagcaaatcagcagcgtccgcgaccgccggcgcgcggtgttgctggacctgggcttctcaggtgggcggggccggggcggtgagcgcggagagccttccgggtgggcggggagggggcggggcctgggcggggaacaccgctggagtttccagctgggcgtggccgtgacgaggggcggggactgaggcagggagtgtcaatgggcctcccgggtgggcggggagggggcggagcctggacggggagcgccgcgggactttctaggtaggcggggcccgggtctgggcggagcctgggcgcggaacgggtctggcgctcccgggtgggcggggtcagcgcaggagagggagg

SEQ ID NO: 78585 - DNA, 27 bp, Homo sapiens
  misc_feature 1..27: note = chr16:204415-204442
  misc_feature 1..27: note = hyper
  source 1..27: mol_type = genomic DNA
ccccaggacaggctgcggcccctcccc

SEQ ID NO: 78586 - DNA, 41 bp, Homo sapiens; identical to SEQ ID NO: 35989
  misc_feature 1..41: note = chr16:204480-204521
  misc_feature 1..41: note = hyper
  source 1..41: mol_type = genomic DNA

SEQ ID NO: 78587 - DNA, 36 bp, Homo sapiens
  misc_feature 1..36: note = chr16:2048205-2048241
  misc_feature 1..36: note = hypo
  source 1..36: mol_type = genomic DNA
cgacagctctggccacgctggcgggagctacgtgat

SEQ ID NO: 78588 - DNA, 92 bp, Homo sapiens
  misc_feature 1..92: note = chr16:2068929-2069021
  misc_feature 1..92: note = hypo
  source 1..92: mol_type = genomic DNA
tgtgagccaccgcgcccggccaaggatctgggccatttaagtggagtcttgaaggatgagtaggtgttaggcacagacgcacagaggcaggc

SEQ ID NO: 78589 - DNA, 339 bp, Homo sapiens
  misc_feature 1..339: note = chr16:2069769-2070108
  misc_feature 1..339: note = hyper
  source 1..339: mol_type = genomic DNA
cctgcaggggacccacggctcgcctccagcctcctgcgctccggtacctgggcgtcccaactccactgcgcgcccaaacccagccgagccggttcgtggcccgccccgccgggcggccgtcgacgcgagcgccctggcgtggcgcccaggggagcggggggctcccgcgagccggccgcggctggcactgctgctgcttctgctcctgctgccgctgccctccggcgcgtggtacaagcacgtggcgagtccccgctaccacacggtgggccgcgccgctggcctgctcatggggctgcgtcgctcaccctatctgtggcgccgcgcgctgcgcgcggc

SEQ ID NO: 78590 - DNA, 275 bp, Homo sapiens
  misc_feature 1..275: note = chr16:2070147-2070422
  misc_feature 1..275: note = hyper
  source 1..275: mol_type = genomic DNA
cgcagcccgcgaggctcctctcctgctgccctcgtgggttcaggagctgtgggagacgcgacgcaggagctcccaggcagggatccccgtccgtgcgccccggagcccgcgcgccccagagcctgcgctggaaccggagtccctggacttcagcggagctggccaggtacgtgagaggggagaggcctggaccgccgcgggcaagggggtctcgggaggtctgagccggagcacggagccgcgcgttcagggggcaccctcgggcccttccattc

SEQ ID NO: 78591 - DNA, 51 bp, Homo sapiens
  misc_feature 1..51: note = chr16:2083370-2083421
  misc_feature 1..51: note = hyper
  source 1..51: mol_type = genomic DNA
gccacgccacctgcccgggctccgggagcccctccacggagcccaccccag

SEQ ID NO: 78592 - DNA, 23 bp, Homo sapiens
  misc_feature 1..23: note = chr16:208745-208768
  misc_feature 1..23: note = hypo
  source 1..23: mol_type = genomic DNA
ttttcttttttgagacggaatct

SEQ ID NO: 78593 - DNA, 622 bp, Homo sapiens
  misc_feature 1..622: note = chr16:2104762-2105384
  misc_feature 1..622: note = hypo
  source 1..622: mol_type = genomic DNA
ggagcgtactggtcccgtcttcctcctcctttctccactttgtggaccttcctcctgccatcctgtggtgggaggtttccattagtcttgggtctctgtgtcatgattctgggaagtagagaaagaggaggaagagatcggtctgactctggctttgctgttctgtcgcccagaaaagggcctcagtggctgggctgcctgcaggacaggtgccggccaggtgcctaccgtcaggtttcctgtctgaggtgacgtggccggcagccaagtgtgcacacgtctcctccgagccactctctgctgggggtggggaacgcccaggagtctggtgatgtcggcgtctcccagcctcgggttgggccctgagtgtacggcatacacacttctgctgccgcctcggcacagaccctctgtgcagccccaggggcggtagatcctagtgtccgtgcgtagccggcctgccctgggctcccctgagcctcttcgggcccagtgcgtggtctgtctgttgctgccgggggactgatgatggggtttctggcagtgacgggtttggacacactgtcctgcggcgggagggggaggtgagtgggagatgtagattcggcgtcctcgcaaactg

SEQ ID NO: 78594 - DNA, 41 bp, Homo sapiens
  misc_feature 1..41: note = chr16:2106600-2106641
  misc_feature 1..41: note = hypo
  source 1..41: mol_type = genomic DNA
ggagctggggtaggacgggcgtgagccgtctccctctccac

SEQ ID NO: 78595 - DNA, 42 bp, Homo sapiens
  misc_feature 1..42: note = chr16:2107015-2107057
  misc_feature 1..42: note = hypo
  source 1..42: mol_type = genomic DNA
agggcagcagccaggcggggccagcagcgggactggggctgg

SEQ ID NO: 78596 - DNA, 30 bp, Homo sapiens
  misc_feature 1..30: note = chr16:2128577-2128607
  misc_feature 1..30: note = hypo
  source 1..30: mol_type = genomic DNA
tggagctcaggcagccgctcgcctgcctga

SEQ ID NO: 78597 - DNA, 108 bp, Homo sapiens
  misc_feature 1..108: note = chr16:21289404-21289512
  misc_feature 1..108: note = hyper
  source 1..108: mol_type = genomic DNA
cctgtgcttggtcaccggcaccacggtgcgcacgggctgcatgacccctccttcgggaccgctggagaagttggccagggccgtctctagaggcgggatgaggaggct

SEQ ID NO: 78598 - DNA, 127 bp, Homo sapiens
  misc_feature 1..127: note = chr16:2129118-2129245
  misc_feature 1..127: note = hypo
  source 1..127: mol_type = genomic DNA
tccacctggagctcacggaaacctgtctggacatgatggctcgatacgtcttctccaacttcacggctgtcccgaagaggtccaggcggcactacagggctgggcgggcctgcgggagctccacggg

SEQ ID NO: 78599 - DNA, 386 bp, Homo sapiens
  misc_feature 1..386: note = chr16:21294910-21295296
  misc_feature 1..386: note = hyper
  source 1..386: mol_type = genomic DNA
ggccaggacaagcaacggatgaagtatctcggaagccggagaagggtggtctggggctcttgggagcatgcgcggggtggggcggtggggggactgaggtggcgctcccggctcctccgcgcgcccccggcaccttccgcgcgtccccggctccccacactccgtccccggctccccacactcccaccccggtctgccccgggcgcccccggttccccacctcctggtgtgcctctggcgggtccgcgcaggatcaggctacagactcgcccgcgggcggctgcgcggcgggccgttggggagggtgttgggatgaggagccccaaccagatggacgcgcaccccgcagcggcggaggcggcggcgaggcttgagcagtgagtgct

SEQ ID NO: 78600 - DNA, 34 bp, Homo sapiens; identical to SEQ ID NO: 36085
  misc_feature 1..34: note = chr16:21295340-21295374
  misc_feature 1..34: note = hyper
  source 1..34: mol_type = genomic DNA

SEQ ID NO: 78601 - DNA, 98 bp, Homo sapiens
  misc_feature 1..98: note = chr16:2131668-2131766
  misc_feature 1..98: note = hypo
  source 1..98: mol_type = genomic DNA
gcaggagctgtctaacgccctcatggcggctgagcgcttcaaggagcaccgggacacagccctgtacaagtcactgtcggtgccggcagccagcacgg

SEQ ID NO: 78602 - DNA, 59 bp, Homo sapiens
  misc_feature 1..59: note = chr16:21363314-21363373
  misc_feature 1..59: note = hypo
  source 1..59: mol_type = genomic DNA
tcttggtgtgtttgccgtgtctgcgggtgtcttggcgtgtttgccgtgtctgcgggtgt

SEQ ID NO: 78603 - DNA, 30 bp, Homo sapiens
  misc_feature 1..30: note = chr16:2141909-2141939
  misc_feature 1..30: note = hypo
  source 1..30: mol_type = genomic DNA
gccggagaggggtggcgtgggtgccgcacc

SEQ ID NO: 78604 - DNA, 82 bp, Homo sapiens
  misc_feature 1..82: note = chr16:2142546-2142628
  misc_feature 1..82: note = hypo
  source 1..82: mol_type = genomic DNA
cgtagggcagcagcacgtgggccatccatggccagagctcctcagacctgccacagcatcagtcacacgctccagcccctac

SEQ ID NO: 78605 - DNA, 102 bp, Homo sapiens; identical to SEQ ID NO: 44525
  misc_feature 1..102: note = chr16:2145625-2145727
  misc_feature 1..102: note = hypo
  source 1..102: mol_type = genomic DNA

SEQ ID NO: 78606 - DNA, 99 bp, Homo sapiens
  misc_feature 1..99: note = chr16:2146363-2146462
  misc_feature 1..99: note = hypo
  source 1..99: mol_type = genomic DNA
gggcatggcagagcccggggtcacacgcgtgggaacacgccgtgggtgcgctccgccgccggctgccatgtgcgtgactatgtgcgtgactacatacaa

SEQ ID NO: 78607 - DNA, 749 bp, Homo sapiens
  misc_feature 1..749: note = chr16:215124-215873
  misc_feature 1..749: note = hyper
  source 1..749: mol_type = genomic DNA
atcctctgtcctgaccgagaagtaccgctgagcgccgcctccgggacccccaggacaggctgcggcccctcccctgcccttcaccctcccacagttcctgccctgactccaataaatggatgaggacggagcgatctgggctctgtgttctcagtattggagggaaggaggggagaagctgagtgatgggtccgggggcttcgcaggaactcggtcgtccccactgtcgtcgcggcctggggttcacttggggggcgccttggggaggttctagcccctgagcaccggagctgcggcccgggtggagcggagcagtcccgggccggcccgcggcgtctcctggggtccttgagtcggacgggcgtttgtgcgtctcccggcttcccatatcgcacaaagattgtcacttcactaagcgtattggaagcgtgtcggggctcagggaacttttccacaaagcctgacgtccgaatcccgggactctggcagctacgggggtccctgaggccggtccctccccgactcctaagagagtagggggtttcctgcccggtgttctctctccggttcctcccatgtgctccctcctggcagagcagtaactttacccgaggggagtaaacagatgcccctaaagtctgcagtaaaggtgcccacgcgcaacggcgtgggtcaatgccagaaaccctgggatcccggaggtcgaggcctccacacagacgggaacccgggctggttacgttccccgg

SEQ ID NO: 78608 - DNA, 32 bp, Homo sapiens
  misc_feature 1..32: note = chr16:2151266-2151298
  misc_feature 1..32: note = hypo
  source 1..32: mol_type = genomic DNA
gagccaccgcgcccggccgacagtttttaaaa

SEQ ID NO: 78609 - DNA, 90 bp, Homo sapiens
  misc_feature 1..90: note = chr16:21526523-21526613
  misc_feature 1..90: note = hypo
  source 1..90: mol_type = genomic DNA
ataaataaataaataaaataaatcactttctatggcttttcactgctccaggaacaatgtccacagatcaaacgccgagcctctccttca

SEQ ID NO: 78610 - DNA, 48 bp, Homo sapiens
  misc_feature 1..48: note = chr16:21539162-21539210
  misc_feature 1..48: note = hypo
  source 1..48: mol_type = genomic DNA
tccccagaccaatggcgctgcgagcttctggggcgtgggctgggccca

SEQ ID NO: 78611 - DNA, 38 bp, Homo sapiens
  misc_feature 1..38: note = chr16:21541457-21541495
  misc_feature 1..38: note = hypo
  source 1..38: mol_type = genomic DNA
agcttgatccagacccgacgcggtgactcatgccagta

SEQ ID NO: 78612 - DNA, 157 bp, Homo sapiens
  misc_feature 1..157: note = chr16:21566618-21566775
  misc_feature 1..157: note = hypo
  source 1..157: mol_type = genomic DNA
tggaaagccgtgtttcgctgctcttcctgtagacaatacagcatgggggcaggagtggggtctggagtcggacgcacgttcagaggctggggtcacttctcccaaaccgtgtgcagtcggacgcacgttcagaagctggggccgccactcccaaact

SEQ ID NO: 78613 - DNA, 51 bp, Homo sapiens
  misc_feature 1..51: note = chr16:21569348-21569399
  misc_feature 1..51: note = hypo
  source 1..51: mol_type = genomic DNA
tcatccaaaaacacccgctgagtttctcccgcgtgccgggcaccacgctca

SEQ ID NO: 78614 - DNA, 48 bp, Homo sapiens; identical to SEQ ID NO: 4305
  misc_feature 1..48: note = chr16:215912-215960
  misc_feature 1..48: note = hyper
  source 1..48: mol_type = genomic DNA

SEQ ID NO: 78615 - DNA, 486 bp, Homo sapiens
  misc_feature 1..486: note = chr16:215961-216447
  misc_feature 1..486: note = hyper
  source 1..486: mol_type = genomic DNA
gcgggcgcggcccccagagcacgtcaggcggcgccatgctcagcgcccaggagcgcgcccaaatcgcgcaggtctgggacctgattgcgggccacgaggcgcaattcggggcggagctgctgctcaggtcggtagaggcggggtctccgggagctcagggaggtggagatgagggttttgggcgcgtgggccgccaacgccatccaaggtccttcgggtgcggatccccgggctctgggcggtgtgggcgctagtgaagccccacgcagccgccctcctccccggtcactgacctggtcctgcaggctcttcacggtgtaccccagcaccaaggtctacttcccgcacctgagcgcctgccaggacgcgacgcagctgctgagccacgggcagcgcatgctggcggctgtgggcgcggcggtgcagcacgtggacaacctgcgcgccgcgctgagcccgctggcggacctgcacgcgctcgtgctg

SEQ ID NO: 78616 - DNA, 471 bp, Homo sapiens
  misc_feature 1..471: note = chr16:216505-216976
  misc_feature 1..471: note = hyper
  source 1..471: mol_type = genomic DNA
cgcagccggggtgggggggctctgggggtccctagcggggcagaccccgtctcaccggccccttctcctgcagctgctaatccagtgtttccacgtcgtgctggcctcccacctgcaggacgagttcaccgtgcaaatgcaagcggcgtgggacaagttcctgactggtgtggccgtggtgctgaccgaaaaataccgctgagccctgtgctgcgcaggccttggtctgtgcctgtcaataaacagaggcccgaaccatctgcccctgcctgtgtggtctttggggagctagcaaagcgaggtcactattgttggccagtgaagctcagggacctaaaaggagcctcctagaactctcaaatgcgccccacccccggaggtttgtcctcccatggcgaggagtgcgatggggcagagggagcactgtgatgtggcgggggtagggagggtggccttcgacttcaacccttg

SEQ ID NO: 78617 - DNA, 256 bp, Homo sapiens
  misc_feature 1..256: note = chr16:21675205-21675461
  misc_feature 1..256: note = hyper
  source 1..256: mol_type = genomic DNA
ggtttgaattcagatctaaataaaggtcccatgtagcgattggtggatagctctctagtgctccccatcctcgcttcctagctgccgccccgaagagtggctggggagcaggcatttgtgcgtcttgcaagcttcgacagataggaagtcccaggcggggactgtgacccccgccgctgccctggctgagttcccacctgggccgctgcagggaggaggtcgcagagctgccggctggcgccgccccgccgctctc

SEQ ID NO: 78618 - DNA, 33 bp, Homo sapiens; identical to SEQ ID NO: 44635
  misc_feature 1..33: note = chr16:21719131-21719164
  misc_feature 1..33: note = hypo
  source 1..33: mol_type = genomic DNA

SEQ ID NO: 78619 - DNA, 411 bp, Homo sapiens
  misc_feature 1..411: note = chr16:21831546-21831957
  misc_feature 1..411: note = hyper
  source 1..411: mol_type = genomic DNA
atccgctcctctaagcgcggtcctgagctttggtcccagacgcgcagaaggaagcggcctgaatcttacccagtcctcgacgcgcccagcgtcttgactgcagaggacgaagcggccgcatctcccgacaaacaacgtgtgaagcagcggtgccgccattgggccgaactaacgcgaccgctgcgcctcaggccggatgcccagctccttccagccacagcctctgtcccggaagttgcgcgtgccagcgcaaccttcagacaatcaggggccccgtgtggggagggcgtatgctctcggcgggctagagcgccgctaaaacgcgctcttcgttctacttggaggacttgttccagccagcgtgagtgcgcgagtgtaaggagagacgggaaggatcggctccatccagcc

SEQ ID NO: 78620 - DNA, 20 bp, Homo sapiens
  misc_feature 1..20: note = chr16:21839328-21839348
  misc_feature 1..20: note = hypo
  source 1..20: mol_type = genomic DNA
acagacagaaaagcacggtc

SEQ ID NO: 78621 - DNA, 135 bp, Homo sapiens
  misc_feature 1..135: note = chr16:2193270-2193405
  misc_feature 1..135: note = hypo
  source 1..135: mol_type = genomic DNA
gatccctgcacctgccgtgaggccatgtgtgtcactctgaggctgccgggagagcctgcagccaggagccctgatgctgcctcctccaatggctaagcggacaccctcactcagctcaggcgcaggaagccagca

SEQ ID NO: 78622 - DNA, 142 bp, Homo sapiens; identical to SEQ ID NO: 44529
  misc_feature 1..142: note = chr16:2212716-2212858
  misc_feature 1..142: note = hypo
  source 1..142: mol_type = genomic DNA

SEQ ID NO: 78623 - DNA, 72 bp, Homo sapiens
  misc_feature 1..72: note = chr16:2213240-2213312
  misc_feature 1..72: note = hypo
  source 1..72: mol_type = genomic DNA
tgtgggtgacctgcacgggttccaggggcgggctcatctctctcctgtgcttttttccgtgcagtgcggttt

SEQ ID NO: 78624 - DNA, 78 bp, Homo sapiens
  misc_feature 1..78: note = chr16:2213645-2213723
  misc_feature 1..78: note = hypo
  source 1..78: mol_type = genomic DNA
ctaagccttgagggacggtgacgcagagccgcctgcctgcccgggcctctgcatacctgggatcggggtgaaggacct

SEQ ID NO: 78625 - DNA, 328 bp, Homo sapiens
  misc_feature 1..328: note = chr16:22173605-22173933
  misc_feature 1..328: note = hyper
  source 1..328: mol_type = genomic DNA
ttttcccacaagaagcgtggaccatttcgcccatcccagccctactggcttcagtttcccctctatgagagcccgcgggtctccacctgagagaatgcaggtgctcccgcgccgggagtgggcgggcagaagagcgggcggggggcggtccggatgcctcgtcccgccccgccccgcccctttctgccctcctcgggagaaggaggtggcccggtggccctggcggcgcggagactggcgcagcgcggggagcacgcagcgccgcgggagcccgggccaggtgagcgaagcccggacgcgggccagggagggacgcaggtgctggagg

SEQ ID NO: 78626 - DNA, 30 bp, Homo sapiens
  misc_feature 1..30: note = chr16:22189581-22189611
  misc_feature 1..30: note = hypo
  source 1..30: mol_type = genomic DNA
gaggtgtacactggtcgggccctcccagcc

SEQ ID NO: 78627 - DNA, 377 bp, Homo sapiens; identical to SEQ ID NO: 12422
  misc_feature 1..377: note = chr16:22203596-22203973
  misc_feature 1..377: note = hyper
  source 1..377: mol_type = genomic DNA

SEQ ID NO: 78628 - DNA, 19 bp, Homo sapiens
  misc_feature 1..19: note = chr16:22216598-22216617
  misc_feature 1..19: note = hypo
  source 1..19: mol_type = genomic DNA
gtttttgtttttttgcgac

SEQ ID NO: 78629 - DNA, 30 bp, Homo sapiens
  misc_feature 1..30: note = chr16:22289966-22289996
  misc_feature 1..30: note = hypo
  source 1..30: mol_type = genomic DNA
ttctggaatgtttcacgagacccacaggcc

SEQ ID NO: 78630 - DNA, 533 bp, Homo sapiens
  misc_feature 1..533: note = chr16:2229690-2230223
  misc_feature 1..533: note = hypo
  source 1..533: mol_type = genomic DNA
gacaggcggcttggccggcttccgggcttcgccctcgggcgggggcaatgggggtaggtgcgccaggtcggtgggcgggggttcggcaggcgggggcggtggaggcagctccggaggcccagcctgctccgaggccggtcggcggcgcacggtgccagtgccattatggtacacggacagtggcggtggtggctcaggcccggcctcccgctccttggccttgggcctgcgcttgaccgtgtcagactcggtcaggatgaacttgacgttctcctgctggttctgcttggcccggatgcgcctcttgagtgtggcgctggcttccaccttggccaagggcgggccttcgacacccgcctcgcccttggagggaccccgaggccgctgccggccagtgccatcctccacaaaggggcctgggtctgccgactccccaggcccccggcgggcagtggccagaagtccggtgactggcccgctgagcgtgcggcgccggttcaccacctccccgccaggcccgatggcctctttgt

SEQ ID NO: 78631 - DNA, 695 bp, Homo sapiens
  misc_feature 1..695: note = chr16:2230488-2231183
  misc_feature 1..695: note = hypo
  source 1..695: mol_type = genomic DNA
ggcactagccagggccgagctggagcgcttgggtgggggcggcgggggccccttctttcggggccgcacggcaaaggactggctgcggttgacgttcttgtcggcacctgcgggcgccctcactgagtggctgcggcccacgcgccgctggaccgtggcataggggccggcagccgcaggcaccagcagctcgtcccgctccggctcgctgtcggacgccgcatagcgattcaggctgtgggcccgcttcttgggccgccccggctccgcgtcggcctcagggggcaggcacagtgtgggcacagccgtcggcacgggtgggggcgcaggccccggggcagccggccccacctcgccctccacgggctggggcagcacgtaggcaaagccgcggtgcgtcggtgactgaggcagggagcggggtgacatggggcgctctgtcggcggcagcagctgcggggtgggcttcaccttggccgtagctggggctggaccatgaggtcccccaagggcctggggagagcctggtcgggttttggtgggcgtctgggggggcgtgaagtggctagtgcctggtgggaggacctgccgtggcttgccaggcacggggggcacgctggccctcttgatgctgtggccgtggcggccgggccgggcctccctgggcggggtgccgggggcggggccctcatcca

SEQ ID NO: 78632 - DNA, 81 bp, Homo sapiens; identical to SEQ ID NO: 44534
  misc_feature 1..81: note = chr16:2232745-2232826
  misc_feature 1..81: note = hypo
  source 1..81: mol_type = genomic DNA

SEQ ID NO: 78633 - DNA, 141 bp, Homo sapiens; identical to SEQ ID NO: 44535
  misc_feature 1..141: note = chr16:2233066-2233207
  misc_feature 1..141: note = hypo
  source 1..141: mol_type = genomic DNA

SEQ ID NO: 78634 - DNA, 214 bp, Homo sapiens
  misc_feature 1..214: note = chr16:223318-223532
  misc_feature 1..214: note = hyper
  source 1..214: mol_type = genomic DNA
caacttcaaggtgagcggcgggccgggagcgatctgggtcgaggggcgagatggcgccttcctctcagggcagaggatcacgcgggttgcgggaggtgtagcgcaggcggcggctgcgggcctgggccgcactgaccctcttctctgcacagctcctaagccactgcctgctggtgaccctggccgcccacctccccgccgagttcacccctgc

SEQ ID NO: 78635 - DNA, 57 bp, Homo sapiens
  misc_feature 1..57: note = chr16:2233791-2233848
  misc_feature 1..57: note = hypo
  source 1..57: mol_type = genomic DNA
gtgggacgcagctggcgctggcggcgcatggaaagctcacctcgggagtcatgcggc

SEQ ID NO: 78636 - DNA, 735 bp, Homo sapiens
  misc_feature 1..735: note = chr16:2234304-2235039
  misc_feature 1..735: note = hypo
  source 1..735: mol_type = genomic DNA
ctgggaaaggggcctcgggctggaccggaaggtgggctctgtgcccacaggcaggggcaccttgcctcctccaccgtgcaggactcagccagcagcttacagctctccggcacacgagtgcactcacacaccatacgccgtgcccatgcacacgctgcaccatctcatacccatccccttccacctgtacacagacacgcgtgcccagctcgcagtcccaccatcacacacacacacgcacacacagaggcacaggttggcccacacgcacagcctgcacaatgacgacacccgtacacacaggcagacacacacacaacacacagactgacagacagaggagagggtctggcctggcaatgcccccgaccccgccgctgccaggccaggcaggccgtgtaagcacccatcagcccatcggccttacagcctctccccggagcccacgctgagaacacccccaagccctgtaccttgccctccgatgctggctccagcttcttgggcggctgctccccatagacctgcccggcgtgggccactggaggctgggaccgggccacacctgaggacgagagtgggtgggggacaagggctgtcgggctgctttcctccatcgggctgcgtggcagcacccttgctcttacctgcagagccttccggaggcttggcggggctgtcccccgggccggactcagagacggacttctgggaaagcaccgttgccaggagctg

SEQ ID NO: 78637 - DNA, 267 bp, Homo sapiens
  misc_feature 1..267: note = chr16:2237256-2237523
  misc_feature 1..267: note = hypo
  source 1..267: mol_type = genomic DNA
cgtgggcattgatcccgctctgcacatgtgagagatgaggctctgtcaggagcccctacagtccactgggcccagcgcccctgggccccacactcacatccagcagcagccgcaccacctctgtctttccgcagagcgcagcctcgtgcagggccgtgccggacttggtctggcggttaatgtcgatgccggcttggaggaggagcctggcgggaaggcaaggtggacaggcggggccttccagcaggaggccggccccagcacccc

SEQ ID NO: 78638 - DNA, 108 bp, Homo sapiens
  misc_feature 1..108: note = chr16:2246993-2247101
  misc_feature 1..108: note = hyper
  source 1..108: mol_type = genomic DNA
cgggcgggcggggaccgggcgccgagagacccgggcgccagtgcccctggagccggcccgccaggctgtcaggcgttcctggcccagggttcccgtgggaggtgtcga

SEQ ID NO: 78639 - DNA, 183 bp, Homo sapiens
  misc_feature 1..183: note = chr16:2256439-2256622
  misc_feature 1..183: note = hypo
  source 1..183: mol_type = genomic DNA
tgagctctggtgggtcgacctcagcacagccaagcttcagttcagcctgtgtccctaggttaccagcacatccgcatgtatgatctcaactccaataaccctaaccccatcatcagctacgacggcgtcaacaagaacatcgcgtctgtgggcttccacgaagacggccgctggatgtacacg

SEQ ID NO: 78640 - DNA, 402 bp, Homo sapiens
  misc_feature 1..402: note = chr16:2278383-2278785
  misc_feature 1..402: note = hypo
  source 1..402: mol_type = genomic DNA
gtgcacagatgcggccgctgccaggcagagttcaccgccttggaggattttgttcagcacaagattcagaaggcctgccagcgggcccctccggaggccctgcctgccacccctgccaccacagcgttgctgggccaggaggtgagccctcacccactcccccatcccctcccgggttcacctgacaggtgggggaggtggccgcgcttcaggatggacctgtgcagccggttccgggggccacgtgggcgggcagagggcaggcacctggctgcggtgtgggagggtccgggtgtgtgagcctgtggtgctctggggcgtcctggagggcctgcggtggcccagccttcttggcagcctctggtcgaagcccgtgctgttgggggccgggatctcttcttt

SEQ ID NO: 78641 - DNA, 199 bp, Homo sapiens
  misc_feature 1..199: note = chr16:2281203-2281402
  misc_feature 1..199: note = hypo
  source 1..199: mol_type = genomic DNA
gcgggtgcaggggtgcggtcagctgtgtgggcagttggaacccacctccaggccctcctgccgcttcgcggaaaaagttcgcgtctcctctggcctcgcagcagccatgttcccccaggtcctccccatcagaggcctctgtcctttggaagatcactcctggggcatcgagcgtgtaagggctcgggcaggagaggct

SEQ ID NO: 78642 - DNA, 63 bp, Homo sapiens
  misc_feature 1..63: note = chr16:2281639-2281702
  misc_feature 1..63: note = hypo
  source 1..63: mol_type = genomic DNA
cgggtgtctggagagcgttcactctcccaggccaagcctgccttgggacggggctctggccag

SEQ ID NO: 78643 - DNA, 604 bp, Homo sapiens; identical to SEQ ID NO: 36090
  misc_feature 1..604: note = chr16:22824473-22825077
  misc_feature 1..604: note = hyper
  source 1..604: mol_type = genomic DNA

SEQ ID NO: 78644 - DNA, 313 bp, Homo sapiens; identical to SEQ ID NO: 36091
  misc_feature 1..313: note = chr16:22825157-22825470
  misc_feature 1..313: note = hyper
  source 1..313: mol_type = genomic DNA

SEQ ID NO: 78645 - DNA, 466 bp, Homo sapiens
  misc_feature 1..466: note = chr16:22825885-22826351
  misc_feature 1..466: note = hyper
  source 1..466: mol_type = genomic DNA
ggtgccccctcggaaaccatgacccccggcgcgggcccatggagccatggcctatagggtcctgggccgcgcggggccacctcagccgcggagggcgcgcaggctgctcttcgccttcacgctctcgctctcctgcacttacctgtgttacagcttcctgtgctgctgcgacgacctgggtcggagccgcctcctcggcgcgcctcgctgcctccgcggccccagcgcgggcggccagaaacttctccagaagtcccgcccctgtgatccctccgggccgacgcccagcgagcccagcgctcccagcgcgcccgccgccgccgtgcccgcccctcgcctctccggttccaaccactccggctcacccaagctgggtaccaagcggttgccccaagccctcattgtgggcgtgaagaaggggggcacccgggccgtgctggagtttatccgagtacacccggacgtg

SEQ ID NO: 78646 - DNA, 30 bp, Homo sapiens
  misc_feature 1..30: note = chr16:2285581-2285611
  misc_feature 1..30: note = hypo
  source 1..30: mol_type = genomic DNA
ctgcggggtcctggccgggcagggacaggg

SEQ ID NO: 78647 - DNA, 95 bp, Homo sapiens
  misc_feature 1..95: note = chr16:2286027-2286122
  misc_feature 1..95: note = hypo
  source 1..95: mol_type = genomic DNA
agcctcggcctccaccgcagggtgagcaggtggagcagcagcaggagatgctgggtagggagtgtggctggtcctacctgcgctgccttgctttc

SEQ ID NO: 78648 - DNA, 97 bp, Homo sapiens
  misc_feature 1..97: note = chr16:2287079-2287176
  misc_feature 1..97: note = hyper
  source 1..97: mol_type = genomic DNA
agacccagacctcagcgccgtgtccgcgctcatggagcagatcaacaggtgtggtgggcagggcccctcgtcgcgaccccccgccgggatctcgccc

SEQ ID NO: 78649 - DNA, 291 bp, Homo sapiens
  misc_feature 1..291: note = chr16:2287230-2287521
  misc_feature 1..291: note = hyper
  source 1..291: mol_type = genomic DNA
cgagtacagctttgtgagcagccagcccctgggccgggaccagtacaaggagatgtacctgttcgtgtacaggtgaggggcgggccgcagggaggggcgcgcggggccgcaggtcgggggctcagcgggtcctccccatctcctaggaaagacgcggtgtcggtcgtggacacctacctgtacccagaccccgaggacgtcttcagccgcgagcccttcgtggtcaagttctcggcccccggcaccggtgagcgggccccgcccctcccctcccgccgagctctgacgccc

SEQ ID NO: 78650 - DNA, 225 bp, Homo sapiens
  misc_feature 1..225: note = chr16:2294431-2294656
  misc_feature 1..225: note = hypo
  source 1..225: mol_type = genomic DNA
ttggactggtacaaccgcagccacagctcctgaacggccttccagtacccagcgtagtgggcggggctcctcccacacatctccgtcaggtccaggccggccgagaagacacccgggcggtcctgcagggggagccggggccacatgcccatcagagtccacctcccagctggcatcacagcaggagggctggggagcccaggtgcacgacgcacagcagggcca

SEQ ID NO: 78651 - DNA, 120 bp, Homo sapiens
  misc_feature 1..120: note = chr16:230196-230316
  misc_feature 1..120: note = hyper
  source 1..120: mol_type = genomic DNA
ggaatggcgccactgcactcaccgcacccggccaatttttgtgtttttagtagagactaaataccatatagtgaacacctaagacggggggccttggatccagggcgattcagagggccc

SEQ ID NO: 78652 - DNA, 556 bp, Homo sapiens; identical to SEQ ID NO: 35996
  misc_feature 1..556: note = chr16:230496-231052
  misc_feature 1..556: note = hyper
  source 1..556: mol_type = genomic DNA

SEQ ID NO: 78653 - DNA, 30 bp, Homo sapiens; identical to SEQ ID NO: 44636
  misc_feature 1..30: note = chr16:23093885-23093915
  misc_feature 1..30: note = hypo
  source 1..30: mol_type = genomic DNA

SEQ ID NO: 78654 - DNA, 41 bp, Homo sapiens
  misc_feature 1..41: note = chr16:2310480-2310521
  misc_feature 1..41: note = hypo
  source 1..41: mol_type = genomic DNA
tttgtaacagaacacaaataaaaaaccggcctcctattttg

SEQ ID NO: 78655 - DNA, 37 bp, Homo sapiens
  misc_feature 1..37: note = chr16:23194399-23194436
  misc_feature 1..37: note = hyper
  source 1..37: mol_type = genomic DNA
ctggcctcttttctccgcccagcgcctgttcagcccc

SEQ ID NO: 78656 - DNA, 59 bp, Homo sapiens
  misc_feature 1..59: note = chr16:2324166-2324225
  misc_feature 1..59: note = hypo
  source 1..59: mol_type = genomic DNA
tgcacctgcccctcccggtccccacgcagcagcctcctgagctgcggatcattttccta

SEQ ID NO: 78657 - DNA, 66 bp, Homo sapiens
  misc_feature 1..66: note = chr16:2327703-2327769
  misc_feature 1..66: note = hypo
  source 1..66: mol_type = genomic DNA
gccgggctggaggatcggggagggtgcctgggtgctcagcactggagtcctcgtcccagggattgg

SEQ ID NO: 78658 - DNA, 213 bp, Homo sapiens
  misc_feature 1..213: note = chr16:23303285-23303498
  misc_feature 1..213: note = hypo
  source 1..213: mol_type = genomic DNA
atgttatattgtagccgttgttctgcaacttgtttttttctctcacgccccacatccaattcttcagcaaattacgtcaactcttcctgggcactgtatccagaatctgggcacctccacggctttcaccctgccccctgctctgcccttggcacccttagttcatcttagttcattctcagcaatcccttttatttaattttattttttatt

SEQ ID NO: 78659 - DNA, 350 bp, Homo sapiens
  misc_feature 1..350: note = chr16:23313389-23313739
  misc_feature 1..350: note = hyper
  source 1..350: mol_type = genomic DNA
ggcgcatgtgggtatcgctggtgtcccgaggtggggagggagaatgcggagcgcgtgcgtgcggggggcgtccagtgtccctgaacctggcgtgtgggggctggagcttattgggaggcgagggaggtggccaggggagccgggaccgtgcgtgtggccaggccggtagcgcccagtaagctccacccgcgggcgctccccgtgcttccccgcccctgaacctgctccctcccagtcggtctcgccgcgctcgccgggtgtcccagtgtcaccaacactcggccgccgccgccagcttggcgcgcaccgccgcctccgccaccgccgacagcgcgcatcctccgtgtccc

SEQ ID NO: 78660 - DNA, 231 bp, Homo sapiens
  misc_feature 1..231: note = chr16:23313779-23314010
  misc_feature 1..231: note = hyper
  source 1..231: mol_type = genomic DNA
cgcacccggtctcccgcgcgctgcccggagtccctgcgcgcgcgccttctcctgcccaaccccggcccgcgagctcctgtcccggcctcagtttcccacgggagggcgcttgggtgcctgtctgaggcgcctgggacccggcctggggactgaacgggttgggggcggaggggagagctggaggctgggaaaagcccccagggtgcagaaggcagacggggccagggtccc

SEQ ID NO: 78661 - DNA, 166 bp, Homo sapiens
  misc_feature 1..166: note = chr16:2334314-2334480
  misc_feature 1..166: note = hypo
  source 1..166: mol_type = genomic DNA
gaggtgcagtacctccgcgtctcgtagttctcgtagaaactgctgactgccatccccagacagtggttgggcagcaccaggaacacgtgatccagggttttggaaagttcttccagttttacagctgcgttggggaggtaagatcagtctgcgctggagggcacac

SEQ ID NO: 78662 - DNA, 99 bp, Homo sapiens
  misc_feature 1..99: note = chr16:233798-233897
  misc_feature 1..99: note = hypo
  source 1..99: mol_type = genomic DNA
aacaatgtagatacacgtcgtgccactgaactgtacactgaaaaactgttataacggcacgttttgtgtgcactttactataataaaaaatgttccatc

SEQ ID NO: 78663 - DNA, 151 bp, Homo sapiens
  misc_feature 1..151: note = chr16:23444796-23444947
  misc_feature 1..151: note = hypo
  source 1..151: mol_type = genomic DNA
cccgaggcagtcacccgttcccttgtcaccacagactctgttctccctagaacaaaaatgagctgttacctgtgtagcccactggatttgtgtgtgccaagcaccaagcaaggcatcatagagtccggtaagctgccggtccagggatagg

SEQ ID NO: 78664 - DNA, 47 bp, Homo sapiens
  misc_feature 1..47: note = chr16:23511691-23511738
  misc_feature 1..47: note = hypo
  source 1..47: mol_type = genomic DNA
agccccaggtagggtcggcccaggggggtctgcggagctgtactgtg

SEQ ID NO: 78665 - DNA, 29 bp, Homo sapiens
  misc_feature 1..29: note = chr16:23551968-23551997
  misc_feature 1..29: note = hypo
  source 1..29: mol_type = genomic DNA
aaggtttgggctgagcgcagtggctcatg

SEQ ID NO: 78666 - DNA, 30 bp, Homo sapiens
  misc_feature 1..30: note = chr16:23595732-23595762
  misc_feature 1..30: note = hypo
  source 1..30: mol_type = genomic DNA
ttctttcactcggcacgttctcaaggttcg

SEQ ID NO: 78667 - DNA, 38 bp, Homo sapiens
  misc_feature 1..38: note = chr16:23606618-23606656
  misc_feature 1..38: note = hypo
  source 1..38: mol_type = genomic DNA
tgcctcccggcgtttcagcctcacgcagatttcatcag

SEQ ID NO: 78668 - DNA, 19 bp, Homo sapiens
  misc_feature 1..19: note = chr16:23651266-23651285
  misc_feature 1..19: note = hypo
  source 1..19: mol_type = genomic DNA
atctcggcagctccctgca

SEQ ID NO: 78669 - DNA, 61 bp, Homo sapiens
  misc_feature 1..61: note = chr16:23706226-23706287
  misc_feature 1..61: note = hyper
  source 1..61: mol_type = genomic DNA
cctggcttcaggtcccggtgcactgtgggagaggggcagaaagaaagctggttgctgaggg

SEQ ID NO: 78670 - DNA, 204 bp, Homo sapiens
  misc_feature 1..204: note = chr16:23706411-23706615
  misc_feature 1..204: note = hyper
  source 1..204: mol_type = genomic DNA
cgcgatccaggtccgggttttctacgtactgagcagcagcaagggccaaagcatcactctccagcccggaccttcccactcaccctccctgaaccgcaatgcaactcacctcctgcaaggaggcccggcagagctccagggcaatgtagtggaactggggtccccgctcggtgcagaagtagcggagcacgttggggtgcctgt

SEQ ID NO: 78671 - DNA, 96 bp, Homo sapiens
  misc_feature 1..96: note = chr16:23716327-23716423
  misc_feature 1..96: note = hypo
  source 1..96: mol_type = genomic DNA
gcagctggcgcaggccgtcctggtgccaggtgtagacgcccatcacaggcacgcccaggtcctgtgtccacagcaccgtcccgcttcctgggtcca

SEQ ID NO: 78672 - DNA, 104 bp, Homo sapiens; identical to SEQ ID NO: 36097
  misc_feature 1..104: note = chr16:23765896-23766000
  misc_feature 1..104: note = hyper
  source 1..104: mol_type = genomic DNA

SEQ ID NO: 78673 - DNA, 337 bp, Homo sapiens
  misc_feature 1..337: note = chr16:23766233-23766570
  misc_feature 1..337: note = hyper
  source 1..337: mol_type = genomic DNA
gttctggagcttggccgcgcgccaggcttgtggccttcgtccccctggggccactggggcggccacgcctctccggcgggaggagagaacgcgtgggtccgggtggctgctccggcccttccgcctccagctcggccatggggtcgcgcagctcccacgccgcggtcattcccgacggggacagtattcggcgagagaccggctgtgagtgcgcccgcgtcggcggctgcggaggggacggggcgaacccaggcgtctggggctagggaaggggttgggttgaaggatggacgaacttacaagtctggggtccggggctccccggagctggaagacc

SEQ ID NO: 78674 - DNA, 102 bp, Homo sapiens
  misc_feature 1..102: note = chr16:23782435-23782537
  misc_feature 1..102: note = hypo
  source 1..102: mol_type = genomic DNA
aaaaaaattcttaaacagttttgcacaattgatcaaatctaagtatttttatagcttccaggtcctctgcaatgcagatgacgtatgcggtctttccagttt

SEQ ID NO: 78675 - DNA, 30 bp, Homo sapiens
  misc_feature 1..30: note = chr16:23829399-23829429
  misc_feature 1..30: note = hypo
  source 1..30: mol_type = genomic DNA
aacagttttgagcatcgtcagattctggta

SEQ ID NO: 78676 - DNA, 262 bp, Homo sapiens; identical to SEQ ID NO: 36099
  misc_feature 1..262: note = chr16:23846792-23847054
  misc_feature 1..262: note = hyper
  source 1..262: mol_type = genomic DNA

SEQ ID NO: 78677 - DNA, 15 bp, Homo sapiens
  misc_feature 1..15: note = chr16:23847310-23847325
  misc_feature 1..15: note = hyper
  source 1..15: mol_type = genomic DNA
cggcagcagctgggc

SEQ ID NO: 78678 - DNA, 186 bp, Homo sapiens; identical to SEQ ID NO: 1261
  misc_feature 1..186: note = chr16:23847326-23847512
  misc_feature 1..186: note = hyper
  source 1..186: mol_type = genomic DNA

SEQ ID NO: 78679 - DNA, 28 bp, Homo sapiens
  misc_feature 1..28: note = chr16:23847788-23847816
  misc_feature 1..28: note = hyper
  source 1..28: mol_type = genomic DNA
ggactcccggctccggaccctgctgccc

SEQ ID NO: 78680 - DNA, 58 bp, Homo sapiens; identical to SEQ ID NO: 1263
  misc_feature 1..58: note = chr16:23847817-23847875
  misc_feature 1..58: note = hyper
  source 1..58: mol_type = genomic DNA

SEQ ID NO: 78681 - DNA, 70 bp, Homo sapiens; identical to SEQ ID NO: 1264
  misc_feature 1..70: note = chr16:23847933-23848003
  misc_feature 1..70: note = hyper
  source 1..70: mol_type = genomic DNA

SEQ ID NO: 78682 - DNA, 561 bp, Homo sapiens; identical to SEQ ID NO: 36105
  misc_feature 1..561: note = chr16:23848004-23848565
  misc_feature 1..561: note = hyper
  source 1..561: mol_type = genomic DNA

SEQ ID NO: 78683 - DNA, 30 bp, Homo sapiens
  misc_feature 1..30: note = chr16:23939787-23939817
  misc_feature 1..30: note = hypo
  source 1..30: mol_type = genomic DNA
tggtatgcatgcagtcggggaccctctgat

SEQ ID NO: 78684 - DNA, 30 bp, Homo sapiens
  misc_feature 1..30: note = chr16:23966825-23966855
  misc_feature 1..30: note = hypo
  source 1..30: mol_type = genomic DNA
cagctgagtgttctgcgtttggggacttgt

SEQ ID NO: 78685 - DNA, 105 bp, Homo sapiens
  misc_feature 1..105: note = chr16:23967391-23967496
  misc_feature 1..105: note = hypo
  source 1..105: mol_type = genomic DNA
tataagactttattacgaataaacaaaaaaagagatcatatcctatatactttttttataattttttttgagagagggccttgctgtgtcatctaggctgaagtg

SEQ ID NO: 78686 - DNA, 231 bp, Homo sapiens
  misc_feature 1..231: note = chr16:23990945-23991176
  misc_feature 1..231: note = hypo
  source 1..231: mol_type = genomic DNA
caactgactgaatggcgggggtgaggaaagcgggggaggctttctcctggaacagtgagatgaatgacaaacacacatgtaactgcactgtgtgagttgagagtgtgggctctagaggaagacaaactggtttcaaatacaagtgttaacacggactagctgaacaaccttgggcaaattacttctctccgagcatcagtgtccctgttaatataacgaggaccgaaggca

SEQ ID NO: 78687 - DNA, 33 bp, Homo sapiens; identical to SEQ ID NO: 44642
  misc_feature 1..33: note = chr16:24013932-24013965
  misc_feature 1..33: note = hypo
  source 1..33: mol_type = genomic DNA

SEQ ID NO: 78688 - DNA, 30 bp, Homo sapiens
  misc_feature 1..30: note = chr16:24118868-24118898
  misc_feature 1..30: note = hypo
  source 1..30: mol_type = genomic DNA
agcccatcttcctcacgttggttctgtgca

SEQ ID NO: 78689 - DNA, 241 bp, Homo sapiens
  misc_feature 1..241: note = chr16:24266904-24267145
  misc_feature 1..241: note = hyper
  source 1..241: mol_type = genomic DNA
cgtctccagagctgccggtgcctttaagaagactcggtctttcgggtcttctttttccccaatgggctccagtggtgcccgcagcaaaaggcaaacttgcctggctcatggggtgaaagggaggattgaagaatgccgcgttgggtgggtgctgagggagcgccagagtgcgctacgggcttcgctccccttcccctttccttaacccttcctagagcggaggaaccgggtcgtgctgcag

SEQ ID NO: 78690 - DNA, 374 bp, Homo sapiens
  misc_feature 1..374: note = chr16:24267220-24267594
  misc_feature 1..374: note = hyper
  source 1..374: mol_type = genomic DNA
cgagccggctggctgacccgggaaggaacgggggaagggcggggtgagggaagaaagaccctttagcaccccgggtttctagcccgggcggcggtgtgcagctgcatgagggagctgtcccttcggcaccacggaccttaaagcctaggcgttaagacgacggaggcggggcaacaggcggggagctgtcccttcagcaccacggaccttggcgcccccagggaaaccagccggcccccgccccaggactctgtcttttctccagtttgagcgggggtgtcgggagcaggcggagagctttcctgcgaggctgtggaagcagtgaacactcttctcagcggctcgcctcccagcagtgctattttttgccatcc

SEQ ID NO: 78691 - DNA, 99 bp, Homo sapiens
  misc_feature 1..99: note = chr16:24267654-24267753
  misc_feature 1..99: note = hyper
  source 1..99: mol_type = genomic DNA
cacactcacacagagacctctctgggtttctttgccttgagtctcccggggctgtgagaagccaggcgcatctcaaaccgagctggcagctccaggctc

SEQ ID NO: 78692 - DNA, 15 bp, Homo sapiens
  misc_feature 1..15: note = chr16:24267789-24267804
  misc_feature 1..15: note = hyper
  source 1..15: mol_type = genomic DNA
cgctcctgaggaatg

SEQ ID NO: 78693 - DNA, 30 bp, Homo sapiens; identical to SEQ ID NO: 44542
  misc_feature 1..30: note = chr16:2436229-2436259
  misc_feature 1..30: note = hypo
  source 1..30: mol_type = genomic DNA

SEQ ID NO: 78694 - DNA, 30 bp, Homo sapiens
  misc_feature 1..30: note = chr16:24366205-24366235
  misc_feature 1..30: note = hypo
  source 1..30: mol_type = genomic DNA
cttcggcgggctctgcgtggcagccagtga

SEQ ID NO: 78695 - DNA, 100 bp, Homo sapiens
  misc_feature 1..100: note = chr16:24373008-24373108
  misc_feature 1..100: note = hypo
  source 1..100: mol_type = genomic DNA
cttccactgacatctcgatgttcaccctctcccgggacccctcaaagatcaccatggggaccctcctcaactccgaccgggaccacgcttttctacagtt

SEQ ID NO: 78696 - DNA, 37 bp, Homo sapiens
  misc_feature 1..37: note = chr16:24383172-24383209
  misc_feature 1..37: note = hypo
  source 1..37: mol_type = genomic DNA
gaataaaattaccatcggggaccggcaccagtggttc

SEQ ID NO: 78697 - DNA, 30 bp, Homo sapiens
  misc_feature 1..30: note = chr16:24549351-24549381
  misc_feature 1..30: note = hypo
  source 1..30: mol_type = genomic DNA
aaaattttattgccacgacatctctatgga

SEQ ID NO: 78698 - DNA, 212 bp, Homo sapiens
  misc_feature 1..212: note = chr16:24621853-24622065
  misc_feature 1..212: note = hyper
  source 1..212: mol_type = genomic DNA
tgcctcattagcatgcgcagggcaccctcgctgggcccgttggaagggaagtgcctgccggctctggggagctgcggctctcgggccctgccaaacagacgcagccttcctaaggagcagcgctgcgctggctctgctggggtggaaggagcttctccttcgctgtcctccctctcccttcccagcccatcttattccgagcctctcctctc

SEQ ID NO: 78699 - DNA, 24 bp, Homo sapiens
  misc_feature 1..24: note = chr16:2466346-2466370
  misc_feature 1..24: note = hypo
  source 1..24: mol_type = genomic DNA
gcgagactccgcctcaaaaaaaaa

SEQ ID NO: 78700 - DNA, 62 bp, Homo sapiens
  misc_feature 1..62: note = chr16:2474253-2474315
  misc_feature 1..62: note = hypo
  source 1..62: mol_type = genomic DNA
gaccccgtggcccggcgcctgttctggaatgctgtggcacacgcccacgagtctggcaaggc

SEQ ID NO: 78701 - DNA, 23 bp, Homo sapiens
  misc_feature 1..23: note = chr16:24880199-24880222
  misc_feature 1..23: note = hypo
  source 1..23: mol_type = genomic DNA
tttttttttttgagacggagtct

SEQ ID NO: 78702 - DNA, 112 bp, Homo sapiens
  misc_feature 1..112: note = chr16:2493315-2493427
  misc_feature 1..112: note = hypo
  source 1..112: mol_type = genomic DNA
ttggcagaagcctttcggagagcactggggcgtatggccagagacttaacacagcttccccaggcattagccatgtaagaaactgagacctgagccacggtggaaaggccac

SEQ ID NO: 78703 - DNA, 30 bp, Homo sapiens
  misc_feature 1..30: note = chr16:2493886-2493916
  misc_feature 1..30: note = hypo
  source 1..30: mol_type = genomic DNA
ttacctgtgacagggcggcatagagttccc

SEQ ID NO: 78704 - DNA, 174 bp, Homo sapiens; identical to SEQ ID NO: 44545
  misc_feature 1..174: note = chr16:2497879-2498053
  misc_feature 1..174: note = hypo
  source 1..174: mol_type = genomic DNA

SEQ ID NO: 78705 - DNA, 23 bp, Homo sapiens
  misc_feature 1..23: note = chr16:25071412-25071435
  misc_feature 1..23: note = hypo
  source 1..23: mol_type = genomic DNA
aaacttgttaatcaccgggcgcg

SEQ ID NO: 78706 - DNA, 31 bp, Homo sapiens
  misc_feature 1..31: note = chr16:25077193-25077224
  misc_feature 1..31: note = hypo
  source 1..31: mol_type = genomic DNA
agctggttttataaggcggccaggactattg

SEQ ID NO: 78707 - DNA, 30 bp, Homo sapiens
  misc_feature 1..30: note = chr16:25078633-25078663
  misc_feature 1..30: note = hyper
  source 1..30: mol_type = genomic DNA
agtggtgattggcttcggttgtcatctgtg

SEQ ID NO: 78708 - DNA, 16 bp, Homo sapiens
  misc_feature 1..16: note = chr16:2508540-2508556
  misc_feature 1..16: note = hypo
  source 1..16: mol_type = genomic DNA
gcgcctggcccccaaa

SEQ ID NO: 78709 - DNA, 115 bp, Homo sapiens
  misc_feature 1..115: note = chr16:2510869-2510984
  misc_feature 1..115: note = hypo
  source 1..115: mol_type = genomic DNA
ctggagaaggctgtacgagttcgaagaggcatcactaaggccggagagagagacaaggcccccagcctgaaatctaggtccattgtcacctcttctggcacgacagcctccgccc

SEQ ID NO: 78710 - DNA, 78 bp, Homo sapiens
  misc_feature 1..78: note = chr16:25111119-25111197
  misc_feature 1..78: note = hypo
  source 1..78: mol_type = genomic DNA
cagagaaggagagaccgagtcaaaagataaccaaggaggtagcacggccagatcacagtaatagccagggtatagaag

SEQ ID NO: 78711 - DNA, 30 bp, Homo sapiens
  misc_feature 1..30: note = chr16:2516812-2516842
  misc_feature 1..30: note = hypo
  source 1..30: mol_type = genomic DNA
ctgtgtggacagtgccggagctccaccaag

SEQ ID NO: 78712 - DNA, 130 bp, Homo sapiens
  misc_feature 1..130: note = chr16:2521727-2521857
  misc_feature 1..130: note = hyper
  source 1..130: mol_type = genomic DNA
tgctgacggcaggcacgctcttcgccgccctgagtcctgggccgccggcgcccgccgacccctgccacgatgaggggggtgcgccccgcggctgcgtgccaggactggtgaacgccgccctgggccgcga

SEQ ID NO: 78713 - DNA, 36 bp, Homo sapiens
  misc_feature 1..36: note = chr16:25266537-25266573
  misc_feature 1..36: note = hypo
  source 1..36: mol_type = genomic DNA
aagggccgacgttctcgctttcggttcagctgttcc

SEQ ID NO: 78714 - DNA, 30 bp, Homo sapiens
  misc_feature 1..30: note = chr16:2531210-2531240
  misc_feature 1..30: note = hypo
  source 1..30: mol_type = genomic DNA
tggcacactggcattcgggaagcatgtctt

SEQ ID NO: 78715 - DNA, 149 bp, Homo sapiens
  misc_feature 1..149: note = chr16:2531804-2531953
  misc_feature 1..149: note = hypo
  source 1..149: mol_type = genomic DNA
agccacagttaggcacgtttgcacttccaaccatcacaggcaggcgggccaaccggcccatggtgtggtgactaacacctcattaatggtcataccccttctgtacctggcatgtgccctccattgtgtgcctccggcaaagagcccac

SEQ ID NO: 78716 - DNA, 44 bp, Homo sapiens
  misc_feature 1..44: note = chr16:2539796-2539840
  misc_feature 1..44: note = hypo
  source 1..44: mol_type = genomic DNA
cctcaggcagctgagcggtcctggccggccgggctgggctgagt

SEQ ID NO: 78717 - DNA, 105 bp, Homo sapiens
  misc_feature 1..105: note = chr16:2540828-2540933
  misc_feature 1..105: note = hypo
  source 1..105: mol_type = genomic DNA
ctctcactccctccccggccaccgcctccggctctgcacctttgtcaggggttgggggactgcagggaacagaggaggccttgtttgctgcgtaggagcaggtgc

SEQ ID NO: 78718 - DNA, 101 bp, Homo sapiens
  misc_feature 1..101: note = chr16:2546405-2546506
  misc_feature 1..101: note = hypo
  source 1..101: mol_type = genomic DNA
gcagcagctgcctgccgctgcccgagttcgtggacaacacgcaggtgcccagctactgcctgaatgcacgcggcgagggggccgtgcgcaagatcctcctg

SEQ ID NO: 78719 - DNA, 30 bp, Homo sapiens
  misc_feature 1..30: note = chr16:2548427-2548457
  misc_feature 1..30: note = hypo
  source 1..30: mol_type = genomic DNA
agagccgcccagccacgtgtcctgcccaca

SEQ ID NO: 78720 - DNA, 30 bp, Homo sapiens
  misc_feature 1..30: note = chr16:25535143-25535173
  misc_feature 1..30: note = hypo
  source 1..30: mol_type = genomic DNA
aatatgccaagtacacgaacactccttcct

SEQ ID NO: 78721 - DNA, 19 bp, Homo sapiens
  misc_feature 1..19: note = chr16:25551069-25551088
  misc_feature 1..19: note = hypo
  source 1..19: mol_type = genomic DNA
ggtgctggccaggcacggt

SEQ ID NO: 78722 - DNA, 28 bp, Homo sapiens
  misc_feature 1..28: note = chr16:25692519-25692547
  misc_feature 1..28: note = hypo
  source 1..28: mol_type = genomic DNA
ttaagatatgtaggccgggtgcggtggc

SEQ ID NO: 78723 - DNA, 1328 bp, Homo sapiens; identical to SEQ ID NO: 36109
  misc_feature 1..1328: note = chr16:25702795-25704123
  misc_feature 1..1328: note = hyper
  source 1..1328: mol_type = genomic DNA

SEQ ID NO: 78724 - DNA, 255 bp, Homo sapiens; identical to SEQ ID NO: 4339
  misc_feature 1..255: note = chr16:25704389-25704644
  misc_feature 1..255: note = hyper
  source 1..255: mol_type = genomic DNA

SEQ ID NO: 78725 - DNA, 151 bp, Homo sapiens
  misc_feature 1..151: note = chr16:25808282-25808433
  misc_feature 1..151: note = hypo
  source 1..151: mol_type = genomic DNA
tttctgggcctccttcgggtttcagccagtcttaattccggtccagagagaagtcctcctgcccttgtccctcactaccattttctgtcctcactgtagccctataaaacgagaattattgtcttcattctataaacgaagtaactggttt

SEQ ID NO: 78726 - DNA, 30 bp, Homo sapiens
  misc_feature 1..30: note = chr16:25859755-25859785
  misc_feature 1..30: note = hypo
  source 1..30: mol_type = genomic DNA
cagcctaattttaaacgaaaaaataatttt

SEQ ID NO: 78727 - DNA, 87 bp, Homo sapiens
  misc_feature 1..87: note = chr16:2589044-2589131
  misc_feature 1..87: note = hypo
  source 1..87: mol_type = genomic DNA
aaatttaattgatcccgtgtcttccaggatgcggcttttttttttttttttttttgatggagtctccctctcgacgcgcaggctgga

SEQ ID NO: 78728 - DNA, 18 bp, Homo sapiens
  misc_feature 1..18: note = chr16:26044215-26044233
  misc_feature 1..18: note = hypo
  source 1..18: mol_type = genomic DNA
tctcgcctcttcttcaca

SEQ ID NO: 78729 - DNA, 32 bp, Homo sapiens
  misc_feature 1..32: note = chr16:26383401-26383433
  misc_feature 1..32: note = hypo
  source 1..32: mol_type = genomic DNA
agctgtaggtagggccgggcgcggtggctcac

SEQ ID NO: 78730 - DNA, 88 bp, Homo sapiens
  misc_feature 1..88: note = chr16:26388441-26388529
  misc_feature 1..88: note = hypo
  source 1..88: mol_type = genomic DNA
ctcaaaaaaaaaaaaaaaaaaaaagaatcacttaccacagtctggaatttactggagacatgcaatggcttagcggcaatccaagaga

SEQ ID NO: 78731 - DNA, 214 bp, Homo sapiens
  misc_feature 1..214: note = chr16:26501488-26501702
  misc_feature 1..214: note = hypo
  source 1..214: mol_type = genomic DNA
gccctcagatgaagacgaaaatctttctttggaaagggctgtttactgattcagaagacaggactgaggcatcagaagcaccgagcctattccattctctcccatactactcagagaaaaccaccaagggttcttgtagagtgccataaggagttaagcacagtcgccatcagaaacacctattgtggaccaggttgtgcgtacatgcacatac

SEQ ID NO: 78732 - DNA, 134 bp, Homo sapiens
  misc_feature 1..134: note = chr16:26616439-26616573
  misc_feature 1..134: note = hypo
  source 1..134: mol_type = genomic DNA
gctcaaggatttcttcggagctgttctgactaaagatgaaattgggaagaggcacacgaggaagaaaatcactcactgcttgaggctgccaggttcagctgacattttctgtctcatcgcgtctacctagaaat

SEQ ID NO: 78733 - DNA, 42 bp, Homo sapiens; identical to SEQ ID NO: 44646
  misc_feature 1..42: note = chr16:26664733-26664775
  misc_feature 1..42: note = hypo
  source 1..42: mol_type = genomic DNA

SEQ ID NO: 78734 - DNA, 30 bp, Homo sapiens; identical to SEQ ID NO: 44647
  misc_feature 1..30: note = chr16:26732577-26732607
  misc_feature 1..30: note = hypo
  source 1..30: mol_type = genomic DNA

SEQ ID NO: 78735 - DNA, 30 bp, Homo sapiens
  misc_feature 1..30: note = chr16:26830222-26830252
  misc_feature 1..30: note = hypo
  source 1..30: mol_type = genomic DNA
ataatagagatatggcgcacataatgggga

SEQ ID NO: 78736 - DNA, 30 bp, Homo sapiens
  misc_feature 1..30: note = chr16:27006797-27006827
  misc_feature 1..30: note = hypo
  source 1..30: mol_type = genomic DNA
cgtaattgattggcacgtgtaactttcaag

SEQ ID NO: 78737 - DNA, 32 bp, Homo sapiens; identical to SEQ ID NO: 44648
  misc_feature 1..32: note = chr16:27038943-27038975
  misc_feature 1..32: note = hypo
  source 1..32: mol_type = genomic DNA

SEQ ID NO: 78738 - DNA, 70 bp, Homo sapiens
  misc_feature 1..70: note = chr16:27052238-27052308
  misc_feature 1..70: note = hypo
  source 1..70: mol_type = genomic DNA
ctggtaatgggttcccggacgctgacaaataggattctcggaggcagccacgccacgttagcagattaaa

SEQ ID NO: 78739 - DNA, 30 bp, Homo sapiens
  misc_feature 1..30: note = chr16:2712995-2713025
  misc_feature 1..30: note = hypo
  source 1..30: mol_type = genomic DNA
ctccaggagacagaccgaattagaagggga

SEQ ID NO: 78740 - DNA, 57 bp, Homo sapiens
  misc_feature 1..57: note = chr16:27166676-27166733
  misc_feature 1..57: note = hyper
  source 1..57: mol_type = genomic DNA
cagcaagtcccccatcgctccaaaaaaaaattaaaaattagccgggcaaaccattca

SEQ ID NO: 78741 - DNA, 36 bp, Homo sapiens; identical to SEQ ID NO: 44649
  misc_feature 1..36: note = chr16:27279055-27279091
  misc_feature 1..36: note = hypo
  source 1..36: mol_type = genomic DNA

SEQ ID NO: 78742 - DNA, 120 bp, Homo sapiens
  misc_feature 1..120: note = chr16:2731636-2731756
  misc_feature 1..120: note = hypo
  source 1..120: mol_type = genomic DNA
attgaattcatgttcggggccacgttgttatatgtattgatatacagccttgaatgtgaataattactatatattttacaacttttttctggctttattacaaaaactttcttttttttt

SEQ ID NO: 78743 - DNA, 30 bp, Homo sapiens
  misc_feature 1..30: note = chr16:27460076-27460106
  misc_feature 1..30: note = hypo
  source 1..30: mol_type = genomic DNA
agtgaggagagggatcggccatacggcctg

SEQ ID NO: 78744 - DNA, 94 bp, Homo sapiens
  misc_feature 1..94: note = chr16:2762746-2762840
  misc_feature 1..94: note = hypo
  source 1..94: mol_type = genomic DNA
ccagctgatcacccccgcctgcagccacgactgacccacgaggcacaccagggggccgcccgagtcgccctgcgggggacgcagagtcaccgtc

SEQ ID NO: 78745 - DNA, 613 bp, Homo sapiens
  misc_feature 1..613: note = chr16:2764096-2764709
  misc_feature 1..613: note = hypo
  source 1..613: mol_type = genomic DNA
ccagcagttcatgcccgtctcaaagatcaccgaggggtcaggcaggcacacggggaggatgtaattggtgaagggcactggtgcctccagctccaccagggccacgtcagcgctggaggccgtgccctggtacagggggttgctctccacctgcctcacccgggcatacatagcgtgtggtcccggctgcactagctgccttgcccccagcaggacctggtacagggacgtctcagaggtgctggcgggagaaacagagaggcggcgtgaggcggcccctcgtgtggggacaggcccgggaggggctggggctcctctggccaccaccgtgccccacacctctctctgcacaatgtcttcgagagtcatctctaggacagccaggtgcagcggtgatgcgtgttgacattgaagccagaccgcccgactcagatttccacctccacccctggccgctgtgtggccttgggcaagtcacttaacaagttctctgtgatgcagctttctcacctgtgctgtggggacagtcacagtgcctacctgaaaggctggctcggagagaaccaccctccaggtgcagcagggccagccccacctgcgggcctctggcagg

SEQ ID NO: 78746 - DNA, 86 bp, Homo sapiens
  misc_feature 1..86: note = chr16:2765717-2765803
  misc_feature 1..86: note = hyper
  source 1..86: mol_type = genomic DNA
cttgcggaagcagtgcgcagccgtcaggacccactgctccgcgatgaggctgcccccgcagaagtggcttccgttgcgctggatgc

SEQ ID NO: 78747 - DNA, 30 bp, Homo sapiens
  misc_feature 1..30: note = chr16:27661959-27661989
  misc_feature 1..30: note = hypo
  source 1..30: mol_type = genomic DNA
caggaaatgttcctccgattttgctttcat

SEQ ID NO: 78748 - DNA, 444 bp, Homo sapiens
  misc_feature 1..444: note = chr16:2770092-2770536
  misc_feature 1..444: note = hypo
  source 1..444: mol_type = genomic DNA
gaccctgcaccttcacgactcaccaaaacacagcagcagcaggagcggcaccgccgccggccgcctcatgtcctcaggcctggctggggcgcagggccgtggtcggcggtggcagaagcgttggagcacgagcgaggtgcaggctccatgaagtggagttttatgctggagatgagcacaggcccggctatgcggcccaacccgtcggcccggcctgcccagctcctctcctcaggaaggaagcgcccagagccgactcctccgtgacctagccctgaaccccgagaccccagggcagacccctcaccccagcgcagcacggggtgccgttggcctcggttcctggaccctgagctgacccagaccccccagcagaccccgagctgaccgcggtgcacgcgaagtccgtccagcttcattcattattattattattattttttt

SEQ ID NO: 78749 - DNA, 110 bp, Homo sapiens
  misc_feature 1..110: note = chr16:27853439-27853549
  misc_feature 1..110: note = hypo
  source 1..110: mol_type = genomic DNA
ttcacatcagtagcacgatgtcgcgcgtgccgaatttcacaccagtagcacgatgtcgcgcgtgccgaatttcacatcagtagcacgttgttgcgcgtgttaaatttcat

SEQ ID NO: 78750 - DNA, 32 bp, Homo sapiens
  misc_feature 1..32: note = chr16:280197-280229
  misc_feature 1..32: note = hypo
  source 1..32: mol_type = genomic DNA
tatttatttttgagacggagtttcgcccaggc

SEQ ID NO: 78751 - DNA, 56 bp, Homo sapiens
  misc_feature 1..56: note = chr16:28057979-28058035
  misc_feature 1..56: note = hypo
  source 1..56: mol_type = genomic DNA
tccagtcttcgtggccgtctctgcttccactcccgcatcaccgctccctggctccc

SEQ ID NO: 78752 - DNA, 210 bp, Homo sapiens
  misc_feature 1..210: note = chr16:2806195-2806405
  misc_feature 1..210: note = hypo
  source 1..210: mol_type = genomic DNA
tggagcattatacagcgaagacttagtgtgaagatcaatgttgaattagggatgaaggagagcagggacttgggtgtggggcggtaagtggttagtttggggccaggggcctgacccgtgtctccccgctccccctcaggagcggtggtgccccccccgggcacggggccatgtacaacgggatcgggctgccgacgccccggggcagcg

SEQ ID NO: 78753 - DNA, 43 bp, Homo sapiens; identical to SEQ ID NO: 36111
  misc_feature 1..43: note = chr16:28073999-28074042
  misc_feature 1..43: note = hyper
  source 1..43: mol_type = genomic DNA

SEQ ID NO: 78754 - DNA, 179 bp, Homo sapiens; identical to SEQ ID NO: 36112
  misc_feature 1..179: note = chr16:28074076-28074255
  misc_feature 1..179: note = hyper
  source 1..179: mol_type = genomic DNA

SEQ ID NO: 78755 - DNA, 520 bp, Homo sapiens; identical to SEQ ID NO: 36113
  misc_feature 1..520: note = chr16:28074417-28074937
  misc_feature 1..520: note = hyper
  source 1..520: mol_type = genomic DNA

SEQ ID NO: 78756 - DNA, 432 bp, Homo sapiens; identical to SEQ ID NO: 36114
  misc_feature 1..432: note = chr16:28074955-28075387
  misc_feature 1..432: note = hyper
  source 1..432: mol_type = genomic DNA

SEQ ID NO: 78757 - DNA, 221 bp, Homo sapiens
  misc_feature 1..221: note = chr16:28104147-28104368
  misc_feature 1..221: note = hypo
  source 1..221: mol_type = genomic DNA
ccaaccaaaacctgagtgtctttaaaaaaaaaatctacctgttgccaaaatgcctgccgcctacgtcaggtctgtggatctctgggacgtttcattgaaatacttaactttccaacccaccccttggtacctgactgacccagggaaagcttctgccacccttcagaggcccctgggggctctgagtcaggctctgaccagcaccacggagctctctctgc

SEQ ID NO: 78758 - DNA, 39 bp, Homo sapiens
  misc_feature 1..39: note = chr16:2818117-2818156
  misc_feature 1..39: note = hypo
  source 1..39: mol_type = genomic DNA
ggcggagttcctcctcgtcgtcgtcgtcctctagctcct

SEQ ID NO: 78759 - DNA, 39 bp, Homo sapiens
  misc_feature 1..39: note = chr16:2819758-2819797
  misc_feature 1..39: note = hypo
  source 1..39: mol_type = genomic DNA
aaagccccacctctgcgggagtggcgtgtgaggctcttc

SEQ ID NO: 78760 - DNA, 220 bp, Homo sapiens
  misc_feature 1..220: note = chr16:28304439-28304659
  misc_feature 1..220: note = hyper
  source 1..220: mol_type = genomic DNA
accagcaagaagcctcggggatcccccccctaaagctccaggacttgggcgactgagcccctggcggcaccgcttgcaccccggtccatggtcgtggcgccctgagcccccggggccgggcagacgaagaccgcgacggcgcccaggccccctgccgcggcgtccccgcggccccagcccaggtaagccgggcccaggtgaggggcggcaggtgagtggc

SEQ ID NO: 78761 - DNA, 267 bp, Homo sapiens
  misc_feature 1..267: note = chr16:2849356-2849623
  misc_feature 1..267: note = hypo
  source 1..267: mol_type = genomic DNA
cgggcctacagcagtcgttacaaagtgcaggacatcattgtgaaccctgacgcacttggggttttacgcaatgacattgccctgctgagactggcctcttctgtcacctacaatgcgtacatccagcccatttgcatcgagtcttccaccttcaacttcgtgcaccggccggactgctgggtgaccggctgggggttaatcagccccagtggcagtgaggctggggatagaccgggtggggtgatgggggtgcggggtgagcattac

SEQ ID NO: 78762 - DNA, 104 bp, Homo sapiens
  misc_feature 1..104: note = chr16:28560175-28560279
  misc_feature 1..104: note = hypo
  source 1..104: mol_type = genomic DNA
ccatgtagaatgaagcgagcccagacatcattgtcgccctccgcaacggtgcatctgtgctcccatttttgcaagaaaaattattttctttttctttttctttt

SEQ ID NO: 78763 - DNA, 30 bp, Homo sapiens
  misc_feature 1..30: note = chr16:2868686-2868716
  misc_feature 1..30: note = hypo
  source 1..30: mol_type = genomic DNA
ccttagtgatccctccgggtggatggtcca

SEQ ID NO: 78764 - DNA, 52 bp, Homo sapiens
  misc_feature 1..52: note = chr16:2877484-2877536
  misc_feature 1..52: note = hypo
  source 1..52: mol_type = genomic DNA
tccccaggtcaggcacgcaggtgaggaggagtgtcctcgtgtgtgcatgccc

SEQ ID NO: 78765 - DNA, 30 bp, Homo sapiens
  misc_feature 1..30: note = chr16:2879766-2879796
  misc_feature 1..30: note = hypo
  source 1..30: mol_type = genomic DNA
gcctggtgcacctgccgcacagggcacagg

SEQ ID NO: 78766 - DNA, 165 bp, Homo sapiens
  misc_feature 1..165: note = chr16:28878680-28878845
  misc_feature 1..165: note = hypo
  source 1..165: mol_type = genomic DNA
ctcttctatcacagacgtccggacaaccacagccctggagatgcctgaccgggagaacacgtttgtggttaaggtaggaattcaacttcccagccgccggcagtgcttgtgttaaggagaaagccctcagcgcatttaagcaagtggcgtcgccgaaaggaggta

SEQ ID NO: 78767 - DNA, 149 bp, Homo sapiens
  misc_feature 1..149: note = chr16:28887653-28887802
  misc_feature 1..149: note = hypo
  source 1..149: mol_type = genomic DNA
tctgtctcaggctctcgactccctcgaagctgcccatctctccgtctgcccctctccatgtttgggcattcccactgctgtaagacagtagcccctgtcactcctccaggtgccggtggggagacgccggccagcgccaaaagccttgg

SEQ ID NO: 78768 - DNA, 523 bp, Homo sapiens
  misc_feature 1..523: note = chr16:28891515-28892038
  misc_feature 1..523: note = hyper
  source 1..523: mol_type = genomic DNA
ctctgcctcctctcccgccctgggggctactccccatcccgcggtccatctgcatgtcgcgggttcttccgcagcatgtgagcctcgctggggactctggaggcaacgaaagcctccctgtgccttggtctccgaacgcaggccccgtcgcgttaagcacaagctggcagggcctctcctctcccttctcagatttgctccttgacatttgcctgctgcctggcggtggcaacagctggggcggggcgcgcgcaggaggccccgtaaccctatccccgctccggctccctcgtgaaaccggagcttccctgccttggccgagggggagggctgcgggggccagaccgcctgcgaagaccacagggtttttcctctcgggttttggctcccgtgggatggatgtggctgtgcggggggttggcctgagcttcgcttctaagccagcagcttggtcagggaaacctgaaagcattcccagctaatcccccaagtggtgcaagtctgtgcgcgcccatcccgctga

SEQ ID NO: 78769 - DNA, 116 bp, Homo sapiens
  misc_feature 1..116: note = chr16:2892487-2892603
  misc_feature 1..116: note = hyper
  source 1..116: mol_type = genomic DNA
gaagttggcctgacccgagaagcccaggatcgctgaggaagctccccactgttgtcgcctctcagccccacgcccactcatccacaggcagccgggatgctcacgcagccacgtca

SEQ ID NO: 78770 - DNA, 103 bp, Homo sapiens
  misc_feature 1..103: note = chr16:2892626-2892729
  misc_feature 1..103: note = hyper
  source 1..103: mol_type = genomic DNA
cgactctgccaacagggggcgctgcaggaggctacgcggtcgcagggactcctttctgtccgtttccgacaaacttcccgcgctcttccggaggttgagggtg

SEQ ID NO: 78771 - DNA, 26 bp, Homo sapiens
  misc_feature 1..26: note = chr16:28947344-28947370
  misc_feature 1..26: note = hypo
  source 1..26: mol_type = genomic DNA
cccgtccgcctcgcaatttgaactcc

SEQ ID NO: 78772 - DNA, 70 bp, Homo sapiens
  misc_feature 1..70: note = chr16:28947831-28947901
  misc_feature 1..70: note = hyper
  source 1..70: mol_type = genomic DNA
gattcttcaaagtgacgcctcccccaggaagcgggccccagaaccagtacgggaacgtgctgtctctccc

SEQ ID NO: 78773 - DNA, 38 bp, Homo sapiens
  misc_feature 1..38: note = chr16:28986682-28986720
  misc_feature 1..38: note = hyper
  source 1..38: mol_type = genomic DNA
ctgaactacatggaccgcttcaccgtggctggtaggga

SEQ ID NO: 78774 - DNA, 90 bp, Homo sapiens
  misc_feature 1..90: note = chr16:29009366-29009456
  misc_feature 1..90: note = hypo
  source 1..90: mol_type = genomic DNA
agcagggactacaggcgtgcaacatcatgcccacttaattgtttgtattttctgtacaaacagttttctgtgacaccccgtctctactaa

SEQ ID NO: 78775 - DNA, 30 bp, Homo sapiens
  misc_feature 1..30: note = chr16:29083064-29083094
  misc_feature 1..30: note = hypo
  source 1..30: mol_type = genomic DNA
gtcctagttaatgttcggcttcttaaattg

SEQ ID NO: 78776 - DNA, 30 bp, Homo sapiens
  misc_feature 1..30: note = chr16:29119028-29119058
  misc_feature 1..30: note = hypo
  source 1..30: mol_type = genomic DNA
taagggaagaaaaggcgctcttttgatgtt

SEQ ID NO: 78777 - DNA, 85 bp, Homo sapiens
  misc_feature 1..85: note = chr16:29139086-29139171
  misc_feature 1..85: note = hypo
  source 1..85: mol_type = genomic DNA
gcagggagggcatttcggcccattttacagaccaggaaaacgggcggagaggctgagtgactgcccgaggcgacacacagctctc

SEQ ID NO: 78778 - DNA, 97 bp, Homo sapiens
  misc_feature 1..97: note = chr16:29153157-29153254
  misc_feature 1..97: note = hypo
  source 1..97: mol_type = genomic DNA
ggtgggataatcctccgtggcacgaggaagcagtggaataatcctccatggcacaagggagcggtggaataatcctctgtggcacgcgggggggggt

SEQ ID NO: 78779 - DNA, 217 bp, Homo sapiens
  misc_feature 1..217: note = chr16:29153374-29153591
  misc_feature 1..217: note = hypo
  source 1..217: mol_type = genomic DNA
gtggtataatcctctgtggcacgaggggtcggcggtataatcctccgtggcacgaggatggtcaccgcattcgtcactcttagctgcagtgcgtgtgacagtcgccagggctgctgtttgaggaatgggagttgcctgcgtctgctctgccccaggtggtttgtagggtggtttttactccttgccaaagcccacacagccccgcaaggcaaacagt

SEQ ID NO: 78780 - DNA, 159 bp, Homo sapiens
  misc_feature 1..159: note = chr16:29169937-29170096
  misc_feature 1..159: note = hypo
  source 1..159: mol_type = genomic DNA
agggctgggaaacagcggagatggcgcgccccacctgggagaacacaggcagctggaggacgtcggcggtgttactgtcacggtcacctggactgggcggttgcaggcggccggatgctggacccgcagcgtgagctccacggccgcagcagggaggcg

SEQ ID NO: 78781 - DNA, 30 bp, Homo sapiens
  misc_feature 1..30: note = chr16:29179232-29179262
  misc_feature 1..30: note = hypo
  source 1..30: mol_type = genomic DNA
gcatcggggtgcgtgcgcaggaaacgggag

SEQ ID NO: 78782 - DNA, 181 bp, Homo sapiens
  misc_feature 1..181: note = chr16:29187850-29188031
  misc_feature 1..181: note = hypo
  source 1..181: mol_type = genomic DNA
tctgtttactgagcacgcgtgatgtgccaggtgtggccctggggctcgaactctattgcccggtctataaagcacatgttgtcaccaccccgttttacagaggaggaaactgaggcttggggaggctcatcagctcaccctgcggggagtcggccggcagcagctgcgtcactgtggatcc

SEQ ID NO: 78783 - DNA, 55 bp, Homo sapiens
  misc_feature 1..55: note = chr16:29191424-29191479
  misc_feature 1..55: note = hypo
  source 1..55: mol_type = genomic DNA
gcatccatgcaccagcggcaccacgacccacccgggcccgcgtgactagactcag

SEQ ID NO: 78784 - DNA, 146 bp, Homo sapiens
  misc_feature 1..146: note = chr16:29230150-29230296
  misc_feature 1..146: note = hypo
  source 1..146: mol_type = genomic DNA
tgcgagaggcatttacgacctcagcgacacattccctcaacctcatcacgctgcaagtgctgccagggtgtgttcaggggacactccctctcgggctggcttgtgcggggacacgtgcgtgcacacagacacggactcacataaat

SEQ ID NO: 78785 - DNA, 344 bp, Homo sapiens
  misc_feature 1..344: note = chr16:29244717-29245061
  misc_feature 1..344: note = hypo
  source 1..344: mol_type = genomic DNA
ggaagggccctgagccgggtgccacggccgacgccctgtcctttgccgtgacagtctctgtgcagtgcaggcagcccccaccgaatccaggtacagtgctcagtgacaagcgtagggagagtggtcaaatcggagcaggggcaggggacgtgagtcaggctgaaaagaagaagctcagagcaggaagggcagaggggccgggaagggcaggtctgaagctcggagtgggaagggcagacgggctgggaagagcaggtctgaagctcggagtgggaggggcagaggcggtgaagggtgagtccggagcagcctctagttgcccaggtgctcggagagtgaggaac

SEQ ID NO: 78786 - DNA, 125 bp, Homo sapiens
  misc_feature 1..125: note = chr16:29248426-29248551
  misc_feature 1..125: note = hypo
  source 1..125: mol_type = genomic DNA
tctgcctgggtctggcgggcgcttcctggtgagagatcccacttggtatctctgtgggaacggaagggaggtgaggccgcgggaacggaagggaggagaggccgcgggaacggcggggaggcgag

SEQ ID NO: 78787 - DNA, 30 bp, Homo sapiens; identical to SEQ ID NO: 44659
  misc_feature 1..30: note = chr16:29262965-29262995
  misc_feature 1..30: note = hypo
  source 1..30: mol_type = genomic DNA

SEQ ID NO: 78788 - DNA, 80 bp, Homo sapiens
  misc_feature 1..80: note = chr16:29266368-29266448
  misc_feature 1..80: note = hypo
  source 1..80: mol_type = genomic DNA
ttaaaacaacagaaacgtatcccccacagccctgaaagcagagggctggcatcaaggagcctgcccgggggtgccagcca

SEQ ID NO: 78789 - DNA, 30 bp, Homo sapiens
  misc_feature 1..30: note = chr16:29324346-29324376
  misc_feature 1..30: note = hypo
  source 1..30: mol_type = genomic DNA
atgccagggcctcagcgctgacctggctgt

SEQ ID NO: 78790 - DNA, 34 bp, Homo sapiens; identical to SEQ ID NO: 44661
  misc_feature 1..34: note = chr16:29324812-29324846
  misc_feature 1..34: note = hypo
  source 1..34: mol_type = genomic DNA

SEQ ID NO: 78791 - DNA, 63 bp, Homo sapiens
  misc_feature 1..63: note = chr16:29353324-29353387
  misc_feature 1..63: note = hypo
  source 1..63: mol_type = genomic DNA
actttaccccctcatcgtcataccatattcagttttctgtatatcccacgatgtagcatgctt

SEQ ID NO: 78792 - DNA, 27 bp, Homo sapiens
  misc_feature 1..27: note = chr16:29660744-29660771
  misc_feature 1..27: note = hypo
  source 1..27: mol_type = genomic DNA
ggcgtgagcgatcgcacccagcctctt

SEQ ID NO: 78793 - DNA, 37 bp, Homo sapiens
  misc_feature 1..37: note = chr16:29682566-29682603
  misc_feature 1..37: note = hypo
  source 1..37: mol_type = genomic DNA
cccaaagtgctgggattacaggcgtgagccacagtgc

SEQ ID NO: 78794 - DNA, 73 bp, Homo sapiens; identical to SEQ ID NO: 44662
  misc_feature 1..73: note = chr16:29691644-29691717
  misc_feature 1..73: note = hypo
  source 1..73: mol_type = genomic DNA

SEQ ID NO: 78795 - DNA, 30 bp, Homo sapiens
  misc_feature 1..30: note = chr16:29703508-29703538
  misc_feature 1..30: note = hypo
  source 1..30: mol_type = genomic DNA
atgcagggcccatcacgggctatgcctacc

SEQ ID NO: 78796 - DNA, 30 bp, Homo sapiens
  misc_feature 1..30: note = chr16:29711222-29711252
  misc_feature 1..30: note = hypo
  source 1..30: mol_type = genomic DNA
atgctgttgtgagtacgggatgtgccagca

SEQ ID NO: 78797 - DNA, 171 bp, Homo sapiens
  misc_feature 1..171: note = chr16:2975829-2976000
  misc_feature 1..171: note = hypo
  source 1..171: mol_type = genomic DNA
cctctgcgttgtctccggagccgaccaggccttcgggagtggaatgtggggccccaggccagggaactttggatcaaagtgggagaccagtgggaactggagctgcagcatgtgaggtgggggtgaggacgctgaaaatgtcagggactgcagtctcgattccaggctgag

SEQ ID NO: 78798 - DNA, 252 bp, Homo sapiens
  misc_feature 1..252: note = chr16:29830871-29831123
  misc_feature 1..252: note = hypo
  source 1..252: mol_type = genomic DNA
ccaggaagctcagcccggagccagaaacgggaggcccgcctggacaaggtgctgtcggacatgaagagacacaagaagctggaggagcagatccttcgtaccgggagggacctcttcagcctggactcggaggaccccagccccgccagccccccactccgatcctccgggagtagtctcttccctcggcagcggaaatactgattcccactgctcctgcctctagggtgcagtgtccgtacctgctggagc

SEQ ID NO: 78799 - DNA, 35 bp, Homo sapiens
  misc_feature 1..35: note = chr16:29884723-29884758
  misc_feature 1..35: note = hypo
  source 1..35: mol_type = genomic DNA
ccccgggttcaggcacggctcgtacttcactgcgg

SEQ ID NO: 78800 - DNA, 148 bp, Homo sapiens
  misc_feature 1..148: note = chr16:29888624-29888772
  misc_feature 1..148: note = hyper
  source 1..148: mol_type = genomic DNA
ctggatttgggggcccgggcggtgcctgaaactgcagtgtgaggtcgggcccagaggagagaaggcggcggcgcggctgaggtccccgcagctgggccaagactcgggcgctgggaccgtccccgtcgaacagcgtcagcatgtcccc

SEQ ID NO: 78801 - DNA, 30 bp, Homo sapiens
  misc_feature 1..30: note = chr16:29913174-29913204
  misc_feature 1..30: note = hypo
  source 1..30: mol_type = genomic DNA
ctcctgcctggggcccggctcgagggccgc

SEQ ID NO: 78802 - DNA, 141 bp, Homo sapiens
  misc_feature 1..141: note = chr16:29936349-29936490
  misc_feature 1..141: note = hypo
  source 1..141: mol_type = genomic DNA
tttgatacttgaaggcagatctccgcctctcaaatttttattctcctgctctcacagtcctcgttaacccctcccttaagactctcccactcccaaactccaaaacttcaaagtctcacttgggcacgaagggtccatact

SEQ ID NO: 78803 - DNA, 35 bp, Homo sapiens
  misc_feature 1..35: note = chr16:29972439-29972474
  misc_feature 1..35: note = hypo
  source 1..35: mol_type = genomic DNA
ctggcgacagactgagaccccgtctcaaaaaaaaa

SEQ ID NO: 78804 - DNA, 34 bp, Homo sapiens
  misc_feature 1..34: note = chr16:299951-299985
  misc_feature 1..34: note = hypo
  source 1..34: mol_type = genomic DNA
atttttctttttagacggagtctcgctctgtcgc

SEQ ID NO: 78805 - DNA, 112 bp, Homo sapiens
  misc_feature 1..112: note = chr16:30015457-30015569
  misc_feature 1..112: note = hypo
  source 1..112: mol_type = genomic DNA
gactggacactgccccgcaggacccagcaggcctaagcctcaggacctccatgtccacaccaggttcagcctcctctgctggcacgtgacttctccccgtttcccgcccccc

SEQ ID NO: 78806 - DNA, 630 bp, Homo sapiens
  misc_feature 1..630: note = chr16:30017228-30017858
  misc_feature 1..630: note = hypo
  source 1..630: mol_type = genomic DNA
gcgggggcctggggccgggctctgagcactgcccgggtgtgcagatgatggggggtttgcatatttgcagggactagcgagtcaggcaggaggtttgcatatgtgaatatagaactccgcagcccctcatgagcagacagacccgggtcacggagactcacaaaaataggtagtgcagggtgggggcagcccaccctgtgtaaacgtgcaacacactcgtgcgaaggttgggtactggacccggctcgatgggcctgtgccgggacactgctgtccactcaggctgaggacagagccccggccgcagggggcagctcactggtcagggtgtgccagcgctccagggctgcgtccggctgctgcaggcagtcactccagtgcttccgagcctcgcctcgggcacctggccccagggacacgccacctggggagcaggtgggcagggtcagggccacctccctgccacttgcccgccctcaacacccgcagccagctcctccctcaccaatgaagtcattggatttgccaatgtcatagtcccagacggtgacttccagggtcttggtggccagagtggagagctctatctcgtagaaaaactcctagggacaaggccggccacccgttcgt

SEQ ID NO: 78807 - DNA, 44 bp, Homo sapiens
  misc_feature 1..44: note = chr16:30018478-30018522
  misc_feature 1..44: note = hypo
  source 1..44: mol_type = genomic DNA
agcccccacacagaccgggacctggcgctcgaggcagatgttaa

SEQ ID NO: 78808 - DNA, 38 bp, Homo sapiens
  misc_feature 1..38: note = chr16:30020315-30020353
  misc_feature 1..38: note = hypo
  source 1..38: mol_type = genomic DNA
cctgagcaccttgtgcgtgatgtcgtcatctgtgatcc

SEQ ID NO: 78809 - DNA, 154 bp, Homo sapiens
  misc_feature 1..154: note = chr16:300225-300379
  misc_feature 1..154: note = hypo
  source 1..154: mol_type = genomic DNA
ggccaggaatctatgttttaaacatttcacacatcccttccttggggacatggtggctagatttgctgaattaatggccgtctcctcttcttccagccctggccccagcccctcaggccctggcaatgaggcactcctacgttctgttgctggc

SEQ ID NO: 78810 - DNA, 114 bp, Homo sapiens
  misc_feature 1..114: note = chr16:30022990-30023104
  misc_feature 1..114: note = hyper
  source 1..114: mol_type = genomic DNA
gatctcggggtctcccgagccaggctggggagcctcacgatctgagggaggaggcagaggtctgatgctgcggcttcccccacgccccctccctttggccgttcaggcctctct

SEQ ID NO: 78811 - DNA, 38 bp, Homo sapiens
  misc_feature 1..38: note = chr16:30032589-30032627
  misc_feature 1..38: note = hyper
  source 1..38: mol_type = genomic DNA
agagtccgctgagcacgcaccttcgttgtgaaactaag

SEQ ID NO: 78812 - DNA, 129 bp, Homo sapiens
  misc_feature 1..129: note = chr16:30042292-30042421
  misc_feature 1..129: note = hyper
  source 1..129: mol_type = genomic DNA
aaggaaggaggtgggcgggagggagcggaggagcagccgggcaagcggtcagcggtcaccaccgctctcctggctccactgcctcctctcgctgccgccccagtccctgccgcccggcacagacaccgc

SEQ ID NO: 78813 - DNA, 26 bp, Homo sapiens
  misc_feature 1..26: note = chr16:30065618-30065644
  misc_feature 1..26: note = hypo
  source 1..26: mol_type = genomic DNA
cagtgatactccgtctcaataagaat

SEQ ID NO: 78814 - DNA, 30 bp, Homo sapiens
  misc_feature 1..30: note = chr16:30085375-30085405
  misc_feature 1..30: note = hypo
  source 1..30: mol_type = genomic DNA
ctaagaagccaggcacggtggctcaagctg

SEQ ID NO: 78815 - DNA, 107 bp, Homo sapiens
  misc_feature 1..107: note = chr16:30100357-30100464
  misc_feature 1..107: note = hypo
  source 1..107: mol_type = genomic DNA
gggtgaatgtagacacggtcaggcaggcggggctctgccttgccgctgggctcccagcgccggccctgccagcggtagcgagccccatccaccggaatcacatccag

SEQ ID NO: 78816 - DNA, 30 bp, Homo sapiens
  misc_feature 1..30: note = chr16:30103941-30103971
  misc_feature 1..30: note = hyper
  source 1..30: mol_type = genomic DNA
gtccagagctcccttcgggtggcgggaagc

SEQ ID NO: 78817 - DNA, 196 bp, Homo sapiens
  misc_feature 1..196: note = chr16:30116119-30116315
  misc_feature 1..196: note = hypo
  source 1..196: mol_type = genomic DNA
gcacaacgatgtgatcgaaaggcaaatatttatttttcaggaagagaaacaggagacctcgaggcttctggacttaggaggtccgggcagctggtccatggttgtccaggtagtgccgcagggctgtgggataatccgttatgacgccagtggctcccacgctgaaggctgcttcaaaatccgactcttcattaag

SEQ ID NO: 78818 - DNA, 34 bp, Homo sapiens
  misc_feature 1..34: note = chr16:30124080-30124114
  misc_feature 1..34: note = hypo
  source 1..34: mol_type = genomic DNA
gagctccaggaggtccgagcgctgggccatggag

SEQ ID NO: 78819 - DNA, 364 bp, Homo sapiens
  misc_feature 1..364: note = chr16:30124497-30124861
  misc_feature 1..364: note = hypo
  source 1..364: mol_type = genomic DNA
agccagcccaggctgcgccagcatcttcttcctcgtccacaccctgccctgccacttcgctctccttctctcttggtccctgccccgtttctagcatgcccccttggacctacccctctgtgctgtccactttggcacctgttctcacccctacccggctcacctcctcggtgggcccccaggcggatgcggaaggtgggagccctgggcgtgtgcagcagatgaggccggcgcaggaagaagatggagagcatggcatagctgcccagggcagggagggcatagtacagcaaaaggctcatgaccgtactcccacagaagctcctgcagccacacgctcagccgtccgcgggactgtgctgcc

SEQ ID NO: 78820 - DNA, 23 bp, Homo sapiens
  misc_feature 1..23: note = chr16:30135083-30135106
  misc_feature 1..23: note = hypo
  source 1..23: mol_type = genomic DNA
agggtctctctctgtcgtccagg

SEQ ID NO: 78821 - DNA, 57 bp, Homo sapiens; identical to SEQ ID NO: 36030
  misc_feature 1..57: note = chr16:3016793-3016850
  misc_feature 1..57: note = hyper
  source 1..57: mol_type = genomic DNA

SEQ ID NO: 78822 - DNA, 275 bp, Homo sapiens; identical to SEQ ID NO: 4311
  misc_feature 1..275: note = chr16:3017156-3017431
  misc_feature 1..275: note = hyper
  source 1..275: mol_type = genomic DNA

SEQ ID NO: 78823 - DNA, 34 bp, Homo sapiens; identical to SEQ ID NO: 44559
  misc_feature 1..34: note = chr16:3021547-3021581
  misc_feature 1..34: note = hypo
  source 1..34: mol_type = genomic DNA

SEQ ID NO: 78824 - DNA, 45 bp, Homo sapiens
  misc_feature 1..45: note = chr16:3026818-3026863
  misc_feature 1..45: note = hypo
  source 1..45: mol_type = genomic DNA
tgccagcctggggtccgaggagggaagaggcggctgatgggaatg

SEQ ID NO: 78825 - DNA, 30 bp, Homo sapiens; identical to SEQ ID NO: 44667
  misc_feature 1..30: note = chr16:30354712-30354742
  misc_feature 1..30: note = hypo
  source 1..30: mol_type = genomic DNA

SEQ ID NO: 78826 - DNA, 181 bp, Homo sapiens
  misc_feature 1..181: note = chr16:30365186-30365367
  misc_feature 1..181: note = hypo
  source 1..181: mol_type = genomic DNA
cccaggccccagccacgccagcccctgggccgcacccagtcaatgttgtccagccagctgtctcggatctgagcatcccggttcaggaagtagttgccatcggcatcaaagtggccttcctccatctcctcctgcaggttaaagggtgtgatccgaacacccccctcgctggggagtgtgg

SEQ ID NO: 78827 - DNA, 20 bp, Homo sapiens
  misc_feature 1..20: note = chr16:30401737-30401757
  misc_feature 1..20: note = hypo
  source 1..20: mol_type = genomic DNA
ttattttttttgagtcggag

SEQ ID NO: 78828 - DNA, 153 bp, Homo sapiens
  misc_feature 1..153: note = chr16:30430020-30430173
  misc_feature 1..153: note = hypo
  source 1..153: mol_type = genomic DNA
cctaaaaggggttcccggcacctcggtttgtgttggttggaggtgatcgcacacttggcccttggttacgtcctcataaccttagacctgaaagggcccataaatatactatgttcacgatcagacacgcactgcattcggcagagctccagt

SEQ ID NO: 78829 - DNA, 19 bp, Homo sapiens
  misc_feature 1..19: note = chr16:30541444-30541463
  misc_feature 1..19: note = hypo
  source 1..19: mol_type = genomic DNA
cggccgagaatagctacat

SEQ ID NO: 78830 - DNA, 63 bp, Homo sapiens
  misc_feature 1..63: note = chr16:30567446-30567509
  misc_feature 1..63: note = hypo
  source 1..63: mol_type = genomic DNA
gggagagttcaggctcggctcatcctggtccttgaatcccacagcccgcgtggacagggacag

SEQ ID NO: 78831 - DNA, 34 bp, Homo sapiens
  misc_feature 1..34: note = chr16:30573625-30573659
  misc_feature 1..34: note = hypo
  source 1..34: mol_type = genomic DNA
ccggtccaagattctcgaccgagggcctgacgtc

SEQ ID NO: 78832 - DNA, 31 bp, Homo sapiens
  misc_feature 1..31: note = chr16:30584531-30584562
  misc_feature 1..31: note = hypo
  source 1..31: mol_type = genomic DNA
catttctacttatttacgttgttccaaatta

SEQ ID NO: 78833 - DNA, 47 bp, Homo sapiens
  misc_feature 1..47: note = chr16:30644928-30644975
  misc_feature 1..47: note = hypo
  source 1..47: mol_type = genomic DNA
tgagatgggaggctccgttgagtcctggagttcgaaaccccgtcact

SEQ ID NO: 78834 - DNA, 280 bp, Homo sapiens
  misc_feature 1..280: note = chr16:3068171-3068451
  misc_feature 1..280: note = hyper
  source 1..280: mol_type = genomic DNA
tcctaggccgagtgtcgggacaggggcggaggcgggggtcttaaagaagcggtgacgtcactggaccaccgccccggaggaggggcagagaccctgtccctgacggcagcgggcgtgcgaatcccaggcttgtcagaggggggcgctggaggctggggtcgctgggcccgcctcgggctggcagacgtccagactcacccagggtgagggcgccaggcttagggtagaacagagcttgagactccgcttcaccacttaagcagcgcggtgacatggggaa

SEQ ID NO: 78835 - DNA, 69 bp, Homo sapiens
  misc_feature 1..69: note = chr16:30761038-30761107
  misc_feature 1..69: note = hypo
  source 1..69: mol_type = genomic DNA
aaccccattttttcacggattcattcatttatgccttcaacacaaagctcaacacggggagggcagaaa

SEQ ID NO: 78836 - DNA, 30 bp, Homo sapiens
  misc_feature 1..30: note = chr16:3078354-3078384
  misc_feature 1..30: note = hyper
  source 1..30: mol_type = genomic DNA
ggcctccagctcctgcgtgagcgccacctt

SEQ ID NO: 78837 - DNA, 48 bp, Homo sapiens
  misc_feature 1..48: note = chr16:30790427-30790475
  misc_feature 1..48: note = hypo
  source 1..48: mol_type = genomic DNA
accctacgaactgtgcgctcacatcatccatcccgtacaagagccaag

SEQ ID NO: 78838 - DNA, 104 bp, Homo sapiens
  misc_feature 1..104: note = chr16:30803850-30803954
  misc_feature 1..104: note = hypo
  source 1..104: mol_type = genomic DNA
gtgaaccaccatgcccggcccaatgctcttcttagttatgggccttatgccccgaggggctgcaataacagtgagttcctggccaggtgcggtggctcacacct

SEQ ID NO: 78839 - DNA, 26 bp, Homo sapiens
  misc_feature 1..26: note = chr16:30804455-30804481
  misc_feature 1..26: note = hypo
  source 1..26: mol_type = genomic DNA
tgcggacttcccgattaaaaagcact

SEQ ID NO: 78840 - DNA, 34 bp, Homo sapiens
  misc_feature 1..34: note = chr16:30817004-30817038
  misc_feature 1..34: note = hyper
  source 1..34: mol_type = genomic DNA
gcgtccgggcccaggcgaccggggcctccgagct

SEQ ID NO: 78841 - DNA, 145 bp, Homo sapiens
  misc_feature 1..145: note = chr16:30826330-30826475
  misc_feature 1..145: note = hypo
  source 1..145: mol_type = genomic DNA
cccaaagtgctgggattaccggcgggagccaccgctcccgtccaggacagggattttggttggttggttggatggagccttacagtttggatgtggtgagcatgaaatgcatacgttcaagaagctgagccgacaaagggcttac

SEQ ID NO: 78842 - DNA, 30 bp, Homo sapiens
  misc_feature 1..30: note = chr16:30832615-30832645
  misc_feature 1..30: note = hypo
  source 1..30: mol_type = genomic DNA
cagggacaggaacaacgctgaggagcttga

SEQ ID NO: 78843 - DNA, 30 bp, Homo sapiens
  misc_feature 1..30: note = chr16:30832846-30832876
  misc_feature 1..30: note = hypo
  source 1..30: mol_type = genomic DNA
cgagaaaatgtgggtcgtgaccaactcagt

SEQ ID NO: 78844 - DNA, 30 bp, Homo sapiens
  misc_feature 1..30: note = chr16:30833324-30833354
  misc_feature 1..30: note = hypo
  source 1..30: mol_type = genomic DNA
ctctgggcttgttgccgttgttggctgcag

SEQ ID NO: 78845 - DNA, 76 bp, Homo sapiens; identical to SEQ ID NO: 44672
  misc_feature 1..76: note = chr16:30906986-30907062
  misc_feature 1..76: note = hypo
  source 1..76: mol_type = genomic DNA

SEQ ID NO: 78846 - DNA, 196 bp, Homo sapiens; identical to SEQ ID NO: 44673
  misc_feature 1..196: note = chr16:30907122-30907318
  misc_feature 1..196: note = hypo
  source 1..196: mol_type = genomic DNA

SEQ ID NO: 78847 - DNA, 99 bp, Homo sapiens
  misc_feature 1..99: note = chr16:3096690-3096789
  misc_feature 1..99: note = hyper
  source 1..99: mol_type = genomic DNA
gcccacccgacccagcggcgcgaccctggccctccgggaccctccgctgactccaccgcgcacttcccgggacccccacacacatcccagccctccggc

SEQ ID NO: 78848 - DNA, 188 bp, Homo sapiens
  misc_feature 1..188: note = chr16:3096821-3097009
  misc_feature 1..188: note = hyper
  source 1..188: mol_type = genomic DNA
cgccctctccaggcccggatctcctcccccaggtccccggggcggccccagccaggcccccttcgaaccccgccggcggcccgggctggggcgcaccatgcggctgcggctccggcttctggcgctgctgcttctgctgctggcaccgcccgcgcgcgccccgaagccctcggcgcaggacgtgagcc

SEQ ID NO: 78849 - DNA, 30 bp, Homo sapiens
  misc_feature 1..30: note = chr16:30979173-30979203
  misc_feature 1..30: note = hypo
  source 1..30: mol_type = genomic DNA
gaattccgagttaaacgaggcatctcccca

SEQ ID NO: 78850 - DNA, 30 bp, Homo sapiens
  misc_feature 1..30: note = chr16:31001301-31001331
  misc_feature 1..30: note = hypo
  source 1..30: mol_type = genomic DNA
gacaacatgccaggacgcacacagacagca

SEQ ID NO: 78851 - DNA, 30 bp, Homo sapiens; identical to SEQ ID NO: 44674
  misc_feature 1..30: note = chr16:31018076-31018106
  misc_feature 1..30: note = hypo
  source 1..30: mol_type = genomic DNA

SEQ ID NO: 78852 - DNA, 30 bp, Homo sapiens; identical to SEQ ID NO: 36119
  misc_feature 1..30: note = chr16:31022167-31022197
  misc_feature 1..30: note = hyper
  source 1..30: mol_type = genomic DNA

SEQ ID NO: 78853 - DNA, 198 bp, Homo sapiens
  misc_feature 1..198: note = chr16:31138607-31138805
  misc_feature 1..198: note = hypo
  source 1..198: mol_type = genomic DNA
caagctctggctctgcgagtactgcctcaagtacatgaaatatgagaagagctaccgcttccacttggtgaggctgggccggccgggccgagctgggcaggggcccggtgagaggcagaggcaggcatggagactgagggcggctgcgccggcagctccagggaggagacaggcccaaaggagcgagtacagggaaga

SEQ ID NO: 78854 - DNA, 39 bp, Homo sapiens; identical to SEQ ID NO: 44676
  misc_feature 1..39: note = chr16:31149942-31149981
  misc_feature 1..39: note = hypo
  source 1..39: mol_type = genomic DNA

SEQ ID NO: 78855 - DNA, 81 bp, Homo sapiens
  misc_feature 1..81: note = chr16:31173147-31173228
  misc_feature 1..81: note = hypo
  source 1..81: mol_type = genomic DNA
caagagtgaaactcaatctcaaaaaaagaaaaaaaagtgtttgtccctgcttaaaagtctctgtggcggctctaggctctt

SEQ ID NO: 78856 - DNA, 196 bp, Homo sapiens
  misc_feature 1..196: note = chr16:31213944-31214140
  misc_feature 1..196: note = hyper
  source 1..196: mol_type = genomic DNA
acttcttgagctcctcggcggtcaggttctccagcgcatccaggatggcgtcgcgcgcgcgccccatggctccaggatccccggccgctgccgccgctcaccccgctgcagccgccgaccaggaggaagtcggctccggggcggaacctggactccccgccttcctcccactctggtctcccgactccccgccccg

SEQ ID NO: 78857 - DNA, 138 bp, Homo sapiens; identical to SEQ ID NO: 36120
  misc_feature 1..138: note = chr16:31226609-31226747
  misc_feature 1..138: note = hyper
  source 1..138: mol_type = genomic DNA

SEQ ID NO: 78858 - DNA, 68 bp, Homo sapiens
  misc_feature 1..68: note = chr16:31227017-31227085
  misc_feature 1..68: note = hyper
  source 1..68: mol_type = genomic DNA
taagggctaggcagccgggatctgcacttatgtgtgcgggcccagggtggcaccgagagccccgtcca

SEQ ID NO: 78859 - DNA, 43 bp, Homo sapiens
  misc_feature 1..43: note = chr16:31227355-31227398
  misc_feature 1..43: note = hyper
  source 1..43: mol_type = genomic DNA
ctggaggcacggaggcgtccttggtccccgaggtggagacact

SEQ ID NO: 78860 - DNA, 39 bp, Homo sapiens
  misc_feature 1..39: note = chr16:31227770-31227809
  misc_feature 1..39: note = hyper
  source 1..39: mol_type = genomic DNA
aaaaaaacccaacctcgcccaaccttgcccgtctttatc

SEQ ID NO: 78861 - skipped

SEQ ID NO: 78862 - DNA, 152 bp, Homo sapiens
  misc_feature 1..152: note = chr16:31373926-31374078
  misc_feature 1..152: note = hypo
  source 1..152: mol_type = genomic DNA
ctcaggttactccaccgagctggccctctggaaaggggtgcagagcctggtcctgggggccccccgctaccagcacaccgggaaggctgtcatcttcacccaggtgtccaggcaatggaggatgaaggccgaagtcacggggactcaggttg

SEQ ID NO: 78863 - DNA, 40 bp, Homo sapiens
  misc_feature 1..40: note = chr16:31384803-31384843
  misc_feature 1..40: note = hypo
  source 1..40: mol_type = genomic DNA
gtgccatctggggcacgcctctgctcgtgtgggtgttcaa

SEQ ID NO: 78864 - DNA, 65 bp, Homo sapiens
  misc_feature 1..65: note = chr16:31388356-31388421
  misc_feature 1..65: note = hypo
  source 1..65: mol_type = genomic DNA
gctgtcctgggagaccggctgcttctgacagccaatgtgagcaggtgagccgggccaggccaggg

SEQ ID NO: 78865 - DNA, 282 bp, Homo sapiens
  misc_feature 1..282: note = chr16:3139085-3139367
  misc_feature 1..282: note = hypo
  source 1..282: mol_type = genomic DNA
gccaagctagtacagcgtctcgcgggcgtgggtgcgcaggtggcgcagcaggtgggagttgcggctgaagctgcggccacactgcgtgcaggagtagggcctggcgcccgtgtgcaccagcaggtgtcgcagcagattgcagctgcggctgaagctcttcccgcactccacgcactcctgcgggggctcggcctgctcctgcccgggctccgcatgggtagccaggtgccgccgcagatgcgcgttgcgccggaagctgcgaccgcacgtctgacagctgta

SEQ ID NO: 78866 - DNA, 30 bp, Homo sapiens
  misc_feature 1..30: note = chr16:3142360-3142390
  misc_feature 1..30: note = hypo
  source 1..30: mol_type = genomic DNA
cctgtgtcctgactccgaggggacatggga

SEQ ID NO: 78867 - DNA, 30 bp, Homo sapiens; identical to SEQ ID NO: 44561
  misc_feature 1..30: note = chr16:3142599-3142629
  misc_feature 1..30: note = hypo
  source 1..30: mol_type = genomic DNA

SEQ ID NO: 78868 - DNA, 445 bp, Homo sapiens
  misc_feature 1..445: note = chr16:31446903-31447348
  misc_feature 1..445: note = hypo
  source 1..445: mol_type = genomic DNA
cgcagccgcacctgcctaaatcccttaatgtataagggaaaggagcgagaattcaggggaaaaaaaacaaacaaaatagcccccagcacttctgagaaagatctgccatacagaaaagccgtcctgagcgggtctgtgtggagggaggggactgcatctcagatccacagtccaccggcggctgcaacaattccacccagggctgcagcacgctggttcttcagtgtcgggccaggttggacctccggctggaggccttccacaccggaaacactggtagggctcctctccagtgtgggttcgagggcggtggaggagctcggcactgtcgctgaagcctggccctggcctcgccgagcggtccggccgctctgtgctgcgaggccttccgggctggctcagggtagcctggggcctgaaccgcctcccgcgagtcccgtcccgc

SEQ ID NO: 78869 - DNA, 141 bp, Homo sapiens
  misc_feature 1..141: note = chr16:31483518-31483659
  misc_feature 1..141: note = hyper
  source 1..141: mol_type = genomic DNA
ctgggtgagtggggccggatccccgggtccgtggcccctcaccgctgcccagagctgcctccccgccgtcgctctcccgcatctccccatccctgtcttcttacttctgcttttcgcctctgcccgcgcctcctttccaac

SEQ ID NO: 78870 - DNA, 30 bp, Homo sapiens
  misc_feature 1..30: note = chr16:31496344-31496374
  misc_feature 1..30: note = hypo
  source 1..30: mol_type = genomic DNA
gggacttcccaactgcggggtgtgactggg

SEQ ID NO: 78871 - DNA, 42 bp, Homo sapiens
  misc_feature 1..42: note = chr16:31498048-31498090
  misc_feature 1..42: note = hypo
  source 1..42: mol_type = genomic DNA
aatcatcctctcctacgatgacgcagaaaaaactggggccgg

SEQ ID NO: 78872 - DNA, 261 bp, Homo sapiens
  misc_feature 1..261: note = chr16:31498557-31498818
  misc_feature 1..261: note = hyper
  source 1..261: mol_type = genomic DNA
aaattcccacaaagacgccttattgctaaggccagcctgtaacataaacagctgggctgtcccctgaccccggcctgttgcaggagggctggccgcgctgatgtacacggacacggtacagaccttcgtcattctggggggcgcctgcatcctcatgggttacggtaggggctcgcctaccagggaggggcgcggagggcatggtcgcggagctctcggcctgcgcgcggggccgttgcgcgtctccggtctgagggtcct

SEQ ID NO: 78873 - DNA, 182 bp, Homo sapiens
  misc_feature 1..182: note = chr16:31499022-31499204
  misc_feature 1..182: note = hyper
  source 1..182: mol_type = genomic DNA
gcccgcgctgctcctcggactcacaatcgtctcgggctggtactggtgcagcgaccaggtgcgggtatagggctgcgcctgcagtgaggccggggcggagccgagacgggcggagcctgagtccctccccgccttccccacaacggtctaaggcgcagtctgaggggcgggaacccctcggg

SEQ ID NO: 78874 - DNA, 413 bp, Homo sapiens
  misc_feature 1..413: note = chr16:31499494-31499907
  misc_feature 1..413: note = hyper
  source 1..413: mol_type = genomic DNA
gtaacatccctgccccgcccctttcctgtgccagcaaccgggcgcccgtcgcccagttccgtcaccctcctaagactcggcagtttgggcccggagtcccgcctccctccgggggtcgcacgcctcctctgctaggattcccagtccccacctcctgggattcccagaccaggccccgtcctaacggcgcggtggcctctctctggcagacgaggtggcgtgcgtggtgcctgaggtgtgcaggcgcgtgtgcggcacggaggtgggctgctccaacatcgcctacccgcggctcgtcgtgaagctcatgcccaacggtaagggcagccccgggccacaggcgcaagctcgctgcggagcccgctgctgggaggggtcgtccctcgcgcagctgcagccgccctggaccccca

SEQ ID NO: 78875 - DNA, 151 bp, Homo sapiens
  misc_feature 1..151: note = chr16:31500522-31500673
  misc_feature 1..151: note = hypo
  source 1..151: mol_type = genomic DNA
gctgtgtgcagccctcggcgtgcccagctttcctctgcggcgtgcactacctctacttcgccattgtgctgttcttctgctctggcctcctcaccctcacggtctccctgtgcaccgcgcccatccccagaaagcacgtgagtggccaggt

SEQ ID NO: 78876 - DNA, 144 bp, Homo sapiens
  misc_feature 1..144: note = chr16:3151042-3151186
  misc_feature 1..144: note = hypo
  source 1..144: mol_type = genomic DNA
gaggtctgaggccaccgaggaagcctcagggactggcctccgtgtagagctgctctcactgccctgggcattggggacaaggccaggacaagcaggaccccgtgcgtgtttcctcgaatggcttatggtcgcttcagaaagaca

SEQ ID NO: 78877 - DNA, 41 bp, Homo sapiens
  misc_feature 1..41: note = chr16:31524056-31524097
  misc_feature 1..41: note = hypo
  source 1..41: mol_type = genomic DNA
ttgagaccttcactacgacagttactactgactacttgaga

SEQ ID NO: 78878 - DNA, 40 bp, Homo sapiens
  misc_feature 1..40: note = chr16:31526376-31526416
  misc_feature 1..40: note = hypo
  source 1..40: mol_type = genomic DNA
tagagatggggaggccgggtatggtggctcatgtctgtaa

SEQ ID NO: 78879 - DNA, 249 bp, Homo sapiens; identical to SEQ ID NO: 36126
  misc_feature 1..249: note = chr16:31540812-31541061
  misc_feature 1..249: note = hyper
  source 1..249: mol_type = genomic DNA

SEQ ID NO: 78880 - DNA, 15 bp, Homo sapiens
  misc_feature 1..15: note = chr16:31549080-31549095
  misc_feature 1..15: note = hyper
  source 1..15: mol_type = genomic DNA
ccgctcctccattgc

SEQ ID NO: 78881 - DNA, 30 bp, Homo sapiens
  misc_feature 1..30: note = chr16:31558059-31558089
  misc_feature 1..30: note = hypo
  source 1..30: mol_type = genomic DNA
gagtttatgtttccacgcagggttctctca

SEQ ID NO: 78882 - DNA, 30 bp, Homo sapiens
  misc_feature 1..30: note = chr16:31560507-31560537
  misc_feature 1..30: note = hypo
  source 1..30: mol_type = genomic DNA
ccaaagaaccctgtccgagtccaaaggcat

SEQ ID NO: 78883 - DNA, 259 bp, Homo sapiens; identical to SEQ ID NO: 4341
  misc_feature 1..259: note = chr16:31580480-31580739
  misc_feature 1..259: note = hyper
  source 1..259: mol_type = genomic DNA

SEQ ID NO: 78884 - DNA, 22 bp, Homo sapiens
  misc_feature 1..22: note = chr16:3158301-3158323
  misc_feature 1..22: note = hypo
  source 1..22: mol_type = genomic DNA
ccgcgcccggcctatagtcagt

SEQ ID NO: 78885 - DNA, 21 bp, Homo sapiens
  misc_feature 1..21: note = chr16:31658246-31658267
  misc_feature 1..21: note = hypo
  source 1..21: mol_type = genomic DNA
aatggaaggactgggcgcggt

SEQ ID NO: 78886 - DNA, 60 bp, Homo sapiens
  misc_feature 1..60: note = chr16:3177923-3177983
  misc_feature 1..60: note = hypo
  source 1..60: mol_type = genomic DNA
tcaagaagagattaacgtttgaattggctgagtgagtaaagcagacggccctcaccacgg

SEQ ID NO: 78887 - DNA, 197 bp, Homo sapiens
  misc_feature 1..197: note = chr16:318060-318257
  misc_feature 1..197: note = hypo
  source 1..197: mol_type = genomic DNA
atcacacatgctatgcgtacacacacttgtgcctcagtgctacacatgcctcatacacacgacacgtgcacacacacaccacatatgcatgcctcagtacacctgcacacgtgcactacacacaatcacacacgctatacatacacaccacacgtgtgcctcagtgctacacatgcctcatacgcacacacacccat

SEQ ID NO: 78888 - DNA, 29 bp, Homo sapiens
  misc_feature 1..29: note = chr16:3183420-3183449
  misc_feature 1..29: note = hypo
  source 1..29: mol_type = genomic DNA
aaaatatgaaaattccgccaggcacggtg

SEQ ID NO: 78889 - DNA, 38 bp, Homo sapiens; identical to SEQ ID NO: 44391
  misc_feature 1..38: note = chr16:319924-319962
  misc_feature 1..38: note = hypo
  source 1..38: mol_type = genomic DNA

SEQ ID NO: 78890 - DNA, 275 bp, Homo sapiens
  misc_feature 1..275: note = chr16:3209099-3209374
  misc_feature 1..275: note = hyper
  source 1..275: mol_type = genomic DNA
gcgccggggccgatccgacttcccgcttccgtccggcttgcggcccctcgccttgcccggctacaggaaggactcgcctgcgcctcctgactggagccttccacctgggagttctgagtgcgcctaaggcctggcgctgaggcagtggaccccagatccgggacccgaaaggagggcaaacacctccaccgccgcgtctgcctctgcggacgtggccctagatcccgggtggccatggaacttggtctgggcgtgtagttttcctttgagtgggt

SEQ ID NO: 78891 - DNA, 99 bp, Homo sapiens
  misc_feature 1..99: note = chr16:3211643-3211742
  misc_feature 1..99: note = hypo
  source 1..99: mol_type = genomic DNA
gatggtcaggaccgccgggagcccatgcccacctccctcagctcccgtggtgcgcccgggggaaatgtggttggaaatcgcggcggccgggcatggtgg

SEQ ID NO: 78892 - DNA, 180 bp, Homo sapiens
  misc_feature 1..180: note = chr16:3211802-3211982
  misc_feature 1..180: note = hypo
  source 1..180: mol_type = genomic DNA
gttcaagcccagcctggacaacgtagtgaaaccccacctctgcaaaacaattttaaaagttagcagggcgtggtggtgcgcgcctgtgatccaagctactcctgtgtctgaggcaggaggatcgcttgagcctgtctcaaataaacaaagggcggggcgcggtggctcactcctgtaatc

SEQ ID NO: 78893 - DNA, 150 bp, Homo sapiens
  misc_feature 1..150: note = chr16:32127040-32127190
  misc_feature 1..150: note = hyper
  source 1..150: mol_type = genomic DNA
tttttgccccccaagcgccaaggctttttgaccaccgcggctttttgaccttcgcctctgcgaattttgccgccgtggctttttgcccgccgcggctttttcccccaactggtgcagcggctgtttgccccctgccgctttttgcccccc

SEQ ID NO: 78894 - DNA, 119 bp, Homo sapiens; identical to SEQ ID NO: 36035
  misc_feature 1..119: note = chr16:3220438-3220557
  misc_feature 1..119: note = hyper
  source 1..119: mol_type = genomic DNA

SEQ ID NO: 78895 - DNA, 303 bp, Homo sapiens; identical to SEQ ID NO: 36036
  misc_feature 1..303: note = chr16:3220590-3220893
  misc_feature 1..303: note = hyper
  source 1..303: mol_type = genomic DNA

SEQ ID NO: 78896 - DNA, 560 bp, Homo sapiens; identical to SEQ ID NO: 1248
  misc_feature 1..560: note = chr16:3221141-3221701
  misc_feature 1..560: note = hyper
  source 1..560: mol_type = genomic DNA

SEQ ID NO: 78897 - DNA, 18 bp, Homo sapiens
  misc_feature 1..18: note = chr16:322126-322144
  misc_feature 1..18: note = hypo
  source 1..18: mol_type = genomic DNA
gcccggcctaatatgtca

SEQ ID NO: 78898 - DNA, 453 bp, Homo sapiens; identical to SEQ ID NO: 36038
  misc_feature 1..453: note = chr16:3221786-3222239
  misc_feature 1..453: note = hyper
  source 1..453: mol_type = genomic DNA

SEQ ID NO: 78899 - DNA, 254 bp, Homo sapiens
  misc_feature 1..254: note = chr16:3224942-3225196
  misc_feature 1..254: note = hyper
  source 1..254: mol_type = genomic DNA
gaattcttcttcagccgaacagcagcggcaaaggctaagggtcctagaaaggaacgggaaaccgtcacctgcccaggtgggacgcgaggcaaggaacccagcgcaggaggccgctgggtcacggaggtttcctgtctgcttcccgccgtcactgccggccgcctcccaccttctcccggccccctgcaacccagcccaccccagcccacctccccctggtggggacacggttttctttccggggtgcctcgcag

SEQ ID NO: 78900 - DNA, 177 bp, Homo sapiens
  misc_feature 1..177: note = chr16:3225459-3225636
  misc_feature 1..177: note = hyper
  source 1..177: mol_type = genomic DNA
acactcaggaggtgccggcctgtggggcgtccgcgggtgggcctctgacgcagagaaagacccagatccagctacctcgggggcctcctgctgcgcctcgcctttggggcaggcctgagggcaacgcttactgcggagcaactgtgttctacagtgtagtcccgacactgaagactc

SEQ ID NO: 78901 - DNA, 488 bp, Homo sapiens
  misc_feature 1..488: note = chr16:3232529-3233017
  misc_feature 1..488: note = hyper
  source 1..488: mol_type = genomic DNA
taacttcgaaggactcgggctgcgctgacctgtcagagctgtctggatctctgatcttcatctaaagtaggaaagggtagaaaccgatattttggaccaaaaaccgggctcgtccgggatttgaacccgggacctctcgcaccctaagcgagaatcatacccctagaccaacgagccacacgccccgtagcctccggcttgtctttgtggccttcgtggagtcctcgtggccagaggtggggacccagcagagcagagctaggaggagactccgatttcctgaagtctggaagagacaagttcaagcgcgggtggacgcggagggagccctgagcccccgcttctccctgcgccgcacaaaatggggagcatcccctgtgcccccacaatccggggccccccgggccctcgcccgcctccgcctctcagccctgggctggggatccgcgcgtcacgccgcgtcgcgtagtgaggagctccagctccgg

SEQ ID NO: 78902 - DNA, 133 bp, Homo sapiens; identical to SEQ ID NO: 1252
  misc_feature 1..133: note = chr16:3233198-3233331
  misc_feature 1..133: note = hyper
  source 1..133: mol_type = genomic DNA

SEQ ID NO: 78903 - DNA, 670 bp, Homo sapiens; identical to SEQ ID NO: 1253
  misc_feature 1..670: note = chr16:3233434-3234104
  misc_feature 1..670: note = hyper
  source 1..670: mol_type = genomic DNA

SEQ ID NO: 78904 - DNA, 271 bp, Homo sapiens
  misc_feature 1..271: note = chr16:3234181-3234452
  misc_feature 1..271: note = hyper
  source 1..271: mol_type = genomic DNA
tcatacccctagaccaacgagccgccgcttcccctctgttttgttgttgttgttgttgttttttgacacgtccttccgcccctgacgcagagcgagactctctccatcgccccaatagctcagtccttagcgcgcgcacctgcgaatctgggcttttgggttcgcggccaccctcagatttgcgaggcaggctttactgctgctggataaaccaaccaggttatccgttgaggttatgagctggtggtttcaatgtcgtcctgatatgaaa

SEQ ID NO: 78905 - DNA, 181 bp, Homo sapiens
  misc_feature 1..181: note = chr16:323418-323599
  misc_feature 1..181: note = hypo
  source 1..181: mol_type = genomic DNA
gcacgctgacccctgcgctggccagcgacccccaccctcaccgcaggtgggctcaccgggggcctgttcaccagccagtaggtctgctcctggcacgcaatgaccagcctgtcccccttgctgcgctgcttggctgccctgggaggaggaggccgagttgagggcacgccctgcacacagc

SEQ ID NO: 78906 - DNA, 335 bp, Homo sapiens
  misc_feature 1..335: note = chr16:3237708-3238043
  misc_feature 1..335: note = hyper
  source 1..335: mol_type = genomic DNA
tggattatcatttgccgttttaaaaccttggataaaatctgtgtatttcctttatgatttctgacatctctatcctgcctggaaatccttttaccttagtaataggcaaatgcacctatatatcataccagcacgacattgaaaccaccagctcataacctcagcgggtaaccttgttggtttacccagcaggagtaaagcctgcctcggaaatctgagggtggccgcgaacccacaagtcaagattcgcaggtgcgcgcgctaaggactgagctattggggcgatggagagagtctcgctctgcgtcagggacggaaggacgtgtcccccacca

SEQ ID NO: 78907 - DNA, 1775 bp, Homo sapiens
  misc_feature 1..1775: note = chr16:3238163-3239938
  misc_feature 1..1775: note = hyper
  source 1..1775: mol_type = genomic DNA
ccccttttccttctcttttttcccatttcgcattttcagcaaggacaggagactaggaaggcggagggaggctgctattggcagggcctcagtggagacctcccggggtcccgggacgcagacggacgggcctgaatcgctcgccttggtgaaatgggatccagcgctgccaactgcggcaactgcggttaaaggagacgaccccgtgcagcaggaggaggttatttagaataaggaagaatgcgccgggctcattggtcgctacaggggcataaattttttctaggattccagagtatggctgctccagtcccaggtgagccctcctccgcttaaaattccagtttattcggagaaggggagaataccggaagcgggggagaagggaggggagtgagtgagaggagggaggcggggaagaccgggcatccgcgggcagcacttcagtcggccctggcggggtgggggtctcggcccttgtccccacccccagaccccggggccttcccactgagagcgagggaattcgcggctttgatctggaggggacagggagccccttttagcccagatctgctggattctcgggagtcaggtgaaatctggatacagggaagggcagagtgacagtaaagggtgccccggaaccgatgcccgacgcctgctgccccacggccttcattcttgctcctcctcacgtcctggggactggaggtcccgccagctccccccagtgaagggcaagggggcgcatcgcagaatcgcccctggtgcgcagcgtagttggtggcctaagccgtcttctccgagagctcagccatcctgggcacttgaggccaggcaggcgctgcggggctggttcagtcgatggagaaaagagactctcagcgtcagcctttagggttcgaggcccacgtgggaaactcgctttctgggttttggcttccctggggagaagggaggaccggagccggagaagcgtgaggtgcggcgaggtagggtgcctggtagctggtgtctcgtgcactccgtcaggcctttattgaacacccattggtgccacgctgagggactgcagcgtttccaaggcgagcttgcagtgatcgaggctcgcagaccctcagcgcagccgctgcctgctattgggaggttcccatgtcctgcggaagctggagctcctcactgcgcgcctcggagacgccgaatccccaactcaaggccgagtggcggtggcgggcgaggacccagggcccttctggattgtggtagcgccagggctgctccccattttgtgcgtcgcggaggaggggccggggctctgggcttccgccacacccatcctcacttgaaattgccccttccaggcgggtctgaaataagattctactcactgggtcctgctgggtccgccccagccgcccccaggatgctaggacgcccacaaagataaccttaatgcgtaaatcgtgtggctcgttggtctaggggtatgattctcgcttagggtgcgagaggtcccgggttcaaatcccggacgagcccggcttttggtgcagggtaaaagtcgtttcctgctcttttttagattcggctcgacttacagacctcagcgcaggacgtggacgccctgcaaaggtaatttgtacaaaggtctcaagctatgttgacgccgcctactatcccactacctcttcttaaaattcatctagagtcctgtcaccagtgttgccagagcccttttgacaagctattttttttgtcgtttgtttggtttt

SEQ ID NO: 78908 - DNA, 30 bp, Homo sapiens
  misc_feature 1..30: note = chr16:323853-323883
  misc_feature 1..30: note = hypo
  source 1..30: mol_type = genomic DNA
tccagtgggtcaccccggcccctgccccca

SEQ ID NO: 78909 - DNA, 35 bp, Homo sapiens; identical to SEQ ID NO: 36049
  misc_feature 1..35: note = chr16:3241024-3241059
  misc_feature 1..35: note = hyper
  source 1..35: mol_type = genomic DNA

SEQ ID NO: 78910 - DNA, 519 bp, Homo sapiens
  misc_feature 1..519: note = chr16:3241472-3241991
  misc_feature 1..519: note = hyper
  source 1..519: mol_type = genomic DNA
ttactagacataaaacgttcccagggaagcccggctagctcagtcggtagagcatgggactcttaatctcagggtcgtgggttcgagccccacgttgggcgacttgttttcttccttgctaccttggagttctggaaacagccagcatttaatgaacactaccaggtgccacatcgcgctctgtgatggtatcccctcaatgattgaattttggtctccgcgcgctcccagcagcaaggattgtcagtgaaatgaccaaaggcagcaccgggacgggctggttgccagccaggggcagaggggcgggggcgggtgagaactgaggggccacaggatgggtgtgaggggtgcaggggcctctccccactttgtgcggtgcggagaggggccggggcgctggcccacccactgagtctgcaatcccagtctcctgtcactttgctttcgcaggcttgagctttatcgctccaagtactccacggctgccacaaagaaaagtaaagggcctgctgctgtggc

SEQ ID NO: 78911 - DNA, 57 bp, Homo sapiens
  misc_feature 1..57: note = chr16:324217-324274
  misc_feature 1..57: note = hypo
  source 1..57: mol_type = genomic DNA
gtccagctctgcagccggcctcagggtacttgtccagaagtacggggtctggcgtgg

SEQ ID NO: 78912 - DNA, 179 bp, Homo sapiens
  misc_feature 1..179: note = chr16:32485443-32485622
  misc_feature 1..179: note = hypo
  source 1..179: mol_type = genomic DNA
tgagggctgagggcccgggaaaggcacacggtggcggtggggtctctctcaggaaggcgctggctctgcagacagctccgcctggtgacccctctttggcactgagctgggaacatggtgtccgcactcccggctagcaagcagaggcccgtgtggtcaggtggcggctggcagtgtag

SEQ ID NO: 78913 - DNA, 48 bp, Homo sapiens
  misc_feature 1..48: note = chr16:325498-325546
  misc_feature 1..48: note = hyper
  source 1..48: mol_type = genomic DNA
ctgggcggagggagtcgtcagggggtgtctggccgccccgcaaccctg

SEQ ID NO: 78914 - DNA, 31 bp, Homo sapiens
  misc_feature 1..31: note = chr16:3269398-3269429
  misc_feature 1..31: note = hypo
  source 1..31: mol_type = genomic DNA
caggcgtgagccaccacgcctggctaacatt

SEQ ID NO: 78915 - DNA, 46 bp, Homo sapiens
  misc_feature 1..46: note = chr16:3286277-3286323
  misc_feature 1..46: note = hypo
  source 1..46: mol_type = genomic DNA
ttcgttccccagtgacgcactgatcagggttcggacaacttgtggg

SEQ ID NO: 78916 - DNA, 285 bp, Homo sapiens
  misc_feature 1..285: note = chr16:330222-330507
  misc_feature 1..285: note = hyper
  source 1..285: mol_type = genomic DNA
ggccccaggtgtggccgcggataatgagaccctggggatgggggcgcacctgcgccacggcgccccgcagagggtttcccaggagaccccctcgggctcccgccgcgccgtgggggtggggcagccctgctggccagagccgggcacgggccgggcgggcggcggggatcgtgaccgcggctgcgtgcgtccgcgtccgggcgcttctgtgcggggtcctggcacgccggcgggggcgacccgggtgccggcccgtgcgggcgacacgcgcgtctctgcggggct

SEQ ID NO: 78917 - DNA, 57 bp, Homo sapiens
  misc_feature 1..57: note = chr16:330921-330978
  misc_feature 1..57: note = hyper
  source 1..57: mol_type = genomic DNA
ggaagggaccaggtgcggacgggtcggcttgggaagcggcggcgctgggaccctctc

SEQ ID NO: 78918 - DNA, 153 bp, Homo sapiens
  misc_feature 1..153: note = chr16:332609-332762
  misc_feature 1..153: note = hypo
  source 1..153: mol_type = genomic DNA
cctagtggacaagaccgtctacatggtgggcagctatggcccgagcgcccaggagtatgagtttgtgactccggtggaggaagcgccgaggggtgcgctggtgcggggcccctatctggtggtgtccctcttcaccgacgatgacaggacgca

SEQ ID NO: 78919 - DNA, 20 bp, Homo sapiens
  misc_feature 1..20: note = chr16:33396766-33396786
  misc_feature 1..20: note = hypo
  source 1..20: mol_type = genomic DNA
tatgagatggattttcgccc

SEQ ID NO: 78920 - DNA, 129 bp, Homo sapiens
  misc_feature 1..129: note = chr16:3355105-3355234
  misc_feature 1..129: note = hyper
  source 1..129: mol_type = genomic DNA
tcttcctcgaggaggcggcgacgagcccagcaacagctcgagcacggccggccgggccgcgggaagcccgagaacgcggcgcgcgcagctgggaggcgacccttacccggcgaggctcccgggaccaaa

SEQ ID NO: 78921 - DNA, 646 bp, Homo sapiens
  misc_feature 1..646: note = chr16:3355250-3355896
  misc_feature 1..646: note = hyper
  source 1..646: mol_type = genomic DNA
cgcagaacagacgcggcagtgcgacgcctcccccactggggacacgagacagcgacagccacgcggtgagccggtacaaggccctctaggcttcagcgggtctggatactcggtggcattaacccttccctaccgccggggaagacagcagtttctctggcgaggaagtaggccgggctcaggcgccttagccagagggcgggcctgcgccaccctcggaaagcgtcacttccacttccggccggcgctctggctctgtacctggacagggctgcggtaggccagcggtgggctggcggttgcgctcctcagatcggcggcctttcgggcggtggcttgcgtttgagcctcagaaagcgaggagcggcctccacggaagccaagctggccgaggtaaccgagaagcggcttcccctatggcttcgaccctggagccgctggagcggcggcggccgcagggaggcagccattttccgtaggcggtggccgcggcgcttccgggccgcgcggctggagcctgaggcggggccaccgtcgggcacgagaaaccattctctccccgcttttcgcagctgtatcccagaggcgcggctgaagctcgctgggacactgcccgcttgcccagtgcccacgggcacgcctgtcg

SEQ ID NO: 78922 - DNA, 30 bp, Homo sapiens
  misc_feature 1..30: note = chr16:33619032-33619062
  misc_feature 1..30: note = hypo
  source 1..30: mol_type = genomic DNA
aggcaaactcgggagcgcaggagatgctca

SEQ ID NO: 78923 - DNA, 256 bp, Homo sapiens
  misc_feature 1..256: note = chr16:337560-337816
  misc_feature 1..256: note = hypo
  source 1..256: mol_type = genomic DNA
atgtacatatttacacgggccctcagaaaggaggacccaggactgcacagccggcggctggaggcaggtgcagtgctccgtcgccgattcacacagtggcaggcaagagacaagctgtgttgaaggcactcggtggcgcgtacaattgacagaggccctgcaggcctctgcatccgggcctgggccccacccagacctgggtacgtgggcaaatcccagagggaaagtagatcccagcacacgtgcccaagggagg

SEQ ID NO: 78924 - DNA, 30 bp, Homo sapiens
  misc_feature 1..30: note = chr16:33784579-33784609
  misc_feature 1..30: note = hypo
  source 1..30: mol_type = genomic DNA
ctgggggaggtggggcggggtggggggggc

SEQ ID NO: 78925 - DNA, 120 bp, Homo sapiens
  misc_feature 1..120: note = chr16:33893476-33893596
  misc_feature 1..120: note = hypo
  source 1..120: mol_type = genomic DNA
attcgatgattcaattggatgtcattcgatgattccataagattccctttgatgatgattctattccgtcctttcaatgatgataccaatcgattccattcgatgattattccatccgat

SEQ ID NO: 78926 - DNA, 97 bp, Homo sapiens
  misc_feature 1..97: note = chr16:33897828-33897925
  misc_feature 1..97: note = hypo
  source 1..97: mol_type = genomic DNA
tttcgatgattccatttgcttccatttagttccatttgaagattacattggatgccatttgatgattccataagattccattcgatgatgattctat

SEQ ID NO: 78927 - DNA, 162 bp, Homo sapiens
  misc_feature 1..162: note = chr16:34264932-34265094
  misc_feature 1..162: note = hypo
  source 1..162: mol_type = genomic DNA
ggctggccctgccagcgtgcctttcctgggaagaggtggaagtgctgagctctgcagacttggaagcaagggaaggcccaagctgctggagaggagccgggctaccccatggggatagcccacgctgagctattgcttgggcaccaacgccagcctcaagcg

SEQ ID NO: 78928 - DNA, 83 bp, Homo sapiens
  misc_feature 1..83: note = chr16:34407744-34407827
  misc_feature 1..83: note = hypo
  source 1..83: mol_type = genomic DNA
tccacacctgtattccgtttcccaccgagcacgtgaggaccaacgagcgctcgcccccgccgggcacccggcatgggggcctg

SEQ ID NO: 78929 - DNA, 30 bp, Homo sapiens
  misc_feature 1..30: note = chr16:34788530-34788560
  misc_feature 1..30: note = hypo
  source 1..30: mol_type = genomic DNA
aatgagtgtaatgtgcgatagtattttttt

SEQ ID NO: 78930 - DNA, 86 bp, Homo sapiens
  misc_feature 1..86: note = chr16:3492682-3492768
  misc_feature 1..86: note = hypo
  source 1..86: mol_type = genomic DNA
aaaaaaaagaacttttaaaagtagccagacactgtggtatgcgcgcctctcagatactcgagaggctgaggcgtaaggattccctg

SEQ ID NO: 78931 - DNA, 213 bp, Homo sapiens
  misc_feature 1..213: note = chr16:34983934-34984147
  misc_feature 1..213: note = hypo
  source 1..213: mol_type = genomic DNA
atagcagcctgagaacgccacagcccggaagctaggcagggtcgagcctggctggggcctggatggaggaccgcctgaggagacccaggctgaaggcttttggcttcctgctcccttcccgcttttccccgctgatcacaatgcatgccaaccgcatcctgagtatttggcccccaatttcccgaccgactctgccctcgctgtgacccggga

SEQ ID NO: 78932 - DNA, 30 bp, Homo sapiens
  misc_feature 1..30: note = chr16:351930-351960
  misc_feature 1..30: note = hypo
  source 1..30: mol_type = genomic DNA
gctgacgtcacagcccgtgggcccggatgt

SEQ ID NO: 78933 - DNA, 202 bp, Homo sapiens
  misc_feature 1..202: note = chr16:3551302-3551504
  misc_feature 1..202: note = hyper
  source 1..202: mol_type = genomic DNA
ctatctgccactggccgcgtgtggctcagaacgcttgaaatgtggctagtgcagatgaataactgaatttttaagtgtaatttatttctgtttgtgtagctgcatgccgctcttcgctaccgtattggaaaatgcatggagagtttagagactattttttgagttgggttagcttagcgcttagaaaaccgaacagcaggcc

SEQ ID NO: 78934 - DNA, 30 bp, Homo sapiens
  misc_feature 1..30: note = chr16:356089-356119
  misc_feature 1..30: note = hypo
  source 1..30: mol_type = genomic DNA
ttatcatccccttaccggcaggcacatgcg

SEQ ID NO: 78935 - DNA, 33 bp, Homo sapiens; identical to SEQ ID NO: 16015
  misc_feature 1..33: note = chr16:3598920-3598953
  misc_feature 1..33: note = hypo
  source 1..33: mol_type = genomic DNA

SEQ ID NO: 78936 - DNA, 30 bp, Homo sapiens
  misc_feature 1..30: note = chr16:3611471-3611501
  misc_feature 1..30: note = hypo
  source 1..30: mol_type = genomic DNA
agcggtgtctagtcccgccaggtcacctcc

SEQ ID NO: 78937 - DNA, 108 bp, Homo sapiens; identical to SEQ ID NO: 44568
  misc_feature 1..108: note = chr16:3696694-3696802
  misc_feature 1..108: note = hypo
  source 1..108: mol_type = genomic DNA

SEQ ID NO: 78938 - DNA, 61 bp, Homo sapiens
  misc_feature 1..61: note = chr16:3740595-3740656
  misc_feature 1..61: note = hyper
  source 1..61: mol_type = genomic DNA
cggacggcaaactcacgggtggccaccagagggggcaagacacacccgacactggcagaag

SEQ ID NO: 78939 - DNA, 118 bp, Homo sapiens
  misc_feature 1..118: note = chr16:3773018-3773136
  misc_feature 1..118: note = hypo
  source 1..118: mol_type = genomic DNA
cacataaaatccatacgtccatgaggctgcgatgtcttcatggtctgagatgaagttattctcctgcctacatgcccctgcccgtctgttacggcgctgtgggcgcagcctctgcttc

SEQ ID NO: 78940 - DNA, 47 bp, Homo sapiens
  misc_feature 1..47: note = chr16:3803027-3803074
  misc_feature 1..47: note = hypo
  source 1..47: mol_type = genomic DNA
atgagtgtcaggtagcgacggcagcacgaatgcggtttagtgctcaa

SEQ ID NO: 78941 - DNA, 30 bp, Homo sapiens; identical to SEQ ID NO: 44569
  misc_feature 1..30: note = chr16:3925449-3925479
  misc_feature 1..30: note = hypo
  source 1..30: mol_type = genomic DNA

SEQ ID NO: 78942 - DNA, 78 bp, Homo sapiens
  misc_feature 1..78: note = chr16:3931903-3931981
  misc_feature 1..78: note = hypo
  source 1..78: mol_type = genomic DNA
ccagagttaacatcccgaaaagagagggagaaaatctgtttaaaacaactccctggccaggcgcggtggcagatcacc

SEQ ID NO: 78943 - DNA, 17 bp, Homo sapiens
  misc_feature 1..17: note = chr16:3951115-3951132
  misc_feature 1..17: note = hypo
  source 1..17: mol_type = genomic DNA
gttaaaaaaatttaccg

SEQ ID NO: 78944 - DNA, 37 bp, Homo sapiens; identical to SEQ ID NO: 16016
  misc_feature 1..37: note = chr16:3957870-3957907
  misc_feature 1..37: note = hypo
  source 1..37: mol_type = genomic DNA

SEQ ID NO: 78945 - DNA, 161 bp, Homo sapiens
  misc_feature 1..161: note = chr16:3998590-3998751
  misc_feature 1..161: note = hypo
  source 1..161: mol_type = genomic DNA
taattcccagaagggcgcatgttttttacattttgacagttcttgctaaatggccctttatagaggttacaccagttttaattcccatcagaatttatttccaaacctatcatgagatacgccagcactgacaagaatcctcactgcggcattgttcatcg

SEQ ID NO: 78946 - DNA, 519 bp, Homo sapiens
  misc_feature 1..519: note = chr16:410195-410714
  misc_feature 1..519: note = hypo
  source 1..519: mol_type = genomic DNA
cccacctgtgccctccgccgcctccctctgcttggctgtcccaagatgtctctctccactgcctaggaaccctgaggccgcggccaagttctgagcgtgtgactgtgtgtgctgggccccaggcccctttgtcgccgcggcgtctgtcgtggcaaacaaaagtgaaccggattagccacagtggattaaaagatttacgtctcagagtttacctaataacctaacaatcgtgtcaacgggagctttgaacccccagggcgcgcctgccaggccaactgagagctcaaggcctctgtgggcagcaggacgtggtcggggggaggagacgcagccacggctgtcctcacacccagctcggcccctgcgggctcctctgggcagaacctggggaaggcacggcctctagcaggaggtggaggcctttgaaagggtgcaggtgttgggaccaggtacccggcccaggcccccagccgcgtccacacacgtcgcacacggcagcaaggacgcaagcagtgtgga

SEQ ID NO: 78947 - DNA, 611 bp, Homo sapiens
  misc_feature 1..611: note = chr16:410995-411606
  misc_feature 1..611: note = hypo
  source 1..611: mol_type = genomic DNA
tttttttctttatatcgcttctgtttcttttttttttttctcctcgaaaaaatgctgcttaaacggcaccgacttgacatggcttgtctcctaaccttggagtggcggccgggacgccggcctggatcagtcgggggtctttgatgccgcctccatgtgaaacctgacgtggaagacccaccggggcggttttggggtccgaggtccgtcaggattcatcctgcctcaccctgctccctttgtctcttcccctgacccttcctcgggacacccggagagggtctgagggtgagggtgcgggcgctgcgtgtgggcttgcactcgagggtggggtgggccgagggcagggccgcagccgcgagaacaatgggcagaggaggcgcgtccacctgtccgcccggccgcctgcccggcttacctcacctgcctggctccgtgtgcctgctcacgccccaccgtcccgctgtccgccatgatgggcttggccgtccgtccgagcactttcagccactctgggaagcaggtccctgctcttggccactgtgtggctgggaggcagaagcgtgactctgggctgcagctcgggctcctgccgccgattggctgaggca

SEQ ID NO: 78948 - DNA, 309 bp, Homo sapiens; identical to SEQ ID NO: 44397
  misc_feature 1..309: note = chr16:412764-413073
  misc_feature 1..309: note = hypo
  source 1..309: mol_type = genomic DNA

SEQ ID NO: 78949 - DNA, 30 bp, Homo sapiens
  misc_feature 1..30: note = chr16:4135781-4135811
  misc_feature 1..30: note = hypo
  source 1..30: mol_type = genomic DNA
agggtggggcccagacgtctgtgttttgac

SEQ ID NO: 78950 - DNA, 36 bp, Homo sapiens
  misc_feature 1..36: note = chr16:4165816-4165852
  misc_feature 1..36: note = hyper
  source 1..36: mol_type = genomic DNA
cgcctcctccagctgcggctccggagggaagttcag

SEQ ID NO: 78951 - DNA, 79 bp, Homo sapiens
  misc_feature 1..79: note = chr16:4203488-4203567
  misc_feature 1..79: note = hypo
  source 1..79: mol_type = genomic DNA
aaaaaacagccaaatcgtggcattttcatgcagctcgacctagtagacatctagtggctgcaagcgcctgtgtgcagcg

SEQ ID NO: 78952 - DNA, 84 bp, Homo sapiens
  misc_feature 1..84: note = chr16:4203911-4203995
  misc_feature 1..84: note = hypo
  source 1..84: mol_type = genomic DNA
agactccgtctcaaaaaaaaaaaaaaaaaaagaactgatcaatgagccgccagatgccgagcaccacaccggcaagggctgcgg

SEQ ID NO: 78953 - DNA, 165 bp, Homo sapiens
  misc_feature 1..165: note = chr16:4264529-4264694
  misc_feature 1..165: note = hypo
  source 1..165: mol_type = genomic DNA
ccaccccccgccccacgttttggctctcattggctgtatattaagtgcagcagggagcaattcagaaaacagagttcatgccgcagagcaggcagcctgcccccttccttgttctagatcttgtctctgaacactcgtggaccgggcaaacgtgggccagcagcc

SEQ ID NO: 78954 - DNA, 143 bp, Homo sapiens
  misc_feature 1..143: note = chr16:428930-429073
  misc_feature 1..143: note = hypo
  source 1..143: mol_type = genomic DNA
gctcatggccccaggcgaggactcaggctctcacccccagccccccgtgccagctccagcctcgtgcccttgcgaccttgggcatccttccctccctgggtcccagccttctcctgggtaggtcagggcggagggcacatccc

SEQ ID NO: 78955 - DNA, 40 bp, Homo sapiens
  misc_feature 1..40: note = chr16:4308064-4308104
  misc_feature 1..40: note = hypo
  source 1..40: mol_type = genomic DNA
ctccccgtcccccgacggctcctcccggctctggtccatg

SEQ ID NO: 78956 - DNA, 160 bp, Homo sapiens; identical to SEQ ID NO: 36054
  misc_feature 1..160: note = chr16:4363920-4364080
  misc_feature 1..160: note = hyper
  source 1..160: mol_type = genomic DNA

SEQ ID NO: 78957 - DNA, 532 bp, Homo sapiens
  misc_feature 1..532: note = chr16:4377893-4378425
  misc_feature 1..532: note = hyper
  source 1..532: mol_type = genomic DNA
gacaaccccagccctcgccccaacccctgggcccttgcgtgtgggggcgctgccctgggcgcatcccaggctgagtgctcgagagacgcggccctgggctctgtgcaccctccacgctgcgctgtcccaccggggggaaactgaggaacggaaggctccaccaggaggcgcagaggggcgtggggccggcgggccttgcgctgcgcccggggagcatccacggggtgcccccacctgaccgagagccggctcctgccctcgggaccccgcagtaattagcacccaggcctctggctgagcttgtccagagccaggctgtcggccttacgctggggagagccacggccacccgctcatgggcactcactcagggttccctggttgcaggcccgctgctccccgctctgggcctccgaggctttcaggagagcaggaacctagctctcgcctgcccccttcacccagccgggaacaaaagcacagagcagagcccagaactggctgctgccggtcggggcgggggtggaagggg

SEQ ID NO: 78958 - DNA, 112 bp, Homo sapiens
  misc_feature 1..112: note = chr16:4385316-4385428
  misc_feature 1..112: note = hypo
  source 1..112: mol_type = genomic DNA
agccacaccgctgtccgacctgcagcaagagcttctcccgcctggagaacctgaagatccacaaccggtcgcacacaggtaagaggccggggccgggcggcttggcccatga

SEQ ID NO: 78959 - DNA, 184 bp, Homo sapiens
  misc_feature 1..184: note = chr16:4395357-4395541
  misc_feature 1..184: note = hypo
  source 1..184: mol_type = genomic DNA
taacagcaggtgcctcggaggcagatcggaaacccaaggctggtgctatctgtcacagcagtcactacgcagggtcccggggtctgaaggtagggcacctgggcaagccgacaagtatcaagaacccaaccccgaggccagaggggcttgctccagattccagtggattcgactccagagctgg

SEQ ID NO: 78960 - DNA, 28 bp, Homo sapiens
  misc_feature 1..28: note = chr16:4402011-4402039
  misc_feature 1..28: note = hypo
  source 1..28: mol_type = genomic DNA
tggattcacaggttccggacatttcata

SEQ ID NO: 78961 - DNA, 23 bp, Homo sapiens
  misc_feature 1..23: note = chr16:440317-440340
  misc_feature 1..23: note = hypo
  source 1..23: mol_type = genomic DNA
aatggggtccagggccgagggct

SEQ ID NO: 78962 - DNA, 66 bp, Homo sapiens; identical to SEQ ID NO: 44575
  misc_feature 1..66: note = chr16:4410920-4410986
  misc_feature 1..66: note = hypo
  source 1..66: mol_type = genomic DNA

SEQ ID NO: 78963 - DNA, 131 bp, Homo sapiens
  misc_feature 1..131: note = chr16:4422122-4422253
  misc_feature 1..131: note = hyper
  source 1..131: mol_type = genomic DNA
cacggtcacctgggccgcccggcgggcaggccctgtacgctccctcccccgccgtcctggggcgccgacagccccgcggccggccagggtgcgcgcctgagtgtgcggtgagcccgcgaggctgcaagcag

SEQ ID NO: 78964 - DNA, 53 bp, Homo sapiens
  misc_feature 1..53: note = chr16:4431066-4431119
  misc_feature 1..53: note = hypo
  source 1..53: mol_type = genomic DNA
catcaccatgctcgacgcaggcagctttgccggcctgccgggcctgcagctcc

SEQ ID NO: 78965 - DNA, 30 bp, Homo sapiens
  misc_feature 1..30: note = chr16:4442476-4442506
  misc_feature 1..30: note = hypo
  source 1..30: mol_type = genomic DNA
cctgctcaaagctcacgcctgaggcagggc

SEQ ID NO: 78966 - DNA, 98 bp, Homo sapiens
  misc_feature 1..98: note = chr16:4443075-4443173
  misc_feature 1..98: note = hypo
  source 1..98: mol_type = genomic DNA
gctggaaagagggggcggaggaggggagaataggaagaatcacgtgggcccagtgagctggctcagagccatgcccggtaggtcgggggcagaagcat

SEQ ID NO: 78967 - DNA, 30 bp, Homo sapiens; identical to SEQ ID NO: 44576
  misc_feature 1..30: note = chr16:4474675-4474705
  misc_feature 1..30: note = hypo
  source 1..30: mol_type = genomic DNA

SEQ ID NO: 78968 - DNA, 186 bp, Homo sapiens; identical to SEQ ID NO: 36056
  misc_feature 1..186: note = chr16:4587903-4588089
  misc_feature 1..186: note = hyper
  source 1..186: mol_type = genomic DNA

SEQ ID NO: 78969 - DNA, 515 bp, Homo sapiens
  misc_feature 1..515: note = chr16:4588308-4588823
  misc_feature 1..515: note = hyper
  source 1..515: mol_type = genomic DNA
cgccggccccgctttacctccagaagcccggtgcccgaggccggccgaaagcggagaggggcccgggtccggacaggcgccggcagaacaagaccctcagccccgcgcggctttgcgcgcacaacgaaaccccccaacccaccgcccaccccaccgcccagaggcttctaggacttgtagtccgcccggtcaccccccccaccacaacccgctctgagaggctggggactacggtgcccggcatgcaccgcccaggcgccgcgggcgggggcggggagggggcgccacggtccgaggtcacgccccgacctgaggagagctggcgcccagacccttcccccggggaggagggctcccgcgcgaagccgtctccgaatgcgtccagtcgactcaccgtccccgcagccctggggcagcggccgcaacagcaggaccgaacgcctcggcagctggcagtcgcacttctgtcacaaggaggcgggtagactttggaccagggccgaggcccgggacgt

SEQ ID NO: 78970 - DNA, 33 bp, Homo sapiens
  misc_feature 1..33: note = chr16:4644769-4644802
  misc_feature 1..33: note = hypo
  source 1..33: mol_type = genomic DNA
ggctcagcccttggccgtcgcaaaggagctggc

SEQ ID NO: 78971 - DNA, 30 bp, Homo sapiens
  misc_feature 1..30: note = chr16:4645003-4645033
  misc_feature 1..30: note = hypo
  source 1..30: mol_type = genomic DNA
aggatctgctgttcccgagatcaacagctg

SEQ ID NO: 78972 - DNA, 30 bp, Homo sapiens; identical to SEQ ID NO: 44577
  misc_feature 1..30: note = chr16:4655417-4655447
  misc_feature 1..30: note = hypo
  source 1..30: mol_type = genomic DNA

SEQ ID NO: 78973 - DNA, 115 bp, Homo sapiens
  misc_feature 1..115: note = chr16:4665621-4665736
  misc_feature 1..115: note = hypo
  source 1..115: mol_type = genomic DNA
taagtgcctactgtgcgcagctgtccagaccgtgaccagagccaggcacgtccatgtcgccctcattgctctcggtggcacccgtgcccctgctctggcacgaattggggtccca

SEQ ID NO: 78974 - DNA, 116 bp, Homo sapiens
  misc_feature 1..116: note = chr16:46721647-46721763
  misc_feature 1..116: note = hypo
  source 1..116: mol_type = genomic DNA
aagggccaaaggggccgccaacacttgctttcggatgcaaaagtgcgacaccaagaagactaagcgagctgcctaaattatagacagtgactgtgaaagaacgaatactcaagttt

SEQ ID NO: 78975 - DNA, 30 bp, Homo sapiens
  misc_feature 1..30: note = chr16:46763064-46763094
  misc_feature 1..30: note = hypo
  source 1..30: mol_type = genomic DNA
agaaggatttccaagcgaatgagtcaagaa

SEQ ID NO: 78976 - DNA, 30 bp, Homo sapiens
  misc_feature 1..30: note = chr16:46785401-46785431
  misc_feature 1..30: note = hypo
  source 1..30: mol_type = genomic DNA
ctaagaaggtggctgcggctggaagctccc

SEQ ID NO: 78977 - DNA, 44 bp, Homo sapiens
  misc_feature 1..44: note = chr16:46803052-46803096
  misc_feature 1..44: note = hypo
  source 1..44: mol_type = genomic DNA
caattaagtattggtcgggcggtggctaacgcctgtaatcccag

SEQ ID NO: 78978 - DNA, 30 bp, Homo sapiens
  misc_feature 1..30: note = chr16:468101-468131
  misc_feature 1..30: note = hypo
  source 1..30: mol_type = genomic DNA
agtcacctgtgatgtcgtgtgtgtcagtag

SEQ ID NO: 78979 - DNA, 85 bp, Homo sapiens
  misc_feature 1..85: note = chr16:47053768-47053853
  misc_feature 1..85: note = hypo
  source 1..85: mol_type = genomic DNA
gaatgacaagagctgcggaaggagccttggaaaatcagaatgcattccaggcactaaatgcagaggaaatgcctccaagggtatt

SEQ ID NO: 78980 - DNA, 987 bp, Homo sapiens
  misc_feature 1..987: note = chr16:47176772-47177759
  misc_feature 1..987: note = hyper
  source 1..987: mol_type = genomic DNA
caaattagtaagaaccgaacaccagcggcggggaattctgagacctctggcggagcgcgaggagcgccgcgtcccgggaagcacccgagcagcagcgctccccgggggccgggacaagccgggtccgcggcgcccgcgcgccgcccccggagcccgcagtggtgccgcagcctccgtggccgcagcaggtgggacccggctggcccagcaggccccgttccccgccgcgaggtgcaggcgccgcggggctattcgaaaaccactgcacgacgtcacggccgcggcttttattgttctcgtggaattactttttgccatcacatctggagaaagagcggcctccgctccacgacaggaatctcacaactttgcaaagggatgcgcggaattctacggaagcggcgcgagggcgcagcccggagggccctgctgggcccaggggcctcctggccgccttcccgacccgatccctcttcccacacgcgccccgcgaacgtcggccggactcgcaggggtcggaagcggcgcgcccggagagccggcggagccgggcagggctcgcgccccgcggtccgctccgagtagccgcgagccccgccagacaaagaggcgcgtcgggtcccgggcgcgggtaagggacgcagaggcgcgggcagggcggcgcgccagcctcggcccgcagggggcgccgtccgtggccccagccccggtccttacctttgaggaccgagcagagccgctccagggccatgttcccgagctgcccggcgcttcgcgaagggctgaggtagcggcggcggtggctcggcgctcacggctcggcgcggcggcgacggccccactccgtccccatcgccggccagcagctgcctccccgctcccctgaggagagctcaggtcctgcggcccgccatgcccgagccccacagtgggctcccgcgcggcccgagcaccccgacgggcgccgcctcctgctccgcggcgccc

SEQ ID NO: 78981 - DNA, 626 bp, Homo sapiens
  misc_feature 1..626: note = chr16:47177819-47178445
  misc_feature 1..626: note = hyper
  source 1..626: mol_type = genomic DNA
gctccgcccgcggccccggcgcgggatccactgaagtggcgggcgcggggcgcccaggctcatttaaggagggagcgcgagcgccgcgtgccggctgcgccgcctgtgcgcatgtgcccgccccgccccgccccgcgccgcgcctcgcgcgcccgccgcggcctcgcgccgtgggacggcgtcgctccccgccggctgccgttagggctgggagccggctgggcgcgggggtagtgagggtgcctctcgccgtggctgcgcggcggcctcgtccgagaggccggcgccggggcagtgaccggcccgtgcccagccgccgcgcagggcgcccggggcagctggccgagccctcgatgcctcccgtctgacggaggcgcccgggaagcgccgcccacctcggccccgcaccctcgccggcctgccgggtctccgccagccctagcagacagagaggggcgccggtccctagtcccccagacctccattcaaggtcaaaactttgcccagctcagccttgctcgaccctgggcagggaagcgcggacatcggcagagggagcccgaggctctccgtgcccttcgcgccggtgagttcccgacccgcggcgctgccggcgtttccctagc

SEQ ID NO: 78982 - DNA, 137 bp, Homo sapiens
  misc_feature 1..137: note = chr16:4723596-4723733
  misc_feature 1..137: note = hypo
  source 1..137: mol_type = genomic DNA
ctgtacctcctgcgccgacacgctgcgctaccaggccaacaactgccccatctgccggctgcgtgagttccccggccggctgttctgtggaaggttctggaaattagggactggccacaccacggtggtcctgggat

SEQ ID NO: 78983 - DNA, 43 bp, Homo sapiens
  misc_feature 1..43: note = chr16:4840446-4840489
  misc_feature 1..43: note = hypo
  source 1..43: mol_type = genomic DNA
cttctggggaactcccgctccttcctggaggcttaaccttaaa

SEQ ID NO: 78984 - DNA, 84 bp, Homo sapiens; identical to SEQ ID NO: 44579
  misc_feature 1..84: note = chr16:4841600-4841684
  misc_feature 1..84: note = hypo
  source 1..84: mol_type = genomic DNA

SEQ ID NO: 78985 - DNA, 91 bp, Homo sapiens
  misc_feature 1..91: note = chr16:4844989-4845080
  misc_feature 1..91: note = hypo
  source 1..91: mol_type = genomic DNA
ggtgctggaaccaatcgttgaggattccaaggacaactctatgatgcaggcacacctgtcctagctgctcaagggtcgtgggatgcaggta

SEQ ID NO: 78986 - DNA, 284 bp, Homo sapiens
  misc_feature 1..284: note = chr16:4846136-4846420
  misc_feature 1..284: note = hypo
  source 1..284: mol_type = genomic DNA
ccccctagggaacaacgagcgaacctgcttggtcccgctgtgcttctcgtgcaggaaagacccaagggagtggataacttggccctggaaccctgaccctgtgtctcctgcccggtggcagtaacaaagccttctgtctgcccagagcctgagtctgcagtgtcttccagtccccgtctgggtgggtgacgcgggactcgccgccccactcaggtggccacctggcctctccaagccttcagtcagcacgactgtgccaggtcatcctcagtcacctagctggg

SEQ ID NO: 78987 - DNA, 104 bp, Homo sapiens
  misc_feature 1..104: note = chr16:4846720-4846824
  misc_feature 1..104: note = hypo
  source 1..104: mol_type = genomic DNA
aaaaaaaaaaaagactcggtggcccaaagtcccaggtagagctcttgtcgccaccccatgggcttcttggcagcccgagggtcccctctcgacagtaggttctg

SEQ ID NO: 78988 - DNA, 120 bp, Homo sapiens
  misc_feature 1..120: note = chr16:48642018-48642138
  misc_feature 1..120: note = hypo
  source 1..120: mol_type = genomic DNA
taggtaaataaacatacatcctttctttctgacattctccgagcgttttattactattaatggtttttttccgattctcaagaacacggttttcaccgtgtgacacaggacagtctcaat

SEQ ID NO: 78989 - DNA, 96 bp, Homo sapiens
  misc_feature 1..96: note = chr16:48644969-48645065
  misc_feature 1..96: note = hypo
  source 1..96: mol_type = genomic DNA
ctcaaaaaaaaaaaaaaagataaattcaggagagtgatttcttctgtgagggaagaaaggggatatgttatgggagaagcccgaaaagtgggagtt

SEQ ID NO: 78990 - DNA, 54 bp, Homo sapiens
  misc_feature 1..54: note = chr16:48845119-48845173
  misc_feature 1..54: note = hyper
  source 1..54: mol_type = genomic DNA
cggggctctgccctcaccctggcatcgtcctgccgggcccgggtgatgctggcc

SEQ ID NO: 78991 - DNA, 30 bp, Homo sapiens
  misc_feature 1..30: note = chr16:4900604-4900634
  misc_feature 1..30: note = hypo
  source 1..30: mol_type = genomic DNA
gatggtcttttgcagcgccagcctgttaca

SEQ ID NO: 78992 - DNA, 55 bp, Homo sapiens
  misc_feature 1..55: note = chr16:4920234-4920289
  misc_feature 1..55: note = hypo
  source 1..55: mol_type = genomic DNA
ctgagcagtcaggtccgctctggggtgtatgcctatcttgcgtcattcctgccct

SEQ ID NO: 78993 - DNA, 37 bp, Homo sapiens
  misc_feature 1..37: note = chr16:4920489-4920526
  misc_feature 1..37: note = hypo
  source 1..37: mol_type = genomic DNA
ccttgaattgtgtcccgctcttcgcaggggggccgtc

SEQ ID NO: 78994 - DNA, 487 bp, Homo sapiens
  misc_feature 1..487: note = chr16:49309010-49309497
  misc_feature 1..487: note = hyper
  source 1..487: mol_type = genomic DNA
cccacaccttccctccgcgccgcactatcccccaccaccacctcattaaggcaacaattaaggagaggggtgaggctccctctccatctgggtaattgtgttctcattaagagcggatgcgcccgggctctgagcattagcgctccagtgcagcttggaaggcatgctcccagctcggctaatggtggaagcggcggccgggcagcaagcgagctggggggcaggcgcggggcccagcgcaacccagcgctgctccgcagacagcagacaccacagtgatcaccctcggctcctcgcctgcgcggctcccggggcgcttagcgcggtgtggagaacccgggcggagaagccaggtctgggcttgttgggtcctagaagcctccctgagttcccctcacagtacctttaagcctggctgggtgccggaaacgctgcgcagaataggaaacagcctctgccctgggagaactgacggggtgtggggagg

SEQ ID NO: 78995 - DNA, 927 bp, Homo sapiens
  misc_feature 1..927: note = chr16:49311063-49311990
  misc_feature 1..927: note = hyper
  source 1..927: mol_type = genomic DNA
cagggagcgccaaagcgtacaggggcagcttccttgagcggtggctctccaaccttcgcggccctacagcctcaagcttacacgcaccctactgactatagggtctccacaagcccggagggctggccctgcaacggcagagctgctgggtggagctagtttcgctgccaaaggctccaactgtctccgacctctccttcccaaccaggagacttcggagaaagcgcgtctctttattaaaagcagtttttctttaaatccctttaaggccccttatttcttctcattcacacttccctggggcctaacagagtagaagggaaactgttgggcagaaacagaaaagtactcgggtccactcctcactcgcgaagtccctatctatctctgtgggtcccggaggcacagggctgcaagggcgcccgctagagctgctccacggcttaccggattgcatgcggagaagaaacgggcccgggtttcaacagaggccccgtgctccgtgaatttctaactcgaaccagccgctgggataaatccgagaaacgttgtttattgtgctattattaactttcccttctccccacgcccctagaggaaataaaattcattcctgaatattgggccaggaaaacgtttctctgaaaggaaccacaactgcaggggaccacccggctgcagctcccagctcccggcccttcgccctaggctgcccactcgctccggctcccgacctccccgctgccgaagcaactgggtcagcctttcagacttaaaacgaagtcgtttatttcatttttgctttcacattatgttccgatacaatcaaaactcctggacgaacctcttgaataaagtcctgtgaatgagcggaatcataggtcctgggcgcccgagtatgcggcgggtggactccggattcagagg

SEQ ID NO: 78996 - DNA, 545 bp, Homo sapiens
  misc_feature 1..545: note = chr16:49312032-49312577
  misc_feature 1..545: note = hyper
  source 1..545: mol_type = genomic DNA
cgcggtgggagacatccggggacagaaggcctgaggagtctgccgctccaggcagggtcgtttgggtcctcaaactgggactattcctgatgcatttggaatgcaaagaaaaaaatcaaacttcgctcctgggccggcggccgcgcctggcctagcaagatttcggccacatttcttacgtttccgccaaagctgtgaacacaggcgaatgcagtgctggtccccggcctggcgcaggaaggagcgcaaggccggctttgcaaggaagccctcgcgcccaggcctttctatggttgcgttcccccaagtctcctgcctttcggaacctcgccctttggcaccccagacccccaacctcgcagctggggaagatgcggattttagaaagctgtttcagaaaaataaaagtcccacttcgactttattagattaaagcaaaattaaaccttgactattcacacgtatgttacagaggaagaggaggcgtccggaagaagctccttggcgtttcgtggagtcacagagcacgacggcattgacaagca

SEQ ID NO: 78997 - DNA, 1668 bp, Homo sapiens
  misc_feature 1..1668: note = chr16:49313154-49314822
  misc_feature 1..1668: note = hyper
  source 1..1668: mol_type = genomic DNA
ttgtcccacagctggcgcgcacctttttacccagatacagttagagaacatgtaggaagtttcaagtcgtgctgctttctcgccctcttaatttcagcctctttctcactccccttcctgccttcgccctctccctgcctcccttccggctacgagccagtcagagaggaaacaccaggaatccggagaaggtcgagtacttccagccccccatcaagtttccccgctccagcttgaggtatgctcggtcgcctttctccatttggattaggactccgttgctggcggcctcccgggtcacgtcctggtcaccagcgaaggctgaaatcaccggccacccgtttagcatgaggctcacctgagaaagagaaaggcccgcttcagaggcgcaacctaggcaggcaccgaagccgcggtggagcgaacctcctccttgcttggctaacagcctgtaaggcctggaagcacggagaggtggggggtggggggggcgaatggaggaaaaggggctttgcagcttactgctgaggctccagtggggcgaaagaccacacatctgggtgacaggaagggcctgtccccaaaacgggagttgctcttattccagtttctcaaatgagcgcgccaagcgaatctcgactgtgctctgtgatccaatttaataaacccatgaggtggctctagcgccctgagacctttgacctctctcccgtttcccctcagcctcaaaaaacaaacaacaaacaaaaaaaacccagcaactcaggctccttctggcgctaccggaaaaacaaaaacgaacaaacaaaaagcccctgatccctcctggacccagctgccaggacacagtggagaagccactgtgatttgtgattagaagtctcgcaccgagcggcacaatgtatttcctccccaaaccacgggctcaattccctcccccatccagccgcgcccgccaccgcctggttttgcccctgtggtggcaccgtcagccaagggcctcgcgccctctccccagctgtgcgtcccacctctctcggcgcccaagggaaacctggacatctttggggacccggagagccggcgagtgattgctgggacacggctggagccgggagagagtagcactacgccccctccctccctcctctctctacccctcaccctccggggctaaatgctgctagctcaaaaacccacagtccgcacggggtggggattggggacaagtgggagaaaacgggggccccgtccgtggtgctgaagacaagcacgcaagccgcatcgcaggcttctgagccggggcaaggggtagggtgtactgtcgcggtgcttcctggggagtccgggaaggcttcccaagcggcagctgtctggggcgctaacaacagccgttacaaggaagtccctgaaatccagggaacccttcggagaggcccggaaggcagaagcagaaaattctgtctctcgggggatggggctggatcccaagagccagagacagggaaagcagaggacagttgaagccacagaactgagaggccccgctatctgtccctccaagcagcccgaagtacatgcagccgccacttctgcctaccacctccggacagcccgagcacccctgaggccagtaacccccctacggggccagggcccggcacgagg

SEQ ID NO: 78998 - DNA, 1357 bp, Homo sapiens
  misc_feature 1..1357: note = chr16:49314959-49316316
  misc_feature 1..1357: note = hyper
  source 1..1357: mol_type = genomic DNA
cgagacgggaacgaaggggagtgggcaggaatcggtcccggactgtcgtccccgcgcctccgcagagcccttggagaggaccgggcatcggtcttccatccatccctccttcaccagcccaatctgcacgccgcgggaggaaggaacactcacctggtcgaagtagatgatcatggtgcgattactcatctcggacggctcgtggttggtgctcctgatggcagagaaagccaccttggcgctgccagagcgcacagagatgcccagggcagtgcccgtggggtcggacgtggggttggagtcgcacaccaccaggcacttgccctccagcacgatgggctccgtctcattctgcccgcgggccgggcccgccagccacgcagcccccagcagcagcagctccaggacgcccagcatcgcgccgccggcgcccaccccgccccccacccccagggctgctcgcgccagccgccccccccgtcccagtcccgctccgaagccccctcctcagctccgtgcgcagctccgccgccgccgctctggacactacacctcttcctcgcactccgggactagcgtcccctccgcgactagcgtcccctccgcgctgtgttcccggagcccctcccgggcctcaggggtgccgcggctgcccagccgcacttggatgcatagccgctgctgctcggtcccgctgctgccgccgcctcctgcccgcacccgccgctgccgccgccgccgccgctctgaattattgatgcagccggcgctgcagccggagcgggcggagagcgcgcgccgggcacaaaggcgcggacctcggcctggccccgcccccgccgcctcccggcccgcctccctccgaggccctgcccccgccccggccgaggccacgccccccagccaatcctgacgcgccgcgctccccaccgagccaatggcggcgctgtccgcgctcggccacctgaccccgggcgccgttgttattaggcgcggcgaggcgggtggcgcgcggcagcagggttgggctctcgccgtgagtcgacgaagggagcgcgggcgcgcgcccgcgtccgcgcactgagagtcgcctcggccgctcgctttctcgactcccgcctcgcgcctcgatcctgttccgcctccctcggccctcctgcccgcccccactcgtcggccctcaggtaggaggcggcgcgccccggggtcgggagtggaatcgctggaggctgcgagtcgcctgcccgcctgtgggcgcgcccgttgggaggggagcgccccccagcgggcgcgggcgcgagggcagccggcgcgctgggcgagcctggctcagggtcccggcggccggggtgcaggg

SEQ ID NO: 78999 - DNA, 30 bp, Homo sapiens
  misc_feature 1..30: note = chr16:4931529-4931559
  misc_feature 1..30: note = hypo
  source 1..30: mol_type = genomic DNA
acacctgtgggaaaacggaccgctcttggc

SEQ ID NO: 79000 - DNA, 203 bp, Homo sapiens
  misc_feature 1..203: note = chr16:49316508-49316711
  misc_feature 1..203: note = hyper
  source 1..203: mol_type = genomic DNA
gactgctctgccggccgcggaggtcggatcgagcggtcattcattcatttgttaattcgttcacttattcaggggagatcattgaacccctacggagtaccgggtactgggccgggcgctgaggacgcggggctgagcaaaagcagccgaggcccaccttcgtgccccttaaaacccagcgtgcggggcggcaacgagtactg

SEQ ID NO: 79001 - DNA, 182 bp, Homo sapiens
  misc_feature 1..182: note = chr16:49317053-49317235
  misc_feature 1..182: note = hyper
  source 1..182: mol_type = genomic DNA
aggctggtagtagggcggcgggagggcggggggacctgtcagtcaagtccaaagcagaaacgcggcgccggatcccagtcagaggccggctggaacgcttcccacaggctcctggcgctccggtccccaccaggcgaccttgatcctggcgtgctcagcggagccagcgcagcgtcgggagc

SEQ ID NO: 79002 - DNA, 48 bp, Homo sapiens
  misc_feature 1..48: note = chr16:49317700-49317748
  misc_feature 1..48: note = hyper
  source 1..48: mol_type = genomic DNA
gactggcagctctggcggcgcgctggaggggaccgggaggggcaccct

SEQ ID NO: 79003 - DNA, 30 bp, Homo sapiens
  misc_feature 1..30: note = chr16:4932123-4932153
  misc_feature 1..30: note = hypo
  source 1..30: mol_type = genomic DNA
aggcagacctacaggcgaggccgcagcaga

SEQ ID NO: 79004 - DNA, 30 bp, Homo sapiens
  misc_feature 1..30: note = chr16:49434635-49434665
  misc_feature 1..30: note = hypo
  source 1..30: mol_type = genomic DNA
ccctcccctaccccacgccagcccacccta

SEQ ID NO: 79005 - DNA, 30 bp, Homo sapiens
  misc_feature 1..30: note = chr16:49464835-49464865
  misc_feature 1..30: note = hypo
  source 1..30: mol_type = genomic DNA
attacacctggatgtcgcagtgagctgtga

SEQ ID NO: 79006 - DNA, 30 bp, Homo sapiens; identical to SEQ ID NO: 44691
  misc_feature 1..30: note = chr16:49500178-49500208
  misc_feature 1..30: note = hypo
  source 1..30: mol_type = genomic DNA

SEQ ID NO: 79007 - DNA, 30 bp, Homo sapiens
  misc_feature 1..30: note = chr16:49508868-49508898
  misc_feature 1..30: note = hypo
  source 1..30: mol_type = genomic DNA
tgcctacactgagcacgctggattattcaa

SEQ ID NO: 79008 - DNA, 184 bp, Homo sapiens
  misc_feature 1..184: note = chr16:49532989-49533173
  misc_feature 1..184: note = hypo
  source 1..184: mol_type = genomic DNA
ccccacccagcaagccgaggtttgcctcatttacgcagatggcagggcaaggtttgcccgagtgggtgtgacacccaaccctggcctcagagtgaagctggtggcccactggccttggacaaagccctgagatgtcctatggcagagggagcagcagctcttccatgcacgggatgtgcgtgag

SEQ ID NO: 79009 - DNA, 161 bp, Homo sapiens; identical to SEQ ID NO: 44693
  misc_feature 1..161: note = chr16:49545215-49545376
  misc_feature 1..161: note = hypo
  source 1..161: mol_type = genomic DNA

SEQ ID NO: 79010 - DNA, 52 bp, Homo sapiens
  misc_feature 1..52: note = chr16:49577715-49577767
  misc_feature 1..52: note = hypo
  source 1..52: mol_type = genomic DNA
ggagtcatatgaccccggtcacagcgaccgccactcacgggctggctgacct

SEQ ID NO: 79011 - DNA, 30 bp, Homo sapiens
  misc_feature 1..30: note = chr16:49593939-49593969
  misc_feature 1..30: note = hypo
  source 1..30: mol_type = genomic DNA
ctgagagcagggtaccgagtagaacatatg

SEQ ID NO: 79012 - DNA, 90 bp, Homo sapiens; identical to SEQ ID NO: 44694
  misc_feature 1..90: note = chr16:49623675-49623765
  misc_feature 1..90: note = hypo
  source 1..90: mol_type = genomic DNA

SEQ ID NO: 79013 - DNA, 43 bp, Homo sapiens
  misc_feature 1..43: note = chr16:49634728-49634771
  misc_feature 1..43: note = hypo
  source 1..43: mol_type = genomic DNA
tgactaccacattgccgaaataaatcaccgtcgctcaggaggg

SEQ ID NO: 79014 - DNA, 44 bp, Homo sapiens
  misc_feature 1..44: note = chr16:49638054-49638098
  misc_feature 1..44: note = hypo
  source 1..44: mol_type = genomic DNA
tcaccatcagcaccccgctggcgggcacccgggcccctcaccac

SEQ ID NO: 79015 - DNA, 30 bp, Homo sapiens
  misc_feature 1..30: note = chr16:49671197-49671227
  misc_feature 1..30: note = hypo
  source 1..30: mol_type = genomic DNA
gctgagagccgctgccgcttcggggaagac

SEQ ID NO: 79016 - DNA, 97 bp, Homo sapiens
  misc_feature 1..97: note = chr16:49671872-49671969
  misc_feature 1..97: note = hypo
  source 1..97: mol_type = genomic DNA
atcttcttctgcccccgcagcggcttcaaggtggagtccggggtggagccacgctccacagaggcgctggagtcgggtgtggcgctgctcatggagg

SEQ ID NO: 79017 - DNA, 20 bp, Homo sapiens
  misc_feature 1..20: note = chr16:49736772-49736792
  misc_feature 1..20: note = hypo
  source 1..20: mol_type = genomic DNA
tgtgtgctggaggagcgagt

SEQ ID NO: 79018 - DNA, 140 bp, Homo sapiens
  misc_feature 1..140: note = chr16:49736852-49736992
  misc_feature 1..140: note = hypo
  source 1..140: mol_type = genomic DNA
cacacacactccatggcaggataaagcaccatatgctcatgttcataaaattttaaaggtaaaagcagatgtaatttgataaatgtgtacatgtgttgatacgaacacatgcaccaacacaggcgcgcaggcatgcacac

SEQ ID NO: 79019 - DNA, 30 bp, Homo sapiens
  misc_feature 1..30: note = chr16:49893240-49893270
  misc_feature 1..30: note = hyper
  source 1..30: mol_type = genomic DNA
cgtatgtccgtttcccgacgctccgccctc

SEQ ID NO: 79020 - DNA, 27 bp, Homo sapiens
  misc_feature 1..27: note = chr16:50070326-50070353
  misc_feature 1..27: note = hypo
  source 1..27: mol_type = genomic DNA
ggcataagccaccgtgcctggcctctt

SEQ ID NO: 79021 - DNA, 69 bp, Homo sapiens
  misc_feature 1..69: note = chr16:5007727-5007796
  misc_feature 1..69: note = hyper
  source 1..69: mol_type = genomic DNA
cgtgtggctcaccggcggctctccagcgcctggacagggctgacccccagcaggcgctctgtgaaggtg

SEQ ID NO: 79022 - DNA, 37 bp, Homo sapiens
  misc_feature 1..37: note = chr16:501346-501383
  misc_feature 1..37: note = hypo
  source 1..37: mol_type = genomic DNA
acctcaccctccccacgcttcccgtatcagggagctt

SEQ ID NO: 79023 - DNA, 17 bp, Homo sapiens
  misc_feature 1..17: note = chr16:50292023-50292040
  misc_feature 1..17: note = hypo
  source 1..17: mol_type = genomic DNA
aacctccaagctactcg

SEQ ID NO: 79024 - DNA, 37 bp, Homo sapiens
  misc_feature 1..37: note = chr16:50292820-50292857
  misc_feature 1..37: note = hypo
  source 1..37: mol_type = genomic DNA
tttagttacagtaaaaaccttccgtattcaccctgtt

SEQ ID NO: 79025 - DNA, 51 bp, Homo sapiens
  misc_feature 1..51: note = chr16:50335767-50335818
  misc_feature 1..51: note = hypo
  source 1..51: mol_type = genomic DNA
tttcactctggtcctcgctatgccttggggctggcccgactgccagaccct

SEQ ID NO: 79026 - DNA, 30 bp, Homo sapiens; identical to SEQ ID NO: 44700
  misc_feature 1..30: note = chr16:50336356-50336386
  misc_feature 1..30: note = hypo
  source 1..30: mol_type = genomic DNA

SEQ ID NO: 79027 - DNA, 152 bp, Homo sapiens; identical to SEQ ID NO: 44701
  misc_feature 1..152: note = chr16:50336625-50336777
  misc_feature 1..152: note = hypo
  source 1..152: mol_type = genomic DNA

SEQ ID NO: 79028 - DNA, 667 bp, Homo sapiens
  misc_feature 1..667: note = chr16:5037514-5038181
  misc_feature 1..667: note = hyper
  source 1..667: mol_type = genomic DNA
ctgccccccccaccacggccgctcactgccgctctgcccccaggcctacgagaagcgtttccccacgtgcccacagatcccagtcttcctgggcagcgaggtcttgcgcgagtcccgcagcccggacggggctgtgcacgtggtggagcggagctgccggctgcgcgtggacgccccgcggctgctgcggaaggtgggcggccctggggctggggggcggaggaggggacctgttgcggaggtgcgggagggctgggcgcgggagctggggaccagggcggcggggtccaggaggtggagcaggggcgtgtgagttgatatttggatggaggttccaggatgagggtggcgggaccagggcccaggaggggcgagggctggaaggctgggctggggagtagcgggaactgggcggggttcgcggggccagggccggagctgggtggtgaagatgggttggcggcagggcggaagtcgggggttggtgtcctgggtccgggctgggtgggcggtggcgcaagggacctgggactcagggcagggggtgactggggcaggcccgccggactcgctctccattcctgtgtgctccacgccgcccacccacctccgcctccccgccccttcccttgcagatcgcaggtgttgagcacgtggtcttcgtgca

SEQ ID NO: 79029 - DNA, 237 bp, Homo sapiens
  misc_feature 1..237: note = chr16:50501876-50502113
  misc_feature 1..237: note = hyper
  source 1..237: mol_type = genomic DNA
cgcccctacccccagcggcgcgagctctaacgcagagcagatggcgggggcgggagcccgggcgggcggggctctgcgcctaggcggctgcagccgggcctgattaggtccccctcccgctggcggccgctggcgctttgaagtgagccgctgcccggcggctccggccgcctggccgtccctgccgccaggccgtcggacccaggctggcggcggggctggcggcgcgtgttgatc

SEQ ID NO: 79030 - DNA, 24 bp, Homo sapiens
  misc_feature 1..24: note = chr16:505034-505058
  misc_feature 1..24: note = hypo
  source 1..24: mol_type = genomic DNA
gcgaaactccgtctcaaaaaaaaa

SEQ ID NO: 79031 - DNA, 66 bp, Homo sapiens
  misc_feature 1..66: note = chr16:50581600-50581666
  misc_feature 1..66: note = hyper
  source 1..66: mol_type = genomic DNA
gcggttacccccttccgggccgcgcagtttggcagcgcgccccgacccgggcgggcacccacgggc

SEQ ID NO: 79032 - DNA, 53 bp, Homo sapiens
  misc_feature 1..53: note = chr16:50667548-50667601
  misc_feature 1..53: note = hypo
  source 1..53: mol_type = genomic DNA
ggccctgtcctggggcgggagcacctgcgggagctgcccgccttggtggtgta

SEQ ID NO: 79033 - DNA, 184 bp, Homo sapiens
  misc_feature 1..184: note = chr16:50699260-50699444
  misc_feature 1..184: note = hyper
  source 1..184: mol_type = genomic DNA
accccaagtggaggtcgcccggggaccccccatcaaaacacttgctggggagaggttatagaggcagcaaagctctttccagcatgatttcaaatcccgtctaagggctttcagaagcctggagaaagtttcggtttcccagctgtttcagctttttccgcccgcaccgcggcgatgcgttcgg

SEQ ID NO: 79034 - DNA, 188 bp, Homo sapiens
  misc_feature 1..188: note = chr16:50753089-50753277
  misc_feature 1..188: note = hypo
  source 1..188: mol_type = genomic DNA
tggagacctgaaaggcgagttctcctagctgccacaccccttctccaaggatacaataatatctgccttataggattgttgtgagctgagtggcttgacgttccttgaaagaatgaaagcgtatagttatcccaggaagcctagggttgcaggtgagagctctggggcttctccgaagctctccgagg

SEQ ID NO: 79035 - DNA, 195 bp, Homo sapiens
  misc_feature 1..195: note = chr16:50753681-50753876
  misc_feature 1..195: note = hypo
  source 1..195: mol_type = genomic DNA
aactagacctagcagcgagggcacctgatgtggctgctgcctcccgggcaggtcttcaatgctttcttcctgtgtttccctggccagggcacagacggccctccttttctgcctgccgctgtgttctctcagcctcctctgtcttcccttccaggctggggaataactacatcactgccgcgggagcccaagtgc

SEQ ID NO: 79036 - DNA, 91 bp, Homo sapiens
  misc_feature 1..91: note = chr16:5090543-5090634
  misc_feature 1..91: note = hypo
  source 1..91: mol_type = genomic DNA
aggaaaaactttaagaacatgatgacttaatggaattacttgtttacagtaggattttataccttgagccgggagccggaaggaatgcact

SEQ ID NO: 79037 - DNA, 30 bp, Homo sapiens
  misc_feature 1..30: note = chr16:5094354-5094384
  misc_feature 1..30: note = hypo
  source 1..30: mol_type = genomic DNA
gctgcttggtggtggcggtgtggatgggtg

SEQ ID NO: 79038 - DNA, 197 bp, Homo sapiens
  misc_feature 1..197: note = chr16:50958551-50958748
  misc_feature 1..197: note = hypo
  source 1..197: mol_type = genomic DNA
cacttttcaaccaaccggcccactacaaaatccttaaaaccccaactccaaactcctccagagatggatctgaggtttcctctcatctcactcggtgaccctatgactaaatctctttctctgctgcaacccggtgtttcagtatattgatttgctgtgtacatcacgcaacaaagctgttccggttacagttctac

SEQ ID NO: 79039 - DNA, 170 bp, Homo sapiens
  misc_feature 1..170: note = chr16:5105315-5105485
  misc_feature 1..170: note = hypo
  source 1..170: mol_type = genomic DNA
agaagtcggagaagccgcccattccacagaacatgactggaagtaaagacgggggccctctgcaggcctgccccccaggcccacctcctcccactccccagggctgccacggtgccacctgccttcatctgcctgggttaggcttaggaggtgggcgttcaatgcagagg

SEQ ID NO: 79040 - DNA, 30 bp, Homo sapiens
  misc_feature 1..30: note = chr16:511064-511094
  misc_feature 1..30: note = hypo
  source 1..30: mol_type = genomic DNA
tggtttcatagaagacgcctttccacagac

SEQ ID NO: 79041 - DNA, 72 bp, Homo sapiens
  misc_feature 1..72: note = chr16:511477-511549
  misc_feature 1..72: note = hypo
  source 1..72: mol_type = genomic DNA
cacagccatcagaaacggaggtcagtcatccccgccatgagctcccacctcctctcccgttcctcagccacc

SEQ ID NO: 79042 - DNA, 30 bp, Homo sapiens
  misc_feature 1..30: note = chr16:5115288-5115318
  misc_feature 1..30: note = hypo
  source 1..30: mol_type = genomic DNA
agtggggtgggaacccgatcttgagggtcc

SEQ ID NO: 79043 - DNA, 72 bp, Homo sapiens
  misc_feature 1..72: note = chr16:5115525-5115597
  misc_feature 1..72: note = hypo
  source 1..72: mol_type = genomic DNA
tagctgggccacagccgccaggaagatccagcccctggcctcctctctccttatagccgaggcaggctatac

SEQ ID NO: 79044 - DNA, 123 bp, Homo sapiens
  misc_feature 1..123: note = chr16:51167687-51167810
  misc_feature 1..123: note = hyper
  source 1..123: mol_type = genomic DNA
ttaattcagtgaattcggttctcggtgatttcaataccaccacgaggcacctctagtgaggcgtagcggggcaagggtcggggagtaggtgaggagggggtgcgcgcccgtcagctgccttca

SEQ ID NO: 79045 - DNA, 468 bp, Homo sapiens
  misc_feature 1..468: note = chr16:51183963-51184431
  misc_feature 1..468: note = hyper
  source 1..468: mol_type = genomic DNA
cgctaggcctgggagctttgaggccggtaccgtgaaacacctttaggagcaaggagggattccaggtgtcctccctttgtaccccaactccctgcccggatctcttccactctctgccatagcccccacacacaaactttgttctggacttgttcagccccttcgggacccacagttgtcgcctccatcggagaaaacaagtgcccctgtttcaggggggattccactctggctggccacccgcaaacctggaaaactattctatgacttcttccctgacccccctggaagtagggagcaccacgatccgcagagggcgcataccgaccagaaagattttggggggcagagggtgcaagtgttgtgggaagagatgcggagataaattttgcgagccagaccccgacactttccccgtccgtttgcaccgtctccggaacaactggcggccagcagcactctccaccc

SEQ ID NO: 79046 - DNA, 281 bp, Homo sapiens
  misc_feature 1..281: note = chr16:51184677-51184958
  misc_feature 1..281: note = hyper
  source 1..281: mol_type = genomic DNA
gagcgctaggggccccgtgcggtcaggccggggcgacctccacccgcacccacgcctcatggggctcccgggtcttggccgcggctgggatccccggaaaagcagggacggagaagccaggccggcatgcccgccctccttcccccgggaggacccaacaactccggaaagatcctgccgggagatgtgctcgctttccccggggcagcgggggaaagcccagcaaaggcacattgaaaattaaaaagaaaaaaaaaattacgccgagtggaagaagcaat

SEQ ID NO: 79047 - DNA, 238 bp, Homo sapiens; identical to SEQ ID NO: 4350
  misc_feature 1..238: note = chr16:51185054-51185292
  misc_feature 1..238: note = hyper
  source 1..238: mol_type = genomic DNA

SEQ ID NO: 79048 - DNA, 423 bp, Homo sapiens; identical to SEQ ID NO: 4351
  misc_feature 1..423: note = chr16:51185542-51185965
  misc_feature 1..423: note = hyper
  source 1..423: mol_type = genomic DNA

SEQ ID NO: 79049 - DNA, 304 bp, Homo sapiens; identical to SEQ ID NO: 36147
  misc_feature 1..304: note = chr16:51186025-51186329
  misc_feature 1..304: note = hyper
  source 1..304: mol_type = genomic DNA

SEQ ID NO: 79050 - DNA, 955 bp, Homo sapiens
  misc_feature 1..955: note = chr16:51186595-51187550
  misc_feature 1..955: note = hyper
  source 1..955: mol_type = genomic DNA
gggacgaggtggcggcgcagagccggaaagcggggtggggggagggcggtggggaggtgttctgtccgaggctgcctggcggcgccgaagctcgcctccactttttgggcacttgccgagcgcggcgcccgaacttttcgctctatcaccatctccctcaagctgagatgcaacctccctaccctcgccccagagcccagagccaggagcccgatccctctgccgggctcaggcgcccgcgaacctgagactcggtacgcggctcagcctagctctttcccctcgcgcctcggggtctcctcgctccaaggttctcgaagtcttgcgcccgaaggactaaactaaactaaacttcggctgagtaatgggggaggaggggggtgcagatacacaatccctgccctatctcacgatcaggaaaggagagggctcataaggacgccccaattcgcgagcgcccttgagtctggccggtgccacggtcggttcgcgcgaagtgggcaccggtctcccgagccgacttcgtgtactccggacctgtactgcgctccggtagaggacccttccctttctcttagcttcttaaatcttttcttttaaggtgtaaatgtgtgtgtgtgccgatgaatgtttctgtttttcatctgctgactttatttttttttattggtataacttctcccttctctctccctgctcgtccgttttccaccttttctcttacttatcttctgccctcgctcactccctaacacacacattcacaccctctccgcctcgctctcccgttctcgccaggtcctgatgggtacagtagattttgataaaaagacaaacgaagctatcagtggggctgatgttgaagaatgaagataataatgtttccataggtggtgcttcaaatgccattatttctcactgaatatttaaagagatccctcggcaaagatggatc

SEQ ID NO: 79051 - DNA, 25 bp, Homo sapiens
  misc_feature 1..25: note = chr16:51189183-51189208
  misc_feature 1..25: note = hyper
  source 1..25: mol_type = genomic DNA
cccagctcaaggccccgctggcccc

SEQ ID NO: 79052 - DNA, 92 bp, Homo sapiens
  misc_feature 1..92: note = chr16:51189282-51189374
  misc_feature 1..92: note = hyper
  source 1..92: mol_type = genomic DNA
cggcgccccgggggcgggggacgaggcacatcgatggtatcaacattattgatggggaaaagttcggggcaggagcccggagatcaggttcc

SEQ ID NO: 79053 - DNA, 116 bp, Homo sapiens
  misc_feature 1..116: note = chr16:51189922-51190038
  misc_feature 1..116: note = hyper
  source 1..116: mol_type = genomic DNA
ttttgggggaactcccgccgcccgccaccaagggctatctccagacgggcgccgggtgcagcgccgtgaccgggcgccctggcgccggctcgggcgcgaaattcagcggtggcaag

SEQ ID NO: 79054 - DNA, 130 bp, Homo sapiens
  misc_feature 1..130: note = chr16:51190121-51190251
  misc_feature 1..130: note = hyper
  source 1..130: mol_type = genomic DNA
cgcttggagggctgttcctacaccggtattaagaaaccgacttcgctagcgactgcaagtgcttgcgattttgactttccgtccacagttgagcgtcttgcacttaaattcactgcgccccgcatgcaac

SEQ ID NO: 79055 - DNA, 22 bp, Homo sapiens
  misc_feature 1..22: note = chr16:5130483-5130505
  misc_feature 1..22: note = hypo
  source 1..22: mol_type = genomic DNA
ggtgtgggaagaggccgggtct

SEQ ID NO: 79056 - DNA, 22 bp, Homo sapiens
  misc_feature 1..22: note = chr16:5130565-5130587
  misc_feature 1..22: note = hypo
  source 1..22: mol_type = genomic DNA
tggaacccgcgccatatgctct

SEQ ID NO: 79057 - DNA, 95 bp, Homo sapiens
  misc_feature 1..95: note = chr16:5164973-5165068
  misc_feature 1..95: note = hypo
  source 1..95: mol_type = genomic DNA
catgttgaaagaatgcgtgaatctcatctccttttgtgggtgattcctgattaactttctttcttttttcaaaatggagccgtgatctgtcaccc

SEQ ID NO: 79058 - DNA, 21 bp, Homo sapiens
  misc_feature 1..21: note = chr16:5215934-5215955
  misc_feature 1..21: note = hypo
  source 1..21: mol_type = genomic DNA
agcaagtatgaaaagcgttct

SEQ ID NO: 79059 - DNA, 42 bp, Homo sapiens
  misc_feature 1..42: note = chr16:5257258-5257300
  misc_feature 1..42: note = hypo
  source 1..42: mol_type = genomic DNA
cacgactgatctgaacggggtgcacttcgacccggaagttta

SEQ ID NO: 79060 - DNA, 309 bp, Homo sapiens
  misc_feature 1..309: note = chr16:52580711-52581020
  misc_feature 1..309: note = hyper
  source 1..309: mol_type = genomic DNA
atccaccgtcgagggcgcccgggggtggcgcgtgggactcgcggccggaggggcgccgggacccagagcccgaggagctcgggagccgcggccgccgcacacaaaggcgcggccacgcgagccgcgggagagcgggaggcggccggggggacgcgccccgccggggcaccgaggcagcgctgcgcgcgggccgggcgccgggggcgcggggcgcggcgctggggcccgggtcggcgaggcgagttcaggtgcgctgggcgaggctgggacggcggcggcggcggcggctggccccgctcctcctcctcc

SEQ ID NO: 79061 - DNA, 145 bp, Homo sapiens
  misc_feature 1..145: note = chr16:52581360-52581505
  misc_feature 1..145: note = hyper
  source 1..145: mol_type = genomic DNA
cggacgccagccctgcgtcccgtgtgtcccaccctcctcctgcgcgaccacagcttccccgggccccagcatccccaagccgtctgctcccttcctgtcgctttcctccccatgacccccttccttcttcatgggtgcctgtccc

SEQ ID NO: 79062 - DNA, 80 bp, Homo sapiens
  misc_feature 1..80: note = chr16:53448471-53448551
  misc_feature 1..80: note = hypo
  source 1..80: mol_type = genomic DNA
tcaccgggcctggcccgaaaccgggtctcttaagggaaaaacaaaaaccacaaagattagccgggcgtggtgggccgcac

SEQ ID NO: 79063 - DNA, 200 bp, Homo sapiens; identical to SEQ ID NO: 44704
  misc_feature 1..200: note = chr16:53563454-53563654
  misc_feature 1..200: note = hypo
  source 1..200: mol_type = genomic DNA

SEQ ID NO: 79064 - DNA, 25 bp, Homo sapiens
  misc_feature 1..25: note = chr16:5412643-5412668
  misc_feature 1..25: note = hypo
  source 1..25: mol_type = genomic DNA
tgagccaccgcgccaggccacatca

SEQ ID NO: 79065 - DNA, 94 bp, Homo sapiens
  misc_feature 1..94: note = chr16:54317132-54317226
  misc_feature 1..94: note = hyper
  source 1..94: mol_type = genomic DNA
aattcttcaaacaaccgaggggagaaaaaacccaaaaaacaaaaaaccaccaaacagatccgtcgagggggcagacaggcgggttatagtcaaa

SEQ ID NO: 79066 - DNA, 30 bp, Homo sapiens
  misc_feature 1..30: note = chr16:54317821-54317851
  misc_feature 1..30: note = hyper
  source 1..30: mol_type = genomic DNA
cgaggcgtcaggacccgaggtctggggctg

SEQ ID NO: 79067 - DNA, 84 bp, Homo sapiens
  misc_feature 1..84: note = chr16:54318505-54318589
  misc_feature 1..84: note = hyper
  source 1..84: mol_type = genomic DNA
gcccagcagggagagcgggtgcaggcgggggccgggcggtgggcctggaaacggccggttggtccaagccgggaacttgcccag

SEQ ID NO: 79068 - DNA, 129 bp, Homo sapiens
  misc_feature 1..129: note = chr16:54318621-54318750
  misc_feature 1..129: note = hyper
  source 1..129: mol_type = genomic DNA
cggcggcggccggagagagctgcagggcggaaggcgcgaccgctgcccccggtggagacccccccgcgccgggaggcgagcggcgcgggttgtccgggcttgtggcagtctccgcgagggaccagatct

SEQ ID NO: 79069 - DNA, 98 bp, Homo sapiens
  misc_feature 1..98: note = chr16:54318955-54319053
  misc_feature 1..98: note = hyper
  source 1..98: mol_type = genomic DNA
gtcgccatccctgcgcgccgccccagccagggacagctcaggctcggtggccgcgccgtctaagttctccaaatcgatctcctcgtcctcgtcgtcgt

SEQ ID NO: 79070 - DNA, 295 bp, Homo sapiens
  misc_feature 1..295: note = chr16:54319354-54319649
  misc_feature 1..295: note = hyper
  source 1..295: mol_type = genomic DNA
gagccaggccttcagcgtgctggtgctctccctggtggcgttcttgggacgggacgggtccccgaactggtactggccatacgggtagaaggcggggtgcgggtgcggaaacgcggcagccgcggccggatgctgcaccccggggctgtccttcagctcatactgcgcgccctgtacgcacatggagaaggaagggacacgcgcggagggagcgcgagtgagccccagccatcgctgcctcccccctcctggcctgcacccctctagtccggcccccgcgcgctcagctcgccct

SEQ ID NO: 79071 - DNA, 341 bp, Homo sapiens
  misc_feature 1..341: note = chr16:54320739-54321080
  misc_feature 1..341: note = hyper
  source 1..341: mol_type = genomic DNA
aaatctcgggtctgacgtcgcgccctcttattcgacttttccccgcgtctcttccccgagtcgccaatcgcctgggcgccttacgggcgaggccgcccacccccgcggatcccgcgcgcggggcggggcggggcaggggcgggagccggagcgccgcgagtccctgcccgccccctcctgctcgcgccgggcgggggagcgagaggcgcggggactgggtgagtgcagggtcagctcgcccctcccgcctcccgcccctccgagcctgtccccaggctgaggcgcgggacctgggccgaggctggctccgggagctcccctgtgcccgggccccttttaca

SEQ ID NO: 79072 - DNA, 533 bp, Homo sapiens
  misc_feature 1..533: note = chr16:54321286-54321819
  misc_feature 1..533: note = hyper
  source 1..533: mol_type = genomic DNA
ccttactaaaaatggcgggctggctccgggggctgaagggtggcagcccgggggcactggaagggtagggagccgccacaaatcggtgaagcaggcccgcgccccaggcggctgggaatgggggaggagcagggcgccgggggacggaggccctaggaacttttggagagctcttcgagaagtttctgtattggcgtttttgtctgtggagaaccttccttgcgcgacccctaccccttctcccggtcccggcgctaacctcttttctctctgcaaggatcctcccaccgcctccggtggggatggaaagcaagagttttggtttaatgatgggatatttcctaaatcaaacttgaaatctcaggatcgggcgcccaccttcacggattagggcgtgcagtcgatagcggcattgaaattcccagcattgccgcggctgggggctcagagctttaggccgcggcggcgacccacaagccggccaggcctgcagtgggcacgccccggagacaaaacgggggtggtgactctgc

SEQ ID NO: 79073 - DNA, 53 bp, Homo sapiens
  misc_feature 1..53: note = chr16:54322754-54322807
  misc_feature 1..53: note = hyper
  source 1..53: mol_type = genomic DNA
ttagggactcagtcacgccggcgggtggggggggggggcgcccacagcccagg

SEQ ID NO: 79074 - DNA, 33 bp, Homo sapiens; identical to SEQ ID NO: 36160
  misc_feature 1..33: note = chr16:54325062-54325095
  misc_feature 1..33: note = hyper
  source 1..33: mol_type = genomic DNA

SEQ ID NO: 79075 - DNA, 150 bp, Homo sapiens
  misc_feature 1..150: note = chr16:5439193-5439343
  misc_feature 1..150: note = hypo
  source 1..150: mol_type = genomic DNA
aaataaataaataaataaataaaggtaaggtatgatttttgtgaaaatttcaaagaatgaaggacacaaagaagaaagtggaaatcctcgttctcagcttctcttcctccaatcttacctgcataacaggcttttcgaccttggctctat

SEQ ID NO: 79076 - DNA, 342 bp, Homo sapiens
  misc_feature 1..342: note = chr16:54628674-54629016
  misc_feature 1..342: note = hyper
  source 1..342: mol_type = genomic DNA
tcccgggatagtctacggggagcagagttaatcgaataaactaatcttcgctgtggagattaactctcagtagctgcaggaaaccgggcaagggagaatgcaaatagcagagacctcaaggtgctggaggagttaggaatctcccctccctcactctaacgctgccgccgccgcaccccgccacctccccccctccccacccccgccgcccacccgccctcaggttttaaatttggaagatattgtggaaatggacaaactcgcctttgcctgctgaccagagcccagccccaggcatgaaactgagaaagtgagcagttgcaaggacgtgacgctttcttg

SEQ ID NO: 79077 - DNA, 285 bp, Homo sapiens
  misc_feature 1..285: note = chr16:54962651-54962936
  misc_feature 1..285: note = hyper
  source 1..285: mol_type = genomic DNA
ccagagggcctggcccgggcgggggctcacctctcctccgccgcgcgggcgcgcgggccgcggacgctccctcgtggctggcgcgagcccccggcgggcggcgcgcgcgggccgttaccgaccgttagcgccaggggctgcggctgcggcgggcggagccgggggcgggcgctgaggggccgtggggccgcaagaggcgggagcgaggggagcagggcggggacgctgctcccaggagctcccggcgacgactcgggcctactgcgagcccgggaagaggccgcc

SEQ ID NO: 79078 - DNA, 446 bp, Homo sapiens
  misc_feature 1..446: note = chr16:54963430-54963876
  misc_feature 1..446: note = hyper
  source 1..446: mol_type = genomic DNA
tatatagttatgcttcggcttgcgtgtggccccattatgcgaagttcccgatatcccgagcttccgcggcgtgcccaaacctgtgccatcttctgtcctggttcaccagcgcccctgtctgtcccagagttcgagtgcgtccgtggcttgtggtggcgggaggtggagagaagaggagagggtctgttttgtattctaactgtgtggccgtcgtgggcaagggctctgcctctgactcagttgtgtgtgtttgcttcgccagcgcctcgctgaacaaacagtggttgggttgggcactgctctgcccagtgtttgcagtggagcgtgggcggatgcgagagtgcgtgcgaaggggaaggcgacttagttaaacaaaagggaaggggacccgcaccctccaccaccaccgacttggcggtgcgagctgcgtgcggtgggaaaaccgg

SEQ ID NO: 79079 - DNA, 44 bp, Homo sapiens; identical to SEQ ID NO: 36164
  misc_feature 1..44: note = chr16:54964141-54964185
  misc_feature 1..44: note = hyper
  source 1..44: mol_type = genomic DNA

SEQ ID NO: 79080 - DNA, 163 bp, Homo sapiens
  misc_feature 1..163: note = chr16:54964972-54965135
  misc_feature 1..163: note = hyper
  source 1..163: mol_type = genomic DNA
ccggagccccggagccggggccagaggagcggcggcccagggcagccagaggccaggtgcccgcccgctcgccctcgcagggcgccgcccggctcgttggcggccgcggcgcggcgcgccccatgcccgtgtgtggccatgtcctatccgcagggctacttgt

SEQ ID NO: 79081 - DNA, 93 bp, Homo sapiens
  misc_feature 1..93: note = chr16:54966076-54966169
  misc_feature 1..93: note = hyper
  source 1..93: mol_type = genomic DNA
atctgcatggagggccgggccgccgtggccagatctgcgcacggggtacggacgtgcccgggcagatgggggcctacggggtgacaccgaggc

SEQ ID NO: 79082 - DNA, 500 bp, Homo sapiens
  misc_feature 1..500: note = chr16:54966765-54967265
  misc_feature 1..500: note = hyper
  source 1..500: mol_type = genomic DNA
cgagccccagaagcccgaggacaagggcgaccccgagggccccgaagcaggttggtggacatgggaaagggcgtgttgggcgggagtaaaaaggaaaagagaggcctggagggggcgcgcacggggcctggaggttgggggcaggggtccctgcctttgcgggcgggaaccgggtcccgccgcgcggcctctgcgcccctgacagcctgggtttcgcccgcaggaggagctgagcagaaggcggcttcgggctgcgaacggcttcagggaccacccacccctgcaggcaaggagacggagggcagcctcagcgactcggattttaaggagccgccctcggagggccgcctcgacgcgctgcagggccccccccgcaccggcgggccctccccggctgggccagcggcggcgcggctggcggaggacccggcccctcactaccccgccggagcgccggcgcccggcccgcatccagccgcgggcgaggtgcctccgggtcc

SEQ ID NO: 79083 - DNA, 224 bp, Homo sapiens
  misc_feature 1..224: note = chr16:54971342-54971566
  misc_feature 1..224: note = hyper
  source 1..224: mol_type = genomic DNA
agctagctgccaactcggacggaagcgcggaacagcgcaatgcaaaccgcccaaagtgaaaggaatgtaattgcgctcccatgacagagccagacgcggatgcagtttaggaagggcgccgcctaccggcccctgggagccatgcgattcgaagggagggggacctagaggagacccccgctatccccccacccaccgtggggccttagctttgaactccggcc

SEQ ID NO: 79084 - DNA, 46 bp, Homo sapiens; identical to SEQ ID NO: 36169
  misc_feature 1..46: note = chr16:54972930-54972976
  misc_feature 1..46: note = hyper
  source 1..46: mol_type = genomic DNA

SEQ ID NO: 79085 - DNA, 402 bp, Homo sapiens
  misc_feature 1..402: note = chr16:55090666-55091068
  misc_feature 1..402: note = hyper
  source 1..402: mol_type = genomic DNA
aatcccatcttttcccgcgccccaagcgccgaagccccagaactgccgccggccgggcccatccccagcccaggctcgtaatcaaaaggcagatttccgcgccgggcacctgtttgcagggctgcgcctccttccgctgcggtgttttatctcggcgcggcggtgaataattcatggccccgggtctgctttgcagtcaaacgcgctgcgttctgtccggcgccgccgccgccgcccgccggccgctgtgatttattatttaccaacgcgcggccgcgccgtgtaaggtgagcattgtggctgctcgcagaactgttacaatctggcctcgttagtggcctttcttgctgcatctccaaacagcggccccgcttattgattttcccgcggaacctctgccaa

SEQ ID NO: 79086 - DNA, 82 bp, Homo sapiens
  misc_feature 1..82: note = chr16:5512088-5512170
  misc_feature 1..82: note = hypo
  source 1..82: mol_type = genomic DNA
caacaaaaggtggaacgctgtgcttgcctacatcccatgagcaagcataaaagaaacccagcgagtttctttctttctttct

SEQ ID NO: 79087 - DNA, 244 bp, Homo sapiens
  misc_feature 1..244: note = chr16:55203739-55203983
  misc_feature 1..244: note = hypo
  source 1..244: mol_type = genomic DNA
tacatagagttagagcgcatattttattaatgttcatcctttagagaccagatttgtgcgttcgctaaaataaacactacagtctttagggcgtggttgggtggagactgcagaagtatgagggcaaagaacattttgcaaggaagtagccactccagagccatcgtcgggtgatgggaggcgcccagagctgggatccagggacccggagtcttgcatctactattcacgaattgaatgactt

SEQ ID NO: 79088 - DNA, 129 bp, Homo sapiens; identical to SEQ ID NO: 36171
  misc_feature 1..129: note = chr16:55357444-55357573
  misc_feature 1..129: note = hyper
  source 1..129: mol_type = genomic DNA

SEQ ID NO: 79089 - DNA, 330 bp, Homo sapiens; identical to SEQ ID NO: 36172
  misc_feature 1..330: note = chr16:55357611-55357941
  misc_feature 1..330: note = hyper
  source 1..330: mol_type = genomic DNA

SEQ ID NO: 79090 - DNA, 360 bp, Homo sapiens; identical to SEQ ID NO: 12479
  misc_feature 1..360: note = chr16:55357991-55358351
  misc_feature 1..360: note = hyper
  source 1..360: mol_type = genomic DNA

SEQ ID NO: 79091 - DNA, 110 bp, Homo sapiens; identical to SEQ ID NO: 36174
  misc_feature 1..110: note = chr16:55358566-55358676
  misc_feature 1..110: note = hyper
  source 1..110: mol_type = genomic DNA

SEQ ID NO: 79092 - DNA, 341 bp, Homo sapiens; identical to SEQ ID NO: 36175
  misc_feature 1..341: note = chr16:55358784-55359125
  misc_feature 1..341: note = hyper
  source 1..341: mol_type = genomic DNA

SEQ ID NO: 79093 - DNA, 294 bp, Homo sapiens
  misc_feature 1..294: note = chr16:55362962-55363256
  misc_feature 1..294: note = hyper
  source 1..294: mol_type = genomic DNA
cgacagccagcgctgttgaaggtgcacccccagcccggcctaggccacgaagtcctgagtgccgtatgattcctggacagcctcctgcctctgcccggcgactctcagtccccagagactccgcgtgcgacgagtcttcctgcatacccaaagcctttggaaaccccaagtttgccctgcagggactaccgctgaactgtgcgccgtgcccgcggaggagcgagcctgtagtgcagtgccagtacccgtctggagcagaaggtagtgggcccccagcggcgctgggagtatcta

SEQ ID NO: 79094 - DNA, 527 bp, Homo sapiens
  misc_feature 1..527: note = chr16:55364692-55365219
  misc_feature 1..527: note = hyper
  source 1..527: mol_type = genomic DNA
aggtgcttgagaggtcggtgtgcaggcaaagatgcattgcggccagggattcttgcgacagcgcggcgtgggctgcatacctcagttcctttagtagctgggaaagaaactgacaaggtaacagacaaggccgtggcgcctgcagctcagcggactaaccgctgcgtaaccaatccgtggagccaagctgaccacctcgcgggtcctgcgcatgggaagtggtgggacttgtcaggatgtttatctggaaactgcatctgtttccgggttcgtatttgggttgtaagtttactgggggaggggtgacgaggaccgcgctcctccgatcgaactgaacctaatggggaggtcaggcagctttcagggtcggtgtgaggcgagagggggcattcttcccgttttatcaaaagtgtcagcaaacacttccggtacaggccaaccaatgggaactgacgggcagggaaggggtctttgtcccccttgctaggagtgtcgagcgaccgggttgggggtaagagatttaaaga

SEQ ID NO: 79095 - DNA, 34 bp, Homo sapiens
  misc_feature 1..34: note = chr16:55365434-55365468
  misc_feature 1..34: note = hyper
  source 1..34: mol_type = genomic DNA
cgtttccaacgccgggtcccggccaggccaggcc

SEQ ID NO: 79096 - DNA, 285 bp, Homo sapiens
  misc_feature 1..285: note = chr16:55404915-55405200
  misc_feature 1..285: note = hyper
  source 1..285: mol_type = genomic DNA
cttttgcatcttatacggatagccggctcatggcaatgtgactcaagctggcaggggtctttgagcatcaaacgtgtcctccttccctctacctacttcggctccggtttctctcccgaagcctaaataaagaaggtaacagacaacacctctattggcagaggcttctgccttttccgtcaggctggctgcagcacatccgtaatccttatgtcagcctgcactctagcgttgccggcccggtccagcatctgacagccgcgaatccaaagctgccggcctctc

SEQ ID NO: 79097 - DNA, 43 bp, Homo sapiens
  misc_feature 1..43: note = chr16:55405201-55405244
  misc_feature 1..43: note = hyper
  source 1..43: mol_type = genomic DNA
tttctaagcagcagctcacagcgccagccgccctcccgcagaa

SEQ ID NO: 79098 - DNA, 237 bp, Homo sapiens
  misc_feature 1..237: note = chr16:5541116-5541353
  misc_feature 1..237: note = hypo
  source 1..237: mol_type = genomic DNA
tctgcagtctgtcatcggccgaaacatcgttacatggtgtgtgactatgtaataaacacacaaaaaagcaatcaacgcaagagtacagctggatgaattgtcacagtgtgaacacatctaggacgccagcacccacttgaagaactggaatattaccagccaccccgagccacccacctagcgactcggcagccaccctcccaagcgccacctgactattatcgccaaaggttaatt

SEQ ID NO: 79099 - DNA, 119 bp, Homo sapiens
  misc_feature 1..119: note = chr16:55512644-55512763
  misc_feature 1..119: note = hyper
  source 1..119: mol_type = genomic DNA
cctatccctaaatatcgaaaatttctgtctctgaccatctatcattgtggctgatcatctgtttctgaccattccttcccgttcctgaccccagggagtgcagggtgtcctagccaagc

SEQ ID NO: 79100 - DNA, 429 bp, Homo sapiens
  misc_feature 1..429: note = chr16:55512935-55513364
  misc_feature 1..429: note = hyper
  source 1..429: mol_type = genomic DNA
cggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccggg

SEQ ID NO: 79101 - DNA, 57 bp, Homo sapiens; identical to SEQ ID NO: 36183
  misc_feature 1..57: note = chr16:55513482-55513539
  misc_feature 1..57: note = hyper
  source 1..57: mol_type = genomic DNA

SEQ ID NO: 79102 - DNA, 437 bp, Homo sapiens
  misc_feature 1..437: note = chr16:55514076-55514513
  misc_feature 1..437: note = hyper
  source 1..437: mol_type = genomic DNA
ggagcttggtcaaagcggggcttggcaaatttctaggaaccttcggcacagatccggagagggacctttaaacaaacagctcgagggggccatttgggaagtgattggggcaggagggaagcagagagcgcatcttttttctcctggcttaatggacaaattggtcaagggctgggcctcggaaagtttcctcgaacttctccaaagggtcggagaaaagaaggagagagctggcccggcaggagggaggaggagtggggcaggcgctggagggcccggcgcgtggggcgggggcggactgcgctccgctcgggtcggagagcggccagagagccctccttcctggctgggctcccaaaccgcggttcagatgttgtcttgtgagcgtgcgcgcgcctggctggaggggcactgagcctggccgcagtgttgcgtaa

SEQ ID NO: 79103 - DNA, 170 bp, Homo sapiens
  misc_feature 1..170: note = chr16:5559726-5559896
  misc_feature 1..170: note = hypo
  source 1..170: mol_type = genomic DNA
tgggccaggcgtggacgttaaggccaagatgggcgcatacacaggggagtggatggacccaggaggtactcttggaggcaaagttgacagggcttagtgatgggtatataagtaagggagtgcggggtgtcccagatggtgcccaagaaccttggcgcagacgagtggag

SEQ ID NO: 79104 - DNA, 76 bp, Homo sapiens
  misc_feature 1..76: note = chr16:55689542-55689618
  misc_feature 1..76: note = hyper
  source 1..76: mol_type = genomic DNA
gagctggtgctgcaccggtcgctgcttccccagtccttttttggcctcctttctgacgcgacgcagaccccagttc

SEQ ID NO: 79105 - DNA, 25 bp, Homo sapiens
  misc_feature 1..25: note = chr16:55689876-55689901
  misc_feature 1..25: note = hyper
  source 1..25: mol_type = genomic DNA
taccagcccggcccccgccaggcac

SEQ ID NO: 79106 - DNA, 478 bp, Homo sapiens
  misc_feature 1..478: note = chr16:55689902-55690380
  misc_feature 1..478: note = hyper
  source 1..478: mol_type = genomic DNA
gccagaaccagtcagcccgcgccctgccggccgccccgcgcctccagctcttccccggccccgcccgaacgccacacggcggagcccagccccagcccgcgccctagagcctgccaaggcgccgccggtcgggggccggcagggcgcaaggcaccagggatcccctcgccgccggacacgtgagtgcgccctgagcgcgggacagggctaggtctgcctgggaggcccgggccgagacgcgccagcagagggctagcgagtttgtagtgcagtgacgttaagtgtccgagaaggctcctgtggctgttgaagtgtcgcggacctgagctggggagggggtcggcacgctgccctcagcctcggtgagttcaatcccagccatttggggcaggcgagagtgggtgaacgaggaaaagtgctgcagggtcttcagccgcccccagagggctgtcagaagtctccaactcttgagttccgg

SEQ ID NO: 79107 - DNA, 124 bp, Homo sapiens; identical to SEQ ID NO: 12490
  misc_feature 1..124: note = chr16:55690453-55690577
  misc_feature 1..124: note = hyper
  source 1..124: mol_type = genomic DNA

SEQ ID NO: 79108 - DNA, 48 bp, Homo sapiens
  misc_feature 1..48: note = chr16:55690761-55690809
  misc_feature 1..48: note = hyper
  source 1..48: mol_type = genomic DNA
cgcgcagccccgggagacctggggcaagaagatcgacttcctgctgtc

SEQ ID NO: 79109 - DNA, 418 bp, Homo sapiens
  misc_feature 1..418: note = chr16:56224364-56224782
  misc_feature 1..418: note = hyper
  source 1..418: mol_type = genomic DNA
aaaattcattttgtgcgtttcgaagggggaggacaggagaatttagtgcaaagacggcctccaccaaacgaaaccgtccaacatttgcaaaagcttttaaaataaactgctcagggatcaggggtttgctggaaactcccggtcgcttgaagccctgtccctccactccgggcaccctggcctccccagggtgggcacccctcctgcacggagagcggcggctgggatctcggagcagggtcggctatggccctggaggcagcggctcacagagaaaaagctctggcttttctccgcccgctgcgttcctcttcttacagcctcgggtgtcacatattaggtgctcaataaatgtggacataggaaacgaaaagtccgaatctgtccttacgcccccaaggcgaattctggggcgcgc

SEQ ID NO: 79110 - DNA, 10 bp, Homo sapiens
  misc_feature 1..10: note = chr16:56224783-56224793
  misc_feature 1..10: note = hyper
  source 1..10: mol_type = genomic DNA
ggtttattcc

SEQ ID NO: 79111 - DNA, 39 bp, Homo sapiens; identical to SEQ ID NO: 4358
  misc_feature 1..39: note = chr16:56224794-56224833
  misc_feature 1..39: note = hyper
  source 1..39: mol_type = genomic DNA

SEQ ID NO: 79112 - DNA, 783 bp, Homo sapiens
  misc_feature 1..783: note = chr16:56224880-56225663
  misc_feature 1..783: note = hyper
  source 1..783: mol_type = genomic DNA
cgggcgacaagatggagagccggcccgagagggacagaggccgcgctggcagcgagctggggggcccacctgaccgtcctgcgggcagcccggccccgcgctcccattgacaaggaggtccgcgccgccggcgcgtggggcgggggcggaggcggggtggggcgccccggcgcgcgcccggccccactccccgcccccgccagtcccgcaagcacccaccccgggggagccgcgggccgggagggcgctggggggaggggcaggccgctccgcgagcgcgtgtgcgcgccgccgccggctgacgcgaactccggcgcgcgcctcccccgccccgcgccctccccgtcccgggggcccggcgcgcggccctgctgacgtcagctggcggcccgcggagccgggtgcgcagagccgctggcgcactcgcgcgctgcgctggcctcctccccgccccgggcccaggcgcgcgcgcgcttgttcgctctcccattttttttttcccctccctccctgcctctctctctctccctctccctcgagctcccggctggctgcggctccctggcgctctccctctctctccggtaggctcaccgagcgatgcgagctctgggagacagcgacgccgcctcccgctagagacctgcccctcggcccggccccctgcccaaccctgcccagcgcgcgggggtcggcgaaggcgccgcggacgcaccgacggctgaagagcggcgatgcacatgcactagcagcaccccctaactcactccctccacatcccgc

SEQ ID NO: 79113 - DNA, 158 bp, Homo sapiens
  misc_feature 1..158: note = chr16:56225723-56225881
  misc_feature 1..158: note = hyper
  source 1..158: mol_type = genomic DNA
agccgcggcagcaggacccaccctgccccccaccccaccctctgtcggctccggctgcggctccagcctcgactattattttatttattttgggtcgtgcacaagcctcagtgcctgcagtccgcgcctcctcggcccgcgggcgcctcctcccttgg

SEQ ID NO: 79114 - DNA, 215 bp, Homo sapiens
  misc_feature 1..215: note = chr16:56226149-56226364
  misc_feature 1..215: note = hyper
  source 1..215: mol_type = genomic DNA
gggatgtactctgagcgcagaggagagagccgccctcgagcggagcaaggcgattgagaaaaacctcaaagaggatggcatcagcgccgccaaagacgtgaaattactcctgctcggtaaggaccgccgctgctacccccatcccccgaccccggccactccgcaccccctgccaccagctcccccaccccactcgcgcccgggagacctggtcc

SEQ ID NO: 79115 - DNA, 48 bp, Homo sapiens; identical to SEQ ID NO: 36194
  misc_feature 1..48: note = chr16:56228369-56228417
  misc_feature 1..48: note = hyper
  source 1..48: mol_type = genomic DNA

SEQ ID NO: 79116 - DNA, 14 bp, Homo sapiens
  misc_feature 1..14: note = chr16:56228577-56228591
  misc_feature 1..14: note = hyper
  source 1..14: mol_type = genomic DNA
gggggaggggagtg

SEQ ID NO: 79117 - DNA, 43 bp, Homo sapiens
  misc_feature 1..43: note = chr16:56460223-56460266
  misc_feature 1..43: note = hypo
  source 1..43: mol_type = genomic DNA
atgctacaataggaacgaaccttaaacacgtgctaagtcaaag

SEQ ID NO: 79118 - DNA, 816 bp, Homo sapiens
  misc_feature 1..816: note = chr16:56623053-56623869
  misc_feature 1..816: note = hyper
  source 1..816: mol_type = genomic DNA
aagagctgggaaatacgcaaagcgcctttttctccactttcggagatggtacgtgcgcgcttccacgcagtggcggctgctgcggcgagcacgtcccctgcgggacccacgcggggagtgggctggcagtgcgcgcacagcggcggcgagtgggtcgtgcacgcggatgcggggtgggagtgggggcgcacgcgcgggcgtgggcgagcgggccccggcagtgcacacacacggcaggggcgggcgacagatgcagtgcgtgcgccggagcccaagcgcacaaacggaaagagcgggcgcggtgcgcaggggcgggcgcccagcgggcttggcatgcgcgcccccgcccgaggctataaaagcatcgccacctgctgccactagccaagccgcgcgtccagttgcttggagaagcccgttcaccgcctccagctgctgctctcctcgacatggaccctgagacctgcccctgcccttctggtgagcccccgcccccgctcgcatcctgcgcactgcgcgcccttgtacctgcaaagaaacccacgccctgcgccttcgctcaaggacacttgggggaagggcccctgattccctattcttcacctcgtgaagggcgggcatgcctgtgtcgcggagaacagggagacttggcaccccatctcctcgtgacaggcgtggggacccgagttcgtccacattaacccttcctgtggcgtcgccctctctaggtggctcctgcacctgcgcggactcctgcaagtgcgagggatgcaaatgcacctcctgcaagaagagtgagtgcggggacccttcccc

SEQ ID NO: 79119 - DNA, 125 bp, Homo sapiens
  misc_feature 1..125: note = chr16:56650999-56651124
  misc_feature 1..125: note = hyper
  source 1..125: mol_type = genomic DNA
aggcctacccagggacgaagctggggttgcacaccggctccgggaatggcgaaataccgcagatggggtggtgggggtgggaatatcgcgaccaccagaggctgggttcccggaacgctcgggga

SEQ ID NO: 79120 - DNA, 127 bp, Homo sapiens
  misc_feature 1..127: note = chr16:56651238-56651365
  misc_feature 1..127: note = hyper
  source 1..127: mol_type = genomic DNA
cgggtgccaagcaagagacccgcggtgcacaccttgcgcccggccggcctgctgctcacagtccctccacgtacccacaggaggcccagactcagcggggcgggtgcaagcgcggggcggggcctct

SEQ ID NO: 79121 - DNA, 715 bp, Homo sapiens
  misc_feature 1..715: note = chr16:56659106-56659821
  misc_feature 1..715: note = hyper
  source 1..715: mol_type = genomic DNA
ccgatccgtgttccccgtgttgctatgtaaggaggtgcgggaccgaggaacctaggtgtggacagggacaggcaaggcgggggacgaagagaaatgaaagccacatcggtggcggatgttctgaacacaactcgctcgctaccgcacgttccccgctccgcactcagcggatcccgggacggcagcaggtgggctgcacacggactctgggacaagtcgagctgaaaaccgcggagctaggggtggggtggagacgcccgcgacgccaaggctggggtcccggaacacgctgggaggagggtggaaggcaacctcggggaaactgggaaaggcggcctggacttcgggaacaccgcgtacctgcgggggcacagccccacccgagcgaacgggctccaaaggggaggtcccgcggtgcccaccgcgcagagctcagggggtggtgcgcccggcccttctgcggcgcacagcccagcccaggaacgcgggcggtgcggactcagcgggccgggtgcaggcgcggagctgggcctctgcgcccggcccgacctccgtctataaatagagcagccagttgcagggctccattctgctttccaactgcctgactgcttgttcgtctcactggtgtgagctccagcatcccctttgctcgaaatggaccccaactgctcttgcgccactggtaagggaagctctgcgccctggaatcccc

SEQ ID NO: 79122 - DNA, 649 bp, Homo sapiens
  misc_feature 1..649: note = chr16:56665943-56666592
  misc_feature 1..649: note = hyper
  source 1..649: mol_type = genomic DNA
ggcgaagagaatggacgggagagagaggccgaccagtgttccccgtgttgctgtgtacggaggagccagtccgagggaccgcggtgtggacagggacaggcaaggcggggaaggaggagaaacgaaagccacattggtggcgggtgctctgcacacgactcgctccctaccacacgccccccgctccgcacacgaccgatccggggactggagcaggagggctgcaccgggactccgggacaggcccagttgaaaacggcggggcgagggggtggggtggagacgcccgcgacgccaaggctggggtcccggaaagcgcggggaggagggtggaaggcaaaggcaacttcggggaaactgggaaaggcggccgggacctcggggacactgcgtaccacccggcgcacagcccctcccgcgcaaacccgagccaaaggggcggtcgagcggcgcactcggagcggagctcaggggatggtgcgcccggcacttatgctgggctcagcccagcccagcccaggaccgctggcggtgcgaacccagccgggcgggtgcaagcgcggggcagggcctctgcgcccggccccctcccctgagtagaaaagcagccgcaggctgtggcgctccaccacgccgtccgggtgggcct

SEQ ID NO: 79123 - DNA, 59 bp, Homo sapiens
  misc_feature 1..59: note = chr16:56672114-56672173
  misc_feature 1..59: note = hyper
  source 1..59: mol_type = genomic DNA
cgctctgcactacgccgatccggggacaggagcaggaggctgtggctgcactcagactt

SEQ ID NO: 79124 - DNA, 165 bp, Homo sapiens; identical to SEQ ID NO: 36202
  misc_feature 1..165: note = chr16:56672221-56672386
  misc_feature 1..165: note = hyper
  source 1..165: mol_type = genomic DNA

SEQ ID NO: 79125 - DNA, 172 bp, Homo sapiens
  misc_feature 1..172: note = chr16:56672513-56672685
  misc_feature 1..172: note = hyper
  source 1..172: mol_type = genomic DNA
cgggtcctttgcgtccggccctctttcccctgaccataaaagcagccgctggctgctgggccctaccaagccttccacgtgcgccttatagcctctcaacttcttgcttgggatctccaacctcaccgcggctcgaaatggaccccaactgctcctgcgccactggtaaggg

SEQ ID NO: 79126 - DNA, 451 bp, Homo sapiens
  misc_feature 1..451: note = chr16:56677117-56677568
  misc_feature 1..451: note = hyper
  source 1..451: mol_type = genomic DNA
cctcgctgcgcttcccgcctcggtcttatctggggacgtgagcactaggctggggtagcacatggactcccacagagccgaagctcacgtcactggtgcggggtgcgggggtggggataccgcgaccacctgaggctgggttcccggaccgcccaagggcaggaatggagtgcaatctccgggaaattcgggagggccgggattatagcagggacgccgcgtaccgccaggagcacagcccctccaaagcgagcgtgagccaaagggccgcccccagggtgcgcaacagccacgttaaggaggatcctgcgcccggcccgcctggtgcgcacagccccgccctgaaccctgggcagcgctgacactgagctgggctggtgcgagacctggggcggggccactgcacccagcaccctgccctgactgtaaagtcaggcggcctgctcctgtt

SEQ ID NO: 79127 - DNA, 74 bp, Homo sapiens
  misc_feature 1..74: note = chr16:56692017-56692091
  misc_feature 1..74: note = hyper
  source 1..74: mol_type = genomic DNA
gtgcctggggatgctcgattcccagacaccatagagagtgttcctgggtttgagaaggtcgtattttgagatct

SEQ ID NO: 79128 - DNA, 265 bp, Homo sapiens
  misc_feature 1..265: note = chr16:56701956-56702221
  misc_feature 1..265: note = hyper
  source 1..265: mol_type = genomic DNA
ggtgcacgtggaaggcggagtggagcccaacagccagcggctgtttttatagtcaggagacggggccgggcgcagacgccccgccccgcccttgcacccagcccgctgagtccgcaccgcccgcggtcccggcctgggctgtgcgcaggagatgggccaagtgcaaggtcccttgagcgcagctgggcgcacaccgcaggacggcccctttcgcaccggctcgcgagggaggcgctgtgccccccgtgtgcggcttctctcaccc

SEQ ID NO: 79129 - DNA, 27 bp, Homo sapiens
  misc_feature 1..27: note = chr16:56703372-56703399
  misc_feature 1..27: note = hyper
  source 1..27: mol_type = genomic DNA
ggggtgggcaggccccggggtgtgggg

SEQ ID NO: 79130 - DNA, 79 bp, Homo sapiens; identical to SEQ ID NO: 36206
  misc_feature 1..79: note = chr16:56709814-56709893
  misc_feature 1..79: note = hyper
  source 1..79: mol_type = genomic DNA

SEQ ID NO: 79131 - DNA, 100 bp, Homo sapiens; identical to SEQ ID NO: 12506
  misc_feature 1..100: note = chr16:56709949-56710049
  misc_feature 1..100: note = hyper
  source 1..100: mol_type = genomic DNA

SEQ ID NO: 79132 - DNA, 27 bp, Homo sapiens
  misc_feature 1..27: note = chr16:56774935-56774962
  misc_feature 1..27: note = hypo
  source 1..27: mol_type = genomic DNA
ggagagggagagcgctaaatttctttt

SEQ ID NO: 79133 - DNA, 30 bp, Homo sapiens
  misc_feature 1..30: note = chr16:57017302-57017332
  misc_feature 1..30: note = hypo
  source 1..30: mol_type = genomic DNA
cctgagattatcactcgagatgtgagtaca

SEQ ID NO: 79134 - DNA, 30 bp, Homo sapiens
  misc_feature 1..30: note = chr16:5703116-5703146
  misc_feature 1..30: note = hypo
  source 1..30: mol_type = genomic DNA
ggtggggtgctgagccgtgtgctggccttc

SEQ ID NO: 79135 - DNA, 216 bp, Homo sapiens
  misc_feature 1..216: note = chr16:57222193-57222409
  misc_feature 1..216: note = hypo
  source 1..216: mol_type = genomic DNA
tactagtgtttggttcgtcgtacttgttagagatggttttccaaatatcgggcaatcatttcctgggatggtatcttgctttgtagatccctctatgagattgtaagagacttgtgtccctgtatgacattttactagtgtttggttcgtcgtacttgttagagatggttttccaaatatcgggcaatttatatgggattttttccgaagtaattt

SEQ ID NO: 79136 - DNA, 35 bp, Homo sapiens
  misc_feature 1..35: note = chr16:57222709-57222744
  misc_feature 1..35: note = hypo
  source 1..35: mol_type = genomic DNA
gagccactgtgtctgcctttcgaagtaatttttgt

SEQ ID NO: 79137 - DNA, 35 bp, Homo sapiens
  misc_feature 1..35: note = chr16:57299645-57299680
  misc_feature 1..35: note = hypo
  source 1..35: mol_type = genomic DNA
gacagggcaggaggccgggtgcagtggctcacacc

SEQ ID NO: 79138 - DNA, 82 bp, Homo sapiens
  misc_feature 1..82: note = chr16:57321270-57321352
  misc_feature 1..82: note = hypo
  source 1..82: mol_type = genomic DNA
tcccactgtctggtggggatgagaagtaataaacccgggaggaataatactttcagatagtgacaaacgctgtgactaaagt

SEQ ID NO: 79139 - DNA, 23 bp, Homo sapiens
  misc_feature 1..23: note = chr16:57457827-57457850
  misc_feature 1..23: note = hypo
  source 1..23: mol_type = genomic DNA
tacaaatccactggtcgggcgtg

SEQ ID NO: 79140 - DNA, 30 bp, Homo sapiens
  misc_feature 1..30: note = chr16:57656267-57656297
  misc_feature 1..30: note = hypo
  source 1..30: mol_type = genomic DNA
tttgagccccccaaccgctggggctcctcc

SEQ ID NO: 79141 - DNA, 37 bp, Homo sapiens
  misc_feature 1..37: note = chr16:5769148-5769185
  misc_feature 1..37: note = hypo
  source 1..37: mol_type = genomic DNA
ggcttagcgtatctacggagttggaaggctgccaccc

SEQ ID NO: 79142 - DNA, 30 bp, Homo sapiens; identical to SEQ ID NO: 16055
  misc_feature 1..30: note = chr16:57759922-57759952
  misc_feature 1..30: note = hypo
  source 1..30: mol_type = genomic DNA

SEQ ID NO: 79143 - DNA, 30 bp, Homo sapiens
  misc_feature 1..30: note = chr16:57935550-57935580
  misc_feature 1..30: note = hypo
  source 1..30: mol_type = genomic DNA
ggtcagaggcaaggccgggccccaccccag

SEQ ID NO: 79144 - DNA, 199 bp, Homo sapiens
  misc_feature 1..199: note = chr16:57937598-57937797
  misc_feature 1..199: note = hypo
  source 1..199: mol_type = genomic DNA
acaggccccagtactcgggacctcagagacacagaggacgagggaggcgccccgaaggcatggcaccgggcaccaggcgacaggagttgactgggagctggtggctgccagggcgtgaccatcttacccagcatgccttgcgagtgccaggtgtactcgtaccaggtcttgacgcggttctgcacggacttggggatct

SEQ ID NO: 79145 - DNA, 933 bp, Homo sapiens
  misc_feature 1..933: note = chr16:58018551-58019484
  misc_feature 1..933: note = hyper
  source 1..933: mol_type = genomic DNA
acaggccagaagcttcgcaacaggtaccacgagggaaagctggcgcccatcgcgccaggcatcaaccgagtggactggccctgcttcacgcgcgccatcgaggactggtcccacttcgtgtcctcggccggggagttcaagctgccttgcctgaggaagcgaggtcagtctacgggccgctgaaggaactgccgggcaggtgggccgcggggctggagcagggaacgtggactgcggacgggaacgcaggcggcgggccaggcagaaacagggcggggccgctgagatgaagctgtggcacttgcggtgggtggagccgagacgtgcgcgcggatctggaggcaggactgcccttggggagggggcggagccaggcggagccttcgggccgggggctttgccctggtggggcagcggaggcgggacctgttctccgtacacgtgtgggtggggctggattgtgggcggggctggattgtgggcggggcttagatgaggaggcggggcttgtcctgggggggggcggatgagcgctcgagaggggctttctgttcgcagcggagggtctcagcggctacgcggtgcggtacttgaagcccgacgtgacccagacctggcgggtagggagcgctgcgcgcagacccgtccctgagcggggagcgggggtcctggtggggagcggcttaagccgggggttgaggggggaggagacccagagcagggcctcccagtcttcaggaccacggtctctagcaggaagccctgtgtggggcgtgggcagggcgtccgtgctcccccgactcaccgcgcccctatccctgctgcccgcctcagtactgcctcagccagaaccccagcctggaccgctacggacagaagcccctgcctttcgactccctgtaagtgacgccacgcgcccggggaccccatatc

SEQ ID NO: 79146 - DNA, 103 bp, Homo sapiens
  misc_feature 1..103: note = chr16:58061004-58061107
  misc_feature 1..103: note = hyper
  source 1..103: mol_type = genomic DNA
ctttctgcgcttttgcgaggaagcctaggcacgcccgggcggggtcctaaggacggaccctgcctcccacagcgcttcctcccaacagcgcccctacgtcgaa

SEQ ID NO: 79147 - DNA, 122 bp, Homo sapiens; identical to SEQ ID NO: 44712
  misc_feature 1..122: note = chr16:58120963-58121085
  misc_feature 1..122: note = hypo
  source 1..122: mol_type = genomic DNA

SEQ ID NO: 79148 - DNA, 50 bp, Homo sapiens
  misc_feature 1..50: note = chr16:58192290-58192340
  misc_feature 1..50: note = hypo
  source 1..50: mol_type = genomic DNA
attaatcaacctgagcgggcgaggggaggcctccacgtgtaggagggcct

SEQ ID NO: 79149 - DNA, 214 bp, Homo sapiens
  misc_feature 1..214: note = chr16:58427268-58427482
  misc_feature 1..214: note = hypo
  source 1..214: mol_type = genomic DNA
tggtgagctgggattcggaacccaaggccatatggcttcaaatataaaattgtcccaggaacatggcttgtaatgattaatttggatatcctgtttcacctaagttttgtatagaacgatgtttattgtttggtctgtttgtttcaagttaatttttatcaaagtaatacataaccaacgttttaaaagtcaaataggccggatgcggtggctc

SEQ ID NO: 79150 - DNA, 23 bp, Homo sapiens
  misc_feature 1..23: note = chr16:58462000-58462023
  misc_feature 1..23: note = hypo
  source 1..23: mol_type = genomic DNA
taatacatcgtggacatccttcc

SEQ ID NO: 79151 - DNA, 122 bp, Homo sapiens; identical to SEQ ID NO: 12509
  misc_feature 1..122: note = chr16:58497214-58497336
  misc_feature 1..122: note = hyper
  source 1..122: mol_type = genomic DNA

SEQ ID NO: 79152 - DNA, 1116 bp, Homo sapiens; identical to SEQ ID NO: 36210
  misc_feature 1..1116: note = chr16:58497469-58498585
  misc_feature 1..1116: note = hyper
  source 1..1116: mol_type = genomic DNA

SEQ ID NO: 79153 - DNA, 64 bp, Homo sapiens; identical to SEQ ID NO: 12512
  misc_feature 1..64: note = chr16:58498586-58498650
  misc_feature 1..64: note = hyper
  source 1..64: mol_type = genomic DNA

SEQ ID NO: 79154 - DNA, 119 bp, Homo sapiens
  misc_feature 1..119: note = chr16:58499185-58499304
  misc_feature 1..119: note = hyper
  source 1..119: mol_type = genomic DNA
caggaccttaatgtccgatgagggagcagagccccggagccctgttacaaggctggaaggggcagccgtctgtgggtgcgctcaggaaacggtggaatccgagtcgggggcagcttttg

SEQ ID NO: 79155 - DNA, 44 bp, Homo sapiens
  misc_feature 1..44: note = chr16:58540563-58540607
  misc_feature 1..44: note = hypo
  source 1..44: mol_type = genomic DNA
ccctcccagctggctcggtaggaggcaggcgagtgtctttggca

SEQ ID NO: 79156 - DNA, 97 bp, Homo sapiens
  misc_feature 1..97: note = chr16:58548289-58548386
  misc_feature 1..97: note = hypo
  source 1..97: mol_type = genomic DNA
gtattatcttagtttcgcaggtgaggagactaaggttcaggaaaaaggatttgcctgagtaacagaccaggccgcgcgcggtggctcacgcctgtaa

SEQ ID NO: 79157 - DNA, 87 bp, Homo sapiens
  misc_feature 1..87: note = chr16:58549151-58549238
  misc_feature 1..87: note = hyper
  source 1..87: mol_type = genomic DNA
agaagcctcagccctcggggacagaccgaaggccagggctgtacctggctcagaaccaggcgccaagcggcacgggactctccttct

SEQ ID NO: 79158 - DNA, 50 bp, Homo sapiens
  misc_feature 1..50: note = chr16:58550442-58550492
  misc_feature 1..50: note = hypo
  source 1..50: mol_type = genomic DNA
gatttggccaacatccgcagcgagtaccagtccatcgtgctgcccttcat

SEQ ID NO: 79159 - DNA, 145 bp, Homo sapiens
  misc_feature 1..145: note = chr16:58831937-58832082
  misc_feature 1..145: note = hypo
  source 1..145: mol_type = genomic DNA
tgcatattcaggcatcgcatgtagtttgttttcttatttcaagagttatatatgcattccgaatacagtttttctgtcagatatcggatttgcaagtattttccttcatggaatgttgaattgcagtgataagagtgtaattttt

SEQ ID NO: 79160 - DNA, 35 bp, Homo sapiens
  misc_feature 1..35: note = chr16:58850468-58850503
  misc_feature 1..35: note = hypo
  source 1..35: mol_type = genomic DNA
caggcgcccgctaccacgcccgaagctgccagttt

SEQ ID NO: 79161 - DNA, 20 bp, Homo sapiens
  misc_feature 1..20: note = chr16:58886050-58886070
  misc_feature 1..20: note = hypo
  source 1..20: mol_type = genomic DNA
aatgctggtcaggcacggtg

SEQ ID NO: 79162 - DNA, 33 bp, Homo sapiens
  misc_feature 1..33: note = chr16:58886324-58886357
  misc_feature 1..33: note = hypo
  source 1..33: mol_type = genomic DNA
taaaaaaaaaagaggggacgttgaaagtggcca

SEQ ID NO: 79163 - DNA, 27 bp, Homo sapiens
  misc_feature 1..27: note = chr16:58932088-58932115
  misc_feature 1..27: note = hypo
  source 1..27: mol_type = genomic DNA
tttgcctaggctgagcgcagtggtgtg

SEQ ID NO: 79164 - DNA, 61 bp, Homo sapiens
  misc_feature 1..61: note = chr16:58969757-58969818
  misc_feature 1..61: note = hypo
  source 1..61: mol_type = genomic DNA
ctgtaggtagtggaacgaagcgatgttccaaatttcatggggctgccgaagaggcttgcag

SEQ ID NO: 79165 - DNA, 38 bp, Homo sapiens; identical to SEQ ID NO: 16056
  misc_feature 1..38: note = chr16:59046529-59046567
  misc_feature 1..38: note = hypo
  source 1..38: mol_type = genomic DNA

SEQ ID NO: 79166 - DNA, 30 bp, Homo sapiens
  misc_feature 1..30: note = chr16:59182473-59182503
  misc_feature 1..30: note = hypo
  source 1..30: mol_type = genomic DNA
tttctcatattttaacgagaaacagcagaa

SEQ ID NO: 79167 - DNA, 30 bp, Homo sapiens
  misc_feature 1..30: note = chr16:5950685-5950715
  misc_feature 1..30: note = hypo
  source 1..30: mol_type = genomic DNA
ctccagcaagtcatgcggggttcttgggga

SEQ ID NO: 79168 - DNA, 28 bp, Homo sapiens
  misc_feature 1..28: note = chr16:60166000-60166028
  misc_feature 1..28: note = hypo
  source 1..28: mol_type = genomic DNA
gcgtgagccaccgcgtcaggccgaaagc

SEQ ID NO: 79169 - DNA, 28 bp, Homo sapiens
  misc_feature 1..28: note = chr16:6068899-6068927
  misc_feature 1..28: note = hyper
  source 1..28: mol_type = genomic DNA
aggagaccagggtaccgggtcgcgtgtc

SEQ ID NO: 79170 - DNA, 41 bp, Homo sapiens
  misc_feature 1..41: note = chr16:6068936-6068977
  misc_feature 1..41: note = hyper
  source 1..41: mol_type = genomic DNA
cgcccgctggaatccagggctgcacgcgtgaccgcggcggc

SEQ ID NO: 79171 - DNA, 60 bp, Homo sapiens
  misc_feature 1..60: note = chr16:6069492-6069552
  misc_feature 1..60: note = hyper
  source 1..60: mol_type = genomic DNA
ccccccagcagcacccgcggtggggcgggggcgctctgccagccccgggaacagcagagg

SEQ ID NO: 79172 - DNA, 17 bp, Homo sapiens
  misc_feature 1..17: note = chr16:6069577-6069594
  misc_feature 1..17: note = hyper
  source 1..17: mol_type = genomic DNA
cgcgcctccggggctga

SEQ ID NO: 79173 - DNA, 202 bp, Homo sapiens
  misc_feature 1..202: note = chr16:6070067-6070269
  misc_feature 1..202: note = hyper
  source 1..202: mol_type = genomic DNA
gaagcgctaggtccccgagaactggcctcctcctagcgccagtctgggcgctctggacgggaactttttcagggtgtgtggaaagatctcgaggcgtgtccccccctacccccaggaggccgagaccctgagcccccttgtgcgtcgcttccagaagcacgtccttccttgccccagagcgcccctccgaagcatccaggct

SEQ ID NO: 79174 - skipped

SEQ ID NO: 79175 - DNA, 39 bp, Homo sapiens
  misc_feature 1..39: note = chr16:607668-607707
  misc_feature 1..39: note = hypo
  source 1..39: mol_type = genomic DNA
actggccatgccgagcgctgcctccgctgccttctctga

SEQ ID NO: 79176 - DNA, 451 bp, Homo sapiens
  misc_feature 1..451: note = chr16:609865-610316
  misc_feature 1..451: note = hyper
  source 1..451: mol_type = genomic DNA
gcaaggaagggagcccggctccgctggctcagtccgcggcacccctgtcccccaggacagcccccaggggccctggctcgggtgggccggcggctgtcaggggccagagccctgatggataagcgctgacggcccctctcccgcgccccgcgccgctgacacccatcacgccgcggcggggacccgggagacctggcggcctctgtgcacccccgcggcagcctgcgggcaacgggggcgggaggcgccgggcgcccctgactcggccgcacacctgcgccgcagtccgctctccgtccgctgcctcccgggttcccggccgctccaccgcgcgccccgagagctgagccggtcccggcgcacgaggccggtgagtgcgcgccagggggcggcggggggcgcgcgggcggcgggggcgcggggttcgggccgggggctgctccttccctcc

SEQ ID NO: 79177 - DNA, 158 bp, Homo sapiens; identical to SEQ ID NO: 35998
  misc_feature 1..158: note = chr16:610343-610501
  misc_feature 1..158: note = hyper
  source 1..158: mol_type = genomic DNA

SEQ ID NO: 79178 - DNA, 205 bp, Homo sapiens
  misc_feature 1..205: note = chr16:611376-611581
  misc_feature 1..205: note = hypo
  source 1..205: mol_type = genomic DNA
gggtgatcgatggcccggcacagccgcctctgtcgccggagcgcccacacccatttgtcatccacatgggtggggggggcggcgggcagggagaaggggccgcctctgcacccaccacccagtccaggccgggtctgcagcccctcggggagccccaggacctctcctggcccagcccctgcctcccgaccgccaccctgtctca

SEQ ID NO: 79179 - DNA, 370 bp, Homo sapiens
  misc_feature 1..370: note = chr16:611950-612320
  misc_feature 1..370: note = hypo
  source 1..370: mol_type = genomic DNA
gtgcagccagggccccgcacttggtggcagactccgttctgagcttaggtggcacagaggtggcttctccgggcactgggtgagggctctgtgtgagcctgtgggctgtgtacacacacccaaagcccgtgtgcgcaggcgtgctgtgcaccccacacaggcgcgtgctggggcggtggacagcccaggtggcggcccagatggagtgtggcgcgcataccagcgccgtgtggggcgtggggaggagcgggtcttggctgagtgtggccgctgcaggctcggccgctgacctgcccgaagccacccagatggagctgggctgagcaggtggctgagccgtggggccatgctgggacgtccactccccaca

SEQ ID NO: 79180 - DNA, 287 bp, Homo sapiens
  misc_feature 1..287: note = chr16:612869-613156
  misc_feature 1..287: note = hypo
  source 1..287: mol_type = genomic DNA
gtgtgtagggtcaaccgataaaataaaggacgcctagttaaaatcgaatttccgataaacaatgaacacctttctagtgtgcctttccaatattgcctaggctacacttaacactcagaaatgacgtgctgctgatcggcgtcagatgcagctcgctgtcctggacttttttttttttttttggtgccctggactttgctgccaccctggaagtgcacgtggggaggagccgaaggatggggctcggggggcacgttgcagggcagaggcggcggggtggggggagc

SEQ ID NO: 79181 - DNA, 496 bp, Homo sapiens
  misc_feature 1..496: note = chr16:613552-614048
  misc_feature 1..496: note = hypo
  source 1..496: mol_type = genomic DNA
gcacccaccccagaccgccctggggagtccgaccccggcaggcaaccccagggagcacggcccacaggtgctgcccccgcgcctgacctcgtggtcgccgacatccactccctgcactgtggcggaggccccaagtccagggccaaggggtccccagggccaccaccccctgtggctagggccacccggaagggtcccggccccagtgggctcctgcctgagtcgtggaagccggggatgggaggggacccaaggggcgtgggtgcgggggacatggcctcagcaggccctgagggcagcgtcccctgctatcccccgcctgccccaggggagttccctgaggcccacagcctccacctgtctctgctgggcgtcaactacccgctcagccccggcctcttctcctacttggggccctcactggccgctgcagcccatgtgcccttcctggcctcggccagccccctgctgcccccggccacggccttcccagccg

SEQ ID NO: 79182 - DNA, 30 bp, Homo sapiens; identical to SEQ ID NO: 44404
  misc_feature 1..30: note = chr16:614353-614383
  misc_feature 1..30: note = hypo
  source 1..30: mol_type = genomic DNA

SEQ ID NO: 79183 - DNA, 502 bp, Homo sapiens
  misc_feature 1..502: note = chr16:614755-615257
  misc_feature 1..502: note = hypo
  source 1..502: mol_type = genomic DNA
ctccccctgcagccacggggcccagtgccaggaagcccggagcatgtgggcgaggacctgacccgagccctcggtgactacgccagggtggagcagcgcctgggacagttggggcccgcggggggcctggccccgagacccctgcgggagcagctgggcaagatccgcctggagctgctcaccattcaccaggcgctggagcaggccgtgaggccgccagacgcacccctcgacctctctgtgaaacgtgcgcccgccaaggggccccaggctcttggagaggcgtgggggcggcccgagctgggtcccgtgttgaccgggggcacccccgagccacccggcatgctgggccctgcagcgccccaacccttctctggccacaccaccaagtgtgaggccgactccagcgtcccacccccagggctccccctcgcagccccagatgaccctgtcattcctggcagtggctggggcacctgtgttgcgacgaggagttcccaga

SEQ ID NO: 79184 - DNA, 30 bp, Homo sapiens
  misc_feature 1..30: note = chr16:61479596-61479626
  misc_feature 1..30: note = hypo
  source 1..30: mol_type = genomic DNA
ccagcacaatccagacgcgcaactcttcca

SEQ ID NO: 79185 - DNA, 30 bp, Homo sapiens; identical to SEQ ID NO: 44589
  misc_feature 1..30: note = chr16:6186354-6186384
  misc_feature 1..30: note = hypo
  source 1..30: mol_type = genomic DNA

SEQ ID NO: 79186 - DNA, 85 bp, Homo sapiens; identical to SEQ ID NO: 36213
  misc_feature 1..85: note = chr16:62068463-62068548
  misc_feature 1..85: note = hyper
  source 1..85: mol_type = genomic DNA

SEQ ID NO: 79187 - DNA, 75 bp, Homo sapiens; identical to SEQ ID NO: 36214
  misc_feature 1..75: note = chr16:62069009-62069084
  misc_feature 1..75: note = hyper
  source 1..75: mol_type = genomic DNA

SEQ ID NO: 79188 - DNA, 138 bp, Homo sapiens; identical to SEQ ID NO: 12513
  misc_feature 1..138: note = chr16:62069136-62069274
  misc_feature 1..138: note = hyper
  source 1..138: mol_type = genomic DNA

SEQ ID NO: 79189 - DNA, 99 bp, Homo sapiens
  misc_feature 1..99: note = chr16:62069336-62069435
  misc_feature 1..99: note = hyper
  source 1..99: mol_type = genomic DNA
cgcagggcgactccggagcccggcaagtttgtagcgggcaccgcacctcccagagctggagctgccacttgtgggaaagcctcgcgctggggctttcgc

SEQ ID NO: 79190 - skipped

SEQ ID NO: 79191 - DNA, 43 bp, Homo sapiens; identical to SEQ ID NO: 36217
  misc_feature 1..43: note = chr16:62070743-62070786
  misc_feature 1..43: note = hyper
  source 1..43: mol_type = genomic DNA

SEQ ID NO: 79192 - DNA, 55 bp, Homo sapiens
  misc_feature 1..55: note = chr16:623234-623289
  misc_feature 1..55: note = hypo
  source 1..55: mol_type = genomic DNA
gtttctccacacctccgggacctgtaagcctctctctccccgtttctaggcaccc

SEQ ID NO: 79193 - DNA, 28 bp, Homo sapiens
  misc_feature 1..28: note = chr16:62670669-62670697
  misc_feature 1..28: note = hypo
  source 1..28: mol_type = genomic DNA
ccagtggcgctatcccggctcactgcaa

SEQ ID NO: 79194 - DNA, 30 bp, Homo sapiens; identical to SEQ ID NO: 44590
  misc_feature 1..30: note = chr16:6314961-6314991
  misc_feature 1..30: note = hypo
  source 1..30: mol_type = genomic DNA

SEQ ID NO: 79195 - DNA, 112 bp, Homo sapiens
  misc_feature 1..112: note = chr16:643882-643994
  misc_feature 1..112: note = hypo
  source 1..112: mol_type = genomic DNA
cctgggtgatggtggcgagttacccggcaggaattatgcttcatccaggagtgtgggtggtgcacgcggcggggaggagaaagctgcagttcaggagcgaacctgcagtcag

SEQ ID NO: 79196 - DNA, 30 bp, Homo sapiens
  misc_feature 1..30: note = chr16:64407177-64407207
  misc_feature 1..30: note = hypo
  source 1..30: mol_type = genomic DNA
tgaatttgatcaatacgatgaactaaggct

SEQ ID NO: 79197 - DNA, 767 bp, Homo sapiens
  misc_feature 1..767: note = chr16:65154509-65155276
  misc_feature 1..767: note = hyper
  source 1..767: mol_type = genomic DNA
ttagggataacccgtcgtcaggcagggatggtattaaataattaaaagatgcgatttcttaatagcagtgtgatggcccatgaaattcctactgcattatcagcaaaagcaacagggcttcttctagcacctagaaaacctttcacccgggagaggcaggcgcggcgagccccgggcgaaagcagggcctcggcaaaaaaacggacaaggaagccggacccgcaagcctcccccgaccccactttctctggggactccgcttcacagcgtgaggcgggccctcctacagttcctctgggttggggaggggggagaagggagctctcctcgccgtcctccccatctggccagcttctcagtgcttcccacctcccggctcgcgttccggggcagagcgcagggagggaggccgtgcgtgccgggagctagagaggcttggcgcgctccgagaagcggcgcaggtttcgggaaggtgtggttctcaaagttaacgttgaccctggcagctttcgccaatcccaagccagaggcgagcccgagtctgggccgctcatggacctactcctgcgctggtgggagcttacaaacgggcgccagagctcccgcagagactcgggctggagggctgtagcgcaccgcagcctgctgccccagaaccacagtcggcggccccaaacccacgctattaaagtgcgggcaatctccttccggagctggggtctttccgttttcccgggcttacccggcagtctcgactgcagggacta

SEQ ID NO: 79198 - DNA, 1218 bp, Homo sapiens
  misc_feature 1..1218: note = chr16:65155677-65156895
  misc_feature 1..1218: note = hyper
  source 1..1218: mol_type = genomic DNA
ctcaccaccccgccccgccaagacattctcttcctgagaaaatcctgccccccattccaagaagccccaaccaggcgagaggaagggactggcggcgcacctcacctggggcccttgagggtggacgcaacctccgagccgccagtccctggcgcagggcaagcgctgcggtgtcagtcccggccccagtcccggtcccattcacaagtcagcggcggctgcgagcggcccccgcggcatctgctcctcggcccgcgacgctcccctcagctggcggcggccgcggaatgagccgccgagcgcgctagtggcaggaatgagaaaccggggggaggtggcgggcgggcaggcgggtgcggggcggggggggcgggaggagggaggctgccgctgtgagggaaggaaagggcgggggctgagagaagccgaggctgcgagaggcagcgagatgggcctcgcagaggctgcgggggccgaccccgtccgcgcccctccccccaggggcccagagatgctaacccctggattcgtggccgcccctcccgccccgtggcgcggcgctccgactccctcagggctcagatggagtctggagcgactgaagttgggctccagggacgcacagccaatcagggagggcggcggagggaagctggagaggggttgggagcccccattttcctccttcccccaaatccgctccagctggccaggctgggctctcgcctggcgggccgggatggtggttgggggaaggtatcgtccaagtgagggaagcaattgggaattcgggagcgcgttctattctttctcactccaccaccccaccttccaaaaatccctcaacgttggcggctcctgcccagcccccacccctctcaatctcccatcccttgcaaactcttctggtggctctggtggtgaagtcgggcggggagggagacttaggacttgggaagagcccagtctccgttctctctcagctctcctctcgtctagtgccccccacgcaacgcctcggagaggggtgcgcggggagcgcttcgccggggtcggcctcgctccagcttttgggagggtgccttggcccctaccccagccaggtatcagtggcccccgccggtagtgtcacttgttgccactccctcgctacagacccgccagggcccggtggagtgtgcgtttctacgggagaaagggcctaatggggcgcagcgc

SEQ ID NO: 79199 - DNA, 378 bp, Homo sapiens
  misc_feature 1..378: note = chr16:65156939-65157317
  misc_feature 1..378: note = hyper
  source 1..378: mol_type = genomic DNA
cgctaccgtgagggttccccgggcctgcttcctgccctccctccccgagtcgccgggagaaagggctggcagggccggggcttaggaatcacgccaaggactgggcggggcgctcgcggtaccgggaacggcgtggggatccgcacacccagcagggaacaaccatgcctgtgtggggacccctggcttgaacaagtttgcagggtgggaggtggaggcaagagaggaggcggaggaaggtggagacgccagtgggtgaaggctaaaaaggaaccgcctagggggacggggatgaggctgggaaaggagaagagatggacccgcgaaaaagacggggaaggaggctgcggagggaaagctgggcgccacagccaagca

SEQ ID NO: 79200 - DNA, 316 bp, Homo sapiens
  misc_feature 1..316: note = chr16:65157522-65157838
  misc_feature 1..316: note = hyper
  source 1..316: mol_type = genomic DNA
gcttggggagacgcccgcgggggcgggtgccggcgaggctgccccgggacctaccctcttcggcctgcgcgcccgcgtttttcttgacgactccaggatccgggtggcgctgcgtgcctgcccccagtccgcgtcctgcgcggagaggatgcctctgtcaccctctgtgtggacgtggcctttgaactcctcattcctccactgcgggggaagagctgtaagtttccagctgcccggttatcttactcctcagccttccccccaccataggtgtccaaggtgatagccccctgggtctccagtaaccccccaacct

SEQ ID NO: 79201 - DNA, 203 bp, Homo sapiens
  misc_feature 1..203: note = chr16:65157863-65158066
  misc_feature 1..203: note = hyper
  source 1..203: mol_type = genomic DNA
cgcgaggacattgactcccggtgctttcctgtagagcgccagagagcagatcgtggtgcctgccactcctgcctccccctgtgggtccctggccctgaaccttttcagagctctaccctgcttcctctgtctgcctttttggcctctgctgtaacccctaaaactttgggtacttcccaagccaccgccgaaagtccccactc

SEQ ID NO: 79202 - DNA, 289 bp, Homo sapiens; identical to SEQ ID NO: 36061
  misc_feature 1..289: note = chr16:6533425-6533714
  misc_feature 1..289: note = hyper
  source 1..289: mol_type = genomic DNA

SEQ ID NO: 79203 - DNA, 478 bp, Homo sapiens; identical to SEQ ID NO: 36224
  misc_feature 1..478: note = chr16:66461511-66461989
  misc_feature 1..478: note = hyper
  source 1..478: mol_type = genomic DNA

SEQ ID NO: 79204 - DNA, 30 bp, Homo sapiens
  misc_feature 1..30: note = chr16:66512694-66512724
  misc_feature 1..30: note = hyper
  source 1..30: mol_type = genomic DNA
gctgacacaggaaatcggcctttgtcaagg

SEQ ID NO: 79205 - DNA, 362 bp, Homo sapiens; identical to SEQ ID NO: 36225
  misc_feature 1..362: note = chr16:66612734-66613096
  misc_feature 1..362: note = hyper
  source 1..362: mol_type = genomic DNA

SEQ ID NO: 79206 - DNA, 175 bp, Homo sapiens; identical to SEQ ID NO: 36226
  misc_feature 1..175: note = chr16:66638277-66638452
  misc_feature 1..175: note = hyper
  source 1..175: mol_type = genomic DNA

SEQ ID NO: 79207 - DNA, 195 bp, Homo sapiens
  misc_feature 1..195: note = chr16:666712-666907
  misc_feature 1..195: note = hypo
  source 1..195: mol_type = genomic DNA
acttggaaatacattcgccttggagaattcaacttcaaaatgcatacgaagtaggtcagggtggaaataaaggcactgccctttctccaggcacgctggagtccacgccctgcctttgcccaatgccctctgagggagaggccctgtgccttgcacccagcgcgggccacaggcggaggccccattccaggcaag

SEQ ID NO: 79208 - DNA, 77 bp, Homo sapiens
  misc_feature 1..77: note = chr16:667484-667561
  misc_feature 1..77: note = hypo
  source 1..77: mol_type = genomic DNA
cggaaaacctgattccgtggtggctgtgagccccttccctccccttctgtcggcttcaccttaaaaagcatttccca

SEQ ID NO: 79209 - DNA, 810 bp, Homo sapiens
  misc_feature 1..810: note = chr16:66878235-66879045
  misc_feature 1..810: note = hyper
  source 1..810: mol_type = genomic DNA
ctggggggtggggggcgggtcccccgggaactgctcctcccgccagccgctgctttaagaggctgctccgcggtagcgagcggggccggagccgcagcccgaacgagcggaccgagccgaccgggcaggtgcacggctgcggggacggcagcggcatgaccggccaccacggctggggctacggccaggacgacggtaggcacagacctcccccaccgcctctggctcggacccccgacccaactgcactcgccccaaccctcttgcccagctggtttcccagaccggaaagctcccacactccaggctgggcgggacccctcttcccatcccggcccccgaacttggcccaagccttggtcccccgcgccagacgcaaagtccgcgctgcgccccgggtggccccgccgccagcaagcgacctggcggctgtgtcctgccgcctcctccgcgaagcccctgattgcccagcccgctcagacccaggcccagactctcactcactcgccccgggcgtgcgcagcgcgtgggggtggcccagggcagcggggggcgggcgccgcggagcgctgtgcgcgggtgtctgcggggagcgcgcacggcaagtgagcggggacctcgggggagcggggctccgcgtggcaagggcgcagtgtcccccggagagaatttccccgcagaagtggccgagctgccttctcggccggtacgtgagggaagggggcacttgggggcgcaagcatgtgtctgggtgtctacaccgagcagggtgtttgcgcacgtccgggtgtgagtcgtgggagcccgtgg

SEQ ID NO: 79210 - DNA, 273 bp, Homo sapiens
  misc_feature 1..273: note = chr16:66958730-66959003
  misc_feature 1..273: note = hyper
  source 1..273: mol_type = genomic DNA
gcccgtcctccacaccgccgaagatgcgcgccagggcgctcttgcccacgccgggcgcccccagcagcagcaccttgtaaacgctctcgtctgagtcgctgccccctgagctgagcgagtcctcggagtcctcgggccagtccagcctgggaccctgggtccccgtcccggccgcggccgccgtcagggcacccggggtcagcgccgcctgcaggtcgcgctcgtccaccggcatgctgcggcggtgcagcggcggggcggggccccagggtg

SEQ ID NO: 79211 - DNA, 167 bp, Homo sapiens
  misc_feature 1..167: note = chr16:66959249-66959416
  misc_feature 1..167: note = hyper
  source 1..167: mol_type = genomic DNA
cccctccggacctggcgcatccatctgcagccgccccgaccccgctccgccaggacactcacccactcgcacacagacacgctcaggactaggatccggattaggaggccacgcactcgtagtccggactcggactttagggtttccgccgccgctgctgctgcagc

SEQ ID NO: 79212 - DNA, 226 bp, Homo sapiens
  misc_feature 1..226: note = chr16:66987397-66987623
  misc_feature 1..226: note = hypo
  source 1..226: mol_type = genomic DNA
aacaagccacctcctcgcctatctgtgtcctgcagaggtgactcaacccatttttgtaagaagcaagactgggcttgtccacaggcccctgagcctgggcctcctgtacagttgccaggaaagccaagccgattcctcagtggccgtctcctgaaggttgctcttcttctcagtggttctacagacactgtaaggcccctactcacaggatcgtagcacactcgcg

SEQ ID NO: 79213 - DNA, 30 bp, Homo sapiens
  misc_feature 1..30: note = chr16:67049292-67049322
  misc_feature 1..30: note = hypo
  source 1..30: mol_type = genomic DNA
cagtggaatgaggtgcggctgcattaaaga

SEQ ID NO: 79214 - DNA, 55 bp, Homo sapiens
  misc_feature 1..55: note = chr16:671371-671426
  misc_feature 1..55: note = hypo
  source 1..55: mol_type = genomic DNA
actgtctgtcccagccgggatttgtcactctgcctccctccgttagagagtggag

SEQ ID NO: 79215 - DNA, 269 bp, Homo sapiens
  misc_feature 1..269: note = chr16:67184148-67184417
  misc_feature 1..269: note = hyper
  source 1..269: mol_type = genomic DNA
tcccgtaggcgtgggcggcgccggtgtgtccccttcgtaggccggcggggctgcacccgcgtcgggtaactggaacgcgcggggtccgggggtgggcctcggtgccgccctccctcgccctcgcggcgcgctcgccgtcggggccgcgccgtcgcgctgcgcatagagtaagaggcccagggaggcgccaaggagcagcgtgagcaatgcgtccctgcgtaggcgcagcctcctcctcatctccgcgcggcctgcgccctccctcccct

SEQ ID NO: 79216 - DNA, 91 bp, Homo sapiens
  misc_feature 1..91: note = chr16:67189168-67189259
  misc_feature 1..91: note = hyper
  source 1..91: mol_type = genomic DNA
gccagttcttcatcccggagccggtcgggctaggggaatggaacgtgccgtcacgggggacttaaccgcggatccccgccctaccccatcc

SEQ ID NO: 79217 - DNA, 689 bp, Homo sapiens
  misc_feature 1..689: note = chr16:67197593-67198282
  misc_feature 1..689: note = hyper
  source 1..689: mol_type = genomic DNA
ggtgcattgtttctgcgtggtgagccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacgtaagcgctctgagagggaacggggggggtgtccaggcgcgccccgagtgctagtgccttcttttgggattgttgccccccgggtctttaccgagttgggaactgtgatggcatcgggaccagtcctgggcgccctgagaccactcgctgctctcaccctctgcagacgccccacccgctcggtcctggacacactgcccccctctcttgcctccacccctctgcggactctgcagctccgcggccccggcgcagggagagggagggcacgggcgcgggccgggcctcaagggtgagtgtgaaataaacaaatcctgcagtgtttctgcgtcctattaaaggcggggtcggatctgaaagggaaggacagggaacgcgcggggtaccggaggagccatcccggcagaggttgggtttcctcaagagcctctggacgacacagctgcggggggtcagggtcggggcactcacacccttggaatgactacgtcccggggttcggcgggagggggcgtgcttccctgccc

SEQ ID NO: 79218 - DNA, 980 bp, Homo sapiens
  misc_feature 1..980: note = chr16:67198552-67199532
  misc_feature 1..980: note = hyper
  source 1..980: mol_type = genomic DNA
ccgctgtccgagccccgccccgcgggcttgcacgtggcccccgcctgacccggcgccccggggcggagtagggcggagcgggcggcaaacgcagcactttccgcggctttgacgagcccgcagcggccgggcccgagcgcagagccgggccgagactgcaccatgcaggaagcgccagctgcgctgcccacggagccaggccccagccccgtgcctgccttcctcggcaagctatgggcgctggtgggggacccaggcacagaccacctgatccgctggagcccggtgagggccggggcccctcgattccccctgtggtcccggggtccctccacgtcagtgaacacccatgcccgcccaaccccctcctgagactgggccgtggatccccggatttggccattcagagaagttcaccttggagggggtgtgcgagaggggggtttcctctgcggccgaagaagggttaggagcctgccttctgaagacctagagtccgagggaccttcgaggccatttagttcccaccctaccccatccgacagatgggaaaacagaggccgggagatgggaagggctggtctagctcagggtcacattgcggggctgggaaccccgtcagcctctcctttctgagaactgagtatggagtcagggtctggctgggggtagggactcactgtggtcgctccaggctaggcctcggagcccgttctggcctggcctcgacccatatccccgtaagcggcaggcctggacccaagagtgagcatgagtgtgtgcgcgcgctggagcgcaggactggccgtgagcgggcaccgctcaccctcctggtctccgcccgcacggtgggcgggcggcgttcttggtagagcgggaccagtttcctcgtaagcgaccagagccgtttcgccaaggaagtgctgccccagtatttcaagcatagcaacatggcgagcttcgtgcgccaactcaacatg

SEQ ID NO: 79219 - DNA, 30 bp, Homo sapiens
  misc_feature 1..30: note = chr16:67241204-67241234
  misc_feature 1..30: note = hypo
  source 1..30: mol_type = genomic DNA
gcaccagaccctgcccgctgggggcctggc

SEQ ID NO: 79220 - DNA, 277 bp, Homo sapiens
  misc_feature 1..277: note = chr16:67241603-67241880
  misc_feature 1..277: note = hypo
  source 1..277: mol_type = genomic DNA
gttgatgccagggcacgtggccacatccaacacccggagctgcctgcacgcctgcccaatagcatccagtgtcctgtggggaggccacctgatgagtgcctggcccggtgtgggacccagcccagcccctgcaccgtggctccatctgcctggtgtcatcggacacacttactgctctatgagctgactgcagctggacaggttgagatgctgcagccttggccaggagctggctgcctgggcccagcccttgtcactgagtcggctgcagtgactc

SEQ ID NO: 79221 - DNA, 30 bp, Homo sapiens
  misc_feature 1..30: note = chr16:67242338-67242368
  misc_feature 1..30: note = hypo
  source 1..30: mol_type = genomic DNA
tgctccagctctgggcgtgactgtgggaag

SEQ ID NO: 79222 - DNA, 101 bp, Homo sapiens
  misc_feature 1..101: note = chr16:67244020-67244121
  misc_feature 1..101: note = hypo
  source 1..101: mol_type = genomic DNA
gcctgggccagttcccgccctcggccatgtcgaggctctgcagctcctgcaggccacccagagctgtacatcctgcatctgtcagccgctgcagcttcccc

SEQ ID NO: 79223 - DNA, 48 bp, Homo sapiens
  misc_feature 1..48: note = chr16:67289799-67289847
  misc_feature 1..48: note = hypo
  source 1..48: mol_type = genomic DNA
ctgctgaaatggcctcgctctccgccattcttgcgtgagttctggggg

SEQ ID NO: 79224 - DNA, 102 bp, Homo sapiens
  misc_feature 1..102: note = chr16:67299098-67299200
  misc_feature 1..102: note = hypo
  source 1..102: mol_type = genomic DNA
gggtgcattcagcaccgtgacctggggctcttcctccagggacttgatttccaagttggaaatgttcaaagcagttattagacaatgcgtgacaggaggcat

SEQ ID NO: 79225 - DNA, 106 bp, Homo sapiens
  misc_feature 1..106: note = chr16:67313852-67313958
  misc_feature 1..106: note = hypo
  source 1..106: mol_type = genomic DNA
ccactgagtcccactcgactgtcttcagcgcggttcacactgagacccagccctctcccgctggccccgagcaggcccacctttaggagggcgtgatggaaaggcc

SEQ ID NO: 79226 - DNA, 83 bp, Homo sapiens
  misc_feature 1..83: note = chr16:67320453-67320536
  misc_feature 1..83: note = hypo
  source 1..83: mol_type = genomic DNA
cctgcgggggccccacgcaggagctcagtgcgctgcgggaggcccagagccttgtgcacttccagctgcggcacggaaacgac

SEQ ID NO: 79227 - DNA, 348 bp, Homo sapiens
  misc_feature 1..348: note = chr16:67360535-67360883
  misc_feature 1..348: note = hyper
  source 1..348: mol_type = genomic DNA
aatccttggccacagcggcccccattcgccgctttggtgcttttggcgcccccgccagagcgggctccgtaccatggtcgcggctccagcagcgggcgggcgggcttgtgacccggccaataacggttcccggggtcgcggcggcgcgcgcgcggggggcggggcagtgggcggggcctggcgtgcgccgggtggtctcgcgggcggtggcaggtgagcggcgggcggggatggcggagcaatgggagctggacgaggaaggcattcgccgcctgggggcgctgacgctggagcagccgggtagggtctggccgggagggtgtggactgggaacgtagggtcagaagc

SEQ ID NO: 79228 - DNA, 162 bp, Homo sapiens
  misc_feature 1..162: note = chr16:67427310-67427472
  misc_feature 1..162: note = hyper
  source 1..162: mol_type = genomic DNA
ggaaggacagaacgacgcaggaatggaccgatggacgcgggagaccaggcggctccgcagctccgctccctgccggctcccgggtgggactgcagcccaggcggctccgccgtattatcccctgtttctcggtctccatagagacggcgagtcccacccccg

SEQ ID NO: 79229 - DNA, 30 bp, Homo sapiens
  misc_feature 1..30: note = chr16:67427854-67427884
  misc_feature 1..30: note = hyper
  source 1..30: mol_type = genomic DNA
ccaggccacaactcccgtgctctcttgggt

SEQ ID NO: 79230 - DNA, 137 bp, Homo sapiens
  misc_feature 1..137: note = chr16:67433335-67433472
  misc_feature 1..137: note = hyper
  source 1..137: mol_type = genomic DNA
ctgcagtgcttggagcgagcgctcctgcagggagagggggcacagcgcgattggccggctcattccccgctctgcggcccggccggtcggggtggttgagtggggtctgtggagggaccaagcgccaggcctgagac

SEQ ID NO: 79231 - DNA, 30 bp, Homo sapiens
  misc_feature 1..30: note = chr16:67478638-67478668
  misc_feature 1..30: note = hypo
  source 1..30: mol_type = genomic DNA
catcaaggtgggggccgggaagtcctggca

SEQ ID NO: 79232 - DNA, 30 bp, Homo sapiens
  misc_feature 1..30: note = chr16:67496823-67496853
  misc_feature 1..30: note = hypo
  source 1..30: mol_type = genomic DNA
ggctcctgttccacacgcacagccatcttc

SEQ ID NO: 79233 - DNA, 38 bp, Homo sapiens
  misc_feature 1..38: note = chr16:67571498-67571536
  misc_feature 1..38: note = hyper
  source 1..38: mol_type = genomic DNA
aggtaggacccagctcggggctgcgaaagctcagggac

SEQ ID NO: 79234 - DNA, 74 bp, Homo sapiens
  misc_feature 1..74: note = chr16:67572364-67572438
  misc_feature 1..74: note = hyper
  source 1..74: mol_type = genomic DNA
gtgcggccgcagcgccgtctgctcagcgcccgggtcaataggagccagtccttcgcaggcgtcctcggcagcca

SEQ ID NO: 79235 - DNA, 81 bp, Homo sapiens
  misc_feature 1..81: note = chr16:67578633-67578714
  misc_feature 1..81: note = hypo
  source 1..81: mol_type = genomic DNA
gcatgggccctggagcggctgctgcgggaagcccgagtactggaggcagtatgcgagttcagcaggcggtgggagatcccg

SEQ ID NO: 79236 - DNA, 77 bp, Homo sapiens
  misc_feature 1..77: note = chr16:67678709-67678786
  misc_feature 1..77: note = hyper
  source 1..77: mol_type = genomic DNA
ggaggggaccagccccggtgggccgcggggatccccaggcaggcagcgtcccctggtgttcgcggcagggactgcgg

SEQ ID NO: 79237 - DNA, 117 bp, Homo sapiens
  misc_feature 1..117: note = chr16:67679041-67679158
  misc_feature 1..117: note = hyper
  source 1..117: mol_type = genomic DNA
ggagcaggtggctgccgtgcgggtctgggccccaggcttcctgtgtgcgcgctcgtcctctgctgtttcccgccggagctcgttgggcctccccggcccgcccggcccatggcccag

SEQ ID NO: 79238 - DNA, 41 bp, Homo sapiens
  misc_feature 1..41: note = chr16:67683741-67683782
  misc_feature 1..41: note = hypo
  source 1..41: mol_type = genomic DNA
tttgggtctgctggacgtggcgcaggcgctggagcagaacc

SEQ ID NO: 79239 - DNA, 259 bp, Homo sapiens
  misc_feature 1..259: note = chr16:67700832-67701091
  misc_feature 1..259: note = hyper
  source 1..259: mol_type = genomic DNA
gccccaagcagctgtcgaggacgcactcagcctgcgcagccatggcctcggcaggggcggagaggcggccgggggtccaggaggcgacggtcgtggggcagggacagctcacggaggagcccggcagcgctcagacctccgaggtgaccgtcaggctgtttaaccttcaaacacagggccgcagcgctctgagaggtggaactgagcgccccgacccgctaactgccaggctgggccctccaggcggggaggggcacag

SEQ ID NO: 79240 - DNA, 18 bp, Homo sapiens
  misc_feature 1..18: note = chr16:67730391-67730409
  misc_feature 1..18: note = hypo
  source 1..18: mol_type = genomic DNA
tttttgagacagtctcgc

SEQ ID NO: 79241 - DNA, 30 bp, Homo sapiens
  misc_feature 1..30: note = chr16:677437-677467
  misc_feature 1..30: note = hypo
  source 1..30: mol_type = genomic DNA
acctcaagtccttctcgatggccaacggca

SEQ ID NO: 79242 - DNA, 72 bp, Homo sapiens
  misc_feature 1..72: note = chr16:677837-677909
  misc_feature 1..72: note = hypo
  source 1..72: mol_type = genomic DNA
tccgggaatcttggtcggaaacaagccgggcctccccagctgcctgggcttgaccggcggggagcctggttg

SEQ ID NO: 79243 - DNA, 100 bp, Homo sapiens
  misc_feature 1..100: note = chr16:67854142-67854242
  misc_feature 1..100: note = hypo
  source 1..100: mol_type = genomic DNA
agccaccgcgcccgactatgctttctcactgcatcctcacatcaatacactgtgacaaagactaccatcatccctattttacagacgtgagaactaaggc

SEQ ID NO: 79244 - DNA, 129 bp, Homo sapiens
  misc_feature 1..129: note = chr16:67877005-67877134
  misc_feature 1..129: note = hyper
  source 1..129: mol_type = genomic DNA
agacgtgaagcccatcgatctcacagtgcaagtggagtttgcagccgcagagggcgcagccgctgcggccgccgcgtcggagttacaggctgctaccgcagggctggaggctgccgagtgccctatggg

SEQ ID NO: 79245 - DNA, 270 bp, Homo sapiens
  misc_feature 1..270: note = chr16:67982004-67982274
  misc_feature 1..270: note = hypo
  source 1..270: mol_type = genomic DNA
caggagtgtctgcaccgcacaggcgaggttcacgaacaggtagcacatcagaaagaacctgcggcacagagggcggttggcgaagagcagcctcctcggcagctggggacctgatgtcaggctgggcctggcccagaaacggggcgtggcccggccctgccctgcatggctcagcaaggtcttctcaacctcattgctgccacctccatggcctgaggcaatgagactactgtggaggagtcctcggagccagatcgcagaggatgggca

SEQ ID NO: 79246 - DNA, 157 bp, Homo sapiens
  misc_feature 1..157: note = chr16:68002842-68002999
  misc_feature 1..157: note = hyper
  source 1..157: mol_type = genomic DNA
agtgtcctggctctgcgccctgggcttacgaagcgctctgttacttagggacggggcagggtaggccggaccggcccaggactgcagaagccacctgcccagggcctcccaccaaccccgtatacctccttcccatttccagcgtctgcatcccatt

SEQ ID NO: 79247 - DNA, 30 bp, Homo sapiens
  misc_feature 1..30: note = chr16:68012551-68012581
  misc_feature 1..30: note = hypo
  source 1..30: mol_type = genomic DNA
agaatgaggccagggcggtcttcaaccccc

SEQ ID NO: 79248 - DNA, 217 bp, Homo sapiens
  misc_feature 1..217: note = chr16:680959-681176
  misc_feature 1..217: note = hyper
  source 1..217: mol_type = genomic DNA
gggcctgggagcccccgcacggttcagacagaggggccaggctgaagctggagaggaaccagcgtcacacagacggcctctgagaacttggagaccccgttacccacccagcaggggtgtcaggacaagcatctgctgcaggcttcagcctcaggggcaaaagggagccccggggtcctggtgggggcaccgaccacaggcccggagggtggatgcc

SEQ ID NO: 79249 - DNA, 416 bp, Homo sapiens
  misc_feature 1..416: note = chr16:68118224-68118640
  misc_feature 1..416: note = hyper
  source 1..416: mol_type = genomic DNA
tccctgtccaccttgcgcctcagcggagccttaggtaaacaagccaggctcccagtccccaaggacggccttcaccccagaccccaggaggaggcgtcttgggccatctcgggaaggctagcttgctcgggaggggcagatcacgaaaacggttctttaggcagtgtcacttcctctccactgccagccacccaatttaggcggctccatccctcccgctttcatggatatgcagcaggatgcagagagcacagagctgtgattggcacgagctcacaacgggctttcccgctcaatctactcaacttccagcaagggacaggccctgcccattggggttcgctgaggcctcaaacgcgcatgctgtcaagggagcagctgcgggggcccgctagtggggacaaaggcgcagccac

SEQ ID NO: 79250 - DNA, 156 bp, Homo sapiens; identical to SEQ ID NO: 36243
  misc_feature 1..156: note = chr16:68118759-68118915
  misc_feature 1..156: note = hyper
  source 1..156: mol_type = genomic DNA

SEQ ID NO: 79251 - DNA, 32 bp, Homo sapiens
  misc_feature 1..32: note = chr16:6825036-6825068
  misc_feature 1..32: note = hypo
  source 1..32: mol_type = genomic DNA
gtagacaaggcagggcgcagtggctcacgcct

SEQ ID NO: 79252 - DNA, 30 bp, Homo sapiens
  misc_feature 1..30: note = chr16:68270127-68270157
  misc_feature 1..30: note = hyper
  source 1..30: mol_type = genomic DNA
gcggctaccggcccacgccctctccaggcg

SEQ ID NO: 79253 - DNA, 84 bp, Homo sapiens
  misc_feature 1..84: note = chr16:68273891-68273975
  misc_feature 1..84: note = hyper
  source 1..84: mol_type = genomic DNA
tcgtctgcccagacccgtccccgctctcagcgaccctccttatgtcccgggccaccccactagccagcgcgttgggccccacct

SEQ ID NO: 79254 - DNA, 30 bp, Homo sapiens
  misc_feature 1..30: note = chr16:68362039-68362069
  misc_feature 1..30: note = hypo
  source 1..30: mol_type = genomic DNA
aatgctaatcctccacgctgacttctgacc

SEQ ID NO: 79255 - DNA, 183 bp, Homo sapiens
  misc_feature 1..183: note = chr16:68385408-68385591
  misc_feature 1..183: note = hypo
  source 1..183: mol_type = genomic DNA
caccacccccactgccgcctccgggatgagtccagcccctcaccctgtcctggctgccttgggctgggctggcttctgtccagctccacaccctcaccttggggggccttgctgtctcccggcctcactcttgcccctgctgcccctccctcggccgttcaggctcctcgctgtgcacgtgtt

SEQ ID NO: 79256 - DNA, 35 bp, Homo sapiens
  misc_feature 1..35: note = chr16:68386152-68386187
  misc_feature 1..35: note = hypo
  source 1..35: mol_type = genomic DNA
ctctctcctcctgggcgagccgttcttcactacca

SEQ ID NO: 79257 - DNA, 148 bp, Homo sapiens
  misc_feature 1..148: note = chr16:6838778-6838926
  misc_feature 1..148: note = hypo
  source 1..148: mol_type = genomic DNA
cactgatttttctgaggatgcctctgtgatgtcatacgatgtgccaatttccatcttatgtcctaaaatggcatcgcctcacttctgagaaatactgtcactctgtagctaactctctgctctaagaactcagcgtccccaagccaac

SEQ ID NO: 79258 - DNA, 41 bp, Homo sapiens
  misc_feature 1..41: note = chr16:68480923-68480964
  misc_feature 1..41: note = hyper
  source 1..41: mol_type = genomic DNA
ctttgtctcccgccccgctcctggcacgtttccgtggaagc

SEQ ID NO: 79259 - DNA, 265 bp, Homo sapiens
  misc_feature 1..265: note = chr16:68504027-68504292
  misc_feature 1..265: note = hyper
  source 1..265: mol_type = genomic DNA
tgcagttagtggtagcgtttgccagaaaaaaataatagattgtaaaggaagcaacacggaacaaccacgtttttgttattcgaaatgcagctacacgtgtttacagtccttaaccatttcatctgacagcctggggagacagacttctaatttgtgttttgataaactgagagtgacagagcggttgttggccctgcttggaggtggagtgatggtgtggtcagaagggaagccggagggaagttacactcgtggggtgtgtgtt

SEQ ID NO: 79260 - DNA, 236 bp, Homo sapiens
  misc_feature 1..236: note = chr16:68544142-68544378
  misc_feature 1..236: note = hyper
  source 1..236: mol_type = genomic DNA
gagagggaggaggctcgtggaccaagaggacgcactcggatctggagttctccggcccggacacccacgggccaccgcgtcgaggcagcgcgagccccgggcgccccctgcaggttgtacgggcctcagctgcgcagcgcagacggaggagggcgctggcggttaagaactcctacttgtcaaccggaaaaacatcccccataaaaaaacggtcaaagggccgggacagaagcatt

SEQ ID NO: 79261 - DNA, 60 bp, Homo sapiens
  misc_feature 1..60: note = chr16:68572648-68572708
  misc_feature 1..60: note = hypo
  source 1..60: mol_type = genomic DNA
ccaaacaaaatcctgcgtaaggggatacgaagtaatgaaataacacggcagtagatctgc

SEQ ID NO: 79262 - DNA, 245 bp, Homo sapiens; identical to SEQ ID NO: 4365
  misc_feature 1..245: note = chr16:68676360-68676605
  misc_feature 1..245: note = hyper
  source 1..245: mol_type = genomic DNA

SEQ ID NO: 79263 - DNA, 198 bp, Homo sapiens; identical to SEQ ID NO: 36247
  misc_feature 1..198: note = chr16:68676841-68677039
  misc_feature 1..198: note = hyper
  source 1..198: mol_type = genomic DNA

SEQ ID NO: 79264 - DNA, 174 bp, Homo sapiens
  misc_feature 1..174: note = chr16:68678982-68679156
  misc_feature 1..174: note = hyper
  source 1..174: mol_type = genomic DNA
tctaacccagaactgcgagacagaggctgagtccctgtaaagaacagctccagaaaagccaggagagcgcaggagggcatccgggaggccaggaggggttcgctggggcctcaaccgcacccacatcggtcccacctgcgagggggcgggacctcgtggcgctggaccaatcag

SEQ ID NO: 79265 - DNA, 108 bp, Homo sapiens
  misc_feature 1..108: note = chr16:68679959-68680067
  misc_feature 1..108: note = hyper
  source 1..108: mol_type = genomic DNA
cccagcagaggaatgcgccggccacattcttcccccaacccgcgcgcaggtgtggggatgagccgtgccccgggcagcccccttcgcccctctcgggccccctttgtg

SEQ ID NO: 79266 - DNA, 80 bp, Homo sapiens
  misc_feature 1..80: note = chr16:68759191-68759271
  misc_feature 1..80: note = hypo
  source 1..80: mol_type = genomic DNA
gttgatttgcactcccgtctgccatgtttagttaggttatttcacccaattctttttttttttgagacagagtctcactc

SEQ ID NO: 79267 - DNA, 120 bp, Homo sapiens
  misc_feature 1..120: note = chr16:68770606-68770726
  misc_feature 1..120: note = hypo
  source 1..120: mol_type = genomic DNA
ggagttcgagaccaggctgggcaatacagggagacacagcgcccccactgcccctgtccgccccgacttgtctctctacaaaaaggcaaaagaaaaaaaaattagcctggcgtggtggtg

SEQ ID NO: 79268 - DNA, 149 bp, Homo sapiens
  misc_feature 1..149: note = chr16:68770846-68770995
  misc_feature 1..149: note = hypo
  source 1..149: mol_type = genomic DNA
accccatctccaaaacgaacaaacaaaaaatcccaaaaaacaaaagaactcagccaagtgtaaaagccctttctgatcccaggtcttagtgagccaccggcggggctgggattcgaacccagtggaatcagaaccgtgcaggtcccata

SEQ ID NO: 79269 - DNA, 76 bp, Homo sapiens
  misc_feature 1..76: note = chr16:68771248-68771324
  misc_feature 1..76: note = hyper
  source 1..76: mol_type = genomic DNA
cagcccgctccagcccggcccgacccgaccgcacccggcgcctgccctcgctcggcgtccccggccagccatgggc

SEQ ID NO: 79270 - DNA, 45 bp, Homo sapiens; identical to SEQ ID NO: 44724
  misc_feature 1..45: note = chr16:68787504-68787549
  misc_feature 1..45: note = hypo
  source 1..45: mol_type = genomic DNA

SEQ ID NO: 79271 - DNA, 42 bp, Homo sapiens
  misc_feature 1..42: note = chr16:68876805-68876847
  misc_feature 1..42: note = hypo
  source 1..42: mol_type = genomic DNA
atatatgcgtgtgtacgtctgtacttaggttttgtttgtttg

SEQ ID NO: 79272 - DNA, 30 bp, Homo sapiens
  misc_feature 1..30: note = chr16:69106048-69106078
  misc_feature 1..30: note = hypo
  source 1..30: mol_type = genomic DNA
tgtgtgtgtcacatgcgctctctaaattct

SEQ ID NO: 79273 - DNA, 25 bp, Homo sapiens
  misc_feature 1..25: note = chr16:69107559-69107584
  misc_feature 1..25: note = hypo
  source 1..25: mol_type = genomic DNA
gttagaaagggcactcgaagccagg

SEQ ID NO: 79274 - DNA, 48 bp, Homo sapiens
  misc_feature 1..48: note = chr16:69133585-69133633
  misc_feature 1..48: note = hypo
  source 1..48: mol_type = genomic DNA
attgtgtctcctgttcgttacttaacactgcatcgtaggtgtctggag

SEQ ID NO: 79275 - DNA, 30 bp, Homo sapiens
  misc_feature 1..30: note = chr16:69139552-69139582
  misc_feature 1..30: note = hyper
  source 1..30: mol_type = genomic DNA
gacaattctcttcagcgcctctttcctgcc

SEQ ID NO: 79276 - DNA, 136 bp, Homo sapiens
  misc_feature 1..136: note = chr16:69352213-69352349
  misc_feature 1..136: note = hypo
  source 1..136: mol_type = genomic DNA
tgaggtgtgagtcaccgcacctggcctgggctgctctttaagtccagctgaagcacatttcccttacggccttcaggagagggccgacccggattcccatctgctccgcgaagaaacagggcgggttataggagtg

SEQ ID NO: 79277 - DNA, 30 bp, Homo sapiens; identical to SEQ ID NO: 44727
  misc_feature 1..30: note = chr16:69352566-69352596
  misc_feature 1..30: note = hypo
  source 1..30: mol_type = genomic DNA

SEQ ID NO: 79278 - DNA, 21 bp, Homo sapiens
  misc_feature 1..21: note = chr16:69359280-69359301
  misc_feature 1..21: note = hypo
  source 1..21: mol_type = genomic DNA
tcgagagttgctgggcgcggt

SEQ ID NO: 79279 - DNA, 30 bp, Homo sapiens
  misc_feature 1..30: note = chr16:69372480-69372510
  misc_feature 1..30: note = hypo
  source 1..30: mol_type = genomic DNA
cccacaactgcccttcgagggagggacgtg

SEQ ID NO: 79280 - DNA, 36 bp, Homo sapiens
  misc_feature 1..36: note = chr16:69563669-69563705
  misc_feature 1..36: note = hypo
  source 1..36: mol_type = genomic DNA
ctggaagcaagactgcgttcccgagcagatggccca

SEQ ID NO: 79281 - DNA, 19 bp, Homo sapiens
  misc_feature 1..19: note = chr16:69564030-69564049
  misc_feature 1..19: note = hypo
  source 1..19: mol_type = genomic DNA
agtcttggccgggcgcgat

SEQ ID NO: 79282 - DNA, 30 bp, Homo sapiens
  misc_feature 1..30: note = chr16:69776566-69776596
  misc_feature 1..30: note = hypo
  source 1..30: mol_type = genomic DNA
ctggtaaggtgcagccgaccttgcagatcc

SEQ ID NO: 79283 - DNA, 187 bp, Homo sapiens
  misc_feature 1..187: note = chr16:69791463-69791650
  misc_feature 1..187: note = hypo
  source 1..187: mol_type = genomic DNA
gtccagctccactttcgcaatctccgctagggttcgtgtttccaagcggataaagccaaatccttaatccttatgaatgaagacttcgcctgcctttccatatttctcaaatagtttcctcatttcttcctcagtgatgtcgggaggaagatttcccacaaaaagacggcttcgttgggtgaaggtc

SEQ ID NO: 79284 - DNA, 33 bp, Homo sapiens
  misc_feature 1..33: note = chr16:6990605-6990638
  misc_feature 1..33: note = hypo
  source 1..33: mol_type = genomic DNA
ttttcttttttgaggcggagtcttactctgtca

SEQ ID NO: 79285 - DNA, 228 bp, Homo sapiens
  misc_feature 1..228: note = chr16:700101-700329
  misc_feature 1..228: note = hypo
  source 1..228: mol_type = genomic DNA
ctgtatgtgctctttcggcccctgcccagcaagcacttcgtcatccacctcgatgtgtcctccaaggtacggagcccgcggctgggggctgcgtgggagccccggcacccctgcggcccctgtctcctcacggccctgctccgtccccacaggacaaccaagtcatccgtgtgtctttctccaacctcttcaaggagtttaagtctacggccacgtggctccagtttc

SEQ ID NO: 79286 - DNA, 64 bp, Homo sapiens; identical to SEQ ID NO: 44412
  misc_feature 1..64: note = chr16:700572-700636
  misc_feature 1..64: note = hypo
  source 1..64: mol_type = genomic DNA

SEQ ID NO: 79287 - DNA, 140 bp, Homo sapiens
  misc_feature 1..140: note = chr16:70379985-70380125
  misc_feature 1..140: note = hypo
  source 1..140: mol_type = genomic DNA
aatgagaccctgactcaaaaaagaaacgaaaaaacgcattgtgtgttgtgtttattggatggtggaattatggggtttacgggtcttctgttgcgttttggtttttgttttcttacctgttatcgcgttcctaacagtag

SEQ ID NO: 79288 - DNA, 136 bp, Homo sapiens
  misc_feature 1..136: note = chr16:70416085-70416221
  misc_feature 1..136: note = hypo
  source 1..136: mol_type = genomic DNA
agttccatttttacacgaagtaggcctggggctcagagctggtgggggcagtcgtccagctgaaattcaactacatacactctccattctatttatgtttttttttcttttctttttcaagacagcgtctcattct

SEQ ID NO: 79289 - DNA, 126 bp, Homo sapiens; identical to SEQ ID NO: 44730
  misc_feature 1..126: note = chr16:70427606-70427732
  misc_feature 1..126: note = hypo
  source 1..126: mol_type = genomic DNA

SEQ ID NO: 79290 - DNA, 19 bp, Homo sapiens
  misc_feature 1..19: note = chr16:70439156-70439175
  misc_feature 1..19: note = hypo
  source 1..19: mol_type = genomic DNA
aggcacagcctggtgcggt

SEQ ID NO: 79291 - DNA, 30 bp, Homo sapiens
  misc_feature 1..30: note = chr16:70514821-70514851
  misc_feature 1..30: note = hypo
  source 1..30: mol_type = genomic DNA
caagccagacagcctcgctcagctccttgg

SEQ ID NO: 79292 - DNA, 28 bp, Homo sapiens
  misc_feature 1..28: note = chr16:70522735-70522763
  misc_feature 1..28: note = hypo
  source 1..28: mol_type = genomic DNA
gagccaccacacccggcccagctactgt

SEQ ID NO: 79293 - DNA, 77 bp, Homo sapiens; identical to SEQ ID NO: 44731
  misc_feature 1..77: note = chr16:70595623-70595700
  misc_feature 1..77: note = hypo
  source 1..77: mol_type = genomic DNA

SEQ ID NO: 79294 - DNA, 140 bp, Homo sapiens
  misc_feature 1..140: note = chr16:70610992-70611132
  misc_feature 1..140: note = hypo
  source 1..140: mol_type = genomic DNA
tacactccagcctggatgacaggacgaaacctgtctcaaaaacaccaaaaaacaaaaaccggtctcctggggtcatggtagcacaaacgcacatgactgagtgctcaggggttctgaggcttgtccgctgacctggggct

SEQ ID NO: 79295 - DNA, 50 bp, Homo sapiens; identical to SEQ ID NO: 44732
  misc_feature 1..50: note = chr16:70680482-70680532
  misc_feature 1..50: note = hypo
  source 1..50: mol_type = genomic DNA

SEQ ID NO: 79296 - DNA, 32 bp, Homo sapiens
  misc_feature 1..32: note = chr16:70719509-70719541
  misc_feature 1..32: note = hyper
  source 1..32: mol_type = genomic DNA
aggacacacagacaccgcggcgcgcggccaca

SEQ ID NO: 79297 - DNA, 30 bp, Homo sapiens
  misc_feature 1..30: note = chr16:70769908-70769938
  misc_feature 1..30: note = hypo
  source 1..30: mol_type = genomic DNA
atgaatttggtaggccgtggtggcctggct

SEQ ID NO: 79298 - DNA, 69 bp, Homo sapiens
  misc_feature 1..69: note = chr16:70795276-70795345
  misc_feature 1..69: note = hypo
  source 1..69: mol_type = genomic DNA
ctcacagtgccttggcgctcagaagaggaaagtgggctgaggctcagcttggaccgtcagcatctgaga

SEQ ID NO: 79299 - skipped

SEQ ID NO: 79300 - DNA, 92 bp, Homo sapiens
  misc_feature 1..92: note = chr16:71264580-71264672
  misc_feature 1..92: note = hyper
  source 1..92: mol_type = genomic DNA
cactctccatgcgccgcccgagctgttgccgtccgttgccacggtaaccacggagccgcacagcctagcaagccgcgcgatgattggaggag

SEQ ID NO: 79301 - DNA, 23 bp, Homo sapiens
  misc_feature 1..23: note = chr16:71266650-71266673
  misc_feature 1..23: note = hypo
  source 1..23: mol_type = genomic DNA
gggtgcagtggctcacgcctgta

SEQ ID NO: 79302 - DNA, 30 bp, Homo sapiens
  misc_feature 1..30: note = chr16:7137064-7137094
  misc_feature 1..30: note = hyper
  source 1..30: mol_type = genomic DNA
gtgtgctgagctgtgcggtgtgaagagtaa

SEQ ID NO: 79303 - DNA, 30 bp, Homo sapiens
  misc_feature 1..30: note = chr16:71418717-71418747
  misc_feature 1..30: note = hypo
  source 1..30: mol_type = genomic DNA
gatcttcacattttacgacaaggtaagaga

SEQ ID NO: 79304 - DNA, 22 bp, Homo sapiens
  misc_feature 1..22: note = chr16:71433525-71433547
  misc_feature 1..22: note = hypo
  source 1..22: mol_type = genomic DNA
cgcgccccgcagctgtggttaa

SEQ ID NO: 79305 - DNA, 133 bp, Homo sapiens; identical to SEQ ID NO: 36250
  misc_feature 1..133: note = chr16:71459956-71460089
  misc_feature 1..133: note = hyper
  source 1..133: mol_type = genomic DNA

SEQ ID NO: 79306 - DNA, 247 bp, Homo sapiens; identical to SEQ ID NO: 36251
  misc_feature 1..247: note = chr16:71460270-71460517
  misc_feature 1..247: note = hyper
  source 1..247: mol_type = genomic DNA

SEQ ID NO: 79307 - DNA, 167 bp, Homo sapiens
  misc_feature 1..167: note = chr16:71715744-71715911
  misc_feature 1..167: note = hypo
  source 1..167: mol_type = genomic DNA
gctcaggaacctcctcgaggctgtaacacgagagatccacggtactgattcgctgggacaccacctgaataatgtcaaagagaagagccttctgagctagtactggatgtctatcacccagcaaagaatggaatggcatttacacaaaaagacgctaattaaaaaga

SEQ ID NO: 79308 - DNA, 45 bp, Homo sapiens
  misc_feature 1..45: note = chr16:71841040-71841085
  misc_feature 1..45: note = hypo
  source 1..45: mol_type = genomic DNA
actttttgccaggcacggtggctcacgcctgtaatcctagcactt

SEQ ID NO: 79309 - DNA, 104 bp, Homo sapiens
  misc_feature 1..104: note = chr16:71841325-71841429
  misc_feature 1..104: note = hypo
  source 1..104: mol_type = genomic DNA
ttcgtctcaaaaaataaataaataaaaataaagacatactttttattcaagcatgctagactgcaaacatgcctttagaataaaagtgacgagattacgagtac

SEQ ID NO: 79310 - DNA, 23 bp, Homo sapiens
  misc_feature 1..23: note = chr16:71919058-71919081
  misc_feature 1..23: note = hypo
  source 1..23: mol_type = genomic DNA
tggttggacgcacttctagtcaa

SEQ ID NO: 79311 - DNA, 140 bp, Homo sapiens
  misc_feature 1..140: note = chr16:72038633-72038773
  misc_feature 1..140: note = hypo
  source 1..140: mol_type = genomic DNA
tatttatcctttcccatgtaaatagcgcaggcagatgaattaacgctgctgctggtgaagtagaacaccatgatgctggcgggggtgcggtgactccaccgtggagcagcagcgttcaactgtggcggttgcctggtccc

SEQ ID NO: 79312 - DNA, 39 bp, Homo sapiens
  misc_feature 1..39: note = chr16:721687-721726
  misc_feature 1..39: note = hypo
  source 1..39: mol_type = genomic DNA
tccctgcaggatccacgtgccccccggctgcagcacgga

SEQ ID NO: 79313 - DNA, 30 bp, Homo sapiens
  misc_feature 1..30: note = chr16:72461127-72461157
  misc_feature 1..30: note = hypo
  source 1..30: mol_type = genomic DNA
aacttgaaggcagagcgatttggaaggggc

SEQ ID NO: 79314 - DNA, 114 bp, Homo sapiens
  misc_feature 1..114: note = chr16:72461587-72461701
  misc_feature 1..114: note = hypo
  source 1..114: mol_type = genomic DNA
taatgaatgagctttcgctgttaatgaggaataatcgtttggctaatgagctttgaaacattaagagaaaagaggttttttccgttaatcgctctggtgcgactgcatggatgg

SEQ ID NO: 79315 - DNA, 703 bp, Homo sapiens
  misc_feature 1..703: note = chr16:725275-725978
  misc_feature 1..703: note = hyper
  source 1..703: mol_type = genomic DNA
gcagggagctccagccggtggcaacatgaaccgcagggagtactgggtcagcctggagggggagcaagcagtggtcagggaaggcttcctggaagaggtggcatcctcacaggcctgagcccgggaaggctgtgagagggcgaacggtcttgcatggggggttttaggtgccccccatccccgtgactccatttaccagcggctgccgtggaggtagtccagtgtgctggagctgcgccagagcgggggtgggggccggcgctgagacgcggtgctagctggaggcggttcctgtccggggtgtgcgtccgcgtgcagggtgcgcgcgtgtcttggccgcgcgtggcggcgtgtgcggcaggggcgggcaggcgggcgactcggtgacgcggcccaagcgcggcgccgagcggagcgggcggagcgggccggctggggcggagcggagtcgtccgcagagcagcccctcccggccgcggccgccgaccccggaccccggcccccggccaggctctatggacaggagctcgctgctgcagctcatccaggagcaggtgcgtcggggggtggtctggggagctggcaccgcccccaatgcggccctcctgccgctgagctgagcttgtgcgggaccgagctccccgaaagccccgctcggtacctacctcatccctccacgaccttggtccgtgtgtctgggacc

SEQ ID NO: 79316 - DNA, 467 bp, Homo sapiens
  misc_feature 1..467: note = chr16:726580-727047
  misc_feature 1..467: note = hypo
  source 1..467: mol_type = genomic DNA
gggggcttgtggatgcggggagctgggtgagcctcacaggcaggggtgccatggggaggtccgtggcccacactcaggcccctgcccccagatcagcagcaagcgctccagcagtttcaagcgggccattgctaacggacagcgggcactgccccgggacgggccgctggatgagccaggcctaggtgtctacaagcggtttgtgcgttacgtggcctacgagatcctgccttgtgaggtggaccgccgctggtacttctaccgtcaccgcagctgcccaccccccgtgttcatggcctcggtcactcttgcccaggtgggccccccggccgctgccccgggagcctcccgcgctcctggccatgaccagcctaacactcgtgtccccagatcatcgtgttcctgtgttacggggcccgcctcaacaagtgggtgctgcagacctaccaccccgagtacatgaagag

SEQ ID NO: 79317 - DNA, 30 bp, Homo sapiens
  misc_feature 1..30: note = chr16:72697029-72697059
  misc_feature 1..30: note = hypo
  source 1..30: mol_type = genomic DNA
cagcctggaattccccggcccaagtgatcc

SEQ ID NO: 79318 - DNA, 121 bp, Homo sapiens
  misc_feature 1..121: note = chr16:72835621-72835742
  misc_feature 1..121: note = hypo
  source 1..121: mol_type = genomic DNA
tagctgttgatgaatcgttaagaatggagtggagattgccaaactcattccatctattttctttttaatagaaggcatttctgactagtgtggttggggagtccagcgggaatccgagaag

SEQ ID NO: 79319 - DNA, 70 bp, Homo sapiens
  misc_feature 1..70: note = chr16:72957744-72957814
  misc_feature 1..70: note = hypo
  source 1..70: mol_type = genomic DNA
tactttgaattgcctcgtcctaccacgttcaagacgcggctactgggcaggtccacgtctttaagttgtg

SEQ ID NO: 79320 - DNA, 30 bp, Homo sapiens
  misc_feature 1..30: note = chr16:72963559-72963589
  misc_feature 1..30: note = hypo
  source 1..30: mol_type = genomic DNA
cgacagggccctccacgcaagctggctgta

SEQ ID NO: 79321 - DNA, 30 bp, Homo sapiens
  misc_feature 1..30: note = chr16:72995364-72995394
  misc_feature 1..30: note = hypo
  source 1..30: mol_type = genomic DNA
ccctgatcctttgcccgtaggtccccagcc

SEQ ID NO: 79322 - DNA, 30 bp, Homo sapiens; identical to SEQ ID NO: 44739
  misc_feature 1..30: note = chr16:73033457-73033487
  misc_feature 1..30: note = hypo
  source 1..30: mol_type = genomic DNA

SEQ ID NO: 79323 - DNA, 82 bp, Homo sapiens
  misc_feature 1..82: note = chr16:73062471-73062553
  misc_feature 1..82: note = hypo
  source 1..82: mol_type = genomic DNA
ccaacagacaggggacgattgttagaactcaagacacagaattccatctccaataacctcaaccgctcggagggattctcaa

SEQ ID NO: 79324 - DNA, 85 bp, Homo sapiens
  misc_feature 1..85: note = chr16:73099886-73099971
  misc_feature 1..85: note = hyper
  source 1..85: mol_type = genomic DNA
cagggcgtggccccacggccggcaggagtccggcgcacactgggcctggagcgcactgactggggctctggctagccgggctacc

SEQ ID NO: 79325 - DNA, 28 bp, Homo sapiens
  misc_feature 1..28: note = chr16:73100271-73100299
  misc_feature 1..28: note = hyper
  source 1..28: mol_type = genomic DNA
cggagccagcgtgcgcgtccctaatgcc

SEQ ID NO: 79326 - DNA, 15 bp, Homo sapiens
  misc_feature 1..15: note = chr16:73100575-73100590
  misc_feature 1..15: note = hyper
  source 1..15: mol_type = genomic DNA
cgccccagcagtggt

SEQ ID NO: 79327 - DNA, 336 bp, Homo sapiens
  misc_feature 1..336: note = chr16:731331-731667
  misc_feature 1..336: note = hypo
  source 1..336: mol_type = genomic DNA
atcgccaatctgcagcgaggttggctgacaagctgcccggttgtggggcctctggggccaggcgggtggactggccagagagtgacgtgaagcccccgttccccagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagaggtgggaccctcaccccaggccgccctgtcttgggataattctgaatcaccgactcccgacacaa

SEQ ID NO: 79328 - DNA, 43 bp, Homo sapiens
  misc_feature 1..43: note = chr16:73397226-73397269
  misc_feature 1..43: note = hypo
  source 1..43: mol_type = genomic DNA
aaaagctaactgttacgtattttaaaaacgattccaaattcta

SEQ ID NO: 79329 - DNA, 33 bp, Homo sapiens
  misc_feature 1..33: note = chr16:73422838-73422871
  misc_feature 1..33: note = hypo
  source 1..33: mol_type = genomic DNA
cacagactatggccacggcgtcttagaggtttt

SEQ ID NO: 79330 - DNA, 25 bp, Homo sapiens
  misc_feature 1..25: note = chr16:73450459-73450484
  misc_feature 1..25: note = hypo
  source 1..25: mol_type = genomic DNA
actcaatttagcagacgaaagttga

SEQ ID NO: 79331 - DNA, 1210 bp, Homo sapiens; identical to SEQ ID NO: 44416
  misc_feature 1..1210: note = chr16:734741-735951
  misc_feature 1..1210: note = hypo
  source 1..1210: mol_type = genomic DNA

SEQ ID NO: 79332 - DNA, 33 bp, Homo sapiens; identical to SEQ ID NO: 36062
  misc_feature 1..33: note = chr16:7354091-7354124
  misc_feature 1..33: note = hyper
  source 1..33: mol_type = genomic DNA

SEQ ID NO: 79333 - DNA, 270 bp, Homo sapiens
  misc_feature 1..270: note = chr16:7354388-7354658
  misc_feature 1..270: note = hyper
  source 1..270: mol_type = genomic DNA
tgcagcatcctctgacgggggccacctgcgtggcgctccccaacgtgggcatgtgtccccagctttcgtgtgccttgacttttatgtacttacagcaggtaaggcgcgcgtctgccctcggtggctgctttcctggggctgggccagatgggtccccgcgcgtactgggctgcgcttcggtgccttatgtaggttctgaggagggggctcccgcgttgcgatggaaagggtggatggaagcctcctgctctctgtggagcccgggcacct

SEQ ID NO: 79334 - DNA, 30 bp, Homo sapiens
  misc_feature 1..30: note = chr16:73558881-73558911
  misc_feature 1..30: note = hypo
  source 1..30: mol_type = genomic DNA
gactgtctccaggttcgaggtagagctgtg

SEQ ID NO: 79335 - DNA, 205 bp, Homo sapiens
  misc_feature 1..205: note = chr16:73693831-73694036
  misc_feature 1..205: note = hypo
  source 1..205: mol_type = genomic DNA
tggtcactgtaattacggaaggtgtatcatttcctaagctctctttgcattaagtgtatgccatacatacatcagacataattagcactttaggtgacaatgatttgatttctttccttgtaataaaagccctctgcgttggcatatacattcagaacgggaaattgaacactgttgctgtttattcacccgaggcaaaatttag

SEQ ID NO: 79336 - DNA, 17 bp, Homo sapiens
  misc_feature 1..17: note = chr16:73984305-73984322
  misc_feature 1..17: note = hypo
  source 1..17: mol_type = genomic DNA
gagtcgcaggcaggccg

SEQ ID NO: 79337 - DNA, 27 bp, Homo sapiens
  misc_feature 1..27: note = chr16:740887-740914
  misc_feature 1..27: note = hypo
  source 1..27: mol_type = genomic DNA
tgtgagccaccgcgcctggcctgtttt

SEQ ID NO: 79338 - DNA, 338 bp, Homo sapiens
  misc_feature 1..338: note = chr16:741169-741507
  misc_feature 1..338: note = hypo
  source 1..338: mol_type = genomic DNA
ccaactcctggcctccgccttcccctgcccacctccagccatggcagcctccacccccattcccagcccaccaagccctttcctgcctcagggacattgtacgtgcgtgcgatgcctcctccacagagcggacctccctgaccactgccctaatgggcttctccatcactgtggcctccacggcacttgtcaccacccattcgtttgtttactggttgttgtcggtcacatacgagtgtgaattccaccaaggcaggaatcacattctggctcaatccccaccgaatgcccagtgcctgacacacctgttcaaccagttgctctcgttctttttttta

SEQ ID NO: 79339 - DNA, 30 bp, Homo sapiens; identical to SEQ ID NO: 44742
  misc_feature 1..30: note = chr16:74331835-74331865
  misc_feature 1..30: note = hypo
  source 1..30: mol_type = genomic DNA

SEQ ID NO: 79340 - DNA, 30 bp, Homo sapiens
  misc_feature 1..30: note = chr16:74401355-74401385
  misc_feature 1..30: note = hyper
  source 1..30: mol_type = genomic DNA
catcccggtacatcacgtttacatgcatgc

SEQ ID NO: 79341 - DNA, 20 bp, Homo sapiens
  misc_feature 1..20: note = chr16:74490343-74490363
  misc_feature 1..20: note = hypo
  source 1..20: mol_type = genomic DNA
caccgcgcccggccctgacc

SEQ ID NO: 79342 - DNA, 30 bp, Homo sapiens
  misc_feature 1..30: note = chr16:74702004-74702034
  misc_feature 1..30: note = hypo
  source 1..30: mol_type = genomic DNA
aagcaaaagggtgcacgcttcagaatattt

SEQ ID NO: 79343 - DNA, 179 bp, Homo sapiens
  misc_feature 1..179: note = chr16:7489013-7489192
  misc_feature 1..179: note = hypo
  source 1..179: mol_type = genomic DNA
tggagcagagttcagcggaaaccaccgcactttgttttgttgagccaacgcagagtctctctgtgcactctcagtgtgcacagaggagcatggtcctcgcgctggcaaatggatgcccttgtccttctgcttaagtcttctttacgcaggccttcgcgctgtgtcgtcttcaccattgc

SEQ ID NO: 79344 - DNA, 152 bp, Homo sapiens
  misc_feature 1..152: note = chr16:74901411-74901563
  misc_feature 1..152: note = hypo
  source 1..152: mol_type = genomic DNA
gccaaaccacgcatacagtaaggaagagacagcatggcgccagccaggcaaagaccccatctccataataagattacggtggggtgcccagcttcctcttgtgctaaacgtcacacctggtccaccctatccgtgggcgctacgtaaatcag

SEQ ID NO: 79345 - DNA, 240 bp, Homo sapiens
  misc_feature 1..240: note = chr16:75019623-75019863
  misc_feature 1..240: note = hypo
  source 1..240: mol_type = genomic DNA
ctccgtctcggaaaaaaaaagaaaaaagaaaaatcaaagctcgtgcaaaccgaagatacctcttctcctgatgcctatcccatcgagatatttaaaagtctgaatgtgcaatttattgtttcatacaatacagcagcgcctcccgtaacaatgaaggtagacttaaatgtgagaatccagctgttttcttgatctgtagtccaatgctctacctgtgagctataccccctcctgcaatcc

SEQ ID NO: 79346 - DNA, 1062 bp, Homo sapiens
  misc_feature 1..1062: note = chr16:750349-751411
  misc_feature 1..1062: note = hyper
  source 1..1062: mol_type = genomic DNA
ggaggcacccacagccggtgacccccatcatgtgcccatgatcagaaggcgcggcctccggaggccgacatcacaacgtttgcaagggccggctggggtcggcacatgattcgacctcacggccgcccttaggggtggaggggtcgctacctcaggtttggggaaggaacacgaggctctgaggagcgaatttgccccaggtgtccggggaggcctggcgcggggctgcctcggttccctcccagagccggggagaggggatatcgcaggatgccggcgcccgaggcggcagcaccaggcccacgggcgccccagtctaaatatcctccgtgcccctagagcggggaccctcgctccccagacccggaagcgccgccttccccgccagggacgcctgggcctccgcagaccccgccggccggcgcgccacccgcgccagcaccatggacagcggccgccccagccgcgcgctcagggccaggcccgggctggcttccaccgcggacggctgcggggtcggggcagccccgcaatcccaaatcccggcagcccccgctcagcagggaggggccccgggggcgaagagtgggggagaagccgggaaggatccggaggaggcggcgggggcggcgccaggggaggaataatcccggcgcagtgccgatttaggttgaaaacgctcccagtcatgggcctgcacgtggagcgccggggctgggggaggcattcgcggggctcctttcccgccccgctcgggagctcacgtttgccggcgcccacagtcccgtccccacctccaggcctcagggtcgagatggagaaaccaagccgcactttgagagcccacaggagggaggggacaggctgaggagcggccgtctgggtatgggtccggggcctggcttccctcatccacacccgcagcgctgccagaaggcgctgctctgcctgtggtcagccctcgacccgtgtgcttggtgggagctgcatccccgcacaggcagccccactgctccccaatctcgcgtccacgttcctgccggcccccgctgctcctcacac

SEQ ID NO: 79347 - DNA, 30 bp, Homo sapiens
  misc_feature 1..30: note = chr16:75112923-75112953
  misc_feature 1..30: note = hypo
  source 1..30: mol_type = genomic DNA
ccattcttatctacccggttcaagtaacct

SEQ ID NO: 79348 - DNA, 598 bp, Homo sapiens
  misc_feature 1..598: note = chr16:75148553-75149151
  misc_feature 1..598: note = hypo
  source 1..598: mol_type = genomic DNA
tgccacagagagaggcgtccgcgcctgggtctggagggcggcgtacagaaggcagcctcagggaccggaggtcctttccctcgggctgggggaggaaggtcccctgaaccccagacacagccctgctcccacggtgccctcagggtcccaggaaaggttcgcgagtcctacccacgggaaaccagaggccgctgtcccgcaggtgggcgttgagggctttgcgggtgacacctggctccaccaccacagagaagtcctcctggttcagctccaggattcggtccatatgcgtcaggttaacgcagacgccgccctggttggggcaggtgctaagaccactgcagacctgggtctctgacctggccacgtccccggaccacaccccgcgggtgtccccccagcagccagaccagacccccagaggcaggcagcccacgggcgggagcagacccaaggtgccgtgtgtggcgggggaggcagccacaggtgtgccaaggtgtgctgggaccatcctcgggccgggcgagggagccccactgtacctgcacagcacagacgccaccctcaagcccggtgccggtgccgaatgggatgatgg

SEQ ID NO: 79349 - DNA, 37 bp, Homo sapiens; identical to SEQ ID NO: 44746
  misc_feature 1..37: note = chr16:75171636-75171673
  misc_feature 1..37: note = hypo
  source 1..37: mol_type = genomic DNA

SEQ ID NO: 79350 - DNA, 38 bp, Homo sapiens
  misc_feature 1..38: note = chr16:75178915-75178953
  misc_feature 1..38: note = hypo
  source 1..38: mol_type = genomic DNA
ttcaagttttaatcacgttgtagcgtgtaccagaacgt

SEQ ID NO: 79351 - DNA, 120 bp, Homo sapiens
  misc_feature 1..120: note = chr16:75183609-75183729
  misc_feature 1..120: note = hypo
  source 1..120: mol_type = genomic DNA
ccgcgtccggccagacacaatttattgatgtaactgttcctctaaatactactttaactacatcactcaaatttttatatcttgtattttcttttctgttgttgttgtttttgagactga

SEQ ID NO: 79352 - DNA, 30 bp, Homo sapiens
  misc_feature 1..30: note = chr16:75227098-75227128
  misc_feature 1..30: note = hypo
  source 1..30: mol_type = genomic DNA
ttcggcactgcagcacgcttcaagtgctcc

SEQ ID NO: 79353 - DNA, 87 bp, Homo sapiens
  misc_feature 1..87: note = chr16:75403259-75403346
  misc_feature 1..87: note = hypo
  source 1..87: mol_type = genomic DNA
aatatagcaaaagttcgcttcaaaaaaaacaaaaacaaaacaacccacaaaaaaacaaaaagccaaaaaacccgcacactgctatac

SEQ ID NO: 79354 - DNA, 35 bp, Homo sapiens
  misc_feature 1..35: note = chr16:75465061-75465096
  misc_feature 1..35: note = hypo
  source 1..35: mol_type = genomic DNA
acactgggcctggcacggtggctcacgcctgtaat

SEQ ID NO: 79355 - DNA, 34 bp, Homo sapiens
  misc_feature 1..34: note = chr16:75465516-75465550
  misc_feature 1..34: note = hypo
  source 1..34: mol_type = genomic DNA
acagagcgagacactgtctcgaaagaaaaaaaaa

SEQ ID NO: 79356 - DNA, 39 bp, Homo sapiens
  misc_feature 1..39: note = chr16:75469080-75469119
  misc_feature 1..39: note = hypo
  source 1..39: mol_type = genomic DNA
gattacaggcgtgagccaccgcgccgggcaccttcaagg

SEQ ID NO: 79357 - DNA, 198 bp, Homo sapiens
  misc_feature 1..198: note = chr16:75528671-75528869
  misc_feature 1..198: note = hyper
  source 1..198: mol_type = genomic DNA
gcgatgccctttccacgttgctgatggaaaagccactcccagctcttcccgccaccccaggtccccggtgcaggacagaggagcgtccccagctgtgccaccagcccggcccccagccgacccgagtgtggggacatcccccgcggagaatgaagaaccaacgtaccccaaagcttggcggctctgcccgagctgcag

SEQ ID NO: 79358 - DNA, 451 bp, Homo sapiens
  misc_feature 1..451: note = chr16:75528922-75529373
  misc_feature 1..451: note = hyper
  source 1..451: mol_type = genomic DNA
cgtctcttccaaattccaccgcacagccagctctttctcttcactgggagggtccgcaggggctgacttgctccttaaggtcccaagactattaagcgacacccggtgaggccgggaaaggggctctaagaggcatggacgagagttggcggtgaccaagccactggaagctcctggagactcgaggtagaacgaatgtgggaacagggcaggagtcccagaatgggatgttgaggctgggggtgtcctggggctaccacagggaaggacccggcgcagagctccctctggaacccggcactgcggcccgcgccctctactccccgcgcgccggccggcaaccctcggcgctgcccggtgcagcccgcccgagcgcacacaatgaggcgctttcagacgtggctgcggtcccgaggtggccagcgggagctagcgccgtgggggaaggaag

SEQ ID NO: 79359 - DNA, 32 bp, Homo sapiens
  misc_feature 1..32: note = chr16:75549843-75549875
  misc_feature 1..32: note = hypo
  source 1..32: mol_type = genomic DNA
caacaagagctaaactccgtctcaaaaataaa

SEQ ID NO: 79360 - DNA, 166 bp, Homo sapiens
  misc_feature 1..166: note = chr16:755523-755689
  misc_feature 1..166: note = hyper
  source 1..166: mol_type = genomic DNA
tcctggctcatgccacgctgtccgccgggcgacctcccgtcatggggagcccggcatgggcgtcggcgcgcgggggccgccggggtgctggactggccggcagggcccggccgcgccctgcgccccgcgtcccgtcctggccgggccccctcggcagcgcacggaa

SEQ ID NO: 79361 - DNA, 144 bp, Homo sapiens
  misc_feature 1..144: note = chr16:756288-756432
  misc_feature 1..144: note = hyper
  source 1..144: mol_type = genomic DNA
ctcccgcccagcccacggcaaggacccttcacagccctcacaccccccgcgcacctgctgcgtgcccggccggaagcccctcattggagaccctggcacacccgcagagcgcgaaaacaagtgactgcacggatcagttcagac

SEQ ID NO: 79362 - DNA, 99 bp, Homo sapiens
  misc_feature 1..99: note = chr16:75658303-75658402
  misc_feature 1..99: note = hypo
  source 1..99: mol_type = genomic DNA
ctggattacaggcgtgagccaccgcacctggctgccgagtctcaatattttaaaaaatacttatgttctgttctgtttttaatgcgaagtttaagaaat

SEQ ID NO: 79363 - DNA, 120 bp, Homo sapiens
  misc_feature 1..120: note = chr16:75666903-75667023
  misc_feature 1..120: note = hypo
  source 1..120: mol_type = genomic DNA
gccagatggccctcttggggggaggttgaccaaagatactgctccctaatggtatttactttagaccatggtacctggactttaataattcctagaactcctctcttacgatgttaatta

SEQ ID NO: 79364 - DNA, 99 bp, Homo sapiens
  misc_feature 1..99: note = chr16:75680068-75680167
  misc_feature 1..99: note = hypo
  source 1..99: mol_type = genomic DNA
cccaactataaacttcgacaatttctcttatactttttctaagatatttgaagcacaaagccagggacacaaaaggaaacatcaggccaggggtggtgg

SEQ ID NO: 79365 - DNA, 69 bp, Homo sapiens
  misc_feature 1..69: note = chr16:7568309-7568378
  misc_feature 1..69: note = hypo
  source 1..69: mol_type = genomic DNA
aaacctgtaccctcccgcccagacgcactccgagcagagcccggcggacacgagcgctcagaccgtctc

SEQ ID NO: 79366 - DNA, 30 bp, Homo sapiens; identical to SEQ ID NO: 44750
  misc_feature 1..30: note = chr16:75733411-75733441
  misc_feature 1..30: note = hypo
  source 1..30: mol_type = genomic DNA

SEQ ID NO: 79367 - DNA, 32 bp, Homo sapiens
  misc_feature 1..32: note = chr16:75787877-75787909
  misc_feature 1..32: note = hypo
  source 1..32: mol_type = genomic DNA
cacctgggcaacaagagcgaaactccatatca

SEQ ID NO: 79368 - DNA, 30 bp, Homo sapiens; identical to SEQ ID NO: 44418
  misc_feature 1..30: note = chr16:760916-760946
  misc_feature 1..30: note = hypo
  source 1..30: mol_type = genomic DNA

SEQ ID NO: 79369 - DNA, 41 bp, Homo sapiens; identical to SEQ ID NO: 36256
  misc_feature 1..41: note = chr16:76311161-76311202
  misc_feature 1..41: note = hyper
  source 1..41: mol_type = genomic DNA

SEQ ID NO: 79370 - DNA, 30 bp, Homo sapiens
  misc_feature 1..30: note = chr16:76685067-76685097
  misc_feature 1..30: note = hypo
  source 1..30: mol_type = genomic DNA
ttcctactagagtatcgatatgagttgaac

SEQ ID NO: 79371 - DNA, 36 bp, Homo sapiens
  misc_feature 1..36: note = chr16:766969-767005
  misc_feature 1..36: note = hypo
  source 1..36: mol_type = genomic DNA
ggccgcatgcaccagcgacttcggtgagtgtccccg

SEQ ID NO: 79372 - DNA, 955 bp, Homo sapiens
  misc_feature 1..955: note = chr16:77245975-77246930
  misc_feature 1..955: note = hyper
  source 1..955: mol_type = genomic DNA
gtgtagccaagaggacggccaaacggggaggcctcctctttgtcctcgcagatgctggagcagcgactggcccgggagatccgtgccctggagagaagcaaggagcagctgctctcggagagtgagcctcccgcgccaggtgggcggggggagggggatgtgcccgggcctcggccctgcccctgacgcccgcccaccgacagggaggctggtgcgcgccaagctgcgggaggtggagcggcggctgcactcgccgcctgaggtcgagggcgccatggcggtgaatgacgggtgagaggggaagggaggagtgggcgaggagggcaggggcagggcggaggggaacccgcccaggtcccccgctccgcccccgactgccgcttccccggcctgtgcctccctcggcgtcgtcgggtctccgcgtctcggtggcttcctcctcgtcccctggactctcgctctcttcctcctgtctcctcggccccttctccgcaggctgaaggcggagctggagatattcggggagcaggtccggagcgcccccgaggtcggggccggcgagggagaggtagggagcccgaggaagggaggcggggcgggcagggaccgagtcaggagagagcgggcgggggtcctgggagcggcccccgagagtggggtctgtggggagcagggcggccccggggacagaggaagccgcggtggaggcctagggcagacgcgggcggacgcgaggagcgtaggaacctggtccgcagcctcacccagcccccggcaggccggacctgagctcccccgcgctcgcgacgaggaggatcccgagccgccggtggctgcccctgacgccctctaggccagcaggacccgcccgttcccgaccttccctcgagacccgccaagaaataaaggcgatgatttccgaccatgctcgcgttctccgcggagtctgtgctac

SEQ ID NO: 79373 - DNA, 129 bp, Homo sapiens
  misc_feature 1..129: note = chr16:77247382-77247511
  misc_feature 1..129: note = hypo
  source 1..129: mol_type = genomic DNA
tctgttaaatgtgtccgccactctggaggccggcatttgggacccaaatccaaaggcacccagcagcaggctgcggccattgactgagcatgtactgactaagcaggcatttgccgattgcctgctggg

SEQ ID NO: 79374 - DNA, 67 bp, Homo sapiens
  misc_feature 1..67: note = chr16:77247715-77247782
  misc_feature 1..67: note = hypo
  source 1..67: mol_type = genomic DNA
tctggagaaggccggcgtggtagagtggaatgaggtagagtgggatgggagacgacactggagagtt

SEQ ID NO: 79375 - DNA, 25 bp, Homo sapiens
  misc_feature 1..25: note = chr16:77372556-77372581
  misc_feature 1..25: note = hypo
  source 1..25: mol_type = genomic DNA
agtaagtggcttggccgggcgcggt

SEQ ID NO: 79376 - DNA, 197 bp, Homo sapiens
  misc_feature 1..197: note = chr16:77468261-77468458
  misc_feature 1..197: note = hyper
  source 1..197: mol_type = genomic DNA
agggtcaaagtgctgcgaaaggcccttcttggggatggggggcaaatacgaaccatcatttaatccgctggcgccgctgctgctgtcactggctaaggccgcggcgaccgacgcacagcagaggcagcacagctggagcgcctgcaagagaaaaggtgacatcgcgcgtgaggggcgcggcggggctggcgtcgggc

SEQ ID NO: 79377 - DNA, 92 bp, Homo sapiens
  misc_feature 1..92: note = chr16:77469028-77469120
  misc_feature 1..92: note = hyper
  source 1..92: mol_type = genomic DNA
gggctcgtccgagcccccgggctggtgcaagggcgtgggattcccggctccagctctgagggagggggcgaagggggcggggaggctgggtg

SEQ ID NO: 79378 - DNA, 273 bp, Homo sapiens
  misc_feature 1..273: note = chr16:775524-775797
  misc_feature 1..273: note = hypo
  source 1..273: mol_type = genomic DNA
ctggtgccatctcctcgcagctccagctccagtacccggctctccagccgaaggatctgtgggacaactggcatgagcaggtgcacctgcccgcgggccacctggggtaggtgaacattcacccggtgcacgctcaggggcgcgcagcactcagaggcaggctgagacccacagatgccatgtgcgtgtgcatgcccatgcagggcacgtgtcctgggcctgcaccccccgtcccccatgcactgaggctggttcacacggctgctcacctca

SEQ ID NO: 79379 - DNA, 30 bp, Homo sapiens
  misc_feature 1..30: note = chr16:77753074-77753104
  misc_feature 1..30: note = hypo
  source 1..30: mol_type = genomic DNA
ttgtaaatatcacagcgatatttcactgat

SEQ ID NO: 79380 - DNA, 200 bp, Homo sapiens
  misc_feature 1..200: note = chr16:77753871-77754071
  misc_feature 1..200: note = hypo
  source 1..200: mol_type = genomic DNA
acagcgatgtttcatcggtatcacagtttgtaaaccttggatattataaacatcacagcgatatttcatttatatcacgatgtgtaaacactggatactataaatatcacagcgatgtttgcttaatatcacggtgtgtaaacactgtatattacaaatatcacagccatattttattaatatcacggtgtgtacacact

SEQ ID NO: 79381 - DNA, 302 bp, Homo sapiens
  misc_feature 1..302: note = chr16:77822117-77822419
  misc_feature 1..302: note = hyper
  source 1..302: mol_type = genomic DNA
agagggcaaccttgtcgcggtaaggcatcctccaggcccagacattagtctcggtccatttcaaggcacccgagcctgtgccgtatataaccaagtactgggcccacaggaagggggatgacagggtggtctctctaggctcgttttagtcacagatcttcggcaaatttgggtttagggccgcgatcccgaccctaacttgggactatttcaggaactggagttgaggcttcgttgggacaggaaagaagggtggggcgggggtgaagcgcttagggcacggctcttgtgaggattacggc

SEQ ID NO: 79382 - DNA, 900 bp, Homo sapiens
  misc_feature 1..900: note = chr16:77822420-77823320
  misc_feature 1..900: note = hyper
  source 1..900: mol_type = genomic DNA
gaggctgtggaccgcggcggcgctcgcagaggctgcagccattgcacagccgagcatcccacattcaacaggaggaacccgcgggagaggagccccactcccccagcgccgcagccaccgcagccaccgcagcccgtgcgccccgcgccctcgagcgccatggccaaggaaggcgtggagaaggcggaggagacggagcaaatgatcgagaaggaggcaggcaaggagccggcggagggcggcggcggcgacggctcgcaccgcctcggggacgcccaggagatgcgcgcggtggtgctggctggcttcggggggctcaacaagctgcggctcttcaggaaggccatgcccgagcctcaggacggcgagctcaagatccgcgtcaaagcctggtccagtatccgcgcctttctcgctttctctctttttgcgcgctgggcgctggggagggggtgggaaagctgcggctgggatgctgcccgggtagaaccgccgcgcgcaccccctccgcgccctcacccgggtctcagagcctccccgggccaaagctggggaggatgcagaggggcggcctccccaagccagatctaggggtgacgggaggagaatgtgagctcctgggcgcggggagaatgctggcgcccaggcaccccgggtctggaagattgcgctacgggagttctccgtctgagaggacaactcagctttcgcacgggagggttgatgcttaacagaattaaaaatatatgtattaagaaccgcaagcccactgtgtgccagccgccgttggtagttttacacgtgcgatcttatttaatacttcctgggacctaatgagtcaggtgccatcatgatccgtttacaggtaagaaagccgccgctcagcgagaatgagtgatt

SEQ ID NO: 79383 - DNA, 30 bp, Homo sapiens
  misc_feature 1..30: note = chr16:78057993-78058023
  misc_feature 1..30: note = hypo
  source 1..30: mol_type = genomic DNA
atactgtacttctttcggtgaaagattaaa

SEQ ID NO: 79384 - DNA, 408 bp, Homo sapiens
  misc_feature 1..408: note = chr16:78079769-78080177
  misc_feature 1..408: note = hyper
  source 1..408: mol_type = genomic DNA
gatggaatgctgccccggggagcggctacagcgcgggatcctggggagatagctcaaggcaggccagggaaggacaggccgggcaatgggcgcggagacgaaggggccggacagcggcgaggcgctggctccggtcgcggcacccggctgctgagggcagtgctgctgcttgggacgttccaggcgaccaagtaccctcggcggccctggcagggcggtgcctggggtgggcgctgggcctccaggcctgcagccacgcttggcgctgtccgctagggccaggtgctgaagtgttggccgcgagcggagctgctgcagcgctggcttccccgggccgctgcgggtggacttggacaacataaagggctgattgagcggggccactttttcgcccgcgtaaagtgtcct

SEQ ID NO: 79385 - DNA, 30 bp, Homo sapiens
  misc_feature 1..30: note = chr16:7827953-7827983
  misc_feature 1..30: note = hypo
  source 1..30: mol_type = genomic DNA
agaggatacatgctgcgacaatctattgag

SEQ ID NO: 79386 - DNA, 30 bp, Homo sapiens
  misc_feature 1..30: note = chr16:79253226-79253256
  misc_feature 1..30: note = hypo
  source 1..30: mol_type = genomic DNA
gagtgcttaccaaaacgcctatctgaaatt

SEQ ID NO: 79387 - DNA, 48 bp, Homo sapiens
  misc_feature 1..48: note = chr16:79253546-79253594
  misc_feature 1..48: note = hypo
  source 1..48: mol_type = genomic DNA
ccacttcctgtgtgacgctgtgccaccattgtacgtctccactccaag

SEQ ID NO: 79388 - DNA, 52 bp, Homo sapiens
  misc_feature 1..52: note = chr16:79623822-79623874
  misc_feature 1..52: note = hyper
  source 1..52: mol_type = genomic DNA
ctccctgggcactgccgcgggtctgggactgcaggcccggcccaggactgag

SEQ ID NO: 79389 - DNA, 213 bp, Homo sapiens
  misc_feature 1..213: note = chr16:79632604-79632817
  misc_feature 1..213: note = hyper
  source 1..213: mol_type = genomic DNA
tagcaagcccacacccgagccggacccccgcggagcacttatcagggtggctagctggaatcgcgtgtcagactcacatgaaaaactcgggagaggacgggttgtcgctgctcgagccgttttctcggaagccgctgctcaccaacttctcgtatttctccttgtacgcgtccctctcgcgcaccagcctggagatctcctgcttgaggtggt

SEQ ID NO: 79390 - DNA, 504 bp, Homo sapiens
  misc_feature 1..504: note = chr16:79633073-79633577
  misc_feature 1..504: note = hyper
  source 1..504: mol_type = genomic DNA
cgcccccgccgcgcccccgccgcctccgccgccgccgccgccgccgccgcccccagcgctggccgggccaccgccgcccgcgcccccagcgccaccggccgaggcggccgcgctgcccgcggcgccgggcgcgccggccgtcgggtggtggtggtggccggcggcgtggtggtggtggtggtggtagtgcgggcccgcgccgctctgcgcggcggccgcggcgatcacggcggacaccacggcggcggcggggcccatctcctcgccgctgccgcccaaggaggcgccggcaccggccccggccgccgcggccagctgctgcgccccgcgcgcgtagccatcgaagccgccctggagctggtggctgttgctgatgagcgcctcgaccgcgtcctcggggctgaagcccagcgcctcggggttcagctgctgcgggtagccggtcatccagtagtagtcttccaggtgcgccttctgctcgctgcccgagcccgggctgggcgc

SEQ ID NO: 79391 - DNA, 51 bp, Homo sapiens; identical to SEQ ID NO: 36268
  misc_feature 1..51: note = chr16:79633792-79633843
  misc_feature 1..51: note = hyper
  source 1..51: mol_type = genomic DNA

SEQ ID NO: 79392 - DNA, 30 bp, Homo sapiens
  misc_feature 1..30: note = chr16:79634334-79634364
  misc_feature 1..30: note = hyper
  source 1..30: mol_type = genomic DNA
acacttcatgcttctcgcctcctcttctgc

SEQ ID NO: 79393 - DNA, 936 bp, Homo sapiens
  misc_feature 1..936: note = chr16:79634758-79635694
  misc_feature 1..936: note = hyper
  source 1..936: mol_type = genomic DNA
aacaaggaaacttttcggagctgtcaatcagggcccaatcagctgactgtcagctgggacgggctggcttaacccttcctgcgccgctgcctacccgggagggaacgaggcccggcgcaaagtttggtgtaagaggggaaggagtttttccagaggggcttcggcaatccgggcggacctgggagggcggtttgcttttctttggagcgcgagacaggcctcccatccggagccccagctcgctgggggctcactcggctgggattggcctgattcccctcccctgcctgccctccacccccaggattgtgaattcgcctcccagcttttcctcctcgcaccaactctggtacccaggtgtctgccggggaccttccttccctgagcctggccgtgcccggcgctcaaacttggccccaactctttgtccgtctctcgggcgcccgtgcggggaagggaccgggaagggagggatgcagtggggtgtccggatcggggctgcgggctgggcgccgcccggccatgcgcctgcccagaaggctgggcatccgtggagagggaaagcccattttatccctctctttacaacgaggtaaaataagttgtttagaggccattcttcacggagaccggctgcccgctggcgtcgcgtgcccttggacagagcgagcgcctatgcgagataactccggggaagctcaaagtcaggtcagccgggctcagccttccggctcctgactggccggagtttggcctttgagactcatattgcgcgctcgctctctctctctcttacacacacacacacaaacacacacacactcacactcacccgtccccttacgaaatctgacctctgtttatcagggtcaggcgcgccctttgcacttttacgtttcctttaattatttcggacttgatcgtggcagggagcaa

SEQ ID NO: 79394 - DNA, 30 bp, Homo sapiens
  misc_feature 1..30: note = chr16:79635937-79635967
  misc_feature 1..30: note = hyper
  source 1..30: mol_type = genomic DNA
tctaagattttaaagcgataggcaagtcga

SEQ ID NO: 79395 - DNA, 36 bp, Homo sapiens
  misc_feature 1..36: note = chr16:79674118-79674154
  misc_feature 1..36: note = hypo
  source 1..36: mol_type = genomic DNA
gtctgacttaagaaccggaggctggccgggcgcggt

SEQ ID NO: 79396 - DNA, 215 bp, Homo sapiens
  misc_feature 1..215: note = chr16:79804242-79804457
  misc_feature 1..215: note = hyper
  source 1..215: mol_type = genomic DNA
gacagaggcaagacacgcagcgagtgctctcgcgagagttcaccgagttgataaaattattaaaacacaaaatacacatttgcgtgagggggaaaaaatacccgcttgtccgtcctgtcccttcaggctgcgcaacgctggagggcgatgggagctccacacaggtgggacgagcctagcaggtaaaccttccaccggcccgagctccgcgacgc

SEQ ID NO: 79397 - DNA, 126 bp, Homo sapiens; identical to SEQ ID NO: 44420
  misc_feature 1..126: note = chr16:798233-798359
  misc_feature 1..126: note = hypo
  source 1..126: mol_type = genomic DNA

SEQ ID NO: 79398 - DNA, 194 bp, Homo sapiens
  misc_feature 1..194: note = chr16:79880975-79881169
  misc_feature 1..194: note = hypo
  source 1..194: mol_type = genomic DNA
ctcccactgctggtgcgggctcctgtagccaccgtggagggtataagcatcagaaatggcagccccttgctgcctgtgatctgtgtcttttgccttcctgaggtgggagggttcagaaagcccaacccatccccacccttccaggacattctttcttggccctgcgctggcatggctgtcgggatcgacagtcc

SEQ ID NO: 79399 - DNA, 30 bp, Homo sapiens
  misc_feature 1..30: note = chr16:80015013-80015043
  misc_feature 1..30: note = hypo
  source 1..30: mol_type = genomic DNA
aaacaaagcagcattcgagctgagccgtgt

SEQ ID NO: 79400 - DNA, 444 bp, Homo sapiens
  misc_feature 1..444: note = chr16:80574608-80575052
  misc_feature 1..444: note = hyper
  source 1..444: mol_type = genomic DNA
tcagcagtttttgaacgaataagtggttatcacattaattcgtgcctcaatgaatgaatgaatggacaaacacaggccgggagcctgacccacttccctcttccctcccgggacccactgctccaggattgggcgaacctcaggtgagcgcctgctcccctcttccgcgaaccttcgcctacggcggccgggaggcatcaggagcgcggtcagggcgaaaaagccgactcgcgagcgcgcaggcgcagccctgacgcttccgtggggccacttccttttttgtctcctagcaacggcgggtagcgttgttgacatcccgggaggctgtgccgccggcctgagcccagagtttcgcggcctccgcgatggtaaatctggggtctccgtccacgccccgccgttccaagcacgccgaccgtcaaggaccttcgcacccagcttctg

SEQ ID NO: 79401 - DNA, 225 bp, Homo sapiens
  misc_feature 1..225: note = chr16:80641678-80641903
  misc_feature 1..225: note = hypo
  source 1..225: mol_type = genomic DNA
gctatagatgttttgcgtttttgtggtgtttaggactttctttgaaagcagtgacgctaccctagagtatccatctctcctgtgaggtttctctgcctggagatgatggacaatttgtaataatgctgactgtctccctctgattgaagctgtcaatactgagaaaaggcatttgttaaattgcaaagggtcttttgcttattccctgtgcgacctctagcaagt

SEQ ID NO: 79402 - DNA, 135 bp, Homo sapiens
  misc_feature 1..135: note = chr16:80644760-80644895
  misc_feature 1..135: note = hypo
  source 1..135: mol_type = genomic DNA
gcccccagtggaccccgggcagaccttgctgaggcaggcacaacacagaaggcccagcaccctccccggcatgccaggctcgcaggggccactccacgccactgccatggcctcatccctcgccctctccccacc

SEQ ID NO: 79403 - DNA, 116 bp, Homo sapiens
  misc_feature 1..116: note = chr16:80654735-80654851
  misc_feature 1..116: note = hypo
  source 1..116: mol_type = genomic DNA
ggccgctgcagaacacgctccccactgcgctgaggagcagcagtttgctgtcgtctgtggctgcgttgcagagcgctcgccggacttctttcatgatctgccggcagagatgaatt

SEQ ID NO: 79404 - DNA, 30 bp, Homo sapiens
  misc_feature 1..30: note = chr16:80671402-80671432
  misc_feature 1..30: note = hypo
  source 1..30: mol_type = genomic DNA
aaagaactggattaacgaaaaaagaaaaaa

SEQ ID NO: 79405 - DNA, 181 bp, Homo sapiens
  misc_feature 1..181: note = chr16:80704532-80704713
  misc_feature 1..181: note = hypo
  source 1..181: mol_type = genomic DNA
agaaccccggggctccgtggacggcaacgtcttaatgacacgaggtgcgcaaacctatttccaggctcattttgccccagggtctcgattttctttctgggacaggatgaaagaaagagaagccatgttgcaacataaaaagtgtgaatcgaggcctcgaggctggcgctcccaggaacac

SEQ ID NO: 79406 - DNA, 115 bp, Homo sapiens
  misc_feature 1..115: note = chr16:80718633-80718748
  misc_feature 1..115: note = hypo
  source 1..115: mol_type = genomic DNA
agtcctgtaagacaccgtcttggtggccctgtcacctcctgaagagggcttgcctgaataccctttttttggcttggccaggggagggttaattcgcttccgtttatgggaggtc

SEQ ID NO: 79407 - DNA, 29 bp, Homo sapiens
  misc_feature 1..29: note = chr16:80837395-80837424
  misc_feature 1..29: note = hyper
  source 1..29: mol_type = genomic DNA
cgtccgagctggtgcgggggcagcaggtg

SEQ ID NO: 79408 - DNA, 44 bp, Homo sapiens
  misc_feature 1..44: note = chr16:80838149-80838193
  misc_feature 1..44: note = hyper
  source 1..44: mol_type = genomic DNA
gtgcgcgtgtgtgtgcgcgcgtgtgtgtgcgagtgtgtgtggtg

SEQ ID NO: 79409 - DNA, 189 bp, Homo sapiens
  misc_feature 1..189: note = chr16:80871876-80872065
  misc_feature 1..189: note = hypo
  source 1..189: mol_type = genomic DNA
gttacgtactaggtacggaagatacggcagtgagcaaaaccaatcatgttccttgtcctcatggggcttacagtggggggagaaaattataagcaaaaagaaaatacaaagaaatacaacacagaaagcacaggcatgaggaaggagggcacggttctgggaaggcttcttggccgaagcaaccagaca

SEQ ID NO: 79410 - DNA, 665 bp, Homo sapiens
  misc_feature 1..665: note = chr16:809389-810054
  misc_feature 1..665: note = hypo
  source 1..665: mol_type = genomic DNA
tgttcagggctcagccgtgtctacggggccctccgagctcttcctggaccctcctcggctccttcagttcagggctcagctgggcacgtgggcgcctccttggctcctccggctcaggcctctcctcgagctctgggccctgagtattctgggctccttccttggtttcctttggcctttggccgggaaagttgtgggtgtccgtggcagcctgggccacttcacagccccgcagccaacctgcggctccttcagagcaaagctgtgtggacacaaagggaacgccactcggagctggcctctccctttacctgtgagttcccgcccaagccggctgccttctgtcccctccccagagcccttgggtaactggtttgctacaagagtgtctggaatttttcagttgttctctgcggaagggagtttttaaaaggcccttaatcccttcttgacatttgtaagttgacgcttacacctggcagccttgctgaattctgtgtgcgtgaaggtccgattccaccgcgagtcacgatagaaaacccactctgtggagagaccagagatgaccgccgcgcacacctccgttcagcacacaaacctttgcaggtgttcatagcggaggcagattccgtactggggataagagctcacgacatgctgggagg

SEQ ID NO: 79411 - DNA, 30 bp, Homo sapiens
  misc_feature 1..30: note = chr16:80965838-80965868
  misc_feature 1..30: note = hyper
  source 1..30: mol_type = genomic DNA
gaaaggggagaggagcgagagagagaagag

SEQ ID NO: 79412 - DNA, 32 bp, Homo sapiens; identical to SEQ ID NO: 36273
  misc_feature 1..32: note = chr16:80966399-80966431
  misc_feature 1..32: note = hyper
  source 1..32: mol_type = genomic DNA

SEQ ID NO: 79413 - DNA, 16 bp, Homo sapiens
  misc_feature 1..16: note = chr16:8097095-8097111
  misc_feature 1..16: note = hypo
  source 1..16: mol_type = genomic DNA
agcattagggccaggc

SEQ ID NO: 79414 - DNA, 90 bp, Homo sapiens
  misc_feature 1..90: note = chr16:81042175-81042265
  misc_feature 1..90: note = hypo
  source 1..90: mol_type = genomic DNA
catgttggcctgggtggtcttgaacgactgacctcaagtgatacaccacgcccggcgcgctcccggcccctcgcccgtgttcttaatggg

SEQ ID NO: 79415 - DNA, 22 bp, Homo sapiens
  misc_feature 1..22: note = chr16:81111435-81111457
  misc_feature 1..22: note = hypo
  source 1..22: mol_type = genomic DNA
aggcgcggtggctcacgcctgt

SEQ ID NO: 79416 - DNA, 100 bp, Homo sapiens
  misc_feature 1..100: note = chr16:81230844-81230944
  misc_feature 1..100: note = hypo
  source 1..100: mol_type = genomic DNA
actaaaaatcatgcccgagggtggagctttaacatgctaatgagacataccacacatcaagaagcatgtgaccagactgcacaggcgctgaacattcccc

SEQ ID NO: 79417 - DNA, 30 bp, Homo sapiens; identical to SEQ ID NO: 16070
  misc_feature 1..30: note = chr16:81533258-81533288
  misc_feature 1..30: note = hypo
  source 1..30: mol_type = genomic DNA

SEQ ID NO: 79418 - DNA, 52 bp, Homo sapiens
  misc_feature 1..52: note = chr16:81557303-81557355
  misc_feature 1..52: note = hypo
  source 1..52: mol_type = genomic DNA
ttgtctggagagcaccgtgcctgttctccaaccacctcgtagcccctggtgg

SEQ ID NO: 79419 - DNA, 150 bp, Homo sapiens
  misc_feature 1..150: note = chr16:81564391-81564541
  misc_feature 1..150: note = hypo
  source 1..150: mol_type = genomic DNA
tttgtgtgctaggcacgtaccctcttttacatacattatcttcgatcagttcagcttcttctgcataaaaaagaaatttctctaccgtcccagggagaataattggaaaagcgagccctgagtactcagcccacccgcccttctcctgct

SEQ ID NO: 79420 - DNA, 151 bp, Homo sapiens; identical to SEQ ID NO: 44759
  misc_feature 1..151: note = chr16:81569552-81569703
  misc_feature 1..151: note = hypo
  source 1..151: mol_type = genomic DNA

SEQ ID NO: 79421 - DNA, 66 bp, Homo sapiens
  misc_feature 1..66: note = chr16:815699-815765
  misc_feature 1..66: note = hypo
  source 1..66: mol_type = genomic DNA
gccgcgtggcggcaacgctcctctcgggacccatcctggcggcagcctgaacggaccatcctccgg

SEQ ID NO: 79422 - DNA, 30 bp, Homo sapiens
  misc_feature 1..30: note = chr16:8158291-8158321
  misc_feature 1..30: note = hypo
  source 1..30: mol_type = genomic DNA
tttttttttaaccctcgcaactggggttta

SEQ ID NO: 79423 - DNA, 223 bp, Homo sapiens
  misc_feature 1..223: note = chr16:816004-816227
  misc_feature 1..223: note = hypo
  source 1..223: mol_type = genomic DNA
gaagaaggggtcaaacgaactccggccctgacccctgacccctgtgccctgcagagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataa

SEQ ID NO: 79424 - DNA, 30 bp, Homo sapiens
  misc_feature 1..30: note = chr16:81615132-81615162
  misc_feature 1..30: note = hypo
  source 1..30: mol_type = genomic DNA
ataatcttatggaaccgcagtcataaatgt

SEQ ID NO: 79425 - DNA, 30 bp, Homo sapiens
  misc_feature 1..30: note = chr16:81619949-81619979
  misc_feature 1..30: note = hypo
  source 1..30: mol_type = genomic DNA
gggtgctattatcatcgaaacagcgatagt

SEQ ID NO: 79426 - DNA, 120 bp, Homo sapiens
  misc_feature 1..120: note = chr16:81627222-81627342
  misc_feature 1..120: note = hypo
  source 1..120: mol_type = genomic DNA
aggcttgaaagtaatcgcctccgtgtattgagtgcccgccgaccacctggcgcgtctgggcattgagctcattggccgctggcacaaatggatcctcgcctcacccggtgcctgcctgta

SEQ ID NO: 79427 - DNA, 200 bp, Homo sapiens
  misc_feature 1..200: note = chr16:81632912-81633112
  misc_feature 1..200: note = hypo
  source 1..200: mol_type = genomic DNA
gaccaaggcccaaaccggcccttctaggatcatatcgttacctgccactttgcgtttgctgtatgactttccgtttgtgagattaaaaagaacatgaaatattttgacgggccttccccaaatgagcatccatgggtttctgccttggaggccaagctgatctataggtgtctgaggacctgctgcgtggggtagcaaca

SEQ ID NO: 79428 - DNA, 30 bp, Homo sapiens
  misc_feature 1..30: note = chr16:81694683-81694713
  misc_feature 1..30: note = hypo
  source 1..30: mol_type = genomic DNA
cggagagggcatgcccggcacccattctta

SEQ ID NO: 79429 - DNA, 30 bp, Homo sapiens
  misc_feature 1..30: note = chr16:81700035-81700065
  misc_feature 1..30: note = hypo
  source 1..30: mol_type = genomic DNA
attcagacaggctctcggggcttcaccata

SEQ ID NO: 79430 - DNA, 30 bp, Homo sapiens
  misc_feature 1..30: note = chr16:81739542-81739572
  misc_feature 1..30: note = hypo
  source 1..30: mol_type = genomic DNA
gaccagtggtggcagcgtcttctgggggct

SEQ ID NO: 79431 - DNA, 165 bp, Homo sapiens
  misc_feature 1..165: note = chr16:81779848-81780013
  misc_feature 1..165: note = hyper
  source 1..165: mol_type = genomic DNA
ataacttcatctactcgtgacacgtgggggtccgccgccgccactggcagggtgccttgagtgcttgagttttcgcccccagcacaggtggagaacccaactcccagaaaacatctggggcggaaacggaagcatggccgcagcggtgaacgcactgcattctgg

SEQ ID NO: 79432 - DNA, 197 bp, Homo sapiens
  misc_feature 1..197: note = chr16:81813400-81813597
  misc_feature 1..197: note = hyper
  source 1..197: mol_type = genomic DNA
cttgtgcccagagctcgcggacgctcggagccacacttccctgtctcacttcggtggttgcgggtggcgggtgggagcgataccgcgggaggcgcagtccttcccggagacttttggagagcttgcaggacactcgcgatgcccgctccgcagctgtctgcgtaattatgcgtgtgtctgtgcgtgttgtgttttgt

SEQ ID NO: 79433 - DNA, 30 bp, Homo sapiens
  misc_feature 1..30: note = chr16:81901263-81901293
  misc_feature 1..30: note = hypo
  source 1..30: mol_type = genomic DNA
tccttttgcctgggacgtgttctcccttgc

SEQ ID NO: 79434 - DNA, 102 bp, Homo sapiens
  misc_feature 1..102: note = chr16:821742-821844
  misc_feature 1..102: note = hypo
  source 1..102: mol_type = genomic DNA
ccataagcccaggggcgccaaaccttgtcagcaatgccagaagctggaggaggcaggaagggtcctccctgcagggttcagagggggcggggactgccagca

SEQ ID NO: 79435 - DNA, 189 bp, Homo sapiens
  misc_feature 1..189: note = chr16:8222706-8222895
  misc_feature 1..189: note = hypo
  source 1..189: mol_type = genomic DNA
aagtggctaggctcacggccgccttccaactttatgatggagaacggctcccttcaaatgtaaaaaccatcactcagcaaagcgtggcaggttggggtctcatctgtccaaatgtagcacacacattcattttgatttcagctgtgtccaattcgctgcctgcatatgcaatatcgcacacacctgagc

SEQ ID NO: 79436 - DNA, 16 bp, Homo sapiens
  misc_feature 1..16: note = chr16:822480-822496
  misc_feature 1..16: note = hypo
  source 1..16: mol_type = genomic DNA
ccgtctcaaaaaatga

SEQ ID NO: 79437 - DNA, 213 bp, Homo sapiens
  misc_feature 1..213: note = chr16:822897-823110
  misc_feature 1..213: note = hypo
  source 1..213: mol_type = genomic DNA
ggttctccagggccacgtcggaggccagcagagccatgaccgtgtcctgggaggtgatgctccactggccgatctcggtgcgggagtagaggtagaccagcgaggtgatgagccgcagctgatcctccgggaggccttgtgggtagatctgagcaggtgggcagggctaggcagggtcagcagaggtgccgcgcccaccggcctccctgtccc

SEQ ID NO: 79438 - DNA, 30 bp, Homo sapiens
  misc_feature 1..30: note = chr16:82336003-82336033
  misc_feature 1..30: note = hypo
  source 1..30: mol_type = genomic DNA
agtgcatatggcttccggcaggctgcctgt

SEQ ID NO: 79439 - DNA, 30 bp, Homo sapiens
  misc_feature 1..30: note = chr16:8234670-8234700
  misc_feature 1..30: note = hypo
  source 1..30: mol_type = genomic DNA
aaaataaaataaaaacgaagtgtttgagtg

SEQ ID NO: 79440 - DNA, 145 bp, Homo sapiens
  misc_feature 1..145: note = chr16:824015-824160
  misc_feature 1..145: note = hypo
  source 1..145: mol_type = genomic DNA
caggccccctctttgaccccttcccctccacttctgaccttggtcagaccttggctttccctgagttctaaccaagaacttgtccaaactacttctctgaagtcagccaggcccgagggaaaagctggaccggtgaggtgcaggg

SEQ ID NO: 79441 - DNA, 480 bp, Homo sapiens
  misc_feature 1..480: note = chr16:824923-825403
  misc_feature 1..480: note = hypo
  source 1..480: mol_type = genomic DNA
gcatgtgggggtctgcggcaccgatgctggacgcgtccatgtcacacaccagggccccgagcagttgctggtcggaggcgctgagtcgcaggcgggccaccccctgcagggccagcaggtcggcgcccagcgggaggctgcctccaatgcaccgggcccatcctgcccaggcgcccaccagacaggccacagccaccccccacacgctccggcccaccccacccagcgcccaccaggcaggccacagccgcacgccacagggcgaccctctggtcgggtagatggctcagcagctccacgtccccctgggcggcacggcggatgaaggcccggcagtcggcttcccgcacctggctcaggctacaggtgagtgtgaggctgtcaggccgactgggggtggggccggacctcccagcagccctgagatgcccctggggctttgagggcccccaggactcctgtggccgggtggccgggcag

SEQ ID NO: 79442 - DNA, 194 bp, Homo sapiens
  misc_feature 1..194: note = chr16:82540089-82540283
  misc_feature 1..194: note = hypo
  source 1..194: mol_type = genomic DNA
attcagtgggtctggcgcagtgcctgagaatctgcatttcttacaaattctgtttgggttctgatggcctgggagccacacgtcgagaaccactggtttagagaattttgtgcaggccagtttagttcatttctggctgttcttgaacccaaagaacctttccattgttttagtgttaccgtccctcctccttc

SEQ ID NO: 79443 - DNA, 426 bp, Homo sapiens
  misc_feature 1..426: note = chr16:82660301-82660727
  misc_feature 1..426: note = hyper
  source 1..426: mol_type = genomic DNA
taggctggaagtggccgccagtcccccgtgcaattccattctctggaaaagtggaatcagctggcattgcccagcgtgatttgtgaggctgagccccaacagtccaaagaagcaaatgggatgccacctccgcggggctcgctcctcgcgaggtgctcaccccgtatctgccatgcaaaacgagggagcgttaggaaggaatccgtcttgtaaagccattggtcctggtcatcagcctctacccaatgctttcgtgatgctgctgctgatctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgc

SEQ ID NO: 79444 - DNA, 176 bp, Homo sapiens
  misc_feature 1..176: note = chr16:82660728-82660904
  misc_feature 1..176: note = hyper
  source 1..176: mol_type = genomic DNA
ttctcctgtcccaggtagggaagaggggctgccgggcgcgctctgcgccccgtttctgcattcggatcgcccggcacgggcagggtgagggggctttcggggggtcggggcctccggtcgcggcggcgaagacagatcggggctcggtagggaggtcattccgagcccagagatcc

SEQ ID NO: 79445 - DNA, 233 bp, Homo sapiens
  misc_feature 1..233: note = chr16:82661179-82661412
  misc_feature 1..233: note = hyper
  source 1..233: mol_type = genomic DNA
ctcgggtccggattgcgggatgcggggctggagaggccgagcaggcaccaccgacttcccagggcgcccgggccccctggtacagcccggctgcccgctggaaggcgcctcggggcagcagagagcctcagcccggctgctgctgtcgctcaaaggcgccggcgccggccgcacccgcatcggggtccttttgctcccagaccccgggcccgaaagggccggagcgtgtcccc

SEQ ID NO: 79446 - DNA, 327 bp, Homo sapiens
  misc_feature 1..327: note = chr16:82661468-82661795
  misc_feature 1..327: note = hyper
  source 1..327: mol_type = genomic DNA
cggccagatcccgggctgccgcctctgctgccttccctgagcgggagcggagcgcagagaaaagttcaagccttgcccacccgggctgcagctgcttgttaaccctcagagcgccacggcgcgagggaagggcacgccaaccaggagagggggcgagggagatgcggtccgcctgcagtcacctctgcacctcagagatttcgggaagtttgagtgcaggaaagcagcgctccgaggccaggcctggggtgctggccgctgcggggggcacgccctgcgctgctcaggggcctgtggtttcggagagcaccccgatccagtccccca

SEQ ID NO: 79447 - DNA, 181 bp, Homo sapiens
  misc_feature 1..181: note = chr16:83151734-83151915
  misc_feature 1..181: note = hypo
  source 1..181: mol_type = genomic DNA
ctgcggatcactgtccggagactgctgtggggggaatcccacaagtcacacatggtctggtgttggtggcggccccagaacctcactctcctctgcacacctctgcgtgcctacgtctgttcctgtgactgaggggattgtgttcagcacactggaagtgcgaagacgtgtggcatatgtc

SEQ ID NO: 79448 - DNA, 169 bp, Homo sapiens
  misc_feature 1..169: note = chr16:83197025-83197194
  misc_feature 1..169: note = hypo
  source 1..169: mol_type = genomic DNA
gctataattgtgaaccgcccgctaacctcctcttgtagtgctccaggccagacgctcatcaccttgttttgttgtctttgccatcagcattatagtagagccattggcactcacccatgtccagccccgttcctcctgggcacacagaaatttccgactctgttttcta

SEQ ID NO: 79449 - DNA, 221 bp, Homo sapiens
  misc_feature 1..221: note = chr16:8322627-8322848
  misc_feature 1..221: note = hypo
  source 1..221: mol_type = genomic DNA
aaccccaaggtccaccgaagttcagtgacttagccaaaaatcacactgcaaggaaatgtcagagctggactagaatcctgtctcgagacatacttctttaatataccaccccttctttcgcagatgtatctttagaccagagtttctcaaacttagcactgctgacatttggggccagaaatactgcattgtcgggggctgccctgcgcattgtagaatgt

SEQ ID NO: 79450 - DNA, 30 bp, Homo sapiens
  misc_feature 1..30: note = chr16:83566510-83566540
  misc_feature 1..30: note = hypo
  source 1..30: mol_type = genomic DNA
cctgcatctgagcagcgtggcttgttagtt

SEQ ID NO: 79451 - DNA, 28 bp, Homo sapiens
  misc_feature 1..28: note = chr16:83670814-83670842
  misc_feature 1..28: note = hypo
  source 1..28: mol_type = genomic DNA
ttaaaatatcaaaaacgtctaatagaaa

SEQ ID NO: 79452 - DNA, 250 bp, Homo sapiens; identical to SEQ ID NO: 44427
  misc_feature 1..250: note = chr16:837308-837558
  misc_feature 1..250: note = hypo
  source 1..250: mol_type = genomic DNA

SEQ ID NO: 79453 - DNA, 32 bp, Homo sapiens
  misc_feature 1..32: note = chr16:83842937-83842969
  misc_feature 1..32: note = hypo
  source 1..32: mol_type = genomic DNA
tctggaaaagaatatcgcggacctcatgacac

SEQ ID NO: 79454 - DNA, 343 bp, Homo sapiens
  misc_feature 1..343: note = chr16:83968763-83969106
  misc_feature 1..343: note = hypo
  source 1..343: mol_type = genomic DNA
gtgtagcacctaaagcgccaatgagactgtgtagaaaaatgtagctgcgtgagcgggagggagttccggtttcatgcagggagcgctggcctggctgagaagacgctggagcacagacctgaattcactgaggcagcgtcgtgtgggcgtctgagggaacagtgttccaggcacagggaacagccagtacaaaggccctggggtaagagtcaatcaggagcagggaggagcccagggagatggagacggggacaagggacccagctcagcggtgacttgtcgatatccggcgtggtcagcagagggctttgttctggtgtgggtgtcccggccgctgtgtgga

SEQ ID NO: 79455 - DNA, 162 bp, Homo sapiens
  misc_feature 1..162: note = chr16:83974810-83974972
  misc_feature 1..162: note = hypo
  source 1..162: mol_type = genomic DNA
ggtgaccagcagagacgcaatgtcgagccacagaagccaggcacaagagagaacgtcctgcgcggttccatctatgccaacatcgagaacaggcacaactgatgtatgggacggaagtcagaaaaggggttgactgctgagccgggcccggtggctcacgct

SEQ ID NO: 79456 - DNA, 125 bp, Homo sapiens
  misc_feature 1..125: note = chr16:84001778-84001903
  misc_feature 1..125: note = hyper
  source 1..125: mol_type = genomic DNA
gtgggcgccgctccccggggctggagccggcagagggcgctccgggctcgctggacacccgcgcttcggcctctgctgcgcgccgcgagtgggaggggggactttagaagcggggagagcaggag

SEQ ID NO: 79457 - DNA, 66 bp, Homo sapiens
  misc_feature 1..66: note = chr16:84002378-84002444
  misc_feature 1..66: note = hyper
  source 1..66: mol_type = genomic DNA
ggagtcgctggcccccgccgcccccgcggaccccggcccagcctcgccgcgcgggggcaccgccgt

SEQ ID NO: 79458 - DNA, 30 bp, Homo sapiens
  misc_feature 1..30: note = chr16:84067071-84067101
  misc_feature 1..30: note = hypo
  source 1..30: mol_type = genomic DNA
acactgccagagacacggggagagctgagc

SEQ ID NO: 79459 - DNA, 30 bp, Homo sapiens
  misc_feature 1..30: note = chr16:84074841-84074871
  misc_feature 1..30: note = hypo
  source 1..30: mol_type = genomic DNA
caggcaaggccggcccggctctgtgtgggg

SEQ ID NO: 79460 - DNA, 41 bp, Homo sapiens; identical to SEQ ID NO: 16073
  misc_feature 1..41: note = chr16:84075186-84075227
  misc_feature 1..41: note = hypo
  source 1..41: mol_type = genomic DNA

SEQ ID NO: 79461 - DNA, 30 bp, Homo sapiens; identical to SEQ ID NO: 44764
  misc_feature 1..30: note = chr16:84129364-84129394
  misc_feature 1..30: note = hypo
  source 1..30: mol_type = genomic DNA

SEQ ID NO: 79462 - DNA, 30 bp, Homo sapiens
  misc_feature 1..30: note = chr16:84131007-84131037
  misc_feature 1..30: note = hypo
  source 1..30: mol_type = genomic DNA
tcaagatggaaaagacgcttactgctgaag

SEQ ID NO: 79463 - DNA, 39 bp, Homo sapiens
  misc_feature 1..39: note = chr16:84148968-84149007
  misc_feature 1..39: note = hypo
  source 1..39: mol_type = genomic DNA
cctggggagtgcagtcgtttgacacgtgtctgggtcagg

SEQ ID NO: 79464 - DNA, 30 bp, Homo sapiens; identical to SEQ ID NO: 44765
  misc_feature 1..30: note = chr16:84152910-84152940
  misc_feature 1..30: note = hypo
  source 1..30: mol_type = genomic DNA

SEQ ID NO: 79465 - DNA, 58 bp, Homo sapiens
  misc_feature 1..58: note = chr16:84153336-84153394
  misc_feature 1..58: note = hypo
  source 1..58: mol_type = genomic DNA
acctggaggtgaaaacgggaagatctggactggcaaccaaagtcgaacatgatggaag

SEQ ID NO: 79466 - DNA, 102 bp, Homo sapiens
  misc_feature 1..102: note = chr16:84328322-84328424
  misc_feature 1..102: note = hyper
  source 1..102: mol_type = genomic DNA
tgcctgggctgcagacgccctggttggagcgtctggggccagatgttatagggcaagctaaaaataaccgggcaggccagccaccatcgaggaaggggcatg

SEQ ID NO: 79467 - DNA, 398 bp, Homo sapiens
  misc_feature 1..398: note = chr16:84402023-84402421
  misc_feature 1..398: note = hyper
  source 1..398: mol_type = genomic DNA
ggcgagctcgcggggcggggccgggtgagccggcacctccctgtgcgcagccccgccccaggggcggggcctcacctgccgcgggcaggtagacagctacctggtaaccgggtccggcccaggaggcttgggcgcgcgcagccatcccgggcctcgccggggacctagggacgcaggcaacgcctgcgcccgctcaccatggtcgagggacgcgtctccgagttcctgaagaaactcggcttctcgggcgggggccgccagtaccaggcgctggagaaggacgaagaggaagccttggtgagtccccgcgactccgcgccgggcgtgcgacccgaccccccatcccctccgtcgtaaccgtccccggcccgagaccccgcgttcgcgctgcgatccgc

SEQ ID NO: 79468 - DNA, 30 bp, Homo sapiens
  misc_feature 1..30: note = chr16:84483442-84483472
  misc_feature 1..30: note = hypo
  source 1..30: mol_type = genomic DNA
acttaagagtggacacgttagtaagtaaac

SEQ ID NO: 79469 - DNA, 168 bp, Homo sapiens
  misc_feature 1..168: note = chr16:84573769-84573937
  misc_feature 1..168: note = hypo
  source 1..168: mol_type = genomic DNA
tgctggcagaagacacgagcctcctgggtcagagacaagtgactttattactcgcagcacagcaagtagcatgagctttatgtttgcatcggtttcccttgtccccaagtcccacaggggccatgcaaaggggcccggaaggggtgggtgttgcgcacacagcacatt

SEQ ID NO: 79470 - DNA, 654 bp, Homo sapiens
  misc_feature 1..654: note = chr16:845850-846504
  misc_feature 1..654: note = hypo
  source 1..654: mol_type = genomic DNA
gggtgggggattccccgcctgctgccctcctgtcctaggtgagcacacatttgtacagcctgctcagctccctgtctgctgcctcccatcccctaggtgagcacacagctgtacagcacccgtgaaaagcaacagctggccagcctggtgggcacgatgctcgcttacagcctgacctaccgccaggagcgcacgcccgatggccagtacatctacaggctggagccgtgagtcccccagtgcctggggtgtgctccagggtcatgctccccggctgtgctccatgttcagggcccgcatggggccaggagtctgaaagcacggtcatggcgtctgggggtggcgggccccagcttatcttttgctcagatgtaaccgtgaaggggggtcacttccagctacttgagattggctctgggacctgagttttgctgcagagctgctcccagccttagcacccccacatggaactggagccgggggccccgagagtgactgcactttccaacactccgtttcccgctgtgggatggccatgggggtggtgggggtgaggcatggggcagtggccccggggtcctgctgccccagcgacggcaccaacttgcaggacgctgagtcactctccgtggcagccatcggcaggtttcatca

SEQ ID NO: 79471 - DNA, 30 bp, Homo sapiens; identical to SEQ ID NO: 44767
  misc_feature 1..30: note = chr16:84593218-84593248
  misc_feature 1..30: note = hypo
  source 1..30: mol_type = genomic DNA

SEQ ID NO: 79472 - DNA, 122 bp, Homo sapiens
  misc_feature 1..122: note = chr16:84593455-84593577
  misc_feature 1..122: note = hypo
  source 1..122: mol_type = genomic DNA
cctgccccagagaggcgcacagttagtgggggaggggagaagcaactggaggagggagggaagagggcggactcattccccatggctgccacagtcagtcaccacaccgggggctcaacaca

SEQ ID NO: 79473 - DNA, 194 bp, Homo sapiens
  misc_feature 1..194: note = chr16:84633325-84633519
  misc_feature 1..194: note = hyper
  source 1..194: mol_type = genomic DNA
actttacagagactccggagaggttatgcaaacacggctcaggaagggaaaaaacaacccacacaccaaaaagctgagctgtcagcttccaccgagggagctccctggagcgaggatgaaaggaaatgggaaagaattcttacatcctgctgcccagagcaaggggacagctgggcagtcgccatggcagcggc

SEQ ID NO: 79474 - DNA, 78 bp, Homo sapiens
  misc_feature 1..78: note = chr16:847008-847086
  misc_feature 1..78: note = hypo
  source 1..78: mol_type = genomic DNA
gagaaaggggtgcaccgacctgccccacgcaaccatgagcagcggctggagcacatcatgaggcgagcggcccgggag

SEQ ID NO: 79475 - DNA, 142 bp, Homo sapiens
  misc_feature 1..142: note = chr16:84765227-84765369
  misc_feature 1..142: note = hypo
  source 1..142: mol_type = genomic DNA
aaaatccttttttctcgaaactttcaaaatgttgccccattgccttccatagccttgttgattttgctattaagacgttctgttgagttttttaatttagtgatttaaaattagtaattaatttccgcgaacactttcatga

SEQ ID NO: 79476 - DNA, 48 bp, Homo sapiens
  misc_feature 1..48: note = chr16:84780623-84780671
  misc_feature 1..48: note = hypo
  source 1..48: mol_type = genomic DNA
tcaggagcatcaagacgccactaggcggcaggacgtttcagttccact

SEQ ID NO: 79477 - DNA, 18 bp, Homo sapiens
  misc_feature 1..18: note = chr16:84852343-84852361
  misc_feature 1..18: note = hypo
  source 1..18: mol_type = genomic DNA
gcccggccagtctgcatt

SEQ ID NO: 79478 - DNA, 297 bp, Homo sapiens; identical to SEQ ID NO: 36283
  misc_feature 1..297: note = chr16:84853364-84853661
  misc_feature 1..297: note = hyper
  source 1..297: mol_type = genomic DNA

SEQ ID NO: 79479 - DNA, 30 bp, Homo sapiens
  misc_feature 1..30: note = chr16:84933190-84933220
  misc_feature 1..30: note = hypo
  source 1..30: mol_type = genomic DNA
atgctgccagttgcacggtggcatcctggg

SEQ ID NO: 79480 - DNA, 30 bp, Homo sapiens
  misc_feature 1..30: note = chr16:84998014-84998044
  misc_feature 1..30: note = hypo
  source 1..30: mol_type = genomic DNA
gggcctatgggactccgaggaggggaacta

SEQ ID NO: 79481 - DNA, 60 bp, Homo sapiens
  misc_feature 1..60: note = chr16:85001619-85001679
  misc_feature 1..60: note = hypo
  source 1..60: mol_type = genomic DNA
ctgaaagcataatgccgagtgaaagaagccagacacagaaggacacgttttgcaagattc

SEQ ID NO: 79482 - DNA, 426 bp, Homo sapiens
  misc_feature 1..426: note = chr16:85007493-85007919
  misc_feature 1..426: note = hypo
  source 1..426: mol_type = genomic DNA
gcccatgcagccgcccggctcaggtgtgcgcctccgtgttcgagtctccttctcatttccgcgtgtctggaatgccaccaggagccccaaggcacagcacgtgcgaggcagggctgcggcacacactgaccatctggcctctgaaaggtaagcgaggcagggctgcggcacacactgaccatctggcctctggaaggtaagtgggcattttggttccctcagtgcaaatgttagacaaatttgttgaatgaattaaaatcaaattgtaggtacttgagattctgaactgtggagattttgaaacattgtttttatttcaacgtgcactaaaaaaaggactaagtaaaacgatgggagtcgaattaaacattcaacaagcaacagtactcactgggcaacatttgtgagtcgcgcttgagtgcccag

SEQ ID NO: 79483 - DNA, 30 bp, Homo sapiens; identical to SEQ ID NO: 44770
  misc_feature 1..30: note = chr16:85010139-85010169
  misc_feature 1..30: note = hypo
  source 1..30: mol_type = genomic DNA

SEQ ID NO: 79484 - DNA, 173 bp, Homo sapiens; identical to SEQ ID NO: 16076
  misc_feature 1..173: note = chr16:85028164-85028337
  misc_feature 1..173: note = hypo
  source 1..173: mol_type = genomic DNA

SEQ ID NO: 79485 - DNA, 30 bp, Homo sapiens; identical to SEQ ID NO: 44772
  misc_feature 1..30: note = chr16:85028787-85028817
  misc_feature 1..30: note = hypo
  source 1..30: mol_type = genomic DNA

SEQ ID NO: 79486 - DNA, 75 bp, Homo sapiens
  misc_feature 1..75: note = chr16:85033827-85033902
  misc_feature 1..75: note = hypo
  source 1..75: mol_type = genomic DNA
cagcacaggtatgtacggccggtgtgatagtgcaagggtgcggcacaaggcaagtcccagcgagcagtggagtca

SEQ ID NO: 79487 - DNA, 212 bp, Homo sapiens
  misc_feature 1..212: note = chr16:85043907-85044119
  misc_feature 1..212: note = hypo
  source 1..212: mol_type = genomic DNA
atgagccacgagccaccgcgtgcgtaccaggccacaaagtgactaaaaggtgatttcaggtatgtaaacactgtaaaacataacaaaaaagagattcttcatctgtgagatgaagagttcagaaagaaatattaatacacattgacctaaatctctaaaccccttgggatagtaacagtaaaatagataaatacgtgcgcttaagtgcatac

SEQ ID NO: 79488 - DNA, 66 bp, Homo sapiens
  misc_feature 1..66: note = chr16:85075504-85075570
  misc_feature 1..66: note = hypo
  source 1..66: mol_type = genomic DNA
gtcccgctcttgaaacgattcccgggattccgagcgtttgcccctatgctgcgcactcctgtccct

SEQ ID NO: 79489 - DNA, 243 bp, Homo sapiens
  misc_feature 1..243: note = chr16:85083548-85083791
  misc_feature 1..243: note = hypo
  source 1..243: mol_type = genomic DNA
agtggaaggccaagtcggtctctgtccgagttgaattcagctgtcccggagtcagccgctgtgtccttttgtgaaagaagtacagcccgtcacccagggagggcgcgccttatggcgggttctaacacgcagttgcaatggaaccaactcagtcaatggtgatcgctgatggtaaacaacccctcaccctgcactgtctcggtgcctgaaactcaagggcccagccctcgactcaggaattac

SEQ ID NO: 79490 - DNA, 72 bp, Homo sapiens
  misc_feature 1..72: note = chr16:85136820-85136892
  misc_feature 1..72: note = hypo
  source 1..72: mol_type = genomic DNA
cccttctgccacatgcggactcatagcaggcaccagccatggggaacaggccctcctcggatgctgaatctg

SEQ ID NO: 79491 - DNA, 47 bp, Homo sapiens
  misc_feature 1..47: note = chr16:85141797-85141844
  misc_feature 1..47: note = hypo
  source 1..47: mol_type = genomic DNA
gtgtccagagctgtgcggcgggaggtggagcgcgaggtgccctccct

SEQ ID NO: 79492 - DNA, 135 bp, Homo sapiens
  misc_feature 1..135: note = chr16:85147716-85147851
  misc_feature 1..135: note = hypo
  source 1..135: mol_type = genomic DNA
gccatggggcagggacgggagcggcgcagtgtgagccaggagcacggagagctgccaggagccggagacagccccggagcctccggagggactgcagcagcctccgtagatccttgatttcggactctgtggccc

SEQ ID NO: 79493 - DNA, 30 bp, Homo sapiens
  misc_feature 1..30: note = chr16:8519135-8519165
  misc_feature 1..30: note = hypo
  source 1..30: mol_type = genomic DNA
tttgaagcacctctccgtctttcaagagcg

SEQ ID NO: 79494 - DNA, 207 bp, Homo sapiens
  misc_feature 1..207: note = chr16:85203399-85203606
  misc_feature 1..207: note = hyper
  source 1..207: mol_type = genomic DNA
ccgctgcttcctgggcgagcagtgggccgccttcgagcgcgcccgcacgccggtggacaagcgcatgtactggctcaagcggccccaccagtgcgacgcgggcgcaggcggccgccgtggcggcgccggggccccccgcgagtggaacgtcgcctacgcgctgggcagcgccaccggcgacgacgacgaggacgacggtggcggccc

SEQ ID NO: 79495 - DNA, 39 bp, Homo sapiens
  misc_feature 1..39: note = chr16:85255435-85255474
  misc_feature 1..39: note = hypo
  source 1..39: mol_type = genomic DNA
gggggccagagcccacgtcagtcccgcttggagccctca

SEQ ID NO: 79496 - DNA, 42 bp, Homo sapiens
  misc_feature 1..42: note = chr16:85264292-85264334
  misc_feature 1..42: note = hypo
  source 1..42: mol_type = genomic DNA
atgactggcctaccccggggcacatgccgtgtgtataaaggg

SEQ ID NO: 79497 - DNA, 137 bp, Homo sapiens
  misc_feature 1..137: note = chr16:85317660-85317797
  misc_feature 1..137: note = hypo
  source 1..137: mol_type = genomic DNA
aattaaatgcatgcccgtggctgtggcatgcgtgaggacagctgcctgccagccttcagaggccagttgttcagctttcaagatgcccccggcccaggagaaggcccggcgggtcgggaggccgggagaattgagaa

SEQ ID NO: 79498 - DNA, 48 bp, Homo sapiens
  misc_feature 1..48: note = chr16:85318173-85318221
  misc_feature 1..48: note = hypo
  source 1..48: mol_type = genomic DNA
cgattctcgggaactcggtgcagatgctgtattcgagccagcgagggg

SEQ ID NO: 79499 - DNA, 32 bp, Homo sapiens
  misc_feature 1..32: note = chr16:85328962-85328994
  misc_feature 1..32: note = hypo
  source 1..32: mol_type = genomic DNA
agttttcaaggttcacgcgtgctgcagcgcgg

SEQ ID NO: 79500 - DNA, 239 bp, Homo sapiens; identical to SEQ ID NO: 44779
  misc_feature 1..239: note = chr16:85336342-85336581
  misc_feature 1..239: note = hypo
  source 1..239: mol_type = genomic DNA

SEQ ID NO: 79501 - DNA, 30 bp, Homo sapiens
  misc_feature 1..30: note = chr16:85337464-85337494
  misc_feature 1..30: note = hypo
  source 1..30: mol_type = genomic DNA
atcgcctggcagtgccgctgcccccagggt

SEQ ID NO: 79502 - DNA, 30 bp, Homo sapiens
  misc_feature 1..30: note = chr16:85369520-85369550
  misc_feature 1..30: note = hypo
  source 1..30: mol_type = genomic DNA
ctccagcatgctgaccggctggcctgagtg

SEQ ID NO: 79503 - DNA, 30 bp, Homo sapiens
  misc_feature 1..30: note = chr16:85399740-85399770
  misc_feature 1..30: note = hypo
  source 1..30: mol_type = genomic DNA
tcgggtactgggctccggcctcccgaagtc

SEQ ID NO: 79504 - DNA, 30 bp, Homo sapiens
  misc_feature 1..30: note = chr16:85401274-85401304
  misc_feature 1..30: note = hypo
  source 1..30: mol_type = genomic DNA
ccctcaccatgaaggcggggaccgtggctc

SEQ ID NO: 79505 - DNA, 221 bp, Homo sapiens
  misc_feature 1..221: note = chr16:85427749-85427970
  misc_feature 1..221: note = hypo
  source 1..221: mol_type = genomic DNA
agccgtgactgctgacgaaaaacacaaacatctgtgaggggagaggcggggctggagggtgggaggcagccgggggccggggagcgaggtcaaggcccgagaaattaaatgttcataaatgtaggcctggcactcacaaagtagggcagagccattagcgctcattaaagtttaatacctgtcggtgctggtgcggccccgctggacgctgctctaatttg

SEQ ID NO: 79506 - DNA, 100 bp, Homo sapiens
  misc_feature 1..100: note = chr16:85455150-85455250
  misc_feature 1..100: note = hypo
  source 1..100: mol_type = genomic DNA
caaacagctgcacagcgattttctgaccaggcggggaggagaaggcaggttttcggggctgctggcagctgctcatttgcaggcccgagcttgtgaacgg

SEQ ID NO: 79507 - DNA, 30 bp, Homo sapiens
  misc_feature 1..30: note = chr16:85455735-85455765
  misc_feature 1..30: note = hypo
  source 1..30: mol_type = genomic DNA
tgcccgggtcatcctcgcaccccacctcgg

SEQ ID NO: 79508 - DNA, 30 bp, Homo sapiens
  misc_feature 1..30: note = chr16:85462609-85462639
  misc_feature 1..30: note = hypo
  source 1..30: mol_type = genomic DNA
cagcagcgtgcacaacgcacacatacaaca

SEQ ID NO: 79509 - DNA, 82 bp, Homo sapiens
  misc_feature 1..82: note = chr16:85464220-85464302
  misc_feature 1..82: note = hypo
  source 1..82: mol_type = genomic DNA
gggagctgcatggaacggggacgcctggtgccacccccagaggctctggcttgatagtccccaggtacgggctgggcacagg

SEQ ID NO: 79510 - DNA, 30 bp, Homo sapiens
  misc_feature 1..30: note = chr16:85464926-85464956
  misc_feature 1..30: note = hypo
  source 1..30: mol_type = genomic DNA
ggtgccgcatgatggcgtatggcaaaatct

SEQ ID NO: 79511 - DNA, 30 bp, Homo sapiens
  misc_feature 1..30: note = chr16:85478405-85478435
  misc_feature 1..30: note = hypo
  source 1..30: mol_type = genomic DNA
ccagtccctctcctccgccccctccagcct

SEQ ID NO: 79512 - DNA, 30 bp, Homo sapiens
  misc_feature 1..30: note = chr16:85479322-85479352
  misc_feature 1..30: note = hypo
  source 1..30: mol_type = genomic DNA
agccctctcctggctcgagggagagctccc

SEQ ID NO: 79513 - DNA, 108 bp, Homo sapiens
  misc_feature 1..108: note = chr16:85485747-85485855
  misc_feature 1..108: note = hypo
  source 1..108: mol_type = genomic DNA
tgggagtgctgaagccgtttgccaccctggcctgcatcggggccccgcaattaagccgattatgttttgagagtcaagctgtctgactcctcgcgtccctaatgtgat

SEQ ID NO: 79514 - DNA, 54 bp, Homo sapiens
  misc_feature 1..54: note = chr16:85496643-85496697
  misc_feature 1..54: note = hyper
  source 1..54: mol_type = genomic DNA
ccctcctagaggccccgggtcccgcggcccggggggcggcgcaggatgctgggc

SEQ ID NO: 79515 - DNA, 30 bp, Homo sapiens
  misc_feature 1..30: note = chr16:85498216-85498246
  misc_feature 1..30: note = hypo
  source 1..30: mol_type = genomic DNA
gtactcacgaagcctcgggaatgtgccacc

SEQ ID NO: 79516 - DNA, 42 bp, Homo sapiens
  misc_feature 1..42: note = chr16:85515663-85515705
  misc_feature 1..42: note = hypo
  source 1..42: mol_type = genomic DNA
acccatgaagggagccgctgttgtggacgacccaacttgtca

SEQ ID NO: 79517 - DNA, 45 bp, Homo sapiens; identical to SEQ ID NO: 44783
  misc_feature 1..45: note = chr16:85516822-85516867
  misc_feature 1..45: note = hypo
  source 1..45: mol_type = genomic DNA

SEQ ID NO: 79518 - DNA, 402 bp, Homo sapiens
  misc_feature 1..402: note = chr16:85517218-85517620
  misc_feature 1..402: note = hypo
  source 1..402: mol_type = genomic DNA
gggatcaagtgtctccgaggcggcgggctgagacggatgggcctcctggccgcacacctgagaacatgctggcaaaagcgtttgcttaattaattgactttgagcgagggagcccgtccccgtgtaaacctagcagcaggctcggtgcttgccgccgggatgctgcgaatgcaaggctagactttaaataagggtgtgattattgtgtgaataattgaagaatgttggggagcttgcagtcctcggtgtaccgtcccctgccagcaggcctctgggccctgcccgtcacgggtacaactctgctgccatcctctcagctgggacagtgggggactttcagacctaagcgttggaggaaacctcctcagcgaccctccccgagaggtgcgtccctgttttcca

SEQ ID NO: 79519 - DNA, 141 bp, Homo sapiens
  misc_feature 1..141: note = chr16:85537491-85537632
  misc_feature 1..141: note = hypo
  source 1..141: mol_type = genomic DNA
ccaggctggggaattcgccggcgcttaattaggaccggcagtgcggaagatagatggtcatcctttttgctcccttcattaggagggagggtcaggtgtggcggtggtcaccggagcccgggctgccgaccctgcagaaaa

SEQ ID NO: 79520 - DNA, 26 bp, Homo sapiens
  misc_feature 1..26: note = chr16:85586238-85586264
  misc_feature 1..26: note = hypo
  source 1..26: mol_type = genomic DNA
caggtggacctcgatggctgtctcca

SEQ ID NO: 79521 - DNA, 30 bp, Homo sapiens
  misc_feature 1..30: note = chr16:85612527-85612557
  misc_feature 1..30: note = hypo
  source 1..30: mol_type = genomic DNA
ctccccccagcacagcgatctggtttgtct

SEQ ID NO: 79522 - DNA, 70 bp, Homo sapiens; identical to SEQ ID NO: 44786
  misc_feature 1..70: note = chr16:85617748-85617818
  misc_feature 1..70: note = hypo
  source 1..70: mol_type = genomic DNA

SEQ ID NO: 79523 - DNA, 61 bp, Homo sapiens
  misc_feature 1..61: note = chr16:85618591-85618652
  misc_feature 1..61: note = hypo
  source 1..61: mol_type = genomic DNA
atggccagggaagtccgaagacctcgtcttccaaggccaaatccagcgtatggggcaggag

SEQ ID NO: 79524 - DNA, 59 bp, Homo sapiens
  misc_feature 1..59: note = chr16:85627887-85627946
  misc_feature 1..59: note = hypo
  source 1..59: mol_type = genomic DNA
acctccctgccccaccgcggtcagcttctccatctgctctccaccgaagcctcctttat

SEQ ID NO: 79525 - DNA, 30 bp, Homo sapiens
  misc_feature 1..30: note = chr16:85628473-85628503
  misc_feature 1..30: note = hypo
  source 1..30: mol_type = genomic DNA
atcattggaggcccacgaggctgtgctgaa

SEQ ID NO: 79526 - DNA, 88 bp, Homo sapiens
  misc_feature 1..88: note = chr16:85668900-85668988
  misc_feature 1..88: note = hypo
  source 1..88: mol_type = genomic DNA
cagggggcagcccctcgcctcctggctcttcctggcaaaccaggcacaggcaggaccgccagaaaaccctccacgcccttggcagggg

SEQ ID NO: 79527 - DNA, 30 bp, Homo sapiens
  misc_feature 1..30: note = chr16:85669859-85669889
  misc_feature 1..30: note = hypo
  source 1..30: mol_type = genomic DNA
gagccatgtgcccatcggttcactcaccca

SEQ ID NO: 79528 - DNA, 347 bp, Homo sapiens
  misc_feature 1..347: note = chr16:85670998-85671345
  misc_feature 1..347: note = hypo
  source 1..347: mol_type = genomic DNA
gctgcctttctgctccgtcctggagttggaccagtgagggcctccccaccttcatcatggcagtggctgtgcccccttgattgcagcagtggctatgtatcgagtccccccttgatcgcggcagtggctatgtattgagtccccccttgatcgcggcagtggctgtgtatcgagcgcctgctgtgcccctggcgggctcgctgtgcttctcacacacccttcgcctctggtggatgagaactgagcctccggcttgcccgggtcccacgttgtaagtggcatggggaattccaatccccagcttgtgcctgagactccatagacccctgccccgcaggtgtagcctc

SEQ ID NO: 79529 - DNA, 30 bp, Homo sapiens
  misc_feature 1..30: note = chr16:85671745-85671775
  misc_feature 1..30: note = hypo
  source 1..30: mol_type = genomic DNA
ttcgccatctgactgcgattgcctccgcgt

SEQ ID NO: 79530 - DNA, 44 bp, Homo sapiens
  misc_feature 1..44: note = chr16:85672034-85672078
  misc_feature 1..44: note = hypo
  source 1..44: mol_type = genomic DNA
ttgggcaagggcagacgcttgcgaatcgccgatgcatgccccag

SEQ ID NO: 79531 - DNA, 55 bp, Homo sapiens; identical to SEQ ID NO: 44789
  misc_feature 1..55: note = chr16:85673184-85673239
  misc_feature 1..55: note = hypo
  source 1..55: mol_type = genomic DNA

SEQ ID NO: 79532 - DNA, 48 bp, Homo sapiens; identical to SEQ ID NO: 44790
  misc_feature 1..48: note = chr16:85673838-85673886
  misc_feature 1..48: note = hypo
  source 1..48: mol_type = genomic DNA

SEQ ID NO: 79533 - DNA, 211 bp, Homo sapiens
  misc_feature 1..211: note = chr16:85674123-85674334
  misc_feature 1..211: note = hypo
  source 1..211: mol_type = genomic DNA
gaggggaggcagatccggttactgtcctgtccctggtgccacctgaaaccgagatcccagctgagtgagtggggactacgtgtgcggggaccacggagcagggaccacagacccatcctcatgagctgccgtgggaatgcttccaccgtggagccggcctgggcgggggagaggctccccctttctgccgctgcctcggaaatctgcctct

SEQ ID NO: 79534 - DNA, 644 bp, Homo sapiens
  misc_feature 1..644: note = chr16:85678117-85678761
  misc_feature 1..644: note = hypo
  source 1..644: mol_type = genomic DNA
gcaatgtggatgaaccgtgaagacacggctcccagtgagaggagccaggcgagaagggccacgcggtgggattcccttgatgtgaagtctccggaacaggcccttctttagagacggagagccaatgcgtgcggggcctggggagacgggagtggttgctcatgggtagggggttccttttggggtgacggaaatgctctgaaatggattgtggtgatggtcgcacaactctggacgtgctagaaccgtggggccgcgcgctgggtgggtgaattacgcgggatggaatcatagctcggtgaagctataacaactgaaacccaagagccatggaggttccatggaatttttttttttaaacaacgatcctttccctagtttttattttttttccccaaaaacttaaagtgaactttttctcaaaatctaaatacatacagaaaagcgcctagactgccagtgtccagaacgaacccacagatcaggagggctgaggcctgttctcctgtccccaccctctgcccctgaggtgaggggcgtggtgccccgccctgcagccagcgtttcccctcctcaggtggatctagtagcccgccggcacagtgcccagtcccaggtgttggcccggtcgacttggggtggtg

SEQ ID NO: 79535 - DNA, 309 bp, Homo sapiens
  misc_feature 1..309: note = chr16:85679146-85679455
  misc_feature 1..309: note = hypo
  source 1..309: mol_type = genomic DNA
gttctgtttccacatcgggatgcctgtggggcctctgcctcctggtcacgccactaaggccactttggctgcctgaggcctctgggcaccccctgtgagcagcagttttctttggtgaatgtgcgcgtgcccactccggacacagtgaaggggagatgaggctgcttctgcccccggaaccaaggccaggtctgaacagaagtcgggcaggatgccgggagctgatgggctggggtcctccttctggaaagggcatctacctgcttctaccacgcattctacctgcttctaccacgcttcctatgcatg

SEQ ID NO: 79536 - DNA, 43 bp, Homo sapiens
  misc_feature 1..43: note = chr16:85679829-85679872
  misc_feature 1..43: note = hypo
  source 1..43: mol_type = genomic DNA
ctaccacgcattctacctgcttctaccacgcattctacttgct

SEQ ID NO: 79537 - DNA, 624 bp, Homo sapiens
  misc_feature 1..624: note = chr16:85683970-85684594
  misc_feature 1..624: note = hypo
  source 1..624: mol_type = genomic DNA
ggctgctggtgccagcgcccgcagctcatgggaggccacttccctgccccagcctggaccaggagcttctaccagccaggaccctgcacccagccactgccttgaccccgaccagagctcctggcctagacccaggacgcctcgaggggattccagcgccttttccggcgactcctccgctctgagctggtccctcctcggagggtccttaccgcctcgggaacattgagctaccccagagcagagcaggggcgcgacaggcccgccccagcagtgtaccaccgcggcgcttaatggaacacggtgccgccagggaaggcgcggggccggcagctggattagcaggtgatgtacggctcctcgctcgggcacagaggctcagcggggcatttaatcctctcggagtggggaggcagagagaggattcccctcccacccggcccaaagctgtggccatgagtctccgaggctgcggacgtgggtggcagttgccgggccggaggcttctcggccccttctcggggtcacccctctctcccaggtgtagtgggagctgcgagaggagaaatgagatgaaaaagcctgttttaaagctaacagggcatgtcccgcctgtctgactat

SEQ ID NO: 79538 - DNA, 79 bp, Homo sapiens
  misc_feature 1..79: note = chr16:85693778-85693857
  misc_feature 1..79: note = hypo
  source 1..79: mol_type = genomic DNA
tccccatggaaagtgcggatgagcgcttgcccttaggggaattcacgcaagcaggtgggaaaatcgaccgaaactggat

SEQ ID NO: 79539 - DNA, 30 bp, Homo sapiens
  misc_feature 1..30: note = chr16:85698705-85698735
  misc_feature 1..30: note = hypo
  source 1..30: mol_type = genomic DNA
gagggacagtcctgccgtctccctgagtgg

SEQ ID NO: 79540 - DNA, 200 bp, Homo sapiens
  misc_feature 1..200: note = chr16:85699645-85699845
  misc_feature 1..200: note = hypo
  source 1..200: mol_type = genomic DNA
tgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagca

SEQ ID NO: 79541 - DNA, 208 bp, Homo sapiens
  misc_feature 1..208: note = chr16:85721429-85721637
  misc_feature 1..208: note = hypo
  source 1..208: mol_type = genomic DNA
gggcgctccctctcccgcctgcaccctccaactccggaacaggtttcacacacccaatgttggggtcctggggtgcggggaggtgggtctgggcaggtacagagcctgccctccttctccaggactcccagcgccgaggcgcctccctcatactgaaaacgcaaagccgggcgggcgcgggggctcacaatccagctactcgggaggc

SEQ ID NO: 79542 - DNA, 163 bp, Homo sapiens; identical to SEQ ID NO: 44796
  misc_feature 1..163: note = chr16:85731450-85731613
  misc_feature 1..163: note = hypo
  source 1..163: mol_type = genomic DNA

SEQ ID NO: 79543 - DNA, 234 bp, Homo sapiens
  misc_feature 1..234: note = chr16:85741334-85741568
  misc_feature 1..234: note = hypo
  source 1..234: mol_type = genomic DNA
cagccaggaccatggcgctccctttcaccaggccggagtcagcaagaacctggaggtgtcagaggtccggtccactcagcggggcctgggaaacactgttctggaagtggacaggctggattcctcgctggtcctgccacgtctctctgagcggaggcccgggttcgctcagttcccatccagggtattcagcacacctgctccaggcagccacgcccccggacacctgaagcc

SEQ ID NO: 79544 - DNA, 35 bp, Homo sapiens
  misc_feature 1..35: note = chr16:85752258-85752293
  misc_feature 1..35: note = hypo
  source 1..35: mol_type = genomic DNA
tcactccagccaatgcggtgcgatgattctatatg

SEQ ID NO: 79545 - DNA, 30 bp, Homo sapiens; identical to SEQ ID NO: 44799
  misc_feature 1..30: note = chr16:85758266-85758296
  misc_feature 1..30: note = hypo
  source 1..30: mol_type = genomic DNA

SEQ ID NO: 79546 - DNA, 32 bp, Homo sapiens
  misc_feature 1..32: note = chr16:85799033-85799065
  misc_feature 1..32: note = hypo
  source 1..32: mol_type = genomic DNA
tgtgcatcaaatgaacgcgatcttccctccag

SEQ ID NO: 79547 - DNA, 145 bp, Homo sapiens
  misc_feature 1..145: note = chr16:858656-858801
  misc_feature 1..145: note = hypo
  source 1..145: mol_type = genomic DNA
gcattctccagaggccgaccaatatattggagagacggattaatagacggatgatagtgggtttgtcaggggaattggcccatgcggttagggaggccgagaagtcccgggagggatgccatctgcaagccggagacctgggatg

SEQ ID NO: 79548 - DNA, 35 bp, Homo sapiens
  misc_feature 1..35: note = chr16:85869217-85869252
  misc_feature 1..35: note = hypo
  source 1..35: mol_type = genomic DNA
caggtgtcggcactgcggcgcggtgtcccaggcct

SEQ ID NO: 79549 - DNA, 174 bp, Homo sapiens
  misc_feature 1..174: note = chr16:85873671-85873845
  misc_feature 1..174: note = hypo
  source 1..174: mol_type = genomic DNA
ccccatgctgtgtgtcgctgggcaagtctccagctcctctgatcctcccctgtaaggcagggccatacgctctccactggagcgtggatggaaggagacaatgggacaaaatgcctgaattacttagcacgagctggtgccagaacatgtccctggcttcgctgtctctggcct

SEQ ID NO: 79550 - DNA, 30 bp, Homo sapiens
  misc_feature 1..30: note = chr16:85919965-85919995
  misc_feature 1..30: note = hypo
  source 1..30: mol_type = genomic DNA
gcatgacatctttaccgttggagacaatgc

SEQ ID NO: 79551 - DNA, 368 bp, Homo sapiens
  misc_feature 1..368: note = chr16:85932298-85932666
  misc_feature 1..368: note = hyper
  source 1..368: mol_type = genomic DNA
ccaatatccagcgctcgtgaaggcggagaccggcggggcagctagtttctggctgtggattctgattaatgggccgcaggcgcacggtctgcaccgtccggctcgttgctagtggctcgctcgggagccgccgcactcccggggctgtccgcccgagccggcctggaaggcggaggacgcctccaggtcgctccgcggggcctccggaattcctgggaaagcccccctgcagcgccgcccctggaccccaggtgtgaggagcggggctcggccagcggctccagaagaggcccggaccccactgccgtggctgccgggggcgggaaagtgatttctcggaaagcagagcacttcgaagaaggcgggcc

SEQ ID NO: 79552 - skipped

SEQ ID NO: 79553 - DNA, 376 bp, Homo sapiens
  misc_feature 1..376: note = chr16:85932669-85933045
  misc_feature 1..376: note = hyper
  source 1..376: mol_type = genomic DNA
cgagccaagctgacgctattggtcggtgtggccgtcgctctgcgcaccgcccgtcccccccacgaccctttttaaggccgcgcgaccgctggcgcatcgcctggagcgcggcagcaagcgtgggaacgcgggcggcgagacggcggcaggacggcggcaggtaggcacagtgggcgggtagggcgcccgtgtcccgcgcggtccggtcccgcggggtccccgacgccaggcggggcgtgggggtggaactacctaccgtaatgtccccgggcgcagctcagtggccacccgtgtccctctctgctttttgcctattttccagccacctaagtccaatctgaatgcccaagtcgttgattgtcgtttgcctgtttcc

SEQ ID NO: 79554 - DNA, 101 bp, Homo sapiens
  misc_feature 1..101: note = chr16:85952205-85952306
  misc_feature 1..101: note = hypo
  source 1..101: mol_type = genomic DNA
gacagaggcaggtgacgcggaagctgttcgggcacctggagcgcggggtgctgctgcacagcagccggcagggcgtgttcgtcaagcggctgtgccagggc

SEQ ID NO: 79555 - DNA, 30 bp, Homo sapiens
  misc_feature 1..30: note = chr16:86068336-86068366
  misc_feature 1..30: note = hypo
  source 1..30: mol_type = genomic DNA
catgctaatttgtctcggcagccctggttc

SEQ ID NO: 79556 - DNA, 51 bp, Homo sapiens
  misc_feature 1..51: note = chr16:8606896-8606947
  misc_feature 1..51: note = hypo
  source 1..51: mol_type = genomic DNA
ctccctgtggccttccgtaatgtggcccctgctgaccgctccagcctctgt

SEQ ID NO: 79557 - DNA, 54 bp, Homo sapiens
  misc_feature 1..54: note = chr16:86081901-86081955
  misc_feature 1..54: note = hyper
  source 1..54: mol_type = genomic DNA
ggacccaggcagttccgggcctgggctcgccactctgcccggaagggggagggg

SEQ ID NO: 79558 - DNA, 198 bp, Homo sapiens
  misc_feature 1..198: note = chr16:86092017-86092215
  misc_feature 1..198: note = hypo
  source 1..198: mol_type = genomic DNA
cctgacagtatcaagcgttggcggggattggagcaactgcagctcccattgctttggaaaagtggcacagtttcttacagaattcaacacacatttacaatgtgaccctgaagtttaactcctagacatttcttcaagagaaatgaagacatacgcccacagaaagatttgaacatgaatgttcgcacttactttttc

SEQ ID NO: 79559 - DNA, 30 bp, Homo sapiens
  misc_feature 1..30: note = chr16:86101131-86101161
  misc_feature 1..30: note = hypo
  source 1..30: mol_type = genomic DNA
tgtttggtgaatgggcgctgctgtctctaa

SEQ ID NO: 79560 - DNA, 55 bp, Homo sapiens
  misc_feature 1..55: note = chr16:86102059-86102114
  misc_feature 1..55: note = hypo
  source 1..55: mol_type = genomic DNA
attagacacagtaaccgaagtttcaggagtggaaccgctacgtggaagtagacgt

SEQ ID NO: 79561 - DNA, 38 bp, Homo sapiens
  misc_feature 1..38: note = chr16:86115722-86115760
  misc_feature 1..38: note = hypo
  source 1..38: mol_type = genomic DNA
ctgggattacaggcatgagccaccgcgcccggcctggg

SEQ ID NO: 79562 - DNA, 55 bp, Homo sapiens; identical to SEQ ID NO: 44800
  misc_feature 1..55: note = chr16:86119064-86119119
  misc_feature 1..55: note = hypo
  source 1..55: mol_type = genomic DNA

SEQ ID NO: 79563 - DNA, 30 bp, Homo sapiens
  misc_feature 1..30: note = chr16:86133147-86133177
  misc_feature 1..30: note = hypo
  source 1..30: mol_type = genomic DNA
agatgaagcttcactcgattgcctgcagct

SEQ ID NO: 79564 - DNA, 35 bp, Homo sapiens
  misc_feature 1..35: note = chr16:86141209-86141244
  misc_feature 1..35: note = hypo
  source 1..35: mol_type = genomic DNA
tgatttttttttcttcgtaacgcttgtctatctaa

SEQ ID NO: 79565 - DNA, 30 bp, Homo sapiens
  misc_feature 1..30: note = chr16:86149152-86149182
  misc_feature 1..30: note = hypo
  source 1..30: mol_type = genomic DNA
tgctcaggagatgcacgggcacggggacac

SEQ ID NO: 79566 - DNA, 96 bp, Homo sapiens
  misc_feature 1..96: note = chr16:86215311-86215407
  misc_feature 1..96: note = hypo
  source 1..96: mol_type = genomic DNA
agcaaccacagggggcggggctcacggtttctttgccaggccatgagcacgtgctgggctaaggctgcagtgagagacggccgcccaggtcagtga

SEQ ID NO: 79567 - DNA, 30 bp, Homo sapiens
  misc_feature 1..30: note = chr16:86216291-86216321
  misc_feature 1..30: note = hypo
  source 1..30: mol_type = genomic DNA
tataacaaagtgtttcggcttcaaaatgca

SEQ ID NO: 79568 - DNA, 224 bp, Homo sapiens
  misc_feature 1..224: note = chr16:86320265-86320489
  misc_feature 1..224: note = hyper
  source 1..224: mol_type = genomic DNA
aaggggagcccagtgcgcagggctccagaaaccccgaccctcgcaggggagagccagccgaaccagacgtgtgggggcagcagccgccgcggcggtctgggacgcgggtgtcgccttccacgggacttgggtccagggacccaagacggggatctgggaggagggggatgcccttggggcctgagacccgggcggtttccgaagcgaagtagttacccagaacc

SEQ ID NO: 79569 - DNA, 578 bp, Homo sapiens
  misc_feature 1..578: note = chr16:86320490-86321068
  misc_feature 1..578: note = hyper
  source 1..578: mol_type = genomic DNA
ctccctaccttctccccgcctccctgtctttctgcccctctgtcccctgcagctgctcggccctccctcctctgaaacccaccgcccgcccaaggctcactccttcctgctgttcccgcccgcgaagctgttgcagggacggtgcgcccttgggctgcactcaccaccgcccctcgcccgcgacgtcctggccccctaaccccagctttcccgccgccgctcactcccgcgctccgctgcagctcagcccggtctgcaactctccctctgttttctgccccgctcctcagttctgcgctctcctcttctccaggcttccctctcctcctccttctgcctctcccctgtccccgttccattctcctgcgcccctcgccagcgcgctcgcagcccatcggctcctgccggggcccctctggtgccagccgccttcaggctgtgggtccgtccgctggtggaggggaaggtcggggctggccccgggccccgcgctgctgggccccatggtcagtggagacgcctcctggtctcccttcagagctcctcgtcgtcgtcggagtcatcggaggaccaggaag

SEQ ID NO: 79570 - DNA, 37 bp, Homo sapiens
  misc_feature 1..37: note = chr16:86334870-86334907
  misc_feature 1..37: note = hyper
  source 1..37: mol_type = genomic DNA
gagcccaggagggcacgtcctccgccagctctcagca

SEQ ID NO: 79571 - DNA, 130 bp, Homo sapiens
  misc_feature 1..130: note = chr16:863747-863877
  misc_feature 1..130: note = hyper
  source 1..130: mol_type = genomic DNA
cctgcctgccctgggcggatccccggggccgcgcggttcgggccgcgctcctgcccgctggggtctcccgccgtcctcgccgtcaccaccgggtggagccacaggtccgtgtgatcgtccccgtgacccc

SEQ ID NO: 79572 - DNA, 109 bp, Homo sapiens
  misc_feature 1..109: note = chr16:86530884-86530993
  misc_feature 1..109: note = hyper
  source 1..109: mol_type = genomic DNA
cacggccacctacttcgtcgggaaagacagtccagcgcccaccggcccgtgctcgcccgcctgccgagccccgagtcccggcaacgcgccccgggtgctccggtccact

SEQ ID NO: 79573 - DNA, 273 bp, Homo sapiens; identical to SEQ ID NO: 4373
  misc_feature 1..273: note = chr16:86531016-86531289
  misc_feature 1..273: note = hyper
  source 1..273: mol_type = genomic DNA

SEQ ID NO: 79574 - DNA, 107 bp, Homo sapiens; identical to SEQ ID NO: 4374
  misc_feature 1..107: note = chr16:86531374-86531481
  misc_feature 1..107: note = hyper
  source 1..107: mol_type = genomic DNA

SEQ ID NO: 79575 - DNA, 129 bp, Homo sapiens
  misc_feature 1..129: note = chr16:86531527-86531656
  misc_feature 1..129: note = hyper
  source 1..129: mol_type = genomic DNA
cgttccctggttcacaaccaccccacccccacgcgcctgtgcacatgtccctcccgccgcgcagggtctccgcgggcgcgccccgccccaaatagagcttactacagtaacccgggagtctcacatctg

SEQ ID NO: 79576 - DNA, 44 bp, Homo sapiens
  misc_feature 1..44: note = chr16:86531946-86531990
  misc_feature 1..44: note = hyper
  source 1..44: mol_type = genomic DNA
cgccccaaccaatctcgcactgtaagtgcatttcttgggttttc

SEQ ID NO: 79577 - DNA, 157 bp, Homo sapiens
  misc_feature 1..157: note = chr16:86537937-86538094
  misc_feature 1..157: note = hyper
  source 1..157: mol_type = genomic DNA
gcagataggtggctccgtgccctgggcacacagcctctcacaggcccactgggaacccaacacacctgtccccgcatctccacaccacaccaagagctgccaccacacccctcacagagccacaaagccggtaaatgtcactcgatggctacaaaaa

SEQ ID NO: 79578 - DNA, 324 bp, Homo sapiens; identical to SEQ ID NO: 36295
  misc_feature 1..324: note = chr16:86539103-86539427
  misc_feature 1..324: note = hyper
  source 1..324: mol_type = genomic DNA

SEQ ID NO: 79579 - DNA, 166 bp, Homo sapiens
  misc_feature 1..166: note = chr16:86539463-86539629
  misc_feature 1..166: note = hyper
  source 1..166: mol_type = genomic DNA
cgctctcggcccgggcggcttcgcttaagcaattagctagtaaaaataccttgggcctggggagtgggagacgttgcagtcgtgtccgtttttacacacccacccccgccctgctcggccagtttcaggattcctggggccagagatggggcgcagatttgttttg

SEQ ID NO: 79580 - DNA, 226 bp, Homo sapiens; identical to SEQ ID NO: 36297
  misc_feature 1..226: note = chr16:86541633-86541859
  misc_feature 1..226: note = hyper
  source 1..226: mol_type = genomic DNA

SEQ ID NO: 79581 - DNA, 32 bp, Homo sapiens
  misc_feature 1..32: note = chr16:86542207-86542239
  misc_feature 1..32: note = hyper
  source 1..32: mol_type = genomic DNA
cctggagggagaggccgcgcccggccagcagt

SEQ ID NO: 79582 - DNA, 400 bp, Homo sapiens
  misc_feature 1..400: note = chr16:86542273-86542673
  misc_feature 1..400: note = hyper
  source 1..400: mol_type = genomic DNA
cgccgcgatgcgccggggctcctgcgctgtcctgcgctccgctctcggcaccacctttcgtggctccaccgcccccagcccgcacccgagcgctgaggtggcaagggcaggtctgcgtgcgagccccctgcgggctggcagccaggtgcgcgagggccgcccttgccggcgctcccagcccgcgctgtctgctctcaggaacctggcctggcgcgcagtgtcagaggccccgcggcggcggcaggccgagcccacaggggcattaggccaactcccccctcccgccctgcgcacgcggaattctctattattattattaaagaatcccccagaacttgtttacgttaaaccctgtaaacttcctgccagggcctttgccatctctcgggaaatcggaacc

SEQ ID NO: 79583 - DNA, 33 bp, Homo sapiens
  misc_feature 1..33: note = chr16:86543017-86543050
  misc_feature 1..33: note = hyper
  source 1..33: mol_type = genomic DNA
gtgagtgactgagcacgccgcttattcaggggc

SEQ ID NO: 79584 - DNA, 30 bp, Homo sapiens
  misc_feature 1..30: note = chr16:86543320-86543350
  misc_feature 1..30: note = hyper
  source 1..30: mol_type = genomic DNA
tgcctgcgatggtcacgaccgggaggccgc

SEQ ID NO: 79585 - DNA, 199 bp, Homo sapiens
  misc_feature 1..199: note = chr16:86543623-86543822
  misc_feature 1..199: note = hyper
  source 1..199: mol_type = genomic DNA
ggtcttaggccgacccgcgagacgcagccgagcggagatggagtgaaggctgcctcgcccggaatctcggagccgagcgccgcgggcggcggggactcagggctgctcccggctggggcgcacggccgtaagacctggaggtggtgcctccccccaaaaaataccggcgggggtagcttcctcacggccttcgcccggg

SEQ ID NO: 79586 - DNA, 384 bp, Homo sapiens
  misc_feature 1..384: note = chr16:86544174-86544558
  misc_feature 1..384: note = hyper
  source 1..384: mol_type = genomic DNA
gatgtcttcggcgcccgagaagcagcagccaccgcacggcggcggcggcggcggcggcgggggaggcggcgcggccatggaccccgcgtcgtccggcccgtccaaggccaagaagaccaacgccggcatccggcgcccggagaagccgccctattcctacatcgcgctcatcgtcatggccatccagagttcacccaccaagcgcctgacgctgagcgagatctaccagttcctgcagagccgcttccccttcttccggggctcctaccagggctggaagaactccgtgcgccacaacctctcgctcaacgagtgcttcatcaagctacccaagggccttgggcggcccggcaagggccactactggaccatcgacccggccag

SEQ ID NO: 79587 - DNA, 99 bp, Homo sapiens
  misc_feature 1..99: note = chr16:86545059-86545158
  misc_feature 1..99: note = hyper
  source 1..99: mol_type = genomic DNA
cgcggccaaccccctgtccggcagcctctccacgcactccctggagcagccgtatctgcaccagaacagccacaacgccccagccgagctgcaaggtga

SEQ ID NO: 79588 - DNA, 30 bp, Homo sapiens
  misc_feature 1..30: note = chr16:86556449-86556479
  misc_feature 1..30: note = hypo
  source 1..30: mol_type = genomic DNA
gcctttctgatttctcggtgattctgttcc

SEQ ID NO: 79589 - DNA, 30 bp, Homo sapiens
  misc_feature 1..30: note = chr16:86564966-86564996
  misc_feature 1..30: note = hypo
  source 1..30: mol_type = genomic DNA
agctggctgagggcccggagtgtgtccaca

SEQ ID NO: 79590 - DNA, 30 bp, Homo sapiens
  misc_feature 1..30: note = chr16:86589626-86589656
  misc_feature 1..30: note = hypo
  source 1..30: mol_type = genomic DNA
gcatccccgtagccacgtgcctggtacatc

SEQ ID NO: 79591 - DNA, 182 bp, Homo sapiens
  misc_feature 1..182: note = chr16:86599203-86599385
  misc_feature 1..182: note = hyper
  source 1..182: mol_type = genomic DNA
ccgtttgcaatcaaccgctcacccagtcttcccacggagcgcgctccctaactcaccctacccacccaacaaaacaaaaaaaaggctgaaatatagaaaagcaacttggaggctcccagggggacgttgccaggagcaggaggcagggacagcgccctagggtcggtgttagcggccggcgc

SEQ ID NO: 79592 - DNA, 567 bp, Homo sapiens
  misc_feature 1..567: note = chr16:86599480-86600047
  misc_feature 1..567: note = hyper
  source 1..567: mol_type = genomic DNA
cgggtttctcctcgcagggcccaggaactcggctctgcctggcccgggtgggtcgctgcattgtcccggtcttctgggagtgcggggtcagcttgttagagggaatttctacctgggaaaagggagacgagtttcgaagctgaagttggtaggctgcgagtgtccacgcgggagacgaaagggggaaatagcagagtcacttcacccttttccccaaaccccacaaaactgctcgcagcgacgcggatgatctaccgaattccccgcgaattcggaggattaagttgtcagtcagcacgttgctaccttcccctctatgcactccgctgcctggctcctcggcggggagcgagggaaactcagtttgtagggtttacctctaaaacctcgataggttatccttgacgaccccgagcctggaaactccctgttgatgattaattatttgattaaataagtataacatccaggagaggccctgccattccaatccagcgcgtttgctttgaatccattacacctgggcccccataattaggaaatctaattattcgcttcatcactcat

SEQ ID NO: 79593 - DNA, 1567 bp, Homo sapiens
  misc_feature 1..1567: note = chr16:86600250-86601817
  misc_feature 1..1567: note = hyper
  source 1..1567: mol_type = genomic DNA
gttttcaagtgaagacggagtcgccgcggaggccggggcggcggggtcttagagccgacggattcctgcgctcctcgccccgattggcgccgactcctctcagctgccgggtgattggctcaaagttccgggagggggcgtggcccgaggaaagtaaaaactcgctttcagcaagaagacttttgaaacttttcccaatccctaaaagggacttggcctctttttctgggctcagcggggcagccgctcggaccccggcgcgctgaccctcggggctgccgattcgctgggggcttggagagcctcctgcgcccctcctcgcgcgggccgagggtccacctgggtccccaggccgcggcgtctccgctgggtccgcggccgcccgcctgcccgcgctgccgccgccgggtcctggagccagcgaggagcggggccggcgctgcgcttgcccggggcgcgccctccaggatgccgatccgcccggtccgctgaaagcgcgcgcccctgctcggcccgagcgccgccgcccgcgcaccctcgccccggaggctgccaggagcccggggccgcccctcccgctcccctcctctccccctctggctctctcgcgctctctcgctctcagggcccccctcgctcccccggccgcagtccgtgcgcgagggcgccggcgagccgtctcggaagcagcatgcaggcgcgctactccgtgtccgaccccaacgccctgggagtggtgccctacctgagcgagcagaattactaccgggctgcgggcagctacggcggcatggccagccccatgggcgtctattccggccacccggagcagtacagcgcggggatgggccgctcctacgcgccctaccaccaccaccagcccgcggcgcctaaggacctggtgaagccgccctacagctacatcgcgctcatcaccatggccatccagaacgcgcccgagaagaagatcaccttgaacggcatctaccagttcatcatggaccgcttccccttctaccgggagaacaagcagggctggcagaacagcatccgccacaacctctcgctcaacgagtgcttcgtcaaggtgccccgcgacgacaagaagcccggcaagggcagttactggaccctggacccggactcctacaacatgttcgagaacggcagcttcctgcggcgccggcggcgcttcaaaaagaaggacgtgtccaaggagaaggaggagcgggcccacctcaaggagccgcccccggcggcgtccaagggcgccccggccaccccccacctagcggacgcccccaaggaggccgagaagaaggtggtgatcaagagcgaggcggcgtccccggcgctgccggtcatcaccaaggtggagacgctgagccccgagagcgcgctgcagggcagcccgcgcagcgcggcctccacgcccgccggctcccccgacggctcgctgccggagcaccacgccgcggcgcccaacgggctgcctggcttcagcgtggagaacatcatgaccctgcgaacgtcgccgccgggcggagagctgagcccgggggccgga

SEQ ID NO: 79594 - DNA, 477 bp, Homo sapiens
  misc_feature 1..477: note = chr16:86602037-86602514
  misc_feature 1..477: note = hyper
  source 1..477: mol_type = genomic DNA
cgtcgcccctgagcgctctcaacctcgccgccggccaggagggcgcgctcgccgccacgggccaccaccaccagcaccacggccaccaccacccgcaggcgccgccgcccccgccggctccccagccccagccgacgccgcagcccggggccgccgcggcgcaggcggcctcctggtatctcaaccacagcggggacctgaaccacctccccggccacacgttcgcggcccagcagcaaactttccccaacgtgcgggagatgttcaactcccaccggctggggattgagaactcgaccctcggggagtcccaggtgagtggcaatgccagctgccagctgccctacagatccacgccgcctctctatcgccacgcagccccctactcctacgactgcacgaaatactgacgtgtcccgggacctcccctccccggcccgctccggcttcgcttcccagccccgacccaaccagaca

SEQ ID NO: 79595 - DNA, 30 bp, Homo sapiens
  misc_feature 1..30: note = chr16:86740720-86740750
  misc_feature 1..30: note = hypo
  source 1..30: mol_type = genomic DNA
acgcggagtgggcctcgacagctatcaacc

SEQ ID NO: 79596 - DNA, 36 bp, Homo sapiens
  misc_feature 1..36: note = chr16:86741248-86741284
  misc_feature 1..36: note = hypo
  source 1..36: mol_type = genomic DNA
ggcatacctgtggaccggcgacgtggcctgagagcc

SEQ ID NO: 79597 - DNA, 91 bp, Homo sapiens
  misc_feature 1..91: note = chr16:86775015-86775106
  misc_feature 1..91: note = hyper
  source 1..91: mol_type = genomic DNA
gggagaccctccctgcgggagccgctgctagagggaaaggcagcgttggatcggatgccggccccagcctgggagacgtgcttcctctgca

SEQ ID NO: 79598 - DNA, 42 bp, Homo sapiens
  misc_feature 1..42: note = chr16:86824590-86824632
  misc_feature 1..42: note = hypo
  source 1..42: mol_type = genomic DNA
gtggcattcccattacgatctgagaagcggaggctgacgact

SEQ ID NO: 79599 - DNA, 30 bp, Homo sapiens
  misc_feature 1..30: note = chr16:86828224-86828254
  misc_feature 1..30: note = hypo
  source 1..30: mol_type = genomic DNA
gcatagcagtcttttcggtctgggctgcct

SEQ ID NO: 79600 - DNA, 279 bp, Homo sapiens
  misc_feature 1..279: note = chr16:86878223-86878502
  misc_feature 1..279: note = hypo
  source 1..279: mol_type = genomic DNA
cccggctggtgacttctatagtcctttcgtctctctaaagtgggtaagagggaaaggtcaacacaaaaccagccatggcacaggcctcgaggagaaggctgaccgtccatggacagcaggcccatggctgctctagctccgctctgctgctgggagtgagtggccgggtggcaggcgccctccagggcatggatgaaacctcacaaatggcgctttgtcgtcccgccgagagatctgggacatcccgtgagttggaatatataacgcccactggattaa

SEQ ID NO: 79601 - DNA, 38 bp, Homo sapiens; identical to SEQ ID NO: 44803
  misc_feature 1..38: note = chr16:86903475-86903513
  misc_feature 1..38: note = hypo
  source 1..38: mol_type = genomic DNA

SEQ ID NO: 79602 - DNA, 85 bp, Homo sapiens
  misc_feature 1..85: note = chr16:86950939-86951024
  misc_feature 1..85: note = hypo
  source 1..85: mol_type = genomic DNA
gcgtatttatccactcggtgctgaaggacatctgggttgcttccgggttttgaaaattagaatgaaactgcgacacatctgtgtg

SEQ ID NO: 79603 - DNA, 30 bp, Homo sapiens
  misc_feature 1..30: note = chr16:86951460-86951490
  misc_feature 1..30: note = hypo
  source 1..30: mol_type = genomic DNA
agcacagcacaccctcggagtctaagctca

SEQ ID NO: 79604 - DNA, 72 bp, Homo sapiens
  misc_feature 1..72: note = chr16:86981285-86981357
  misc_feature 1..72: note = hypo
  source 1..72: mol_type = genomic DNA
gagaaacctgctgcccgctgctaacccatactgagcgtcccgagccaggaccctcatcgtacacttgcacac

SEQ ID NO: 79605 - DNA, 30 bp, Homo sapiens
  misc_feature 1..30: note = chr16:87020868-87020898
  misc_feature 1..30: note = hypo
  source 1..30: mol_type = genomic DNA
atttcaggggtcagacgacaagaagccttc

SEQ ID NO: 79606 - DNA, 88 bp, Homo sapiens
  misc_feature 1..88: note = chr16:87022637-87022725
  misc_feature 1..88: note = hypo
  source 1..88: mol_type = genomic DNA
ctatgacacaggtgacgtgcgtgacgcaccatccagagtgctgctgctgctctgcggggctcctgtgacaccccgacctcccccggcc

SEQ ID NO: 79607 - DNA, 164 bp, Homo sapiens
  misc_feature 1..164: note = chr16:87052288-87052452
  misc_feature 1..164: note = hypo
  source 1..164: mol_type = genomic DNA
acctggcccaccccacgctcctctccttgccactcggccaaacaagcgcaagtgaagagtgatgccgaccagttgttgagcatatataggccacctggatcacccaaccaggaaatcaaaactgcagccatgccgggcacggtggctcacgcctgtaatcccaa

SEQ ID NO: 79608 - DNA, 30 bp, Homo sapiens
  misc_feature 1..30: note = chr16:87091202-87091232
  misc_feature 1..30: note = hypo
  source 1..30: mol_type = genomic DNA
gagagtccacaggtgcggcattcaccttgt

SEQ ID NO: 79609 - DNA, 245 bp, Homo sapiens
  misc_feature 1..245: note = chr16:87092376-87092621
  misc_feature 1..245: note = hypo
  source 1..245: mol_type = genomic DNA
tgacaaatatgctctcggatagaacagcccagaaagggcaagagggagagttggaacactcagataattacccttcagcgacgcagtgcacttaagtggtgaaaggagattcactggttggaaaaacactccagggcgaagggccagcgtgtgcaaaagcaccgaagcatgaccgagcgcgggcattcccgccagccaccagtgggccacgcatcccaacatgtgagtgccgcaaggatacaagt

SEQ ID NO: 79610 - DNA, 207 bp, Homo sapiens
  misc_feature 1..207: note = chr16:870938-871145
  misc_feature 1..207: note = hypo
  source 1..207: mol_type = genomic DNA
cccacttcttttgttcgctgccgcgtgcttgtcaatcaagtttttcatcctatggatccgtcttttgtcagtttaatttgcaggccccagtcgcagaatttaagaggacagaagaatggtcttttgttcccaacagcctccttcaccaccacaaccccactggctgcctcaccttacgtgtgacacgctcgtcgaacttgccagcaa

SEQ ID NO: 79611 - DNA, 30 bp, Homo sapiens
  misc_feature 1..30: note = chr16:87100260-87100290
  misc_feature 1..30: note = hypo
  source 1..30: mol_type = genomic DNA
gaaggagatgccagccgggccagtgactca

SEQ ID NO: 79612 - DNA, 30 bp, Homo sapiens
  misc_feature 1..30: note = chr16:87106180-87106210
  misc_feature 1..30: note = hypo
  source 1..30: mol_type = genomic DNA
tggggaccctcatatcgaattcatgggagg

SEQ ID NO: 79613 - DNA, 54 bp, Homo sapiens
  misc_feature 1..54: note = chr16:87158485-87158539
  misc_feature 1..54: note = hypo
  source 1..54: mol_type = genomic DNA
acacacattcacatacgcaacacacatgccacacacacacgcagcacatactct

SEQ ID NO: 79614 - DNA, 77 bp, Homo sapiens
  misc_feature 1..77: note = chr16:87178999-87179076
  misc_feature 1..77: note = hypo
  source 1..77: mol_type = genomic DNA
tgggcagaggtgaggcgctgcttgcattctcagctctagtcaccatccccgcccagtgttgacgtacagcggtgaca

SEQ ID NO: 79615 - DNA, 131 bp, Homo sapiens
  misc_feature 1..131: note = chr16:87186183-87186314
  misc_feature 1..131: note = hypo
  source 1..131: mol_type = genomic DNA
ggctggctccttctacgggctccagggagaatccctttccgcatctctctgggcttctagcacccgccacactccttggctcgtggccacttcactccagtccctgctcagccgtgcgtggcctcttctct

SEQ ID NO: 79616 - DNA, 247 bp, Homo sapiens
  misc_feature 1..247: note = chr16:87187799-87188046
  misc_feature 1..247: note = hypo
  source 1..247: mol_type = genomic DNA
tcctggtctcatcctcgggtggtagcactcacagcattataaccacgtctctccagccatccagggaaaacgccaaagatgttacacgatatggcagttttccaggtgggaaaatcaaccaaccgccttagaaaacaatcgtacctctgagcctcggggtctgaattcccatcatggaaagtcgagcaagactcgattcatgaagttttggcctcccaagtgcccagtccctcgagatgcttaaagt

SEQ ID NO: 79617 - DNA, 194 bp, Homo sapiens
  misc_feature 1..194: note = chr16:87215623-87215817
  misc_feature 1..194: note = hypo
  source 1..194: mol_type = genomic DNA
aattgtagataagaacgaaataatgtccatctgaggggggatcgcatcctccacctggccatcccagaacccaggacagagcgacgctcccccagtgctaacccaggagtggaccccagttctcctgagcccttccagtgcatatcatggtgagaccgggtggtgaagcaaggggaactcgttggtgctttatc

SEQ ID NO: 79618 - DNA, 30 bp, Homo sapiens
  misc_feature 1..30: note = chr16:87221538-87221568
  misc_feature 1..30: note = hypo
  source 1..30: mol_type = genomic DNA
gggtgtgcatgtgtacgtgtgtgggtgtat

SEQ ID NO: 79619 - DNA, 30 bp, Homo sapiens
  misc_feature 1..30: note = chr16:87249934-87249964
  misc_feature 1..30: note = hypo
  source 1..30: mol_type = genomic DNA
cctcatcctccctttcgcttcagctgggga

SEQ ID NO: 79620 - DNA, 33 bp, Homo sapiens
  misc_feature 1..33: note = chr16:87253357-87253390
  misc_feature 1..33: note = hypo
  source 1..33: mol_type = genomic DNA
cccaccccaaagaagcgacgatccagccgagga

SEQ ID NO: 79621 - DNA, 104 bp, Homo sapiens
  misc_feature 1..104: note = chr16:87262420-87262524
  misc_feature 1..104: note = hypo
  source 1..104: mol_type = genomic DNA
acagccaccacctcacggcaatctcatgagagaccccaagacagacagtgggagaaccaccagccaagccccactggctcacagaatcacgagacacaattcaa

SEQ ID NO: 79622 - DNA, 30 bp, Homo sapiens
  misc_feature 1..30: note = chr16:87273793-87273823
  misc_feature 1..30: note = hypo
  source 1..30: mol_type = genomic DNA
ttctgcagagctgtgcgctgctggagcagg

SEQ ID NO: 79623 - DNA, 30 bp, Homo sapiens
  misc_feature 1..30: note = chr16:87284714-87284744
  misc_feature 1..30: note = hypo
  source 1..30: mol_type = genomic DNA
agaggggcaggaacccgccaacaggaagac

SEQ ID NO: 79624 - DNA, 147 bp, Homo sapiens; identical to SEQ ID NO: 16090
  misc_feature 1..147: note = chr16:87296936-87297083
  misc_feature 1..147: note = hypo
  source 1..147: mol_type = genomic DNA

SEQ ID NO: 79625 - DNA, 40 bp, Homo sapiens
  misc_feature 1..40: note = chr16:87300104-87300144
  misc_feature 1..40: note = hypo
  source 1..40: mol_type = genomic DNA
taggtccagggaaatcgaggagcgtcggctctgattattc

SEQ ID NO: 79626 - DNA, 30 bp, Homo sapiens
  misc_feature 1..30: note = chr16:87311858-87311888
  misc_feature 1..30: note = hypo
  source 1..30: mol_type = genomic DNA
gaccaacatcccagtcgaagcaggggtgtc

SEQ ID NO: 79627 - DNA, 36 bp, Homo sapiens
  misc_feature 1..36: note = chr16:87312099-87312135
  misc_feature 1..36: note = hypo
  source 1..36: mol_type = genomic DNA
acagcccagagctgccgtctccgtctctcagaaaag

SEQ ID NO: 79628 - DNA, 135 bp, Homo sapiens; identical to SEQ ID NO: 44808
  misc_feature 1..135: note = chr16:87354991-87355126
  misc_feature 1..135: note = hypo
  source 1..135: mol_type = genomic DNA

SEQ ID NO: 79629 - DNA, 202 bp, Homo sapiens
  misc_feature 1..202: note = chr16:87356769-87356971
  misc_feature 1..202: note = hypo
  source 1..202: mol_type = genomic DNA
ctcaacctcccacaacgcatggagcggcccggcgcacgactcacccggccccaaacaccaactgtgccgaggtgatgccctgccctgaggcgagcgtacaaggcttgagcgtcgagaacactgcaagggtctcagccagtgaggggctgcctgggccccgccgcaggcctgactcctagagccaagccgttttctcccttca

SEQ ID NO: 79630 - DNA, 32 bp, Homo sapiens
  misc_feature 1..32: note = chr16:87418168-87418200
  misc_feature 1..32: note = hyper
  source 1..32: mol_type = genomic DNA
gtcgtctcccaggtccgcgggtggtgaccgcg

SEQ ID NO: 79631 - DNA, 85 bp, Homo sapiens; identical to SEQ ID NO: 44810
  misc_feature 1..85: note = chr16:87421370-87421455
  misc_feature 1..85: note = hypo
  source 1..85: mol_type = genomic DNA

SEQ ID NO: 79632 - DNA, 207 bp, Homo sapiens
  misc_feature 1..207: note = chr16:87583661-87583868
  misc_feature 1..207: note = hypo
  source 1..207: mol_type = genomic DNA
ggcagtgtgcatgcacgtatgtgtgagcatgtggcagtgtgcatgcacgtatgtgtgagtgtgtggcagcgtgcatgcgtggatgtgtgtttgtggcagtgtgcctgcacgtatgtgtgagcacgtggcagtgtgcacgcatggatgtgtgatcgtgtggccgtgtacgtgtgccagcgtgtatgtgaaagacgtgtttgtgtgggt

SEQ ID NO: 79633 - DNA, 78 bp, Homo sapiens
  misc_feature 1..78: note = chr16:87584344-87584422
  misc_feature 1..78: note = hypo
  source 1..78: mol_type = genomic DNA
ggtgagcagaacagacggggcctccccgtccggagcttgcgtcccagtgaggacaccgggaggcgacccgtggggagc

SEQ ID NO: 79634 - DNA, 146 bp, Homo sapiens
  misc_feature 1..146: note = chr16:87594957-87595103
  misc_feature 1..146: note = hypo
  source 1..146: mol_type = genomic DNA
cctaaggattggaaacgaccatcggcaggggacgggttaaaccgattaaggtgactgacaccgcgcagtgatgcgcagccagtgtaacggccctgtggaggacatctaggtgcatcgtctggtagaaggtacgagggcagacagca

SEQ ID NO: 79635 - DNA, 40 bp, Homo sapiens
  misc_feature 1..40: note = chr16:87622634-87622674
  misc_feature 1..40: note = hyper
  source 1..40: mol_type = genomic DNA
tttccagccccactgcgaagggctccggccttttccagtg

SEQ ID NO: 79636 - DNA, 391 bp, Homo sapiens
  misc_feature 1..391: note = chr16:87635070-87635461
  misc_feature 1..391: note = hyper
  source 1..391: mol_type = genomic DNA
cagtttctggctcaccgcgctgcggtcaccggcccacactcccaggagcgaggaccctgggcagcctccacacccccatcagcccactgcaccggtctgctgccatttcccgcacgcatttcaggagggctggggacgccggcttctgcctgaggatttatggtccaggaaatgcattttaaatggatcccaggatgctcggatccaagaatcagactctctcttgtgcgtgggaagaggggcggagggtgagagtatgtctggagagagacctagaaacgcccgaatggcggtcccactttgctccccaaaagcgcgaccgttccccgagtgggggggcgctacctgttggccagggcgcagggcgcacggaattcgggtgactttgctc

SEQ ID NO: 79637 - DNA, 87 bp, Homo sapiens
  misc_feature 1..87: note = chr16:87635740-87635827
  misc_feature 1..87: note = hyper
  source 1..87: mol_type = genomic DNA
ctctgcaggcctcaccgcccagctcccgggagggggccgagggcgccctgagtgctgcgcgccttcccatgacgcagttcctgtgcc

SEQ ID NO: 79638 - DNA, 294 bp, Homo sapiens; identical to SEQ ID NO: 36310
  misc_feature 1..294: note = chr16:87636197-87636491
  misc_feature 1..294: note = hyper
  source 1..294: mol_type = genomic DNA

SEQ ID NO: 79639 - DNA, 156 bp, Homo sapiens; identical to SEQ ID NO: 12571
  misc_feature 1..156: note = chr16:87636626-87636782
  misc_feature 1..156: note = hyper
  source 1..156: mol_type = genomic DNA

SEQ ID NO: 79640 - DNA, 537 bp, Homo sapiens; identical to SEQ ID NO: 36312
  misc_feature 1..537: note = chr16:87636783-87637320
  misc_feature 1..537: note = hyper
  source 1..537: mol_type = genomic DNA

SEQ ID NO: 79641 - DNA, 193 bp, Homo sapiens
  misc_feature 1..193: note = chr16:87637541-87637734
  misc_feature 1..193: note = hyper
  source 1..193: mol_type = genomic DNA
atcaggccccagcttcgcttctggtgttcctgcggcgcccgagggccttcctcagccccgaatctgcccaagccgagagaaagggagtgatggggagcgctaggggcgggggatgccaacccgaaccaaaacagccaggcagtacacttctaggtggttggacgcggactagcgctgtcgaagcaggctgctg

SEQ ID NO: 79642 - DNA, 138 bp, Homo sapiens
  misc_feature 1..138: note = chr16:87648265-87648403
  misc_feature 1..138: note = hypo
  source 1..138: mol_type = genomic DNA
gcaggtccctgcacacgtgaggagccgcgcgtcccctcccgggataaactctggtccctgcacacacgaggagccgcgcgtcccctcccgggataaacgctggtccctgcacacacgaggagccgcgtgtcctctccc

SEQ ID NO: 79643 - DNA, 30 bp, Homo sapiens
  misc_feature 1..30: note = chr16:87657914-87657944
  misc_feature 1..30: note = hypo
  source 1..30: mol_type = genomic DNA
ccttccccattcccacggctccccacccct

SEQ ID NO: 79644 - DNA, 36 bp, Homo sapiens
  misc_feature 1..36: note = chr16:87678053-87678089
  misc_feature 1..36: note = hypo
  source 1..36: mol_type = genomic DNA
gtcccgcgggggcttcgtgctcgtggcccacagtga

SEQ ID NO: 79645 - DNA, 30 bp, Homo sapiens
  misc_feature 1..30: note = chr16:87681285-87681315
  misc_feature 1..30: note = hypo
  source 1..30: mol_type = genomic DNA
tgctgtccacacacacggctctgcacacca

SEQ ID NO: 79646 - DNA, 281 bp, Homo sapiens
  misc_feature 1..281: note = chr16:87688422-87688703
  misc_feature 1..281: note = hypo
  source 1..281: mol_type = genomic DNA
gtgggctctgaccaccgctctgccctcttctcacaggaaccagcgaccactcggcccggcgtaaccacgcatgtccactggtcacctggtggccttcgacaagaacgtgtgataaatccctgccggagtgcggctccgggaaaacgctgtcaccgcaaaccagctcctctttgttgcagtcccccgggggcatggcccggcaagtttccttagccaggggccagtttgcctggggtcagtgggcagcgcctgggagtcgagtgtctcgagtggggctctgc

SEQ ID NO: 79647 - DNA, 30 bp, Homo sapiens; identical to SEQ ID NO: 44814
  misc_feature 1..30: note = chr16:87701846-87701876
  misc_feature 1..30: note = hypo
  source 1..30: mol_type = genomic DNA

SEQ ID NO: 79648 - DNA, 232 bp, Homo sapiens
  misc_feature 1..232: note = chr16:87714174-87714406
  misc_feature 1..232: note = hypo
  source 1..232: mol_type = genomic DNA
taggtggaggcactacggagccatggtgcaggggtggggggccccaggtgagctcagatgccctccctgcctgtgccaccgtggcctgaccctccacaggtgggagccataggcgtcaggagccattaccccttggagaactgggtgccaggccgagacctggtgtctcatttatgacaaaccgctgcagtgcgtttgggagtctcctcctccatgacgtgcttgtctggat

SEQ ID NO: 79649 - DNA, 32 bp, Homo sapiens
  misc_feature 1..32: note = chr16:87718103-87718135
  misc_feature 1..32: note = hypo
  source 1..32: mol_type = genomic DNA
cagtccttggggcaccgcgtgttgcttgccgg

SEQ ID NO: 79650 - DNA, 30 bp, Homo sapiens
  misc_feature 1..30: note = chr16:87718416-87718446
  misc_feature 1..30: note = hypo
  source 1..30: mol_type = genomic DNA
acctcgtcctcccttcgagggggggatcat

SEQ ID NO: 79651 - DNA, 103 bp, Homo sapiens
  misc_feature 1..103: note = chr16:87721480-87721583
  misc_feature 1..103: note = hypo
  source 1..103: mol_type = genomic DNA
ctgctaggtccatagcgtctaaggcacaggaatgccagccccttggaagtcccatcctggccaaggaggaggtacgatgtgggtgatccgtgggcatgattgg

SEQ ID NO: 79652 - DNA, 30 bp, Homo sapiens
  misc_feature 1..30: note = chr16:87722716-87722746
  misc_feature 1..30: note = hypo
  source 1..30: mol_type = genomic DNA
ggtggggagggaagtcggctcctgggctct

SEQ ID NO: 79653 - DNA, 1244 bp, Homo sapiens
  misc_feature 1..1244: note = chr16:87723113-87724357
  misc_feature 1..1244: note = hypo
  source 1..1244: mol_type = genomic DNA
ttgcctgcagcctttcggtgagtgggaagcgcctctgctgccctgaggttccctctggcgccctggcccggggaccgcggcctcgctgtggaatgtgctgggtaacgccgtctggcgtcgtcttgtgtccccatacagggctggagtaccagaggccgaagcgtcagacctcctgtgacgacatcgaggtgctgtccaccgggacacccctgcagcaggagagccccgagctgtaccgcaagggcaccactccctccgacctgacccccgacgacagccccctgcagagcttccccaccagccccgcggccaccccgccgcccgcgcccgccgccaggaacaaggtcgcccacttctcgaggcaggtgtcggtggacgaggagcggggcggggacatccagatgctcctggagggccgggccggggactgcgcccgcagcagctggggcgaggagcaggccgggggctccaggggtgtccgcagcggtgccctgcgcggcggcctgctcgtggatgacttccgcacccgaggttcgggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatggggatgagctcaagtccagtacggtgagtgggcggccaccaggctggtcccagtggaggcaacatccacctctctgctgacctggtgtttcctgagggtttccagcaaggtcactgctcccctgttcctctccaggggtggagtagggtgggggtacagccgggagtggtggccctcaggtcgctgggaccctcccctaggaagccaggtggggcaggtgtcatacctctttccgtgagaggctgccc

SEQ ID NO: 79654 - DNA, 20 bp, Homo sapiens
  misc_feature 1..20: note = chr16:87726991-87727011
  misc_feature 1..20: note = hypo
  source 1..20: mol_type = genomic DNA
tttcttggccaggcacggtg

SEQ ID NO: 79655 - DNA, 30 bp, Homo sapiens
  misc_feature 1..30: note = chr16:87728594-87728624
  misc_feature 1..30: note = hypo
  source 1..30: mol_type = genomic DNA
tgtgaatcctgctgccgggagtgtgtgcac

SEQ ID NO: 79656 - DNA, 30 bp, Homo sapiens
  misc_feature 1..30: note = chr16:87740397-87740427
  misc_feature 1..30: note = hypo
  source 1..30: mol_type = genomic DNA
cacttctcaagccatcgccccaaggtgacc

SEQ ID NO: 79657 - DNA, 30 bp, Homo sapiens
  misc_feature 1..30: note = chr16:87740741-87740771
  misc_feature 1..30: note = hypo
  source 1..30: mol_type = genomic DNA
ccaattatgcaaatccgaattggccttcag

SEQ ID NO: 79658 - DNA, 70 bp, Homo sapiens
  misc_feature 1..70: note = chr16:877732-877802
  misc_feature 1..70: note = hypo
  source 1..70: mol_type = genomic DNA
gctgtggaagctgcacgtgtcaccttatgtcatggctgcaacggcacgcaatgcacgcacaacatgtgtg

SEQ ID NO: 79659 - DNA, 147 bp, Homo sapiens; identical to SEQ ID NO: 44593
  misc_feature 1..147: note = chr16:8781004-8781151
  misc_feature 1..147: note = hypo
  source 1..147: mol_type = genomic DNA

SEQ ID NO: 79660 - DNA, 78 bp, Homo sapiens
  misc_feature 1..78: note = chr16:87864575-87864653
  misc_feature 1..78: note = hypo
  source 1..78: mol_type = genomic DNA
tgggaagcagtggtgcgtgcctccagggagcacttctcctggacccggggccgtggctgcctacgatgtccactgcct

SEQ ID NO: 79661 - DNA, 30 bp, Homo sapiens
  misc_feature 1..30: note = chr16:878827-878857
  misc_feature 1..30: note = hypo
  source 1..30: mol_type = genomic DNA
gtccgcctgctgctccggggccgctggggt

SEQ ID NO: 79662 - DNA, 81 bp, Homo sapiens
  misc_feature 1..81: note = chr16:87905808-87905889
  misc_feature 1..81: note = hypo
  source 1..81: mol_type = genomic DNA
aggcgtgagccaccacgcccagcgccctgcaggtcctttttaaggctgtttgcaacataaatgagacgaggcatcttctgc

SEQ ID NO: 79663 - DNA, 59 bp, Homo sapiens
  misc_feature 1..59: note = chr16:87911217-87911276
  misc_feature 1..59: note = hypo
  source 1..59: mol_type = genomic DNA
gaagacacgctgcaacgtgcaggacccctgaaaacactgggctgcgtgaaagggtcagt

SEQ ID NO: 79664 - DNA, 60 bp, Homo sapiens
  misc_feature 1..60: note = chr16:87916269-87916329
  misc_feature 1..60: note = hypo
  source 1..60: mol_type = genomic DNA
acaacacacttcacccgggcctggttcaggagcgggcgaggcagccgtacaccctgtcct

SEQ ID NO: 79665 - DNA, 30 bp, Homo sapiens
  misc_feature 1..30: note = chr16:87941554-87941584
  misc_feature 1..30: note = hypo
  source 1..30: mol_type = genomic DNA
aaaagcggttgtttccgtctggaccatcac

SEQ ID NO: 79666 - DNA, 30 bp, Homo sapiens
  misc_feature 1..30: note = chr16:87960551-87960581
  misc_feature 1..30: note = hypo
  source 1..30: mol_type = genomic DNA
ctgcagggagagagacggagaccctgagtg

SEQ ID NO: 79667 - DNA, 30 bp, Homo sapiens
  misc_feature 1..30: note = chr16:87979832-87979862
  misc_feature 1..30: note = hypo
  source 1..30: mol_type = genomic DNA
gcctgggtgacatagcgagactccgcctaa

SEQ ID NO: 79668 - DNA, 30 bp, Homo sapiens
  misc_feature 1..30: note = chr16:88056313-88056343
  misc_feature 1..30: note = hypo
  source 1..30: mol_type = genomic DNA
gtgtgggcagggccacgctgcctgagaagg

SEQ ID NO: 79669 - DNA, 81 bp, Homo sapiens
  misc_feature 1..81: note = chr16:88092513-88092594
  misc_feature 1..81: note = hypo
  source 1..81: mol_type = genomic DNA
taaagtggcccctgccggcttttccttctgcctcctggtgggcccctgagccgctgctcctgctttcggcagctgctcctc

SEQ ID NO: 79670 - DNA, 30 bp, Homo sapiens
  misc_feature 1..30: note = chr16:88098353-88098383
  misc_feature 1..30: note = hypo
  source 1..30: mol_type = genomic DNA
ggttgggggtgctgccgctcttgcccgcag

SEQ ID NO: 79671 - DNA, 48 bp, Homo sapiens; identical to SEQ ID NO: 44817
  misc_feature 1..48: note = chr16:88101496-88101544
  misc_feature 1..48: note = hypo
  source 1..48: mol_type = genomic DNA

SEQ ID NO: 79672 - DNA, 158 bp, Homo sapiens
  misc_feature 1..158: note = chr16:88101811-88101969
  misc_feature 1..158: note = hypo
  source 1..158: mol_type = genomic DNA
gggatggaggaggtgcgggcttaccgtgtgctcctctgctgctcgccccaggcttgggtttcctggcggtcacctggttggcgtgaaccttgggcgtgcgccagggtccctgtgctgtcgtggagtgcaggcaggtgggcaggcgcttgggagttacc

SEQ ID NO: 79673 - DNA, 66 bp, Homo sapiens
  misc_feature 1..66: note = chr16:88107013-88107079
  misc_feature 1..66: note = hypo
  source 1..66: mol_type = genomic DNA
tactctgcccatgggcgcggtggcccccgcagaggcgcgccctgtactctgcgtggtgtttggttc

SEQ ID NO: 79674 - DNA, 30 bp, Homo sapiens
  misc_feature 1..30: note = chr16:88133222-88133252
  misc_feature 1..30: note = hypo
  source 1..30: mol_type = genomic DNA
ccacccacatgttctcgaggtcagacccct

SEQ ID NO: 79675 - DNA, 99 bp, Homo sapiens
  misc_feature 1..99: note = chr16:88137279-88137378
  misc_feature 1..99: note = hypo
  source 1..99: mol_type = genomic DNA
ggtagaataatcctccgtggcacgaggaagcgctggaataatcctccatggcacgagggagcggtggaataatcctccgtggcacgggggtgggtggaa

SEQ ID NO: 79676 - DNA, 47 bp, Homo sapiens
  misc_feature 1..47: note = chr16:88138197-88138244
  misc_feature 1..47: note = hypo
  source 1..47: mol_type = genomic DNA
tgggagtgtctccctcgctcagcgtcacattccgggggcctgtccat

SEQ ID NO: 79677 - DNA, 237 bp, Homo sapiens
  misc_feature 1..237: note = chr16:88164335-88164572
  misc_feature 1..237: note = hypo
  source 1..237: mol_type = genomic DNA
ggcacctaataaaaacggcagcgcagcctcccacgcactcagtggttcagacacacgaagacagcaatacagatgttacctcggctggtctcagcgcagcaccggcgctgggaaacgacgctgcctgggatggcgggcgcgtgggaaggccccgcggagtgggggtgtgaagtggccgcggggtgtcggcagagacaggcggaagtggcgtcccgatgaggacgaggtgcccgggca

SEQ ID NO: 79678 - DNA, 215 bp, Homo sapiens
  misc_feature 1..215: note = chr16:88165545-88165760
  misc_feature 1..215: note = hypo
  source 1..215: mol_type = genomic DNA
ctaatggctcctgcccggcccgcgcatctccggggctgctgaagacagggcagcgatgctccgcccgtgggaagctgggcagcggcaggacggcactcccagcctctccatcggctttgaatcacggcctggagttccgatgcttcgtggccactctcctctccatgtgtggacatcgctgtctgtggccccggccataccgatggcttcaggtg

SEQ ID NO: 79679 - DNA, 30 bp, Homo sapiens
  misc_feature 1..30: note = chr16:88179063-88179093
  misc_feature 1..30: note = hypo
  source 1..30: mol_type = genomic DNA
agcccctgcgagcctcgtgcttggccgctg

SEQ ID NO: 79680 - DNA, 30 bp, Homo sapiens
  misc_feature 1..30: note = chr16:88216917-88216947
  misc_feature 1..30: note = hypo
  source 1..30: mol_type = genomic DNA
agaaatgaaactgcacgtccccaccaaacc

SEQ ID NO: 79681 - DNA, 79 bp, Homo sapiens; identical to SEQ ID NO: 44432
  misc_feature 1..79: note = chr16:882403-882482
  misc_feature 1..79: note = hypo
  source 1..79: mol_type = genomic DNA

SEQ ID NO: 79682 - DNA, 139 bp, Homo sapiens; identical to SEQ ID NO: 44433
  misc_feature 1..139: note = chr16:882542-882681
  misc_feature 1..139: note = hypo
  source 1..139: mol_type = genomic DNA

SEQ ID NO: 79683 - DNA, 40 bp, Homo sapiens
  misc_feature 1..40: note = chr16:88261467-88261507
  misc_feature 1..40: note = hypo
  source 1..40: mol_type = genomic DNA
cacgcaggtgtaccccgccaggctccgcctccattattat

SEQ ID NO: 79684 - DNA, 30 bp, Homo sapiens
  misc_feature 1..30: note = chr16:88317274-88317304
  misc_feature 1..30: note = hypo
  source 1..30: mol_type = genomic DNA
tgtgaggagttggagcggattcttagggct

SEQ ID NO: 79685 - DNA, 71 bp, Homo sapiens
  misc_feature 1..71: note = chr16:883188-883259
  misc_feature 1..71: note = hypo
  source 1..71: mol_type = genomic DNA
cagggcacggggaaccggggtcgggctgaacattactccctactctgaaaggacagcgttgggacaatgtg

SEQ ID NO: 79686 - DNA, 150 bp, Homo sapiens
  misc_feature 1..150: note = chr16:88355986-88356136
  misc_feature 1..150: note = hypo
  source 1..150: mol_type = genomic DNA
ctgcacctgctctcgcggtctcgggagccccgccctgcctgtcacgtcagtgtcccggccgtgttcatcctgaagctccacagccgcagccacccatggcagtggggagccaactgcagtatgctctgatcaaaccgtatctcatggctc

SEQ ID NO: 79687 - DNA, 138 bp, Homo sapiens
  misc_feature 1..138: note = chr16:88358687-88358825
  misc_feature 1..138: note = hypo
  source 1..138: mol_type = genomic DNA
gatcacatccagctgcggcatactcagggtctcaagtcctcacctgcacactccaggtggtcccgacagcagctgcgacatacacagggcctcaagtcctcacctgcacactccaggtggtcgcgacagcagctgtga

SEQ ID NO: 79688 - DNA, 128 bp, Homo sapiens
  misc_feature 1..128: note = chr16:883606-883734
  misc_feature 1..128: note = hypo
  source 1..128: mol_type = genomic DNA
ccccggcgcctctcccggagaagcagcctccccaagctgtgcctgagccgagggcaccgtccaggtcatctcagccagagccttggccgggtctaggggaggggtcacgccaacgtgatgacctcctg

SEQ ID NO: 79689 - DNA, 30 bp, Homo sapiens
  misc_feature 1..30: note = chr16:88369078-88369108
  misc_feature 1..30: note = hypo
  source 1..30: mol_type = genomic DNA
agggccactctggcacggggtctcagggtg

SEQ ID NO: 79690 - DNA, 45 bp, Homo sapiens
  misc_feature 1..45: note = chr16:88374282-88374327
  misc_feature 1..45: note = hypo
  source 1..45: mol_type = genomic DNA
cagaggaggcaggtgcgtggggaggagtcccgctggaacagaatc

SEQ ID NO: 79691 - DNA, 85 bp, Homo sapiens; identical to SEQ ID NO: 44820
  misc_feature 1..85: note = chr16:88375259-88375344
  misc_feature 1..85: note = hypo
  source 1..85: mol_type = genomic DNA

SEQ ID NO: 79692 - DNA, 180 bp, Homo sapiens
  misc_feature 1..180: note = chr16:88387108-88387288
  misc_feature 1..180: note = hypo
  source 1..180: mol_type = genomic DNA
ggcctttgcgcacaacgccctccgccagcctctcgcggctcactgctgcctgcccagagaggctcccggagcccattgggtgccttaggccttccctgctcggtgttgcttcagagcatgcgcgcgtgtcgtggtgaacggtggctcccaacaactcagtccacacgaatcctcagaatg

SEQ ID NO: 79693 - DNA, 87 bp, Homo sapiens
  misc_feature 1..87: note = chr16:88442772-88442859
  misc_feature 1..87: note = hypo
  source 1..87: mol_type = genomic DNA
gtgtgaggggacgtccggggtgagagggggagggaagctgcagcaggcactgaaggccgctgtccctctcctcgcctgccccaggcc

SEQ ID NO: 79694 - DNA, 1179 bp, Homo sapiens
  misc_feature 1..1179: note = chr16:88449274-88450453
  misc_feature 1..1179: note = hyper
  source 1..1179: mol_type = genomic DNA
aacacctaggaaaagcggcgctaaaaatagctggggggagggtgcgggggcggcggagtctgtaacctaagccgccccagcctccggggggcagaccccgcggccgccggccggcgtccggccttcccagcacccggcccagggctggagctggctgcagggctggcccgcggcgacctgggcagggtggcggctgctccctctcctcccaccccgccccgaggcgcagcgcgcggcagagcggctcggtgcccggcgggcgggcggcccgggcgggcctgcggtcgggatgaggacggcgcctccgctgcagagcgctggggcggcgcgggccgggagctcgttggcggcggccggcgtggcgggcggagcgggcctcggagcggaggtgagtgcggatgcgccgcctgggcgcgcgcggtgcctggggaccccgggctggaacgcggggcgggggtgtcaccgggctgcgcgggggtctccggcccggctcccgctcctgcgccctcgggggccgctccccggcggggccggaccctcccagcgctcgcggcgcccggcccggctcccccgacctcctcctcccgggcccggacgtgcggggcagcgagcgccggggcccggcgggggccgcagccttgcccggagcggagcgttggcagcgcggggtccggctccgtgggcagtttgggaagcgcccgggcaacgtactggcgagggccgcggagcgaggggctcggggagcgggacctccgggcggggctgcggggagcggggcccgggccgccccattcatcgcggatcggagccgggggtgccccagccgtgccgccgcctcctccgggccgcccgcccgggcgtgctggccccgcggcgctccgagcgcggcataggcttgcgagtcggcggtgtcagcgccccggacgggggtgggagctttggagcccaccctgggggagaccacgccgcacccccgcccagccccgcgcacccccagaggcttttgcagagccgggaagttggctggacgtctagacccgtggggacgcggcgccccgcgtggcggcggccggaagggaaggccaatggggctcgggggactcccgcggccacccagtccttgtccctgcaccctgggccgagggcagagggacaggtccccggcgggggcgggggggc

SEQ ID NO: 79695 - DNA, 42 bp, Homo sapiens
  misc_feature 1..42: note = chr16:88460646-88460688
  misc_feature 1..42: note = hypo
  source 1..42: mol_type = genomic DNA
gagcagggtttgacacgtctacacctgcgctgcctgagagga

SEQ ID NO: 79696 - DNA, 39 bp, Homo sapiens
  misc_feature 1..39: note = chr16:88464766-88464805
  misc_feature 1..39: note = hypo
  source 1..39: mol_type = genomic DNA
ggatgaaggaggacccgtgagccacggatgaagggacat

SEQ ID NO: 79697 - DNA, 32 bp, Homo sapiens
  misc_feature 1..32: note = chr16:88473761-88473793
  misc_feature 1..32: note = hypo
  source 1..32: mol_type = genomic DNA
ctcttctcagtgttacgcgaaggaaggagcaa

SEQ ID NO: 79698 - DNA, 210 bp, Homo sapiens
  misc_feature 1..210: note = chr16:88476104-88476314
  misc_feature 1..210: note = hypo
  source 1..210: mol_type = genomic DNA
acgtgtgcagctctgcgtgaggaaaatgcaaacaaagctcggtaaagcaggccggggcccacacatgcgggcagggcatccaggcagcttgggcagagtgatcagaggtcctcgctcagtggcctgtgagcggaggcctgagtgcgacaggtgtggtggccatcttggccggggggggggggggggggcgcggggcgttccagggctctg

SEQ ID NO: 79699 - DNA, 41 bp, Homo sapiens
  misc_feature 1..41: note = chr16:88480893-88480934
  misc_feature 1..41: note = hypo
  source 1..41: mol_type = genomic DNA
aaggtggcagcctcccgggagagagccgtgagggcagaggc

SEQ ID NO: 79700 - DNA, 30 bp, Homo sapiens
  misc_feature 1..30: note = chr16:88484563-88484593
  misc_feature 1..30: note = hypo
  source 1..30: mol_type = genomic DNA
acctgcggccccaaccggtgtgatgccggc

SEQ ID NO: 79701 - DNA, 170 bp, Homo sapiens; identical to SEQ ID NO: 44822
  misc_feature 1..170: note = chr16:88495551-88495721
  misc_feature 1..170: note = hypo
  source 1..170: mol_type = genomic DNA

SEQ ID NO: 79702 - DNA, 36 bp, Homo sapiens
  misc_feature 1..36: note = chr16:88497351-88497387
  misc_feature 1..36: note = hyper
  source 1..36: mol_type = genomic DNA
gggcgggtctcgcccgggccccggcaggagccctca

SEQ ID NO: 79703 - DNA, 743 bp, Homo sapiens
  misc_feature 1..743: note = chr16:88498119-88498862
  misc_feature 1..743: note = hypo
  source 1..743: mol_type = genomic DNA
cctttgccaggacggcgaggatgccggttccctcgagccacagctgccaaggagcccacctggcaccgctgagacggagccaggcagggctgcatcgccaccgaccttggagtcctcatccctcttcccagacctgccggtggacagattcgacccacccctctatggcagcctgtctgcgaacagggactccggtctgccgttcgcatgtgccgaccctccccagaagacggtgccgtcagatccaccgtacccctcttttttgctgcttgaggaagtatccccgatgctgcctagccattttcctgatctctcggggggaaaggtgctcagtaagacgtgtccccctgaacggacagtggttcccggcgccgccccatctttgcctgggaaggggagtggatgtagcgttgctcttatgagtcacctgtccgaggatgaactggagatccagaaattggtcaccgaattagaaagtcagctgcaaaggagcaaagacacacgtggggccccgagagagcttgcagaagctgagtcggtgggcagggtggagctcggcacaggcacagagccaccctcccaacggcgcacctgccaggccaccgtgccccacgaggacacgttctcggcagctgacctcacgcgcgttggagaatccactgcacatcgggagggtgcggaatcggctgtggccaccgtggaagcggttcaggggaggcctggggggacgtggccctgcccag

SEQ ID NO: 79704 - DNA, 30 bp, Homo sapiens
  misc_feature 1..30: note = chr16:88501699-88501729
  misc_feature 1..30: note = hypo
  source 1..30: mol_type = genomic DNA
gaaaaaagagaaggccggaggtggcgccga

SEQ ID NO: 79705 - DNA, 207 bp, Homo sapiens
  misc_feature 1..207: note = chr16:88502150-88502357
  misc_feature 1..207: note = hypo
  source 1..207: mol_type = genomic DNA
caagagagaccaaggcgttgggtgtgtgcaaagagtctgggagcgagcctgcggaggacagcagcagggcccacagccgatcagaggaaggtgtctgggaggagaacacgccccccttgggccccctgggttttcccgagacttccagctctccggcggacagcaccaccagcagctgcctccagggcctcccggacaacccagaca

SEQ ID NO: 79706 - DNA, 30 bp, Homo sapiens; identical to SEQ ID NO: 44826
  misc_feature 1..30: note = chr16:88502901-88502931
  misc_feature 1..30: note = hypo
  source 1..30: mol_type = genomic DNA

SEQ ID NO: 79707 - DNA, 520 bp, Homo sapiens
  misc_feature 1..520: note = chr16:88503229-88503749
  misc_feature 1..520: note = hypo
  source 1..520: mol_type = genomic DNA
aaagtgtgcttccagcgcttccgcagcctgggcgagctggacctgcacaagctggcccacacgcccgcgccgccgcccacctgctacatgtgcgtggagcgcaggtttggctcgcgggagctgctgcgggggcacctgcaggagaggcacgcgcagagcaaggccgggccctgggcgtgcggcatgtgcctgaaggaggtggccgacgtctggatgtacaacgagcacctgcgtgagcacgcggtccgcttcgcccgcagggggcaggcgcggaggtccttgggggacctgcccggaggcctggagggcagcagcgctgtcgcccaccttctgaacagcatcacggaacccgcgcccaaacaccacaggggcaagcgctccgccggcaaggccgccgggagcccgggagacccgtgggggcaagagggagaagccaagaaagacagcccgggcgagagggcgaaaccccgggcacgcagcacccccagcaacccagacggggccgcgaccccagacagcg

SEQ ID NO: 79708 - DNA, 763 bp, Homo sapiens
  misc_feature 1..763: note = chr16:88504017-88504780
  misc_feature 1..763: note = hypo
  source 1..763: mol_type = genomic DNA
gctggcacacctgggcggggcgcacgggctgctggagcggccggagctgcagcacacgccgctgtatgcctgcgagctctgcgccacggttatgcgcatcatcaagaagtccttcgcctgcagctcctgcaactacaccttcgccaagaaggagcagttcgaccgccacatgaacaagcacctcaggggggggcggcagcccttcgcgttccgcggcgtgcggaggccgggagcgccgggacagaaggcccgggccctcgagggcacactgcccagcaaacggcgcagggtggccatgcccggcagtgcccctgggcccggcgaggacaggcctcctccccggggaagcagccccatcctgagtgagggctctctcccggccctgctccacctgtgttcggaggtggctcccagcaccaccaagggatggcccgagaccctagagaggcctgtagaccccgtgacccacccgatcagaggttgtgagctgccatccaaccaccaggagtgtcccccgccgtctctgtctcccttcccagctgccttggctgatggcagaggagactgcgcgctggacggagccctggagaggccagagaacgaggcttccccaggcagccccgggcctcttctccagcaagctctccctctgggggcatctctgccgcggccgggagccagaggccaagatgcggagggaaagagggctcctctcgtgttctcagggaaacgcagggccccgggtgcccgtggcaggtgtgcc

SEQ ID NO: 79709 - DNA, 195 bp, Homo sapiens
  misc_feature 1..195: note = chr16:88506346-88506541
  misc_feature 1..195: note = hypo
  source 1..195: mol_type = genomic DNA
cctccatttgctctgcgggagaaaagcccatctctagcacaccttgaccccaggaaccgggttcccgtatggaactgggaagaaaccgcccctgtgccagctcccgcgggccctcctcgttccctcccagcctccatggccgccctctagagcctccctgctgtacggagctctgggctccgcctatttgcaatg

SEQ ID NO: 79710 - DNA, 462 bp, Homo sapiens
  misc_feature 1..462: note = chr16:88506828-88507290
  misc_feature 1..462: note = hypo
  source 1..462: mol_type = genomic DNA
cgtgtcctctcacagcgtcgtgcctgtgaaggtgggtcaaagggtgagagggcttccttctcacccttctctccataagtatcttgaagatccatggtttgttttgctctattgtttagtttttacttgggtgcaatgtgtacgtcaaaagtttttattttgatatttgaaagagaccaaatcaggcccagaccgcctctctggaaggtgttgtaggccattcaaaacgcctccggagtgtcgcaaaccaagtgcggaggggccctgaggttgtactgtaaacatcatagtgacttgtcttttcaaatatattcccactattttcgcagaaaacctccagctgcgtgacgtctgtcctcccgccggcccccatccctggtctgcacctccctgagcctcagaacttggctcccagggtgtctgcgccagctgccactctcgggccaccgtgggccaagggcc

SEQ ID NO: 79711 - DNA, 160 bp, Homo sapiens
  misc_feature 1..160: note = chr16:88507982-88508142
  misc_feature 1..160: note = hypo
  source 1..160: mol_type = genomic DNA
cctcccccaggtgggcgctgggcctcccctgctttccacttgttgctggcggaactcacaccgtaagggcgtctgcgaaggggcccagcgtggggagggcagcgcctgtcctcaaagccctgctctcggggtggatgtcggacaccgtcatgccagctgc

SEQ ID NO: 79712 - DNA, 274 bp, Homo sapiens
  misc_feature 1..274: note = chr16:88512417-88512691
  misc_feature 1..274: note = hypo
  source 1..274: mol_type = genomic DNA
ccccaaaagtctcaccgtgtctcagcgtcaggctcaggcccggggccctgacatttagatagggccaggtgtggctgaggccatcgagtcattcctccggtgaagtatgcccgtgcgtcggggtgcagggcacggggtgtaggacaaatgctaccaatgcccctgtcgggaactgggaggagggtggcacatgtccgtcactgccacaggcggttccgaagcccgggccctgccccgtacagtgactgtgctgttagcccggccacctggggcc

SEQ ID NO: 79713 - DNA, 64 bp, Homo sapiens
  misc_feature 1..64: note = chr16:88534612-88534676
  misc_feature 1..64: note = hypo
  source 1..64: mol_type = genomic DNA
cacccgcgagcccaccgcccctcaagcacccgcgagcccaccgtcccgacgcacccgcgagccc

SEQ ID NO: 79714 - DNA, 30 bp, Homo sapiens
  misc_feature 1..30: note = chr16:88548193-88548223
  misc_feature 1..30: note = hypo
  source 1..30: mol_type = genomic DNA
ctacgtgggtgggggcggttaagggtgggc

SEQ ID NO: 79715 - DNA, 30 bp, Homo sapiens
  misc_feature 1..30: note = chr16:88550771-88550801
  misc_feature 1..30: note = hypo
  source 1..30: mol_type = genomic DNA
tgttccagcctgcaacgctcaggccttccc

SEQ ID NO: 79716 - DNA, 168 bp, Homo sapiens
  misc_feature 1..168: note = chr16:88551406-88551574
  misc_feature 1..168: note = hypo
  source 1..168: mol_type = genomic DNA
cctgcttggtttgttcgctcgacaagtctgtgagcgcctcctttgtgctgggtgagggtgtcaccccagggagttcccagaccgagggaatgagtgtgagggaagtgcacggggactgggcccctgggcggggcactggcaggtgatgccaggcggaggccgtggcga

SEQ ID NO: 79717 - DNA, 30 bp, Homo sapiens
  misc_feature 1..30: note = chr16:88594593-88594623
  misc_feature 1..30: note = hypo
  source 1..30: mol_type = genomic DNA
cctgccccagcaggccgggatggcctccat

SEQ ID NO: 79718 - DNA, 170 bp, Homo sapiens
  misc_feature 1..170: note = chr16:88601509-88601679
  misc_feature 1..170: note = hypo
  source 1..170: mol_type = genomic DNA
ggccgcagggggcagcgcccgcctggacccttggcacttaataaagaagttcagtttgatgagcatggtggtgggccagcctagttctctgagccagcaggcacacgcagccagtgtcacatccagccctgctgtgtacacaggccactgcggcccggagtggctgggcc

SEQ ID NO: 79719 - DNA, 51 bp, Homo sapiens; identical to SEQ ID NO: 44837
  misc_feature 1..51: note = chr16:88602946-88602997
  misc_feature 1..51: note = hypo
  source 1..51: mol_type = genomic DNA

SEQ ID NO: 79720 - DNA, 80 bp, Homo sapiens
  misc_feature 1..80: note = chr16:88603696-88603776
  misc_feature 1..80: note = hypo
  source 1..80: mol_type = genomic DNA
caaggaccctgtgaccgggacccagacctgaagtcaccccagagggccccgccacggcccggactcgaagcttagggcag

SEQ ID NO: 79721 - DNA, 30 bp, Homo sapiens
  misc_feature 1..30: note = chr16:88622299-88622329
  misc_feature 1..30: note = hypo
  source 1..30: mol_type = genomic DNA
ccacggagcccaggacggagactcacacag

SEQ ID NO: 79722 - DNA, 205 bp, Homo sapiens
  misc_feature 1..205: note = chr16:88623960-88624165
  misc_feature 1..205: note = hypo
  source 1..205: mol_type = genomic DNA
tgcagcctcaaggcacgggagccacggatgcctgaggcctgggaacctggaagaggccgtggggagccttccctgcagcctgcagccctgcccgtgcctcgagttccacttcatgactctgctatcagacatctggcctacggaactgtgaggcgatatgtttctgagtgtttttgttgtcactattgttgtcgtttgagacagt

SEQ ID NO: 79723 - DNA, 19 bp, Homo sapiens
  misc_feature 1..19: note = chr16:88624548-88624567
  misc_feature 1..19: note = hypo
  source 1..19: mol_type = genomic DNA
aaaatacataaaaggcgga

SEQ ID NO: 79724 - DNA, 559 bp, Homo sapiens
  misc_feature 1..559: note = chr16:88624747-88625306
  misc_feature 1..559: note = hypo
  source 1..559: mol_type = genomic DNA
ttcaagcgttcatcctgccgcagcctccccagcagatgggattaggagttaaagatgtgcggtgagtcccgcgtccccccatgctccgggggtgtgagtcgcgcatccccccgtcggggggtgagtcgcccgtccccccgtgctccgggggggtgagtcccgcgtccccccgtgctccgggggggtgagtcccgcgtccccccgtgctccgggggggtgagtcccgcgtcccccggtgctccgggggggtgagtcccgcgttccccccgtgctctgggggtgtgagtcctgcgtcctcccgttccctgggggtgtgagtcaggcatcctcccgttccctggtggtgtgagtcccgcatcctcccgttccctgggggtgtgagtcccgcatccccccatgctccaggggtgtgagtcccatgtccccctgtactctgggggtgtgagtcctgcatcctcccattctctgggggtgtgagtcccgcgtctcccatggaccagcgctgtaagtcccatgccctcctgtgctatggtggtgtgagtcccgtgtcctcccattc

SEQ ID NO: 79725 - DNA, 30 bp, Homo sapiens
  misc_feature 1..30: note = chr16:88627634-88627664
  misc_feature 1..30: note = hypo
  source 1..30: mol_type = genomic DNA
aagagtagggccctacgattgtacctgctc

SEQ ID NO: 79726 - DNA, 40 bp, Homo sapiens
  misc_feature 1..40: note = chr16:88629600-88629640
  misc_feature 1..40: note = hypo
  source 1..40: mol_type = genomic DNA
caggcgtgggccaccgcgcccggcccgtttcttttgttat

SEQ ID NO: 79727 - DNA, 95 bp, Homo sapiens
  misc_feature 1..95: note = chr16:88633091-88633186
  misc_feature 1..95: note = hypo
  source 1..95: mol_type = genomic DNA
cacaaccaaccagcccgtatcgggacacgatcattgacttaagtccacagtttacattacagttcactcttggcgttgtgcgttatgtgggtttt

SEQ ID NO: 79728 - DNA, 397 bp, Homo sapiens
  misc_feature 1..397: note = chr16:88683701-88684098
  misc_feature 1..397: note = hypo
  source 1..397: mol_type = genomic DNA
acctgcggctggagacggagttgtgccgctctctccgtcctagtttgccttttgaggcttacccactcctccacctgggctgttttaaaatgattagagcagaacctttcaatcaattctatcaaatgcatctgtagagctaagggggcggtcccttatgtgaaacctaatctttatagctaggccgatgggtgtgctcaccgccgaggcacgtcattacgatgctctttggctagtcattgtcattagaaatgtaaacactgattggggaccttcccgcaggagctgtctgggctgcctgctgtctccaagctattcaacttccaggtttacctttgcagctttgggtgccccttcagggcttgagcttggcaggctcctgcggtggggttgtggg

SEQ ID NO: 79729 - DNA, 53 bp, Homo sapiens
  misc_feature 1..53: note = chr16:8870353-8870406
  misc_feature 1..53: note = hypo
  source 1..53: mol_type = genomic DNA
ccccctcccctgccccgcccccaccacccatggctccccgcagcagcctccgg

SEQ ID NO: 79730 - DNA, 54 bp, Homo sapiens
  misc_feature 1..54: note = chr16:88709735-88709789
  misc_feature 1..54: note = hypo
  source 1..54: mol_type = genomic DNA
gcgggagggcaggtccggggcgaggtcacacgacctcgtcggtcaccgggatgg

SEQ ID NO: 79731 - DNA, 491 bp, Homo sapiens
  misc_feature 1..491: note = chr16:88722326-88722817
  misc_feature 1..491: note = hypo
  source 1..491: mol_type = genomic DNA
ggtggtggcgcccgccgcatgggagcggttcctgagcactcaaccacgcttctgttccttcagcccccgctgaccccaggagccaagcaaagcctggatggacgccttcgctcctgctcccggcagcagccctgactagggacagaggccaccgggctgctgctccacccgccccaccccactcaccacaaggatgagcacgcggagttcaggccagtgtgactcgggggccacttgccgagcgatgctgtccttcccgtcggcctgctctcccatctgccactccacaaagcccccatacaggctccggcaggcgctgcctgagccccggcgagccacttctgagaggtcactctccacgccgtagacacgggccagggtgtaggctgcaggcatgcggattcagggagggtcctcagagctgcctgcgctgtgctccctgacagctcaccgccccaggaacgtcccacaccccacggcaaatggggatt

SEQ ID NO: 79732 - DNA, 30 bp, Homo sapiens
  misc_feature 1..30: note = chr16:88725656-88725686
  misc_feature 1..30: note = hypo
  source 1..30: mol_type = genomic DNA
agcacaccatctgctcggttttgtgcgagg

SEQ ID NO: 79733 - DNA, 159 bp, Homo sapiens
  misc_feature 1..159: note = chr16:88757527-88757686
  misc_feature 1..159: note = hypo
  source 1..159: mol_type = genomic DNA
tgagccatcaagcagcgaggcagcgtgcgtgtgagtctgcaggccacaggcgtgttcgtgcgtgtgtccatgggcgtatgcgtgtgggaagtcgcagtagctgctctgaggtgacatggaggctgggcatcagcgggtaagtcccgggcaccaggagag

SEQ ID NO: 79734 - DNA, 30 bp, Homo sapiens
  misc_feature 1..30: note = chr16:88760519-88760549
  misc_feature 1..30: note = hypo
  source 1..30: mol_type = genomic DNA
ccgtaggaggggtcccggcctccccacttt

SEQ ID NO: 79735 - DNA, 30 bp, Homo sapiens
  misc_feature 1..30: note = chr16:88780737-88780767
  misc_feature 1..30: note = hypo
  source 1..30: mol_type = genomic DNA
ggtggagccccagcccgtgtgattcacctg

SEQ ID NO: 79736 - DNA, 294 bp, Homo sapiens
  misc_feature 1..294: note = chr16:88791525-88791819
  misc_feature 1..294: note = hypo
  source 1..294: mol_type = genomic DNA
gccaccaggaggggtcggggctgtgagtgctcccgtcttggagacaggataggtggagacagacacggacacccacagtgacgggggccgtgtggggccatggggctcagagcccatgtgcgtggacggacagtcacagggcggccatggggcctgccagacagagggtgatcatgcggacaggacaggcgggctgggagccctgtgggacgtcacatgggcacagacgcagcacacgccagcaggcacagacatgctggacacggggccctgggtgcccgactccagctgcac

SEQ ID NO: 79737 - DNA, 398 bp, Homo sapiens
  misc_feature 1..398: note = chr16:88793275-88793673
  misc_feature 1..398: note = hypo
  source 1..398: mol_type = genomic DNA
gatgcgggtggcccccgtgacaaacaccaccaccagcaccagccagaacaggtatcggaagacggccaccttcagcatgtcaaggtaggacctgccaggccggagcgtcagggcgggcgccccggccacccctcccagaaggttccccgtggagggtgacgtggaacccacctgcagtggataaagttgggcacggggttgggctccccccgcagcggctccaggcggtcggtgttgacgccagccatgcgctgccactcctctgtgcgctcagctgagaacacctgccactgctgggaggcgcacagcagcaggagaaagtcgcctgcaggacacaggagccgccgctgtgccacacggggacccacacgaggtgggcacggcgcataaatcccacc

SEQ ID NO: 79738 - DNA, 148 bp, Homo sapiens
  misc_feature 1..148: note = chr16:88794012-88794160
  misc_feature 1..148: note = hypo
  source 1..148: mol_type = genomic DNA
gccacttgatgagtgcggagttcatggggacggcccggctccagcgccagggataatctgggggaaggggtgtcatgtcaggaagggccgggcctgcctggggcctgagacacccggtccccacccgttgacccgagtctatcaccag

SEQ ID NO: 79739 - DNA, 195 bp, Homo sapiens
  misc_feature 1..195: note = chr16:88794566-88794761
  misc_feature 1..195: note = hypo
  source 1..195: mol_type = genomic DNA
tgggagtcctgctgacgtggcgttctgataggaccacgtgctggggatgggagcggccggggcctgctggggagggagccgtggcactgccggcccccggccacacttcctgggaggcgtgtgaggcagggagggtcggtccctaaggactgagggcatggatgtgactccacgcatctgcgaaacccacagccc

SEQ ID NO: 79740 - DNA, 30 bp, Homo sapiens
  misc_feature 1..30: note = chr16:88797788-88797818
  misc_feature 1..30: note = hypo
  source 1..30: mol_type = genomic DNA
cacggccgacccgcacggggcccggagagg

SEQ ID NO: 79741 - DNA, 271 bp, Homo sapiens
  misc_feature 1..271: note = chr16:88798735-88799006
  misc_feature 1..271: note = hypo
  source 1..271: mol_type = genomic DNA
gcctcacctccagcccgaatttgtagaagaagaagttgatgaagtacttgaggcagccgagcagatcctggtccagctgctggcgggtgccgctggcaaacacggcctgggcaggcagcggggccagctggtgctgccggcggtagtgctcctggcgccggtacacgatggcctcgaataccagcagcagcagcacttgcaggtggttctgcggagggcaagggtcagggggcagccgggtactcgcccgcccagccgcccaccagccctt

SEQ ID NO: 79742 - DNA, 90 bp, Homo sapiens
  misc_feature 1..90: note = chr16:88800047-88800137
  misc_feature 1..90: note = hypo
  source 1..90: mol_type = genomic DNA
agctccagcagccgccgcaggaacacctgcacgcgtgagaggacgtccgagaagccggctgccagctccagcagccgctcagccaccagg

SEQ ID NO: 79743 - DNA, 52 bp, Homo sapiens
  misc_feature 1..52: note = chr16:88801866-88801918
  misc_feature 1..52: note = hypo
  source 1..52: mol_type = genomic DNA
gcatgggttcacttgcgctcacacgcagagtcacacacgggttcactagttc

SEQ ID NO: 79744 - DNA, 52 bp, Homo sapiens
  misc_feature 1..52: note = chr16:88802185-88802237
  misc_feature 1..52: note = hypo
  source 1..52: mol_type = genomic DNA
aatgggcagagcccacgctcacacacactgtcaggggcgcaggggtggtgcc

SEQ ID NO: 79745 - DNA, 54 bp, Homo sapiens
  misc_feature 1..54: note = chr16:88802631-88802685
  misc_feature 1..54: note = hypo
  source 1..54: mol_type = genomic DNA
gtgggcagctcagggcgcaggtccatggcccacacgtagcgtaggcagcacagc

SEQ ID NO: 79746 - DNA, 197 bp, Homo sapiens
  misc_feature 1..197: note = chr16:88803266-88803463
  misc_feature 1..197: note = hypo
  source 1..197: mol_type = genomic DNA
gctatgggcagaacacgagggctccggcaattgggctgacaccgtccctgagcgtcagggatggccctgccagcacctgccgttctctgggcctcactttccttgaaagggtgggaaaggtggccctgaccccctttccagctctgcgcacctgaagactctcaggacccccaccccagggccgtggcttcatttgc

SEQ ID NO: 79747 - DNA, 41 bp, Homo sapiens
  misc_feature 1..41: note = chr16:88804816-88804857
  misc_feature 1..41: note = hypo
  source 1..41: mol_type = genomic DNA
gacactggagagggccgaggggtgggcgatgcctgcggggc

SEQ ID NO: 79748 - DNA, 90 bp, Homo sapiens
  misc_feature 1..90: note = chr16:88805842-88805932
  misc_feature 1..90: note = hypo
  source 1..90: mol_type = genomic DNA
tggcctggctgccaccggcccagtgtccccatctgtgactcgggggctctcctggtggctgaggcgccaggtgcccgggctgagaccgca

SEQ ID NO: 79749 - DNA, 30 bp, Homo sapiens
  misc_feature 1..30: note = chr16:88822251-88822281
  misc_feature 1..30: note = hypo
  source 1..30: mol_type = genomic DNA
ctgaggagacagtggcgctcaggagtcaac

SEQ ID NO: 79750 - DNA, 50 bp, Homo sapiens
  misc_feature 1..50: note = chr16:88827020-88827070
  misc_feature 1..50: note = hypo
  source 1..50: mol_type = genomic DNA
ggacaggcaggggcccgaggggagccacccgtcttcgaggcagcagcacc

SEQ ID NO: 79751 - DNA, 193 bp, Homo sapiens
  misc_feature 1..193: note = chr16:88827321-88827514
  misc_feature 1..193: note = hypo
  source 1..193: mol_type = genomic DNA
ctcatctgacctacacggggcagggtcctgcaggcctggtggctgctgtgggctgggcacccaccgcacctgccacagccatctgctctcagacctgctggcgtggagagtcaggacaccctcccggacacactcagcccgcagcccctggaggggtttgcagggcagggtgggggtccgtctgtgaagaagg

SEQ ID NO: 79752 - DNA, 67 bp, Homo sapiens
  misc_feature 1..67: note = chr16:88831230-88831297
  misc_feature 1..67: note = hypo
  source 1..67: mol_type = genomic DNA
cgtgacctcccaaaacgaggactccgccctcggcaccaggggcagacactggcgaccactccaacca

SEQ ID NO: 79753 - DNA, 176 bp, Homo sapiens
  misc_feature 1..176: note = chr16:88832651-88832827
  misc_feature 1..176: note = hypo
  source 1..176: mol_type = genomic DNA
aaggcaggggagtgtcgcctaagggcccggaggaggaattcccaggaccgccacagagaagcccggcctgagcgcacagcctggactcgagactgcaacagcggctcttgacagccagcgcgccctgcgaacttcagacgtgacagccccacaatcgcgtgcgtcagctccttaaa

SEQ ID NO: 79754 - DNA, 41 bp, Homo sapiens
  misc_feature 1..41: note = chr16:88871924-88871965
  misc_feature 1..41: note = hypo
  source 1..41: mol_type = genomic DNA
agtaccaggtgctggcggagatgttccgcagcatggacacc

SEQ ID NO: 79755 - DNA, 30 bp, Homo sapiens
  misc_feature 1..30: note = chr16:88875855-88875885
  misc_feature 1..30: note = hypo
  source 1..30: mol_type = genomic DNA
caggaggacaggagacggctcttgtgggaa

SEQ ID NO: 79756 - DNA, 148 bp, Homo sapiens
  misc_feature 1..148: note = chr16:88879949-88880097
  misc_feature 1..148: note = hypo
  source 1..148: mol_type = genomic DNA
gggctgttgggctggcgtgggaacagcaaggagccccgagtcctgcccttcaacaaccaatgtggcgctggcctctggaggaggccggccgggaggcagcgggagctgggcacctgattcttggcagctgctgagaaggtgtgaaagg

SEQ ID NO: 79757 - DNA, 39 bp, Homo sapiens
  misc_feature 1..39: note = chr16:88880594-88880633
  misc_feature 1..39: note = hypo
  source 1..39: mol_type = genomic DNA
tcctgaggtctgaggcgccgtgggcgaggaggagggtcc

SEQ ID NO: 79758 - DNA, 33 bp, Homo sapiens
  misc_feature 1..33: note = chr16:88881413-88881446
  misc_feature 1..33: note = hypo
  source 1..33: mol_type = genomic DNA
tataggcgtgagccaccgcgcttggcctcgagc

SEQ ID NO: 79759 - DNA, 896 bp, Homo sapiens
  misc_feature 1..896: note = chr16:88882683-88883579
  misc_feature 1..896: note = hypo
  source 1..896: mol_type = genomic DNA
cactgcagcctgggtcgtagagaaggacccagcagcacggagtgggattgggtgtggaaggcagaaggccagggctcctccacggctggtggccctgggctcctggggccccgagactcaggggtcctgagacagggacctccctgctccaccactgagtccagaggcggggacgccagctgcccaggtccctttgaaggaagggccctgaatatcttcctatgaaacttgccaggcacccccgccccccgccccccaactaacggaggtggccctgccctgcccagtcctaaataaccctgcagggtggactgtccctgggcagggacaaggccatctgccctccatggtcctcactgctggtaggtgctcccgatggccggtgctctcctgttacatccgccggcccacgctgtggctccctggctgttcagagccaccaccttccttcccacggcacggcgggcacccagcggctcccacgctgcagccgggtctggccctggaaagaggcttcagctgggccttttcgcccgcacagcaggagcccaggctgaagtctgcagctgccgaggggccttcttcccgaatcctgcgcggcagatccaggggctgtgggcagccacgcccagcccgtgtaaacaggtgagcgacggcccaggggcctcgaggctgggctcggccatctccactgtgctcggtgggctctgggcacccaggagcgacaccgcagacctgtgtgtggctcgtttttgccgactagagcgagggccgcacgtgtcccatctgaaggagctgtgaagacctgccctgctgggacccacatcagctgtgctgggaaacaggcctttgcggccactgcacacgcgggatggctgggccgtccacatgccacc

SEQ ID NO: 79760 - DNA, 187 bp, Homo sapiens
  misc_feature 1..187: note = chr16:888838-889025
  misc_feature 1..187: note = hypo
  source 1..187: mol_type = genomic DNA
tgagtcttgactgagcgtctgaggggcagctgggccccgaggctgatgggaagagccagacgaggcctgggaagatggatccgtcccagtgtggccgcgcggctgtcaggagggcacggggactgggcgcggccgtcaggaaggttcggggactgggctgctgtagcaaactcgggggcttaaagca

SEQ ID NO: 79761 - DNA, 126 bp, Homo sapiens
  misc_feature 1..126: note = chr16:88884153-88884279
  misc_feature 1..126: note = hypo
  source 1..126: mol_type = genomic DNA
agccaggcagaggcccgggtggccggctgtggacctgcggctgccctggtgcagcgttgttctggtccccgagtcgcttggctcctgcctcccgaatcccggacgccgccgcgtgtgctctgaggc

SEQ ID NO: 79762 - DNA, 34 bp, Homo sapiens
  misc_feature 1..34: note = chr16:88898821-88898855
  misc_feature 1..34: note = hypo
  source 1..34: mol_type = genomic DNA
ccgactggtgcttcccgaacgtgaatgttcacaa

SEQ ID NO: 79763 - DNA, 91 bp, Homo sapiens; identical to SEQ ID NO: 44857
  misc_feature 1..91: note = chr16:88931237-88931328
  misc_feature 1..91: note = hypo
  source 1..91: mol_type = genomic DNA

SEQ ID NO: 79764 - DNA, 47 bp, Homo sapiens
  misc_feature 1..47: note = chr16:88933367-88933414
  misc_feature 1..47: note = hypo
  source 1..47: mol_type = genomic DNA
cactgcatgaacactcgatctaagtgggaacacgggagtggtttctt

SEQ ID NO: 79765 - DNA, 30 bp, Homo sapiens
  misc_feature 1..30: note = chr16:88934321-88934351
  misc_feature 1..30: note = hypo
  source 1..30: mol_type = genomic DNA
ctcctacccccaggccgaggccatcctctc

SEQ ID NO: 79766 - DNA, 204 bp, Homo sapiens
  misc_feature 1..204: note = chr16:88935284-88935488
  misc_feature 1..204: note = hypo
  source 1..204: mol_type = genomic DNA
gttcgcattcgcctccggtgagcggagggtaacgttagctctgtcctttgtcccatacctgggaagataagctgctagatcacactatctgggtgggatccagcagaactgtttcagagccaagatcttgggacccacaaggaatttccctgtaagcgcgatgcgaggaggcacaggcttcttcatcttcgtggctgtccaatt

SEQ ID NO: 79767 - DNA, 220 bp, Homo sapiens
  misc_feature 1..220: note = chr16:88941005-88941225
  misc_feature 1..220: note = hypo
  source 1..220: mol_type = genomic DNA
gaatggaggtggtgccggggccagggcaatgtctggaggacagactcgatctatcttgactttcagaacgaggtttctgttgtcagacttggttccagacggtacctgaccggtggtgacccgacaggatccatccttatgatgctcaaagaatgaatttttaccaccgtgaaagaaccaccagcaggcaaaccgctcctcccctcggggccactgttcg

SEQ ID NO: 79768 - DNA, 126 bp, Homo sapiens
  misc_feature 1..126: note = chr16:88941444-88941570
  misc_feature 1..126: note = hypo
  source 1..126: mol_type = genomic DNA
aactcctgatagccacgcacacagatgccaggccacgggccacgccacgcgcacagatgccaggccacgggccacgccacacacacagatgccaggccacgggccacgccacgcacacagatgcca

SEQ ID NO: 79769 - DNA, 203 bp, Homo sapiens
  misc_feature 1..203: note = chr16:88941957-88942160
  misc_feature 1..203: note = hypo
  source 1..203: mol_type = genomic DNA
gtagctgcggtggggcgatggggccgagaggttggagttggggcgatggggctgagagaggtcggagctggggtgagggggccgagagaggtcggagggcgcggagaggagagaggtagaggaggacgggctggccgagaagcagtgtttcagggaggcctgctggctccgcatgctcgaaaagcagtcgagaatcaacccaa

SEQ ID NO: 79770 - DNA, 178 bp, Homo sapiens
  misc_feature 1..178: note = chr16:88943054-88943232
  misc_feature 1..178: note = hypo
  source 1..178: mol_type = genomic DNA
tgggcagagccgccgcgcctgcggcatctgctctgctgtctaaagctcagtcgaggcttctgaggatgcttgaagagacgttgtcaggaggtctccgcgcggaatcattaggtagctgaggcaggtgcactgaatgcggttttgttggttctgtgtcttctttcggagaggggcagta

SEQ ID NO: 79771 - DNA, 615 bp, Homo sapiens
  misc_feature 1..615: note = chr16:88943442-88944057
  misc_feature 1..615: note = hypo
  source 1..615: mol_type = genomic DNA
ccgcagagccggcttcgctggggctggcagcacccacaggcagggaggggcccaggctgtgggcggcttcgggcggtccaggcaccgggtcggccaccacggctgtggggccctgcaggctctggccacacacgtggtgatgcttctcccagtcccgatgctggcagaaggacccgcagtagcgtgccgcgttgcagccgctgcacgtctcactggctttccgcccgcagttccagcagctctgggtgggggcagaggggccagtcagggctgggtctggccacccgaatccccaacacacgcctcaaccaagccattcagacccagccacgtcatcaccaggtgagaagagagaaactccaaagccccacagccctcgggccatgctccagatacagccactcactgggccattttgcgggacggcatcccactaccgtgtctcacgctccagcccacccagataggtctgcgctgtgctaactggacaacgacccctgcctcctctccaggaagccctcctgagctcaccaggctccaaaaccgcaaaaccaaagggcgtggccccggcaggattgaggctgctgagatctcaccatccgcctctgctgcatc

SEQ ID NO: 79772 - DNA, 30 bp, Homo sapiens
  misc_feature 1..30: note = chr16:88944446-88944476
  misc_feature 1..30: note = hypo
  source 1..30: mol_type = genomic DNA
gccaggcacagtccccgctccaggccctgg

SEQ ID NO: 79773 - DNA, 94 bp, Homo sapiens
  misc_feature 1..94: note = chr16:88944924-88945018
  misc_feature 1..94: note = hypo
  source 1..94: mol_type = genomic DNA
tgcctcccaggtgcacgggcacaagcatcgtaattctcaggcctgccgtgtgcaccgggagggagccgggcgcctcggacgccacctggggccc

SEQ ID NO: 79774 - DNA, 711 bp, Homo sapiens
  misc_feature 1..711: note = chr16:88945368-88946079
  misc_feature 1..711: note = hypo
  source 1..711: mol_type = genomic DNA
cagccaacctgggctcgagtcctggccccaccgcttcccaaggccgtgacctcagacaagctgccaaccctctcgagccctcagtttctggaactacagaacggggacatccataggacgcctcactgaaccatgtgggatctctgtgctgataaagcacagtgtgggcggggatggcgtgcctgctgcaggatgcccgtgacaactgtgctgatgccacgtggaggctcagaatcctcatgggggtggcgtgggaccgcacgggagccgaggcaggggatgggtgtcagcgtggccgggtggccctacctcgctggagtcctcctgctggttgatgaccgtcagggcgtcctcggaggcctgccgcttcgcctcggccagggcccgctccatcttggcacgctccgtggtgatgagctcgtgcgctttgcgctccgcgtccgacacggctttctgcagctccgacatggcctgccgcttcacctcattcacggcctcttctgcaaaggacatgggcagggctggcggtcacatgggccatcccagatgggtctctggacttcctacgcgtggccacaacctggggacaggggctgtgtgcagctgaacacacgtaccatctgtgcacacaaaggcacatgttgatggggctgtaggcagctgaacacacgtagcatctgtgcacacacagacacacgttgatggccctca

SEQ ID NO: 79775 - DNA, 445 bp, Homo sapiens
  misc_feature 1..445: note = chr16:88948324-88948769
  misc_feature 1..445: note = hypo
  source 1..445: mol_type = genomic DNA
tgaggagcccagttccgggccgtccccgaacacgtcctgcctcaaagaggcctcggcactgcttttgcccacacttcttgcaagactcaggatagactctgggaagagccagtgagcagaaagtaagtggagggaagcaaggcccgccatgagggttttaggaatcctcctccctgggcctctcgagatgcctgggctgcgctgacagctgggaggaggggggctcaggtgaaggacccagccgctgcgcagggacggcgcaggccacacaggagggcactgagctcaggggcgcccacacagccctgctgtctccagcagccccaggccccatggggcagagccatggccgtgtttatgcataggcatacaggtgtggctgtgtggggacatggctgtgtgggtgtagctgtgtgtgggcatggctgtgcgtgggtgtggctgt

SEQ ID NO: 79776 - DNA, 30 bp, Homo sapiens
  misc_feature 1..30: note = chr16:88951851-88951881
  misc_feature 1..30: note = hypo
  source 1..30: mol_type = genomic DNA
tctctgcccctctgccggggcccatgccag

SEQ ID NO: 79777 - DNA, 624 bp, Homo sapiens
  misc_feature 1..624: note = chr16:88952174-88952798
  misc_feature 1..624: note = hypo
  source 1..624: mol_type = genomic DNA
gcccactggggtgtccgcccgtgcagccaccaagcctgctggccctagtacacctcgccacgctccctcagcccgagagagccggccgggctggctgcagccccagaggaggttccctctcttacccagaggggagcagggtgagccgcgtgtccacggcacccccagcccagatccccggagcccacaggtacctgtcgggcgtcctcctcttgccgttctcgttgacttccagtagcagctctgaggagtcgatgggggaggaggcgctggcgtccagcaggagctgctcatgctgggccaagtactgggcgggcgtctgcttggccaggcgtgcacagtgcaggagctcccgctgcagcaagggcaggtttgcctgtggggtggggaaggagggcctgggtagcatgcaggggtgcacagccctgctcaggtccgagcagagggggcctgggctgggtggccgaaagctcaacttgacctcgggcctcaaaggtcaaggtgctcgacctctctgggcctcaagttccttcctagcagtgccatgggagggtggcgtgggagggtgggcacagagcttcgcaggagtgcctcacctgggccacacggcgatgtggggcatgt

SEQ ID NO: 79778 - DNA, 179 bp, Homo sapiens; identical to SEQ ID NO: 44867
  misc_feature 1..179: note = chr16:88955189-88955368
  misc_feature 1..179: note = hypo
  source 1..179: mol_type = genomic DNA

SEQ ID NO: 79779 - DNA, 619 bp, Homo sapiens
  misc_feature 1..619: note = chr16:88956093-88956712
  misc_feature 1..619: note = hypo
  source 1..619: mol_type = genomic DNA
ctcctcctccagggacgacaccccgcgattcctcctcctccagggacacttcaaatccctggacgacgccccgcgattcctcctcctccagggacgacgccacgcgattcctcctcctccagggacacttcaaatccctggacgatgccccgcgattcctcctcctccagggacacttcaaatccctggacgacgccccgcgattcctcctccttcagggacgacgccccgcgattcctcctcctccagggacgacgccgtgcgattcctcctcctccagggacgacgccccgtgattcctcctcctccaggggacgtttcaaatccctggacgatgccccgcgattcctcctcctccaggggacgtttcaaatccctggacgatgccccgcgattcctcctcctccaggggacgtttcaaatccctggacgatgccccgcgtgaatctagaacatgcctcacctccctgtagtccccgctacctgggaggctgaggtggaagattcccctgagcccgggagtgaggccccgttctttccgcgtgtccctccacgctgtctcctcaacagcctgaggatgattccattttgcagatacagaaaccgaagcacagaggaa

SEQ ID NO: 79780 - DNA, 622 bp, Homo sapiens; identical to SEQ ID NO: 44870
  misc_feature 1..622: note = chr16:88957373-88957995
  misc_feature 1..622: note = hypo
  source 1..622: mol_type = genomic DNA

SEQ ID NO: 79781 - DNA, 184 bp, Homo sapiens
  misc_feature 1..184: note = chr16:88958295-88958479
  misc_feature 1..184: note = hypo
  source 1..184: mol_type = genomic DNA
gaagggaatgacaaacggccgcagagggaagttggtggcctcctgaagcttggaatgaaactcctcgatcgtcaatgtcgagttctgcaggggagaaaacccacctcacatcagcaccgctcggcatgtgagccagcgccgacccacccatgcctgaggaggaggcttccgtgttggaggcagg

SEQ ID NO: 79782 - DNA, 81 bp, Homo sapiens
  misc_feature 1..81: note = chr16:88958818-88958899
  misc_feature 1..81: note = hypo
  source 1..81: mol_type = genomic DNA
ggccattgctgaagccgttgggtgtgcacggtgcaccattgatggctgttggtgagtggctgctgccgttcatcactgcag

SEQ ID NO: 79783 - DNA, 111 bp, Homo sapiens
  misc_feature 1..111: note = chr16:88960414-88960525
  misc_feature 1..111: note = hypo
  source 1..111: mol_type = genomic DNA
ggaggactgaagccccgcacacactcacggctggctcccgcctcctgcagaaggacacgctccctacaaagggtaccaactcccctgccctcagagcgagccctccatttc

SEQ ID NO: 79784 - DNA, 30 bp, Homo sapiens
  misc_feature 1..30: note = chr16:88961870-88961900
  misc_feature 1..30: note = hypo
  source 1..30: mol_type = genomic DNA
tgggctccgaggaaccgaagacacacagca

SEQ ID NO: 79785 - DNA, 347 bp, Homo sapiens
  misc_feature 1..347: note = chr16:88962615-88962962
  misc_feature 1..347: note = hypo
  source 1..347: mol_type = genomic DNA
ctcagactttccctacgggggggctgcaggattgagacatctctgttgctggggccgcgaacctccacacgctgttctgagcggctgctcccctcaaccgggcaacctgcacagggggtagcctgtctgcgcccctggcttgaacgatcttagcagcgccttcctgggctcaggatggacgcaccggccctctggagcgcgcggcaccgataacggcgtcgtattctggggctttccctcttctggggggacagtggacgctgacacaggatgcaccgagcccctggtctctcgccttctgagcctctgtccggaggaccccaccgcgctgccgagtttccctctca

SEQ ID NO: 79786 - DNA, 586 bp, Homo sapiens
  misc_feature 1..586: note = chr16:88963177-88963763
  misc_feature 1..586: note = hypo
  source 1..586: mol_type = genomic DNA
ggggcccctgcccaccgccccggccagcctgggcctggccctcccttaggtgcgcttaccagccttgccccgggtgcctggtccttccggcggcctgctcgccctcgcctgcccgcgcactccctcccgcgctgctgggcagtctcagcagctaaagagacgccaaaaataaccccggcacaagcgctttcattcccacgacaggtgtgttcctaagttagaccgcacacgtgtccccagctgaggattgggggcacacgcgagcacccccgcggctcccccagcctcagagccttggtgggggggtcagatgcgacagaggcaccctaacgcagcccctcctgtcacccctgctccttgctgtgggggctccgggatctgggattcaccaactttgccatccataagatcacagagtggatgacaagagccactgtccaggagctgcacgccaggcgcgagtgcgtggccaggcccatcacagaataatggctgtgaaaaggacagccctgtgcaacagaaacaacgcacagttgttctgctgccctcgttcttagagccgggagtgccacgacagccacacctg

SEQ ID NO: 79787 - DNA, 105 bp, Homo sapiens
  misc_feature 1..105: note = chr16:88964508-88964613
  misc_feature 1..105: note = hypo
  source 1..105: mol_type = genomic DNA
aagcagccatgaaaacggccgtggggcagcgtcgcaggcccgtcctctcgatctgtaagcaaaataagaagaacacgctgtcaggaggggcgtgggcaggagact

SEQ ID NO: 79788 - DNA, 51 bp, Homo sapiens
  misc_feature 1..51: note = chr16:88965028-88965079
  misc_feature 1..51: note = hypo
  source 1..51: mol_type = genomic DNA
ctcagggacctgggccgaagccgcgtgtcctaaaagcgacctgagactcgg

SEQ ID NO: 79789 - DNA, 45 bp, Homo sapiens
  misc_feature 1..45: note = chr16:88965602-88965647
  misc_feature 1..45: note = hypo
  source 1..45: mol_type = genomic DNA
tcagaggccagtccccggggaggagcctcccggcagggctctgca

SEQ ID NO: 79790 - DNA, 728 bp, Homo sapiens
  misc_feature 1..728: note = chr16:88966234-88966962
  misc_feature 1..728: note = hypo
  source 1..728: mol_type = genomic DNA
gagcgtttcctcccccggggctggggtatactgcaaatttaacacagcagcggtctccctctacctatgtgggctcggtgtggtcgcaagctgcctggtagagagacggcccgtggtttgtaccagaccggagggctcttccgaagagagggaagggtgatcccagcccggccacatcgccgtgtgacaaggacatgtgagaaaaagcccagccagcctctcactagaaaccgtggccagctccgcagagccaggacctgcacgctgggcccgccgtcccccaggacctgcaaaatcgtgagtgcggcgtcccgactctctgaggcagggccggccccgcgggtgcagggagtagccgttaggctgtttggctcctactgagtgccgggcacatttccagctgtacctgcctctgggcggcacacctgggggcaccccattgctgggccaccccattccccaaccaagtcgggaggctgactcggagccaacatcctacaaacagggccgcaaatctgctgcctgaccgcacagccagtgctctctccagatggaggggagatgatggccaaagccctcggcggagcaggcccccagcctcagcggcagagccagggagggagccaggcctggcctatagccacccggtgctctgaggacagtcgtgacgtaaagggactgaggaagcagctctttctggcccgtcagggacccggggcaagcaggac

SEQ ID NO: 79791 - DNA, 1111 bp, Homo sapiens
  misc_feature 1..1111: note = chr16:88967701-88968812
  misc_feature 1..1111: note = hypo
  source 1..1111: mol_type = genomic DNA
ggcaaggacatgacccggagctacccagtgggaagcagggaagctgggatttgaaccggccaagcctgggctctgggccacacgagctcctcacactcagggctcacagaaggtgcccgctggctccgggcaggaagctcagaatttcaaacaacacaagggcctcccctgaaacacctggccctcggctgccaggtgggggctacttacgtgtgtgtggcgtgaaggagggggggcgtgtggccccctgggatgcggcaggcggtgggggcggcatgctggggggtgtggaccggggctgcgtcttcacctccgctggggagtccggcatcgctgaggccttagctttcctgtccactggggctgcgaccaacggagaaagaaagagtcggtgaagcaggctaagtgcaaaggccagggcccgcagccccacggttcccagcgaaggccccactgagtgtccgcccagcgctggggcagtctgccccaggtgtcctgacaggtggctgacgtcccacgtgcaggatcacgggggcagaaccaggccggaggacgggcttgggccagctcatctgaggtggccggccaggctggagctggggccctcggtgtgtggccgccctgcgagagccgtgccccactccaggcttgaggcttctacagaccagggagtgggcagtgccccgaggcagcggtgccttgctcccacctccatgagcatcccccggggggtgttcagacagacctcagcctcttcccccagtcctgattcagcaggtcaggctgagacccagaatttgcatttccggcatgttcccaggtggcgctgctgctggtctggccctggaagccatggttctaagagtcccttccactttcagatgctagaaggctcccctgggctggggggcgggggacggtgtctgcccagggagaggccggcaggcaggccatttagggcggcaaaacctctattttaaccgtcttctgccccggtgattcacaggacagccaagacagaggcggcattgacttcaggatggccgaggcctggctgcgctgggcgcagcccccggcaggtggtaacgccaggacacgtgattaatgagaa

SEQ ID NO: 79792 - DNA, 93 bp, Homo sapiens
  misc_feature 1..93: note = chr16:88970441-88970534
  misc_feature 1..93: note = hypo
  source 1..93: mol_type = genomic DNA
tgggccgtcatgccacggcgcaaggagtcaccacagccgtcacccaacaagggctcatggccaccacctgcgtgctcacggccaccacctgcg

SEQ ID NO: 79793 - DNA, 131 bp, Homo sapiens
  misc_feature 1..131: note = chr16:88976603-88976734
  misc_feature 1..131: note = hypo
  source 1..131: mol_type = genomic DNA
cttccaccaggtccccgcaagtctgcctctcatcctcacacctttgctgcaggctgcctccttcccggtgatgctgcagcccgcgcggcccttcaccctggctcccctcctgtcaccggctctccctgtag

SEQ ID NO: 79794 - DNA, 204 bp, Homo sapiens
  misc_feature 1..204: note = chr16:88977918-88978122
  misc_feature 1..204: note = hypo
  source 1..204: mol_type = genomic DNA
ggggcagggagggaacgggaacctcaggcgccctctccctgcaggaacggagttggcttttccgtctcctaatctggcctcagttttctcatctgtaaaatgggaatggggatggaattcccgcagaatcacggagggacgaagtacatgagctcacgaaaagcgtctagaacagagcgcctggccgctcgccctggccaccca

SEQ ID NO: 79795 - DNA, 50 bp, Homo sapiens
  misc_feature 1..50: note = chr16:88978924-88978974
  misc_feature 1..50: note = hypo
  source 1..50: mol_type = genomic DNA
gaagccttccctgaccgcccatgtccctgcccccacgctctctgccccat

SEQ ID NO: 79796 - DNA, 30 bp, Homo sapiens; identical to SEQ ID NO: 44881
  misc_feature 1..30: note = chr16:88980132-88980162
  misc_feature 1..30: note = hypo
  source 1..30: mol_type = genomic DNA

SEQ ID NO: 79797 - DNA, 44 bp, Homo sapiens
  misc_feature 1..44: note = chr16:88990078-88990122
  misc_feature 1..44: note = hypo
  source 1..44: mol_type = genomic DNA
gcatcctccgcaacccggctcacacatgtcgctcctgctgtcag

SEQ ID NO: 79798 - DNA, 30 bp, Homo sapiens
  misc_feature 1..30: note = chr16:88990804-88990834
  misc_feature 1..30: note = hypo
  source 1..30: mol_type = genomic DNA
aaaaggagagggacccggggtccaggaagg

SEQ ID NO: 79799 - DNA, 30 bp, Homo sapiens
  misc_feature 1..30: note = chr16:88992350-88992380
  misc_feature 1..30: note = hypo
  source 1..30: mol_type = genomic DNA
aggaccagaaagacacggctgtcctgtctc

SEQ ID NO: 79800 - DNA, 152 bp, Homo sapiens
  misc_feature 1..152: note = chr16:88993078-88993230
  misc_feature 1..152: note = hypo
  source 1..152: mol_type = genomic DNA
agctggccatggtcccgtgcgtgccagggtggggcctgctgagcctcagtttcctcggctgtaagacgggacggaggtgttcacagtgggggttgctgggaattcctcctctggattgggctggtgcctcggtgcaccgtgggctcccagga

SEQ ID NO: 79801 - DNA, 380 bp, Homo sapiens
  misc_feature 1..380: note = chr16:88994340-88994720
  misc_feature 1..380: note = hypo
  source 1..380: mol_type = genomic DNA
ctgcccagtgtggggcgtcctctgaagtgggagccgcagggagggcctcacggaggcctctgtccacaggcagcggctcccggcacccaccgctgctgaccgagcccctggcacccccaagccgagcctttgaaccccagcagggaaggccacctggccgagaccctggccaccacggggccatcactgtcccacggggctctgttccgactccttggcccgagggtctctgagcaccaccagggttgcctcacgcctctgagtttggggtggtttgttcggcagcactggggcccggggcagcttcttgcccggcgtgtggcacagctgtccttgttgggggcgtttctgggatcctgtggtttcggggacgctcccct

SEQ ID NO: 79802 - DNA, 71 bp, Homo sapiens
  misc_feature 1..71: note = chr16:88997925-88997996
  misc_feature 1..71: note = hypo
  source 1..71: mol_type = genomic DNA
agaagggccgtgggccggccccgtggacgagccagaggtggagaagggccgtgggccggccccgtggatga

SEQ ID NO: 79803 - DNA, 84 bp, Homo sapiens
  misc_feature 1..84: note = chr16:88999377-88999461
  misc_feature 1..84: note = hypo
  source 1..84: mol_type = genomic DNA
gggaaaaaaagaaagaaagaaaagaaaaatggcctcttgggccaggtcctgggagctcgagggaggtgacggcatggagccagg

SEQ ID NO: 79804 - DNA, 29 bp, Homo sapiens
  misc_feature 1..29: note = chr16:88999664-88999693
  misc_feature 1..29: note = hypo
  source 1..29: mol_type = genomic DNA
cctcacagtgccacacgtctgcacgcctc

SEQ ID NO: 79805 - DNA, 136 bp, Homo sapiens
  misc_feature 1..136: note = chr16:89000126-89000262
  misc_feature 1..136: note = hypo
  source 1..136: mol_type = genomic DNA
cacgcctctgcacacgtcacgtgcctctatacgcctcacacgcctcacagtgccacacgtctgcgtccccacagccatagtggccacttcatgccacgcgtatgtgacttggtgaaatccccgtccctctgctctg

SEQ ID NO: 79806 - DNA, 199 bp, Homo sapiens
  misc_feature 1..199: note = chr16:89000985-89001184
  misc_feature 1..199: note = hypo
  source 1..199: mol_type = genomic DNA
ggacagatggggacacggaggcccagaggagcggagaggagtctggcctcgctgcctgcctattcttgctgttggcagggcctggtaaaggaggcagagatgccacgaaagaggcacgaagggccgtgccctgccctcttccacccccgaagttcagaaggacgcattctttttttctcggagacggagtctcgctctg

SEQ ID NO: 79807 - DNA, 249 bp, Homo sapiens
  misc_feature 1..249: note = chr16:89006347-89006596
  misc_feature 1..249: note = hyper
  source 1..249: mol_type = genomic DNA
cccgccccttatccccggccgacccgtccgccgaggtggctgccctgggaacctcctgttcctcgtccaggagaggaaacgcacacccgggccggacgcacagaagccgcaccctggctggggccacaagcctgacagctaccgacaagcccccacccacaggagcacgcgacgtgctctcttttcaagggaaaggtttttcttcctgggccctggaatgggcctgaagtcagccggcctcagcccaca

SEQ ID NO: 79808 - DNA, 90 bp, Homo sapiens
  misc_feature 1..90: note = chr16:89006819-89006909
  misc_feature 1..90: note = hyper
  source 1..90: mol_type = genomic DNA
tcccacagcctggctcggggcctgcccaacacagatggacgcttcccaaaggctgtgcgcgccatcgctgccacccggctgtgccgaggc

SEQ ID NO: 79809 - DNA, 481 bp, Homo sapiens
  misc_feature 1..481: note = chr16:89007308-89007789
  misc_feature 1..481: note = hyper
  source 1..481: mol_type = genomic DNA
caccaactttgaaaacggcccgtgcgctcggcgcggctgcggcgcagatccgggaacggcagccgcgggcggagtcggggtagagcggcggcggcgcgcggggcggacacggcacttacggtcggggggtccgggggatccggcgggcggcggacggcgcacactcgcgactcggtccgggagtcgctgctccttccagcttggtccccgcctccacgactcaggggcggctgcgcgctgtcttctggcgccgcaccgggctcaggcgcgcggcggggctggggcgcgcggggcggccgcctgggccatgccggggactcggctccggccaccccgcgcgggaacaaagcgcgcaccccgcccggggcggtctccggcctccgcggcccgcgccgggtccagccgccgcgcctgtggctccaacgccgcgcgctcgcccgagagtctcacggggccccgcggcccccgccccgcgcgctcc

SEQ ID NO: 79810 - DNA, 224 bp, Homo sapiens
  misc_feature 1..224: note = chr16:89008368-89008592
  misc_feature 1..224: note = hyper
  source 1..224: mol_type = genomic DNA
gcccggggccacctccgtgcgtggccggcaggggtcgcgctccccccgctcagcctcccgggcgggtccgatgcgaagccctcgcttcccgcgggtcccggggccaggtcatttgcatacactttgcattcatttgcatatcgtgcgtttcatgtccacctgcagaaacgccccgagccgctgctctgccctctccgcactttctctgccggcaggccccctcc

SEQ ID NO: 79811 - DNA, 196 bp, Homo sapiens
  misc_feature 1..196: note = chr16:89010286-89010482
  misc_feature 1..196: note = hypo
  source 1..196: mol_type = genomic DNA
ccagcgtcacctgtgcgggagacagaccacgggcgagcaggacctcggagggccacactcagggctcgggagggggcagagccgtggaggagggagctcgagggtgtgcccatggagctcccagtgtgtcgctgtctgtagaggcaggagctcaattcacttaaaagaaaccaccacggccgggtgcggtgggtca

SEQ ID NO: 79812 - DNA, 41 bp, Homo sapiens
  misc_feature 1..41: note = chr16:89015672-89015713
  misc_feature 1..41: note = hypo
  source 1..41: mol_type = genomic DNA
gatgggttgggaggccgggcgcggcgcctcacacctgtaat

SEQ ID NO: 79813 - DNA, 30 bp, Homo sapiens
  misc_feature 1..30: note = chr16:89016452-89016482
  misc_feature 1..30: note = hypo
  source 1..30: mol_type = genomic DNA
actctcgaagtcacacggcttccctgcttc

SEQ ID NO: 79814 - DNA, 30 bp, Homo sapiens
  misc_feature 1..30: note = chr16:89022691-89022721
  misc_feature 1..30: note = hypo
  source 1..30: mol_type = genomic DNA
agaaccccacgcacacggagctcatggcct

SEQ ID NO: 79815 - DNA, 412 bp, Homo sapiens
  misc_feature 1..412: note = chr16:89025720-89026132
  misc_feature 1..412: note = hypo
  source 1..412: mol_type = genomic DNA
agaggggtctccttgcgggagagagttgaagtagtcctggcgatgatggtgggctcccaggagaggtggagggaacacgcatgcacgcccagggctggaggcacgtgggtgttcagggcctgtgaggaggcccgggcaccaaggcagcacccagcgcttacagagcctgcaggtcttggacagaggtgcaggcagaggcaggaggtggcatgggtcataccacctgtaaaagccaggcgcagtagagaatgttctagaaataaatgtgatgctgcgattgcctgagagggaacccaggtgcaggagagggaaggtcccggggaaaccctccttttcctcctccttcctcccagcagctgggaaaggcgatggagagaaaacgggagcagggcagagacggtatctgggatta

SEQ ID NO: 79816 - DNA, 114 bp, Homo sapiens
  misc_feature 1..114: note = chr16:89028699-89028813
  misc_feature 1..114: note = hypo
  source 1..114: mol_type = genomic DNA
tttccactgcatactcgtacttttttacttttacaaaagcatcaattgccaatggatatttattttccacaaataacatgagacgccatgaaccagcctcgaaggtgaatgcac

SEQ ID NO: 79817 - DNA, 81 bp, Homo sapiens
  misc_feature 1..81: note = chr16:89029708-89029789
  misc_feature 1..81: note = hypo
  source 1..81: mol_type = genomic DNA
atcttctgccaggggcgggcgctcatcttctgccaggcttttttttttttttaagaatgttaagatcttttaaaaatttgt

SEQ ID NO: 79818 - DNA, 201 bp, Homo sapiens
  misc_feature 1..201: note = chr16:89029849-89030050
  misc_feature 1..201: note = hypo
  source 1..201: mol_type = genomic DNA
ttagtacactgacaacgttctgcaaccagcgcctccacctaactccagagcacatcatcaacctcgcagtgaatcccggccccaggagctgtcactgtcttctccacaccctccccatggtgaccccaaatccactctgtctctgtggatttgttatcgtggacattccataaaatgggaccagaccgtatgcggcctctt

SEQ ID NO: 79819 - DNA, 163 bp, Homo sapiens
  misc_feature 1..163: note = chr16:89047584-89047747
  misc_feature 1..163: note = hypo
  source 1..163: mol_type = genomic DNA
gaacagtgtcatgtacggaggagccttgccccggctttctggtcctgaataaggtgtggacagttggggtgagccacagagggagtgggggccgggggtggaggcaggaaaaaacctgccccgggtgttcaaggcagtgcaggtgaagcggctcatagctgga

SEQ ID NO: 79820 - DNA, 601 bp, Homo sapiens
  misc_feature 1..601: note = chr16:89055344-89055945
  misc_feature 1..601: note = hypo
  source 1..601: mol_type = genomic DNA
tccttcccacccactcggctccacgcagggcaacgggagctcctggctcccagcaatccccttcccacccactcagtgtctcgtgcatggcacacacgtgtcctgcgggcccgctgggagctggctgctggtccctgtacgaggctgggggtctgacctcaccaccagggacagacagcaaagcagaccatgagacaggggagcaaagccgtgcggtgggaggggtgaggcgtgcggcatgactgcagggcggggagggcctcaaggggagaggcaactcggggcagcccgcatggcccaggcgtgggtcaagctctgggaggcacgctccccgcaggaccagccgcacgtgcaaagctcctcctgcccccagccccggccagcatctcggagccactgcggattcagtcgtggggtccctggaaggcaaggccttccctaatctgggcaccggggcctcccaggtggcgacgacagactcccaggctggcttgaggcaaaaacacggcgcgctgggacgtatttggatgtaaatgttttcagcacagagcagctgggagatgcggcctccgtgggagctgggagccggggccatatggcc

SEQ ID NO: 79821 - DNA, 364 bp, Homo sapiens
  misc_feature 1..364: note = chr16:89072463-89072827
  misc_feature 1..364: note = hypo
  source 1..364: mol_type = genomic DNA
cttgagcaaaggcttcgaggtggaggttttaggtgggtgaggagcagaaggccaacgcgggtggctgaggagagggcaaggaagaagaggcaggagtccaccgccagtgccaaccaggggcctcggggcaccgctccaggagcaaccccagagtgcatccacctcctcccgggtgggccacgccttgaggtgctgacggcgccccaaactccactccccggaatcggcccaggctcagccacatcggcccgggctcctacagaagccgacctggagacgaggaactgacctggagacgaggaactgacctggagacaaggaactgactgcaagtggaccatttgcagggcgaccccaagggcag

SEQ ID NO: 79822 - DNA, 192 bp, Homo sapiens
  misc_feature 1..192: note = chr16:89084022-89084214
  misc_feature 1..192: note = hypo
  source 1..192: mol_type = genomic DNA
tgaggaggtggccttcgggggagggtgaatgcccttcggggggcagttagggcaggaggctggggtccccccgatgggatcagtgccctcaccaaagaggccaagggagacccctgggagtgcacagagtgaaggcgtcacccacagccaggaagagggccctccccgccccgtcctcggacgctgatggca

SEQ ID NO: 79823 - DNA, 116 bp, Homo sapiens
  misc_feature 1..116: note = chr16:89086081-89086197
  misc_feature 1..116: note = hypo
  source 1..116: mol_type = genomic DNA
ccggcaccaagggcacgggatggcagccactgggaaagcaccacggaagccgcatcggcaggttcctgctgccaccccttggtgccaggtacagggcaggacgcagaggggaagct

SEQ ID NO: 79824 - DNA, 37 bp, Homo sapiens
  misc_feature 1..37: note = chr16:89088526-89088563
  misc_feature 1..37: note = hypo
  source 1..37: mol_type = genomic DNA
attcactgcacaccccgccctccgccccttggtgaac

SEQ ID NO: 79825 - DNA, 30 bp, Homo sapiens
  misc_feature 1..30: note = chr16:89090173-89090203
  misc_feature 1..30: note = hypo
  source 1..30: mol_type = genomic DNA
ggttcccggccctcccggcccctcacccct

SEQ ID NO: 79826 - DNA, 81 bp, Homo sapiens
  misc_feature 1..81: note = chr16:89103448-89103529
  misc_feature 1..81: note = hypo
  source 1..81: mol_type = genomic DNA
gcaggcggagaggtgcgggcaggctaggggtttgctccattctcttggccgcctgaaagtcatcaacgtggcaggttctcc

SEQ ID NO: 79827 - DNA, 30 bp, Homo sapiens
  misc_feature 1..30: note = chr16:89103807-89103837
  misc_feature 1..30: note = hypo
  source 1..30: mol_type = genomic DNA
gtggcttcgacatgacgcagggtagggggg

SEQ ID NO: 79828 - DNA, 59 bp, Homo sapiens
  misc_feature 1..59: note = chr16:89104048-89104107
  misc_feature 1..59: note = hyper
  source 1..59: mol_type = genomic DNA
acacccctcctgagacgctcctggtcccgtgtgcccatgatatccgggctcaggtggcc

SEQ ID NO: 79829 - DNA, 183 bp, Homo sapiens
  misc_feature 1..183: note = chr16:89105500-89105683
  misc_feature 1..183: note = hypo
  source 1..183: mol_type = genomic DNA
atcaacaccccttcccgggaagggtggtgctcgccctgcctccttcccaaggtggaggtctgcggggcgcaggtctctgtctggggctgccatccacatacgctgtggctcatgtacagtgaccacctgctgcaggatgagacggtggcacccgccgctccctgagagcggcacttcactgca

SEQ ID NO: 79830 - DNA, 184 bp, Homo sapiens
  misc_feature 1..184: note = chr16:89107642-89107826
  misc_feature 1..184: note = hypo
  source 1..184: mol_type = genomic DNA
aggtgggagggcaaccgagtcggcctgggttcaagttctccagagtgccggccctccactcgagttcccctgccccggggaatgccctttccctacacctgcaatcccctgagggacgggaggaggccggtagtccatgagcatctgtcactggctgtgcggctctgggcgctctgggccagtt

SEQ ID NO: 79831 - DNA, 39 bp, Homo sapiens
  misc_feature 1..39: note = chr16:89108941-89108980
  misc_feature 1..39: note = hypo
  source 1..39: mol_type = genomic DNA
cctgccagggtgcagcgatgggcgcggggctggcctgcc

SEQ ID NO: 79832 - DNA, 211 bp, Homo sapiens
  misc_feature 1..211: note = chr16:89109448-89109659
  misc_feature 1..211: note = hypo
  source 1..211: mol_type = genomic DNA
gccagggagaattgacgagcagtggcgtcctggaattcccgtgaggtggcgggagaagattctatgattgatccgtcatgcctgccgtggctcaggatgggaccggcctctcaagctacagatcaagaaactgagaagggagtagcctaaagtcaccatgagagtggccaggtctgggccggcctggcctccaccccgcagagaccatctc

SEQ ID NO: 79833 - DNA, 30 bp, Homo sapiens; identical to SEQ ID NO: 44896
  misc_feature 1..30: note = chr16:89110091-89110121
  misc_feature 1..30: note = hypo
  source 1..30: mol_type = genomic DNA

SEQ ID NO: 79834 - DNA, 116 bp, Homo sapiens
  misc_feature 1..116: note = chr16:89115281-89115397
  misc_feature 1..116: note = hypo
  source 1..116: mol_type = genomic DNA
gcccagggtgagccacgcaggcgcgtggagagggcaccccatgtggggcagactcccgctcagaggggcctcgctgtggccaccacctacagaccagaacccggggccggggtctc

SEQ ID NO: 79835 - DNA, 30 bp, Homo sapiens
  misc_feature 1..30: note = chr16:89116859-89116889
  misc_feature 1..30: note = hypo
  source 1..30: mol_type = genomic DNA
ccttgcccagcagagcgggagaagcccggt

SEQ ID NO: 79836 - DNA, 943 bp, Homo sapiens
  misc_feature 1..943: note = chr16:89119921-89120864
  misc_feature 1..943: note = hypo
  source 1..943: mol_type = genomic DNA
cgggcatcggggagacgaggtgttggggacagagccggcggtcatagcctccagctcctcttcctgcatggagtgacctggcgccgcgaggtggagctggtgtccgagccctgaggatgaggctgctccctccgcaaggtgggcgaggagccaggaagagccaagggagtggccaccctgccctgacggccaccaacggccaccacgtcaccctagaagacaacccaagcccgtctccccacacctcgcggatggtgcagtgcagagagaaggccgggcgggtgctggggggcccatctccccgagccttgcaaatagtgcagtgcagggagaaggccgggcgggtgctggggggcccgtctccctgtgactcgtggacggtgcggtgcagggagaagggcgggcaggtgctggaggactgagtgaggcccctccaggatggctccctgcccctccatgcgctgggtcctcgggccaggacaggttgcatctgggtcaccagccccctcacacccgctcgcctgaaggcggccgaccctggccactggtcgcctggtggcagaagcctcttctgggcattttcaggcaccgcaatgctcttcacagcgttaactttttttttatccaaccaaggacaacctcagcttcagaaagccctggaatgccccacaatggacaagcaaggaacaccctccgggacggaccgcgagactcggccctgagatgcctcaataccctggacaccccagaacctcagattgcgtggctggggctcctgcggccaccctgctccccagaacctcgtcgtcttcccggtgccctgcggcaggaacacagggctggagccgacccccagggcatggctgggagctgcgggagtgaacggggagttaacccccagggcatggctgggagctgcgggagtgaacggggagctgcctgt

SEQ ID NO: 79837 - DNA, 30 bp, Homo sapiens
  misc_feature 1..30: note = chr16:89121266-89121296
  misc_feature 1..30: note = hypo
  source 1..30: mol_type = genomic DNA
ttccctcagcctggacgctcctcctgcatg

SEQ ID NO: 79838 - DNA, 50 bp, Homo sapiens
  misc_feature 1..50: note = chr16:89122497-89122547
  misc_feature 1..50: note = hypo
  source 1..50: mol_type = genomic DNA
gcacgtgggagagtgcgccacccgtgtgtgtggtccgtgagcatccacca

SEQ ID NO: 79839 - DNA, 30 bp, Homo sapiens
  misc_feature 1..30: note = chr16:89131236-89131266
  misc_feature 1..30: note = hypo
  source 1..30: mol_type = genomic DNA
gctgcagggatttgccgggagagcccgggg

SEQ ID NO: 79840 - DNA, 192 bp, Homo sapiens
  misc_feature 1..192: note = chr16:89134608-89134800
  misc_feature 1..192: note = hypo
  source 1..192: mol_type = genomic DNA
ggctctgagaggggtcggtggcctctgtctcaactcagctcgctcagcggccctgggaagccaggggaggttctggagccaagctccagccagacccatcccatcagcattgctgcagctccccaagggctctgctgcgtgcttggaagtgaaaattgctgatggagggggtgggtccgacgagaagagagg

SEQ ID NO: 79841 - DNA, 152 bp, Homo sapiens
  misc_feature 1..152: note = chr16:89138016-89138168
  misc_feature 1..152: note = hypo
  source 1..152: mol_type = genomic DNA
gaggaaagacagacacggcgttggctgcgcgggggcctgcatccctcccgaccttctcatttgatcctcctgccctatgcggttggtgccaacgttcatcccattttacagatgagtaaactcagcttcagtgaggccggggccttcctgga

SEQ ID NO: 79842 - DNA, 43 bp, Homo sapiens
  misc_feature 1..43: note = chr16:89139238-89139281
  misc_feature 1..43: note = hypo
  source 1..43: mol_type = genomic DNA
gggctgctgggaggacgagtaagaaaagcgggtgaagcacaga

SEQ ID NO: 79843 - DNA, 25 bp, Homo sapiens
  misc_feature 1..25: note = chr16:89139536-89139561
  misc_feature 1..25: note = hypo
  source 1..25: mol_type = genomic DNA
cacttacctggagtgcggtggcccc

SEQ ID NO: 79844 - DNA, 104 bp, Homo sapiens
  misc_feature 1..104: note = chr16:89139951-89140055
  misc_feature 1..104: note = hypo
  source 1..104: mol_type = genomic DNA
tgcggacccctccttcgtggcctccagcttctatttagagagggtgtgacacgctgagatctttcacacgggtggtgacgggactgaatcgagttgcaggacgc

SEQ ID NO: 79845 - DNA, 67 bp, Homo sapiens
  misc_feature 1..67: note = chr16:89140367-89140434
  misc_feature 1..67: note = hypo
  source 1..67: mol_type = genomic DNA
gagccatgtcatgaacgactcatgcatgcaccagtcacgtgaggacctgtcacgtgtggacctgtca

SEQ ID NO: 79846 - DNA, 30 bp, Homo sapiens; identical to SEQ ID NO: 44903
  misc_feature 1..30: note = chr16:89141923-89141953
  misc_feature 1..30: note = hypo
  source 1..30: mol_type = genomic DNA

SEQ ID NO: 79847 - DNA, 88 bp, Homo sapiens
  misc_feature 1..88: note = chr16:89146026-89146114
  misc_feature 1..88: note = hypo
  source 1..88: mol_type = genomic DNA
gagatctgtgccagccgcaggacatctgggaggaggtgcataaacccaacagggccaagcacagaggggcgcacgtgtgacttccttg

SEQ ID NO: 79848 - DNA, 30 bp, Homo sapiens
  misc_feature 1..30: note = chr16:89146902-89146932
  misc_feature 1..30: note = hypo
  source 1..30: mol_type = genomic DNA
tgggctcacccccatcgtgcccatgatctg

SEQ ID NO: 79849 - DNA, 30 bp, Homo sapiens
  misc_feature 1..30: note = chr16:89156566-89156596
  misc_feature 1..30: note = hypo
  source 1..30: mol_type = genomic DNA
ctcagtttcctcattcgtaaaacggcacaa

SEQ ID NO: 79850 - DNA, 194 bp, Homo sapiens
  misc_feature 1..194: note = chr16:891650-891844
  misc_feature 1..194: note = hypo
  source 1..194: mol_type = genomic DNA
ctacctaccagcccccgttatccctcgaactctcagactcacttggaccagggatggcaggatgggaccagagacctgtccactcagcacctcaggcaggtgaaggaaaaaagaaccactcctgctattgcatttcgggagactggtgccctcacgagcgtgggtggcctcgggtgccccgacctgctgccgca

SEQ ID NO: 79851 - DNA, 30 bp, Homo sapiens
  misc_feature 1..30: note = chr16:89165849-89165879
  misc_feature 1..30: note = hypo
  source 1..30: mol_type = genomic DNA
gttcaacctaaaacacgttttctagctctg

SEQ ID NO: 79852 - DNA, 402 bp, Homo sapiens; identical to SEQ ID NO: 44904
  misc_feature 1..402: note = chr16:89172134-89172536
  misc_feature 1..402: note = hypo
  source 1..402: mol_type = genomic DNA

SEQ ID NO: 79853 - DNA, 37 bp, Homo sapiens
  misc_feature 1..37: note = chr16:89184300-89184337
  misc_feature 1..37: note = hypo
  source 1..37: mol_type = genomic DNA
gacggcaggttccctcgggtgccggggatgctccctc

SEQ ID NO: 79854 - DNA, 81 bp, Homo sapiens
  misc_feature 1..81: note = chr16:89188334-89188415
  misc_feature 1..81: note = hypo
  source 1..81: mol_type = genomic DNA
gaaaggtgcagtggccgcaccttgtgtggagggccacacggcgtgtcccgcctggcctgggccccccgcagtgggctgtta

SEQ ID NO: 79855 - DNA, 224 bp, Homo sapiens
  misc_feature 1..224: note = chr16:89189759-89189983
  misc_feature 1..224: note = hypo
  source 1..224: mol_type = genomic DNA
ggactccccaccccacgctcacactcgcagacgcacttggtactttcatctgagtctcacgcagtagcccttctctccacagcatcccagaacccgagggtgcccctcactaccacggtcccggatccacgtggctcaagtgaggctgtggccgacagctgggctgtccgatccactcttgtctgtgccgaggcgtgggtcccggccagcgtccctccccagaa

SEQ ID NO: 79856 - DNA, 19 bp, Homo sapiens
  misc_feature 1..19: note = chr16:89202477-89202496
  misc_feature 1..19: note = hypo
  source 1..19: mol_type = genomic DNA
tggccggttcttgtatttt

SEQ ID NO: 79857 - DNA, 148 bp, Homo sapiens
  misc_feature 1..148: note = chr16:89203067-89203215
  misc_feature 1..148: note = hypo
  source 1..148: mol_type = genomic DNA
tcctccgggtcaggatgagaggagaggttgccagctttgatgccagccgctcctgcctcccccacctgcctctgtgcctacagcccgcttctgcctcaagatcacacagcgggcttgtgaggccaggggtctccgctgctgctcaagg

SEQ ID NO: 79858 - DNA, 30 bp, Homo sapiens
  misc_feature 1..30: note = chr16:89216656-89216686
  misc_feature 1..30: note = hypo
  source 1..30: mol_type = genomic DNA
cacagacagcagaaacgcttgcttgatcag

SEQ ID NO: 79859 - DNA, 54 bp, Homo sapiens; identical to SEQ ID NO: 44906
  misc_feature 1..54: note = chr16:89219318-89219372
  misc_feature 1..54: note = hypo
  source 1..54: mol_type = genomic DNA

SEQ ID NO: 79860 - DNA, 94 bp, Homo sapiens
  misc_feature 1..94: note = chr16:89219597-89219691
  misc_feature 1..94: note = hypo
  source 1..94: mol_type = genomic DNA
tcagtgcagcctggacgccctggaccagcccctcctgcgcctgggccacggccgctgccttcagggcatcactggtgggcggcacaaccatcct

SEQ ID NO: 79861 - DNA, 707 bp, Homo sapiens; identical to SEQ ID NO: 44907
  misc_feature 1..707: note = chr16:89220327-89221034
  misc_feature 1..707: note = hypo
  source 1..707: mol_type = genomic DNA

SEQ ID NO: 79862 - DNA, 179 bp, Homo sapiens
  misc_feature 1..179: note = chr16:89225868-89226047
  misc_feature 1..179: note = hypo
  source 1..179: mol_type = genomic DNA
ccgtctgagggtgggcggagggcgctgccgcaggtccccacatacccagcgcacgctcaccccacactggaggcacctgccgggttctgacacccctcgaggtgccttcccagggttctcacacccactgaaggcagcgcgctcagcctgctttgcacatgagccgctgaggcaggcga

SEQ ID NO: 79863 - DNA, 458 bp, Homo sapiens
  misc_feature 1..458: note = chr16:89226262-89226720
  misc_feature 1..458: note = hypo
  source 1..458: mol_type = genomic DNA
aggtgggcaaggccacggtttggccaggtaaggctgggagggcccaggatgattgtgcgttgagccaggcagatctggagaggcggagggatggggacggagcgccatgcagaggccgctcggtcctcaggagctgagcatcaccctgggagtctcaaggagggtgtcccctggccttagcgggcagccagggccagcatgtggtctgtggcagccggtctcagaggtggcctggttcgcagtcttgctggatggagatccccagctcctagggcaagggcaggtggggtggggccgcctcggtcagctgataggaactgaactgagaaggctgtgagccgctgagtcgccctaactgcagggtggtcctgcgggcagtactgagcccgccctgctgggcaccccacagcccctgtggctctccagctgccactgaggccggacgcctcatgaggagg

SEQ ID NO: 79864 - DNA, 279 bp, Homo sapiens
  misc_feature 1..279: note = chr16:89242783-89243062
  misc_feature 1..279: note = hypo
  source 1..279: mol_type = genomic DNA
ttgcagggggaggggcggcccagctggcccagctctgaccccccggttctcggtgctccatttcatggggccccaccctgcctggagcgggtgcccccttccagcggggagctgggtgaggcctcccacgcagggtcccgctcaccagggccgactcggtgctccctccgctcgcacaatgtggggagctgttctaggtgttggtgtggcgtggccggcacacctctgtagtaggcacaggacttggtgccggctggggagtcccgtgagcctccctag

SEQ ID NO: 79865 - DNA, 151 bp, Homo sapiens; identical to SEQ ID NO: 44911
  misc_feature 1..151: note = chr16:89245291-89245442
  misc_feature 1..151: note = hypo
  source 1..151: mol_type = genomic DNA

SEQ ID NO: 79866 - DNA, 143 bp, Homo sapiens
  misc_feature 1..143: note = chr16:89245643-89245786
  misc_feature 1..143: note = hypo
  source 1..143: mol_type = genomic DNA
tttgcccttgtgctacgcagccccgtgtgtggaagccgccttgcgccaatgggcaccgacccgtgggctgagggaaacactgcgccccgtggcctcctcaccacccacagctcccagctgcacgctgccgcccagggctccag

SEQ ID NO: 79867 - DNA, 156 bp, Homo sapiens
  misc_feature 1..156: note = chr16:89254608-89254764
  misc_feature 1..156: note = hypo
  source 1..156: mol_type = genomic DNA
caccatcctggaaggcgaccccgatgggcagttcaccatccgcacggaccccaagaccaacgagggtgttctgtccattgtgaaggtgagcggcccccggctggcacacagatgccggcagacgcagatgccgacacacacagatgcccacacaca

SEQ ID NO: 79868 - DNA, 603 bp, Homo sapiens
  misc_feature 1..603: note = chr16:89267222-89267825
  misc_feature 1..603: note = hyper
  source 1..603: mol_type = genomic DNA
ctagcccagcctctgcgcacctcactgatgggaagcccaccttccccagtctgtgctgaccacgtcagtccctccaagcagagactctgccttggaaagccagcccaaagccacggtctgctgaagacgctggtggtcctgaagcaaattccaggccctgctcccccaccggcgccttcggctccaatcctccagcgccccaggccgccccgcgcctggcagctcccaggcccagattcagcccccgcccggcccctctccgcgggtccggcccgtgcgcgcccgtctgcggcaccgtcgggccggcggccgccccggagcaggaagcccaggaggacggccggggggcccgggtcagaggcgccaggtaggatggagaaaggacacccagggcctcggcgggctgggggcggggagggctgcggggcagcagggacgggggcgcacctgggtgaccgggctttgcaggaggccggcgccgggcagcgcgtagagccagccgcgtgtgcagggccgggtgccgttgcgtgcgggcgcggggcgcgggcccggggcgggtgcagggcgcgggatcggggtagcgcaggagcaggcaggggctcg

SEQ ID NO: 79869 - DNA, 182 bp, Homo sapiens
  misc_feature 1..182: note = chr16:89268351-89268533
  misc_feature 1..182: note = hyper
  source 1..182: mol_type = genomic DNA
tggcaggggcgtggccgggagcgctcaggtgccctcgcggcgcaggtgcactcaggttgcccgggggcgcgcgggctccggccggcgtcccggggtggtccccgcgtggggccgggggcgtccgcgcgggcggggcgaggtcggggagggcagccgcccgccctcctcggcgctgggagctt

SEQ ID NO: 79870 - DNA, 178 bp, Homo sapiens
  misc_feature 1..178: note = chr16:89268813-89268991
  misc_feature 1..178: note = hyper
  source 1..178: mol_type = genomic DNA
ctcgcgttaacaattcgaatgggcacgtttctgcgtttcagaacgctgttcgcttcctcacacttagattgaggtggaactcacgtcacataaaccgggtcgcaaggctcagctcagcggggcccccccaacagtgttgcgggaccagcaccttctcgggctccggaacagcttctac

SEQ ID NO: 79871 - DNA, 30 bp, Homo sapiens; identical to SEQ ID NO: 44914
  misc_feature 1..30: note = chr16:89311109-89311139
  misc_feature 1..30: note = hypo
  source 1..30: mol_type = genomic DNA

SEQ ID NO: 79872 - DNA, 90 bp, Homo sapiens
  misc_feature 1..90: note = chr16:89313564-89313654
  misc_feature 1..90: note = hyper
  source 1..90: mol_type = genomic DNA
tgagagcagcctctccgcgggactggcctgtgcgcgcgcgtctgcggcaccgtcggaccaggggccgcccccgagcggggagcccaggag

SEQ ID NO: 79873 - DNA, 39 bp, Homo sapiens
  misc_feature 1..39: note = chr16:89321968-89322007
  misc_feature 1..39: note = hypo
  source 1..39: mol_type = genomic DNA
gtagaagttcagcaacgcaggcatcgcaccaggtcacac

SEQ ID NO: 79874 - DNA, 274 bp, Homo sapiens
  misc_feature 1..274: note = chr16:89323313-89323587
  misc_feature 1..274: note = hyper
  source 1..274: mol_type = genomic DNA
cgctctgtgcaaaaccgagtcgtgtgcgggcccagggtggcgctcggggcgcttccagcgcacgtcacctcatctgcgtcgtcaccactgtcgcctccgaaagcgcattccgtcgtcaaaatacaccacgaggtcccgggtgccctcaccgccctccccttcctcgccctctcgtcgttgctgttgggacgggctctcgtcgcccgcgctggggcgcagtgactcagtgtgactcaggcctcgcccgcgctcgggctcacggagcagctgggac

SEQ ID NO: 79875 - DNA, 35 bp, Homo sapiens
  misc_feature 1..35: note = chr16:89360320-89360355
  misc_feature 1..35: note = hypo
  source 1..35: mol_type = genomic DNA
caggccaggagcccacgctgcgtccccgctctgag

SEQ ID NO: 79876 - DNA, 121 bp, Homo sapiens
  misc_feature 1..121: note = chr16:89410313-89410434
  misc_feature 1..121: note = hypo
  source 1..121: mol_type = genomic DNA
ggaaactacggatcacgggctgttttgggtgtgggaaatccacccacccacactcacggccagctctgaccgactgaacccaggggcacatcacagacataaatatcggtgcaggcggcca

SEQ ID NO: 79877 - DNA, 37 bp, Homo sapiens
  misc_feature 1..37: note = chr16:894468-894505
  misc_feature 1..37: note = hypo
  source 1..37: mol_type = genomic DNA
cccggaactggaggctctcacacgccacagttagaga

SEQ ID NO: 79878 - DNA, 334 bp, Homo sapiens
  misc_feature 1..334: note = chr16:894865-895199
  misc_feature 1..334: note = hypo
  source 1..334: mol_type = genomic DNA
accccggagcctccacgtcctggtacagagcctgcctctccgggactgggcttcggccgagcagacaccgcctagctgctctttgaccagcgttctctgctctgcgtctggctggcatcggcggcttgctgagtccagcctggcatctcgctggcatcggcggctcgctgggtccagcctggcgctgacacgtttctgtgctcatttcattttacaaatcaactccccaaggtgaggtgggctcgtgccagcaggtgggagccggtcgtgcacgtctgcccagctccgtgctgagtgaggacgtgttgggggcttgaatcggagatgggggcgg

SEQ ID NO: 79879 - DNA, 64 bp, Homo sapiens
  misc_feature 1..64: note = chr16:89531790-89531854
  misc_feature 1..64: note = hypo
  source 1..64: mol_type = genomic DNA
catgaattagactggcgttggacttctctcatctttacagcagaggccacgacagagaacaggg

SEQ ID NO: 79880 - DNA, 134 bp, Homo sapiens; identical to SEQ ID NO: 44916
  misc_feature 1..134: note = chr16:89558631-89558765
  misc_feature 1..134: note = hypo
  source 1..134: mol_type = genomic DNA

SEQ ID NO: 79881 - DNA, 42 bp, Homo sapiens
  misc_feature 1..42: note = chr16:89575654-89575696
  misc_feature 1..42: note = hypo
  source 1..42: mol_type = genomic DNA
aggttgttgttttttcggttatttttgagacagagatctcgc

SEQ ID NO: 79882 - DNA, 162 bp, Homo sapiens
  misc_feature 1..162: note = chr16:89575936-89576098
  misc_feature 1..162: note = hypo
  source 1..162: mol_type = genomic DNA
cgtgagccaccgcgcccggccataaaacatatttaaatgggaaaatgtttatcttgaaaggagaactctgaaagtatatacttgttaactggtttggtacctggaaatgttctacaaggagccactctctggtgacagcaggagccccgtgtctgggcagcc

SEQ ID NO: 79883 - DNA, 30 bp, Homo sapiens
  misc_feature 1..30: note = chr16:89622358-89622388
  misc_feature 1..30: note = hypo
  source 1..30: mol_type = genomic DNA
ctgggcaggtgtgggcggtgccgtccccgg

SEQ ID NO: 79884 - DNA, 27 bp, Homo sapiens
  misc_feature 1..27: note = chr16:89637111-89637138
  misc_feature 1..27: note = hypo
  source 1..27: mol_type = genomic DNA
acaggaggaggtgagcggggattggag

SEQ ID NO: 79885 - DNA, 29 bp, Homo sapiens
  misc_feature 1..29: note = chr16:8963909-8963938
  misc_feature 1..29: note = hypo
  source 1..29: mol_type = genomic DNA
gggtgcggtggctcacgcctgtaattcca

SEQ ID NO: 79886 - DNA, 287 bp, Homo sapiens
  misc_feature 1..287: note = chr16:89641417-89641704
  misc_feature 1..287: note = hyper
  source 1..287: mol_type = genomic DNA
gcttttggcgaggtccgtgccctatttttaggcagaaatcggcaaaaagagtggactgcgaggtggtttctgtccccgccgacgcctcctcttccgctgctccctcccccgggaccggtgatggggaaggtgggggagtgagttcagggcggagcgggcccaccccccacggaacccaggcctgccccgccccgccccggcctcgggggactggtgtggaccgtgccccgcggacccctcggaatcagaccgcgattcagccctcggccccccgggacggtccttcc

SEQ ID NO: 79887 - DNA, 18 bp, Homo sapiens
  misc_feature 1..18: note = chr16:89642511-89642529
  misc_feature 1..18: note = hyper
  source 1..18: mol_type = genomic DNA
ccgggccggggctggcgc

SEQ ID NO: 79888 - DNA, 39 bp, Homo sapiens
  misc_feature 1..39: note = chr16:89642560-89642599
  misc_feature 1..39: note = hyper
  source 1..39: mol_type = genomic DNA
cgctgaggccagtggggcgcaaggcggggccccccggag

SEQ ID NO: 79889 - DNA, 45 bp, Homo sapiens
  misc_feature 1..45: note = chr16:89650665-89650710
  misc_feature 1..45: note = hypo
  source 1..45: mol_type = genomic DNA
catcatcactgtcaccgccattagctctcccgcccctcctggcag

SEQ ID NO: 79890 - DNA, 51 bp, Homo sapiens
  misc_feature 1..51: note = chr16:89651630-89651681
  misc_feature 1..51: note = hypo
  source 1..51: mol_type = genomic DNA
aggtggcagaagttacgaaggtggaggcacagggctcggaaatgtgtctcc

SEQ ID NO: 79891 - DNA, 119 bp, Homo sapiens
  misc_feature 1..119: note = chr16:89655014-89655133
  misc_feature 1..119: note = hypo
  source 1..119: mol_type = genomic DNA
tctacctgtcaggagcgggttcggggagccccggcccagcacagctcctggctcccggcccactgcaggtggccattgacttcaccgcctccaatggagacccgcggaacagctgctcc

SEQ ID NO: 79892 - DNA, 30 bp, Homo sapiens
  misc_feature 1..30: note = chr16:89657693-89657723
  misc_feature 1..30: note = hypo
  source 1..30: mol_type = genomic DNA
tgcttggtgtggggtcggctgtgtgtgcac

SEQ ID NO: 79893 - DNA, 71 bp, Homo sapiens
  misc_feature 1..71: note = chr16:89663895-89663966
  misc_feature 1..71: note = hypo
  source 1..71: mol_type = genomic DNA
agtgaggactgtggacgtgatgcaggggtgccaggagcctcccacatggcctgcaccgcagggagctgggc

SEQ ID NO: 79894 - DNA, 30 bp, Homo sapiens; identical to SEQ ID NO: 44922
  misc_feature 1..30: note = chr16:89667452-89667482
  misc_feature 1..30: note = hypo
  source 1..30: mol_type = genomic DNA

SEQ ID NO: 79895 - DNA, 96 bp, Homo sapiens
  misc_feature 1..96: note = chr16:89668332-89668428
  misc_feature 1..96: note = hypo
  source 1..96: mol_type = genomic DNA
gattctgacaccccacggtaagaatgctgggcgctgctcccgtgctcaggagatgtggctcccgggaaactgacgatgctgcgaggaagctcaagc

SEQ ID NO: 79896 - DNA, 56 bp, Homo sapiens
  misc_feature 1..56: note = chr16:89674507-89674563
  misc_feature 1..56: note = hypo
  source 1..56: mol_type = genomic DNA
ggtgtcatctttgcacgtaactgtctctgtgtgtgtcccgtcgtcttcagctcgga

SEQ ID NO: 79897 - DNA, 170 bp, Homo sapiens
  misc_feature 1..170: note = chr16:89688129-89688299
  misc_feature 1..170: note = hypo
  source 1..170: mol_type = genomic DNA
gtgtgtctgtgtgcacgtggaggtatctgagtgtgcgtttactcatcccgtgggaaagtctgcacatgtctgttctaggtacgcggacgtatctgaccgtgtgggcttgcgatgcgcccaggtgttctcgtctgcgatgatctgtgtgtggggggcgtgggtaggtccgc

SEQ ID NO: 79898 - DNA, 402 bp, Homo sapiens
  misc_feature 1..402: note = chr16:89702599-89703001
  misc_feature 1..402: note = hypo
  source 1..402: mol_type = genomic DNA
actcccacaggcatgcggggggtgggctgagacctggctgcatcagctcctggcaccccctgcggcccacagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggtggggtcctgacctgggtcctccaggtcctgcgtcttctcacccagccctcatcctgagcagcaggtgccggtcaggacacctcaccctccagataccaggtgcccactcccctgcaccctgactctccccgcaggcattcggcaggccttccgggaagggaaggtggccagcctgatcggcgtggagggcggcca

SEQ ID NO: 79899 - DNA, 212 bp, Homo sapiens
  misc_feature 1..212: note = chr16:89704484-89704696
  misc_feature 1..212: note = hypo
  source 1..212: mol_type = genomic DNA
aggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggac

SEQ ID NO: 79900 - DNA, 87 bp, Homo sapiens
  misc_feature 1..87: note = chr16:89713549-89713636
  misc_feature 1..87: note = hypo
  source 1..87: mol_type = genomic DNA
tgagctgcccacacacgctccttgtccccaggccacagccccaagggtaggggccacataccgatgtatggacgtccaggttctgca

SEQ ID NO: 79901 - DNA, 30 bp, Homo sapiens
  misc_feature 1..30: note = chr16:8971974-8972004
  misc_feature 1..30: note = hypo
  source 1..30: mol_type = genomic DNA
ggatagatggacagacggcagctgctgggg

SEQ ID NO: 79902 - DNA, 17 bp, Homo sapiens
  misc_feature 1..17: note = chr16:89725803-89725820
  misc_feature 1..17: note = hypo
  source 1..17: mol_type = genomic DNA
gggcgcagtggctcacg

SEQ ID NO: 79903 - DNA, 37 bp, Homo sapiens; identical to SEQ ID NO: 44928
  misc_feature 1..37: note = chr16:89763835-89763872
  misc_feature 1..37: note = hypo
  source 1..37: mol_type = genomic DNA

SEQ ID NO: 79904 - DNA, 79 bp, Homo sapiens
  misc_feature 1..79: note = chr16:89778723-89778802
  misc_feature 1..79: note = hyper
  source 1..79: mol_type = genomic DNA
cctgcctctgcaaagcggggagcccctcggccctgtaccccgaccccggaacctccgctcccctcgctgcccccttctc

SEQ ID NO: 79905 - DNA, 334 bp, Homo sapiens
  misc_feature 1..334: note = chr16:8978000-8978334
  misc_feature 1..334: note = hypo
  source 1..334: mol_type = genomic DNA
tagtttcctccaaaccggggtgggggagccacaccacacccccacatatcaggtccccagtctccagatcccagcatctccccatctcaggtgagcaccgacagcccatgggaattgagaagccacaggggtcctggccccggggggtcccacctgcttcccgcttcccactcccacagctgtatgccggcatgtccgtggtggggacgtccatgccggtgcaggccgtgtgtccctactgtggaaaccgcatcatcacggtgacgacctttgtcccgggtgccctcacctggctgctgtgtaccaccctcttcctgttcgggtgagtggccgc

SEQ ID NO: 79906 - DNA, 92 bp, Homo sapiens
  misc_feature 1..92: note = chr16:89846148-89846240
  misc_feature 1..92: note = hypo
  source 1..92: mol_type = genomic DNA
tggcaggcatcagagcggagtctgcacaccctgcaggcatcagagcagagtctgcacatactgcaggcatcagagcgcggtctgcacacact

SEQ ID NO: 79907 - DNA, 42 bp, Homo sapiens
  misc_feature 1..42: note = chr16:89855370-89855412
  misc_feature 1..42: note = hypo
  source 1..42: mol_type = genomic DNA
tcctctcccaactgtcgcctctggaaccgaagaaaaagcagc

SEQ ID NO: 79908 - DNA, 30 bp, Homo sapiens
  misc_feature 1..30: note = chr16:8987879-8987909
  misc_feature 1..30: note = hypo
  source 1..30: mol_type = genomic DNA
tcaaggtaagtgtagcgactcctctttggg

SEQ ID NO: 79909 - DNA, 420 bp, Homo sapiens
  misc_feature 1..420: note = chr16:89883924-89884344
  misc_feature 1..420: note = hypo
  source 1..420: mol_type = genomic DNA
cagagcgagactctgtctcaaaacaaaaccaaacataagaattcgtaaaagcgagtgcctaggcgaagctaatgtgcctcaaagtcctgggtaagtagaggccctggagacccgtccgcatcctctggcagtggccttggaaccaccgaagggattcagccgaagggccgcgttcccggcaggcgtctttattgtgttgattacgtagatggcgtagatgacgtagatgacgttcagcaccacaaacgaagagccgaggcacagagtggggccttggattcatgagatggggatggagcagaaatgagaattcggagtccatgaaacccccacaaagactcctgcacggcccgactcggacactttgcaatctgctggttgagggggatggtgtgaactcagggaacagcctgagatcgc

SEQ ID NO: 79910 - DNA, 93 bp, Homo sapiens; identical to SEQ ID NO: 44930
  misc_feature 1..93: note = chr16:89884896-89884989
  misc_feature 1..93: note = hypo
  source 1..93: mol_type = genomic DNA

SEQ ID NO: 79911 - DNA, 33 bp, Homo sapiens; identical to SEQ ID NO: 44931
  misc_feature 1..33: note = chr16:89885109-89885142
  misc_feature 1..33: note = hypo
  source 1..33: mol_type = genomic DNA

SEQ ID NO: 79912 - DNA, 30 bp, Homo sapiens; identical to SEQ ID NO: 44932
  misc_feature 1..30: note = chr16:89896219-89896249
  misc_feature 1..30: note = hypo
  source 1..30: mol_type = genomic DNA

SEQ ID NO: 79913 - DNA, 852 bp, Homo sapiens
  misc_feature 1..852: note = chr16:89899963-89900815
  misc_feature 1..852: note = hypo
  source 1..852: mol_type = genomic DNA
ttcagctcaggcctacggcctgctgggcttgagaagcttcgcctttgtgcctcggtttccttctccgtgaaatgggaggtgcagcgtggtgctaacgtctgtgcagccctgggcacgcctggctccggaagcactggccagtggaggtggcagcaagggatctgcacctgtgcactcgctggacctgccttggggagcagcacgtgtgggtccaggctgcgaatcccgaccggattctcagggaggggttctgcaaggtgcacccggtgggggctgggagctcctccggggcgtgtttccctgtgacgtaaaatgacctctatccctgagccctcccatgtagaaagcgggaaggaggctggccgctgtgtgtgggtgtgggtgtgagctgggtgtgtctctgtgtgagctggggtttgtttgtagatggcattcccgatatagtctcacctctgagcaagggttacctcacaggaaggcagtcctgcagcaagactcttctctttacggagacatctgtgaacctgcctgcgctcgcggttggccgtcgtagaagcatggataagcatagcccgtgtgaatctgtgaacctgcctgcgctcgcggttggccgtcgtagaagcctggataagcatagcccgtgtgaatctgtgaacctgcctgtgctcacggttggccgtcgtagaagcatggataagcatagcccgtgtgaatctgtgaacctgcccgcgctcgcggttggccgtcgtagaaggccccataagcatagcccgtgtgaatctgtgaacctgcctgtgctcacggttggccgtcgtagaagcctggataagcatagcccgtgtgaatctgtga

SEQ ID NO: 79914 - DNA, 38 bp, Homo sapiens
  misc_feature 1..38: note = chr16:89901552-89901590
  misc_feature 1..38: note = hypo
  source 1..38: mol_type = genomic DNA
ctcacggttggccgtcgtagaagcgtggataagcatag

SEQ ID NO: 79915 - DNA, 30 bp, Homo sapiens
  misc_feature 1..30: note = chr16:899159-899189
  misc_feature 1..30: note = hypo
  source 1..30: mol_type = genomic DNA
gggtcacgtggtcgccgtttctagctctcc

SEQ ID NO: 79916 - DNA, 111 bp, Homo sapiens
  misc_feature 1..111: note = chr16:89972124-89972235
  misc_feature 1..111: note = hypo
  source 1..111: mol_type = genomic DNA
tggcagtcatgggcccgtccgcgtgtctgctgtccccactggactggacattctcatggacaggagcattttgttccctgtactgctctccaagagcgatttccagcaggg

SEQ ID NO: 79917 - DNA, 97 bp, Homo sapiens
  misc_feature 1..97: note = chr16:89972675-89972772
  misc_feature 1..97: note = hypo
  source 1..97: mol_type = genomic DNA
tcgctgccctgcccccggtaagggagaaaggctgaaatgggagctctgtgtaagccggtcacatgcacgtcccttctgctccgggcggtccacatgc

SEQ ID NO: 79918 - DNA, 32 bp, Homo sapiens
  misc_feature 1..32: note = chr16:89985113-89985145
  misc_feature 1..32: note = hyper
  source 1..32: mol_type = genomic DNA
aacgtaaaggagatccgcggtgtgagggaccc

SEQ ID NO: 79919 - DNA, 161 bp, Homo sapiens
  misc_feature 1..161: note = chr16:89992858-89993019
  misc_feature 1..161: note = hyper
  source 1..161: mol_type = genomic DNA
actgccctcaaagcccggccccgctttccccaggaccccaagcgctgcgcgaggtcagcaccaaggacagcgcccgggccgagcgcctggcctcgaacgccgggttctgctttgtgtttccaggtttttgtttttggttatgagaggaggcctggctctgt

SEQ ID NO: 79920 - DNA, 49 bp, Homo sapiens
  misc_feature 1..49: note = chr16:90002280-90002329
  misc_feature 1..49: note = hypo
  source 1..49: mol_type = genomic DNA
gagccatcttgctgccgacaccctgctttcccctcgccctagggctccc

SEQ ID NO: 79921 - DNA, 40 bp, Homo sapiens; identical to SEQ ID NO: 44936
  misc_feature 1..40: note = chr16:90037700-90037740
  misc_feature 1..40: note = hypo
  source 1..40: mol_type = genomic DNA

SEQ ID NO: 79922 - DNA, 30 bp, Homo sapiens
  misc_feature 1..30: note = chr16:90048779-90048809
  misc_feature 1..30: note = hypo
  source 1..30: mol_type = genomic DNA
gctgaccctggacagcggctggggctttgt

SEQ ID NO: 79923 - DNA, 463 bp, Homo sapiens
  misc_feature 1..463: note = chr16:9005341-9005804
  misc_feature 1..463: note = hypo
  source 1..463: mol_type = genomic DNA
gagctcgtcctgctccggtcatgaaggaaaaacgcaactgcacaacactgaaaacagcgctgtcacgctccggacacatgcggtacaggacagggatccctgaagggacaaatgagagccccgtgatgggcccagctctgctgaaagtttacaggctgcagcccggagaaggcaaacccagacagagccaagaagtgagaatgagaggagctcaagggagcgggaacctgctgggcagagtagcctaaagcagaatgctgcccagaaagcgagatctggggatgtgcagtttcttccgaagctgtcagtgagaactgatcagtgaactcgaggaaattacctggggcaaggaaaagaaccagcaagaggatgaggattggggggaacaaccttcagagctcacgacaggctgggaagtctgtgttcccaccagccaccgtggaaaaaccgctgaacacctggg

SEQ ID NO: 79924 - DNA, 363 bp, Homo sapiens
  misc_feature 1..363: note = chr16:90066618-90066981
  misc_feature 1..363: note = hypo
  source 1..363: mol_type = genomic DNA
cttgatgacgaggtccggcacctcgtcagtgccacctacaggtgcaccctggacctgctgacacggtgccgggagcatgtggagaaggtgagtgtggcctctgcccagacaggtcgtgggtcccatgttgagtcacggtcatgccacacccgaaggccacacccgtccttcagcttgcttaggtttgggctgtgatcatgtcctcagagccgtctgacaggtgggccgttgtttccaggtgggccagcggctcctggagaaggaagtactggagaaggcagacatggtggagctgctgggcccccggcccttctcggagaagtctacctatgaggagtttgtagagggcgtgggcagcctgga

SEQ ID NO: 79925 - DNA, 157 bp, Homo sapiens
  misc_feature 1..157: note = chr16:90069167-90069324
  misc_feature 1..157: note = hypo
  source 1..157: mol_type = genomic DNA
gcagagtgacacctgcgggcactgctgtctgtgctgtagcggtctgtgcaccctgcagggacacgagccttcagcccctgtatttctcagcctgcctgcctccctccctctgccagaagggaaggtggaatggggtggaatgcgtgtacctgccagt

SEQ ID NO: 79926 - DNA, 199 bp, Homo sapiens
  misc_feature 1..199: note = chr16:9009860-9010059
  misc_feature 1..199: note = hypo
  source 1..199: mol_type = genomic DNA
gtgtgtgtgcttctgcgtcttttatcacaactggaagaatgaggatttgctagtgattagtgatggcgcggggagagtaatcaccgcatgctgaggtctgctcaatgagaacctcgctgcacaggaggggtctggacactggagtaacaacagaagtcaccactgtacagtgactcaggaccaacgggacagccaacaa

SEQ ID NO: 79927 - DNA, 65 bp, Homo sapiens
  misc_feature 1..65: note = chr16:901765-901830
  misc_feature 1..65: note = hypo
  source 1..65: mol_type = genomic DNA
agggctggacactcacgggtcagagccaagggctccatggagtgggccctcgaggcccccagctg

SEQ ID NO: 79928 - DNA, 42 bp, Homo sapiens
  misc_feature 1..42: note = chr16:904733-904775
  misc_feature 1..42: note = hypo
  source 1..42: mol_type = genomic DNA
gcctgctgggactcccggcccccgacccggctcctcagcctg

SEQ ID NO: 79929 - DNA, 41 bp, Homo sapiens
  misc_feature 1..41: note = chr16:9053767-9053808
  misc_feature 1..41: note = hyper
  source 1..41: mol_type = genomic DNA
aacatctatcccattcgtctcagagccgacactgaaacaga

SEQ ID NO: 79930 - DNA, 120 bp, Homo sapiens
  misc_feature 1..120: note = chr16:9062079-9062199
  misc_feature 1..120: note = hypo
  source 1..120: mol_type = genomic DNA
ggattacaggcgtgagccaccacgcccagcccaaccttttctaattctggattcttatcagggaaatgggaaaacagtctacctgaaaccataaaatatcaaacgcttcaaaatccacag

SEQ ID NO: 79931 - DNA, 30 bp, Homo sapiens
  misc_feature 1..30: note = chr16:9063642-9063672
  misc_feature 1..30: note = hypo
  source 1..30: mol_type = genomic DNA
tatagtggttggagtcgtgttcattttttt

SEQ ID NO: 79932 - DNA, 30 bp, Homo sapiens
  misc_feature 1..30: note = chr16:9106938-9106968
  misc_feature 1..30: note = hyper
  source 1..30: mol_type = genomic DNA
aggcatgagccacaccgccccctaggcctt

SEQ ID NO: 79933 - DNA, 51 bp, Homo sapiens
  misc_feature 1..51: note = chr16:9229760-9229811
  misc_feature 1..51: note = hyper
  source 1..51: mol_type = genomic DNA
ttgacctcttatcaccggccaggctctgtgccctgccgcaacagacaggat

SEQ ID NO: 79934 - DNA, 300 bp, Homo sapiens
  misc_feature 1..300: note = chr16:924548-924848
  misc_feature 1..300: note = hypo
  source 1..300: mol_type = genomic DNA
tctccaggcaggcagcggccccagggccccgcggaaccctccggaacagctgtgtaaactgcgtgggaggagggaggctgctcatgccgcaactccccaacggaaggatcacgggaaccaggacaggctccgggggacggtgctcagatgggaacacacggaaccaggacgggatccggggaggcggcgctcagatgggaacacacggaaccaggacaggctccaggcaggcggcgctcagaagtctcagggcactcggctgtcacagcgcggcacaggggagtacgcagccccagccag

SEQ ID NO: 79935 - DNA, 30 bp, Homo sapiens
  misc_feature 1..30: note = chr16:925813-925843
  misc_feature 1..30: note = hypo
  source 1..30: mol_type = genomic DNA
gggcagcacagcccacgcaggaggtgtgtg

SEQ ID NO: 79936 - DNA, 66 bp, Homo sapiens
  misc_feature 1..66: note = chr16:928296-928362
  misc_feature 1..66: note = hypo
  source 1..66: mol_type = genomic DNA
tcacctgatgggcaccggtgccagcctccaagcagctaacgcggaaaagcccgagggagtcaggag

SEQ ID NO: 79937 - DNA, 30 bp, Homo sapiens
  misc_feature 1..30: note = chr16:929536-929566
  misc_feature 1..30: note = hypo
  source 1..30: mol_type = genomic DNA
ggacacggggcagggcgggcggcgcgggct

SEQ ID NO: 79938 - DNA, 30 bp, Homo sapiens
  misc_feature 1..30: note = chr16:9381764-9381794
  misc_feature 1..30: note = hypo
  source 1..30: mol_type = genomic DNA
gtgtgaccgcatgcacgtgcttcctatgaa

SEQ ID NO: 79939 - DNA, 30 bp, Homo sapiens
  misc_feature 1..30: note = chr16:939019-939049
  misc_feature 1..30: note = hypo
  source 1..30: mol_type = genomic DNA
ccgtccatgcatccccggtgtctcatggga

SEQ ID NO: 79940 - DNA, 30 bp, Homo sapiens
  misc_feature 1..30: note = chr16:942296-942326
  misc_feature 1..30: note = hypo
  source 1..30: mol_type = genomic DNA
atgctctaggtgcaccgtggccatgaccac

SEQ ID NO: 79941 - DNA, 39 bp, Homo sapiens
  misc_feature 1..39: note = chr16:943022-943061
  misc_feature 1..39: note = hypo
  source 1..39: mol_type = genomic DNA
atgcaggtgaggtctcgccagcaccggtccccccggatc

SEQ ID NO: 79942 - DNA, 187 bp, Homo sapiens
  misc_feature 1..187: note = chr16:943459-943646
  misc_feature 1..187: note = hypo
  source 1..187: mol_type = genomic DNA
ggatgagcccaaagtcggagggagcacccagtgcacacgcgtctcagccccgccccctgcggcacaaagggagccgaggcgcaggccccgtgtgtctcccacacactgcagctcgcctgctgtgaggactcctggggcacgggacaggcttccaggggcctgcagagggagccgccagcactgggga

SEQ ID NO: 79943 - DNA, 58 bp, Homo sapiens
  misc_feature 1..58: note = chr16:945674-945732
  misc_feature 1..58: note = hypo
  source 1..58: mol_type = genomic DNA
cgtggctcaagtgaccgatgccgagagggacacgaatgagaaacggcaggggagtggg

SEQ ID NO: 79944 - DNA, 82 bp, Homo sapiens
  misc_feature 1..82: note = chr16:946275-946357
  misc_feature 1..82: note = hypo
  source 1..82: mol_type = genomic DNA
gaggctcagccaccccgcgcactgtgaaggctgcctctggcggggccatgtctgggtccggcatcgccgtctctagggtctt

SEQ ID NO: 79945 - DNA, 30 bp, Homo sapiens
  misc_feature 1..30: note = chr16:949510-949540
  misc_feature 1..30: note = hypo
  source 1..30: mol_type = genomic DNA
ggcctgtcagggaaacggcagcacatctgc

SEQ ID NO: 79946 - DNA, 565 bp, Homo sapiens
  misc_feature 1..565: note = chr16:962833-963398
  misc_feature 1..565: note = hypo
  source 1..565: mol_type = genomic DNA
gctgccattgttctccgcctcagcgtggcggacaacgcgtccccaggaaagtcaataagcagcacgctgccagggcggcctcagcgccaaggtcagggccagggctctccagacagctctcacccagcaaacaccagcgctgcctgaagcgagccccaggcacccgaacgaggcggcaacacgcagggccacagcacacgctgccactgccggggagaggagccgtcctcgcccccgcctcagtgcctttcccgttgcgcagctgcacgcgctgcctgctgggcgccagcatctgcacgccctgctcttccccagggacctcccttccctttagccagggggacggctccgggagggcccctgctccactccacggctccggcgtcgtttccacctcgtgctgtgctgggccttccgggagactgagcacaccctgtgaggagcctgacgcgttctgcctgggtaacggggcagtagctcttgtggggaacattcacttccacggccgctgctctccttcctgcgacacagacagcgttggcccaatcagcggagaagctgcatg

SEQ ID NO: 79947 - DNA, 83 bp, Homo sapiens
  misc_feature 1..83: note = chr16:965804-965887
  misc_feature 1..83: note = hypo
  source 1..83: mol_type = genomic DNA
gatgagcaccatcaccgggggccggagcaggtgagatgcaggggccggagcacgtgggacgcgggggccggagcaggtgagac

SEQ ID NO: 79948 - DNA, 30 bp, Homo sapiens; identical to SEQ ID NO: 44442
  misc_feature 1..30: note = chr16:968262-968292
  misc_feature 1..30: note = hypo
  source 1..30: mol_type = genomic DNA

SEQ ID NO: 79949 - DNA, 90 bp, Homo sapiens
  misc_feature 1..90: note = chr16:968556-968646
  misc_feature 1..90: note = hypo
  source 1..90: mol_type = genomic DNA
atggctgaagtgtgccgagcctccaagggactcatgagaccccagaaaagtgctggccatcgtgggctgcggggacgttgtgcccacgga

SEQ ID NO: 79950 - DNA, 30 bp, Homo sapiens
  misc_feature 1..30: note = chr16:969209-969239
  misc_feature 1..30: note = hypo
  source 1..30: mol_type = genomic DNA
tgtggccaacaggcacgatccaccccacgt

SEQ ID NO: 79951 - DNA, 30 bp, Homo sapiens
  misc_feature 1..30: note = chr16:977343-977373
  misc_feature 1..30: note = hypo
  source 1..30: mol_type = genomic DNA
aagggctctgcctcccggtttgagggaacc

SEQ ID NO: 79952 - DNA, 114 bp, Homo sapiens
  misc_feature 1..114: note = chr16:981729-981843
  misc_feature 1..114: note = hypo
  source 1..114: mol_type = genomic DNA
ctgccgaagctactacgagtcttctgaatttctgcgcgacagtccaaagtgacgtgctgagccgctgcagggtcagacacaacatgaaactcaggctcacgagggctctcaggc

SEQ ID NO: 79953 - DNA, 30 bp, Homo sapiens
  misc_feature 1..30: note = chr16:982069-982099
  misc_feature 1..30: note = hypo
  source 1..30: mol_type = genomic DNA
gcaagtggttggggacgcgggaggctggct

SEQ ID NO: 79954 - DNA, 30 bp, Homo sapiens
  misc_feature 1..30: note = chr16:983721-983751
  misc_feature 1..30: note = hypo
  source 1..30: mol_type = genomic DNA
ggaggtcacatccaccgtcctcccggccct

SEQ ID NO: 79955 - DNA, 184 bp, Homo sapiens
  misc_feature 1..184: note = chr16:9842646-9842830
  misc_feature 1..184: note = hypo
  source 1..184: mol_type = genomic DNA
gcagaaggaaggcagcgacttcttcaaactagagcagccgccatttcttcccagaaggctgtgggacttggcggccactggggggctcctgaagaggagcatccctagccttacctaactgcaaggaggctgcgatccagcccaggccccaagaagaagagtctctatgcgaagccaccatcgt

SEQ ID NO: 79956 - DNA, 30 bp, Homo sapiens
  misc_feature 1..30: note = chr16:9862871-9862901
  misc_feature 1..30: note = hypo
  source 1..30: mol_type = genomic DNA
ggctgctcatcacctcgttcttctcgttgt

SEQ ID NO: 79957 - DNA, 208 bp, Homo sapiens; identical to SEQ ID NO: 44598
  misc_feature 1..208: note = chr16:9888740-9888948
  misc_feature 1..208: note = hypo
  source 1..208: mol_type = genomic DNA

SEQ ID NO: 79958 - DNA, 30 bp, Homo sapiens
  misc_feature 1..30: note = chr16:9943625-9943655
  misc_feature 1..30: note = hypo
  source 1..30: mol_type = genomic DNA
acttccgacatggcacggtgttcctcacac

SEQ ID NO: 79959 - DNA, 54 bp, Homo sapiens
  misc_feature 1..54: note = chr17:10101056-10101110
  misc_feature 1..54: note = hyper
  source 1..54: mol_type = genomic DNA
ccaaggcagcacgaccgtccacgggtcatcaggctctagactccggggtggaga

SEQ ID NO: 79960 - DNA, 317 bp, Homo sapiens; identical to SEQ ID NO: 1280
  misc_feature 1..317: note = chr17:10101131-10101448
  misc_feature 1..317: note = hyper
  source 1..317: mol_type = genomic DNA

SEQ ID NO: 79961 - DNA, 401 bp, Homo sapiens; identical to SEQ ID NO: 36377
  misc_feature 1..401: note = chr17:10102264-10102665
  misc_feature 1..401: note = hyper
  source 1..401: mol_type = genomic DNA

SEQ ID NO: 79962 - DNA, 43 bp, Homo sapiens
  misc_feature 1..43: note = chr17:10146608-10146651
  misc_feature 1..43: note = hypo
  source 1..43: mol_type = genomic DNA
ccgggggttggggagcggtgagaaggagagtcatccctttgaa

SEQ ID NO: 79963 - DNA, 42 bp, Homo sapiens
  misc_feature 1..42: note = chr17:10212555-10212597
  misc_feature 1..42: note = hypo
  source 1..42: mol_type = genomic DNA
agtgcaggagctgcacgcggtcgctggcgtccagcagctcct

SEQ ID NO: 79964 - DNA, 201 bp, Homo sapiens
  misc_feature 1..201: note = chr17:10212807-10213008
  misc_feature 1..201: note = hypo
  source 1..201: mol_type = genomic DNA
ccaggtacgcagaggcggccaccgtgctcaccttgagctggccctggaccgtgcgcagatgcttctgggtctctgccatctggcggttggagtggcccagctgaatctccatctcattaaggtctccctccatcttcttctttagcctcagggcgtcgttccggctgcggatttcagcatccagcacgctctgcagggcct

SEQ ID NO: 79965 - DNA, 30 bp, Homo sapiens
  misc_feature 1..30: note = chr17:10303782-10303812
  misc_feature 1..30: note = hypo
  source 1..30: mol_type = genomic DNA
agcttctgtttgacccgctgcaagttgtca

SEQ ID NO: 79966 - DNA, 161 bp, Homo sapiens
  misc_feature 1..161: note = chr17:10404695-10404856
  misc_feature 1..161: note = hypo
  source 1..161: mol_type = genomic DNA
cttcttccagcctctcgctgatctcctccagctcccgggagagatcagagcgctgcttctctgctttggcccgggaggcccgctctgcctcgatttcctcctccagctcctcaatgcgggcctgggaatggtgaaaaatattaatacgaactcaacttctt

SEQ ID NO: 79967 - DNA, 30 bp, Homo sapiens
  misc_feature 1..30: note = chr17:10558730-10558760
  misc_feature 1..30: note = hypo
  source 1..30: mol_type = genomic DNA
gtgttgctgagggaacgtttaaaaataaac

SEQ ID NO: 79968 - DNA, 463 bp, Homo sapiens
  misc_feature 1..463: note = chr17:10632887-10633350
  misc_feature 1..463: note = hyper
  source 1..463: mol_type = genomic DNA
ccctggtatgggactcgcttccatgaacacatccgcgtctcttagacgggggagaaagtgggggctccccaagcagaaagcccaagtcccgtcctccccactaactgtgcgcccctgcgactctgcccgctagtcagttacacggcccgctaggccagggggcggagctgggagccgggcgggtccccctcccaccgcggccgcctgacctgcaccaaggccgccagcgcgaagaaggcggccatgagtccgttgcaggcccgccacagcgctggcgccatggctcggagaacacggcgcggggcggtgagtcctgccacgtgcggggcggtgagtcctgccacgtacggtccgccttcctccttgcgcggagggaccgagacccccgcctcggtttcggtgccttggggacactgccgtggccgtcgctccgcccgggggcggggagcgaagggcgtgggtg

SEQ ID NO: 79969 - DNA, 47 bp, Homo sapiens
  misc_feature 1..47: note = chr17:1082429-1082476
  misc_feature 1..47: note = hyper
  source 1..47: mol_type = genomic DNA
gtctcccctcccacccgatcccaccccagcaccgaacccctgggccc

SEQ ID NO: 79970 - DNA, 30 bp, Homo sapiens
  misc_feature 1..30: note = chr17:1082997-1083027
  misc_feature 1..30: note = hyper
  source 1..30: mol_type = genomic DNA
gccccggtggctgagcggctccatcccgcg

SEQ ID NO: 79971 - DNA, 224 bp, Homo sapiens
  misc_feature 1..224: note = chr17:1083533-1083757
  misc_feature 1..224: note = hyper
  source 1..224: mol_type = genomic DNA
aggatcctggcgatccgcaaaccaggtgccgtggggggcccgggagcccacaggggtgacatcacctcccgcccgggatctccaagcgcggcttcgcgggcgggagcggcggccgggcccctccccagccagacccgctgcgggacccacggggtgaacgtcctgcgcgccgcgggacgcgcctctctcctcccgaaccttcccccgctcgtccctttccacac

SEQ ID NO: 79972 - DNA, 131 bp, Homo sapiens
  misc_feature 1..131: note = chr17:11143519-11143650
  misc_feature 1..131: note = hyper
  source 1..131: mol_type = genomic DNA
agggtggggactggtcgcgaaggctagagaaggcaatggcaggggaggtcagtccctgccgcgggccggctgcagagcggacgttccgccctgctcccggccccctcttcgcccgccgggttcgccgtgtc

SEQ ID NO: 79973 - DNA, 362 bp, Homo sapiens
  misc_feature 1..362: note = chr17:11144922-11145284
  misc_feature 1..362: note = hyper
  source 1..362: mol_type = genomic DNA
gcccgggcgcccggaatcccggaggcgggaagccggcgggggcagcccgcggcggctgtggcggcggcggccagcgcggccgtcacctacgagacgtgctggggctactacgacgtgagcggccagtacgacaaggagttcgagtgtaacaacagcgagagcggctacctgtactgctgcggtacctgctactaccgcttctgctgcaagaagcgccacgagaagctggaccagcgccagtgcaccaactaccagagcccggtgtgggtacagacgcccagcaccaaggtggtgtcgccggggcccgagaacaagtacgacccggagaaggacaagaccaacttcaccgtctacatcacctg

SEQ ID NO: 79974 - DNA, 30 bp, Homo sapiens
  misc_feature 1..30: note = chr17:1129316-1129346
  misc_feature 1..30: note = hypo
  source 1..30: mol_type = genomic DNA
cagaataatactcgccgtgtccaatgcact

SEQ ID NO: 79975 - DNA, 18 bp, Homo sapiens
  misc_feature 1..18: note = chr17:1134324-1134342
  misc_feature 1..18: note = hypo
  source 1..18: mol_type = genomic DNA
attgatctaagaggccgg

SEQ ID NO: 79976 - DNA, 87 bp, Homo sapiens
  misc_feature 1..87: note = chr17:1136675-1136762
  misc_feature 1..87: note = hypo
  source 1..87: mol_type = genomic DNA
ccgcgcccggcctctttctttctttctaactcggtgtgccactggcatgaatcatcccagtgtttgtcttcacgccagactgctatg

SEQ ID NO: 79977 - DNA, 45 bp, Homo sapiens
  misc_feature 1..45: note = chr17:11461634-11461679
  misc_feature 1..45: note = hypo
  source 1..45: mol_type = genomic DNA
gccggggctgctgggcgtggcagagcagagcgggggccgggaggg

SEQ ID NO: 79978 - DNA, 97 bp, Homo sapiens
  misc_feature 1..97: note = chr17:11501937-11502034
  misc_feature 1..97: note = hyper
  source 1..97: mol_type = genomic DNA
cgcctgggagcgttgcgcggggagtgctgaggcggagcagctgctccaggccttcctgggccgcgatgctgccgaggggccgcggccgctgctggtg

SEQ ID NO: 79979 - DNA, 30 bp, Homo sapiens
  misc_feature 1..30: note = chr17:11507618-11507648
  misc_feature 1..30: note = hypo
  source 1..30: mol_type = genomic DNA
gtgagccgccgcgcccgtcctcttcccaac

SEQ ID NO: 79980 - DNA, 158 bp, Homo sapiens
  misc_feature 1..158: note = chr17:11572707-11572865
  misc_feature 1..158: note = hypo
  source 1..158: mol_type = genomic DNA
gatttggcaaacatgcggcgcacactcatggagagagtccagagaatgatgggcctctgctgtggctatcagagcaccttcagccagtattcgtacctctatgtggaggaccggaaggaggttctgggtcagtttctgctgtacgggcacatcctcac

SEQ ID NO: 79981 - DNA, 30 bp, Homo sapiens
  misc_feature 1..30: note = chr17:1163513-1163543
  misc_feature 1..30: note = hyper
  source 1..30: mol_type = genomic DNA
ccctggggcgcctcccgacgcgtcccggcc

SEQ ID NO: 79982 - DNA, 165 bp, Homo sapiens; identical to SEQ ID NO: 44999
  misc_feature 1..165: note = chr17:11637555-11637720
  misc_feature 1..165: note = hypo
  source 1..165: mol_type = genomic DNA

SEQ ID NO: 79983 - DNA, 192 bp, Homo sapiens
  misc_feature 1..192: note = chr17:11672352-11672544
  misc_feature 1..192: note = hypo
  source 1..192: mol_type = genomic DNA
tgttctgaaatgcttcggaacgccgctggtgcatctgtttctccctagagcccacccttggcaggcttattgtgctcccattccaggcgtgtttggtgcacacgagtgagaccatccgtgtgtgctacttcatggagcggttgatggcgcggcagcggcctgtcatgctggtgggcacggctggcactggca

SEQ ID NO: 79984 - DNA, 89 bp, Homo sapiens; identical to SEQ ID NO: 36326
  misc_feature 1..89: note = chr17:1174273-1174362
  misc_feature 1..89: note = hyper
  source 1..89: mol_type = genomic DNA

SEQ ID NO: 79985 - DNA, 171 bp, Homo sapiens
  misc_feature 1..171: note = chr17:1174384-1174555
  misc_feature 1..171: note = hyper
  source 1..171: mol_type = genomic DNA
cgcctcgtgccccccgcacgcgcccctggcacggcccagtgcggtggccgaggggccgggcctagcacaggcctccgggggaagctggcgccgctgtccgggggcttcctctgccgggccgcctccctggccgcggggctacctgcgatccgcccccgggatgggccatcc

SEQ ID NO: 79986 - DNA, 30 bp, Homo sapiens
  misc_feature 1..30: note = chr17:1180688-1180718
  misc_feature 1..30: note = hypo
  source 1..30: mol_type = genomic DNA
gtggctaggggctaccgaattgggctgggt

SEQ ID NO: 79987 - DNA, 16 bp, Homo sapiens
  misc_feature 1..16: note = chr17:11808260-11808276
  misc_feature 1..16: note = hypo
  source 1..16: mol_type = genomic DNA
agagaataggctgggc

SEQ ID NO: 79988 - DNA, 32 bp, Homo sapiens
  misc_feature 1..32: note = chr17:11820735-11820767
  misc_feature 1..32: note = hypo
  source 1..32: mol_type = genomic DNA
agtgctgggattacagacgtgagccaccacat

SEQ ID NO: 79989 - DNA, 40 bp, Homo sapiens
  misc_feature 1..40: note = chr17:11836966-11837006
  misc_feature 1..40: note = hypo
  source 1..40: mol_type = genomic DNA
aattacaggcgtgagccaccgcgcccggccttcttcaggc

SEQ ID NO: 79990 - DNA, 40 bp, Homo sapiens
  misc_feature 1..40: note = chr17:11838965-11839005
  misc_feature 1..40: note = hypo
  source 1..40: mol_type = genomic DNA
caggcgtgagccaccgcgcccggcccgaaagatatttttt

SEQ ID NO: 79991 - DNA, 30 bp, Homo sapiens
  misc_feature 1..30: note = chr17:11866757-11866787
  misc_feature 1..30: note = hypo
  source 1..30: mol_type = genomic DNA
aaaaaaagaagacaacgaccacatagatgg

SEQ ID NO: 79992 - DNA, 30 bp, Homo sapiens; identical to SEQ ID NO: 44946
  misc_feature 1..30: note = chr17:1193094-1193124
  misc_feature 1..30: note = hypo
  source 1..30: mol_type = genomic DNA

SEQ ID NO: 79993 - DNA, 97 bp, Homo sapiens
  misc_feature 1..97: note = chr17:12150178-12150275
  misc_feature 1..97: note = hypo
  source 1..97: mol_type = genomic DNA
ggttaactttaagagcgaaggattaaaacaaagaaacaaacaaacaacaaacctctgttaaaaaaccctgagaactttttttttttttttttttttt

SEQ ID NO: 79994 - DNA, 66 bp, Homo sapiens
  misc_feature 1..66: note = chr17:12568725-12568791
  misc_feature 1..66: note = hyper
  source 1..66: mol_type = genomic DNA
atttccaaattgccccgcgtgaactgtcccgcgggcgcgcacgccctttcgcgcagcctttgcagc

SEQ ID NO: 79995 - DNA, 230 bp, Homo sapiens
  misc_feature 1..230: note = chr17:12569172-12569402
  misc_feature 1..230: note = hyper
  source 1..230: mol_type = genomic DNA
ggaccttcataaaggcgtggtggcgattctccgcaatcgccggcagcctatgacatcagacaggaacgcctgggatgccgcgctgctcctggccaacctccgaggaggaggagggtcccgccggctaagagttaattagccccgcacggcgaggggggaggcgccagttttctggggacactggctgccactgtactcctacccaggggagctcacggagagttggatga

SEQ ID NO: 79996 - DNA, 297 bp, Homo sapiens
  misc_feature 1..297: note = chr17:12693203-12693500
  misc_feature 1..297: note = hyper
  source 1..297: mol_type = genomic DNA
ggcaggtaggtcacccgcgggcaccgctgtcggtgcgcgcccgcgaggctgcatccgcaggggcgcgcaggtgatggagcccgcccagcctccagtcctccttgcctcagtcctttcccctgcaccagctccctccaggcgccgctcgcaggcgcgacccctcctccctaacttcccagaccccggagctcttctcactcgccgccttctgctccgggctccggttgccaagcgcaaagtgtgacgcatcctttacctgcgtccccggctgccccttcgcttcgtcctccctgcctt

SEQ ID NO: 79997 - DNA, 48 bp, Homo sapiens
  misc_feature 1..48: note = chr17:12877698-12877746
  misc_feature 1..48: note = hyper
  source 1..48: mol_type = genomic DNA
aggcctcttggatttcgtcgtttcccatgcccccgcccccatttctaa

SEQ ID NO: 79998 - DNA, 30 bp, Homo sapiens
  misc_feature 1..30: note = chr17:13400298-13400328
  misc_feature 1..30: note = hypo
  source 1..30: mol_type = genomic DNA
tcctcgtgtattaaacggagaataataata

SEQ ID NO: 79999 - DNA, 103 bp, Homo sapiens; identical to SEQ ID NO: 36383
  misc_feature 1..103: note = chr17:13503842-13503945
  misc_feature 1..103: note = hyper
  source 1..103: mol_type = genomic DNA

SEQ ID NO: 80000 - DNA, 576 bp, Homo sapiens
  misc_feature 1..576: note = chr17:13504194-13504770
  misc_feature 1..576: note = hyper
  source 1..576: mol_type = genomic DNA
cgccgccggccacaccgccagctccctcgggcctccggccaggacgccgccaccaggggcccccgcctcctcgccgccgccggacagccccacgacggggccggacagggtctggcagcgctcggccaggcagtagaagacgtaaagggacgtgagcagggagcagagcatcagcaagaacttccggaagatgctgcgggacagcggctcggccgaggtggagagggcactggccgggcccggaggggccatcctagccggaggcgacgtcgggcaacgcgccggccatgctaggcctggaccccgacaggtgccagagcatccccccggcgggccagcgcgctggacggaggccacatcgccgtgcgcccctgtggccgtgcgaactgtcccgggaggcagcggccggggctccgcggggaaacggaatcccgggggccccgcgcaggatccctgcctccagtcgagggagcgggaaggggaacgcgggtccgtgcttaagaaaccatcgtcttagactcgcccaagtcctgagcttggggcagccttggcccctcggttccccgcaagagtcgc

SEQ ID NO: 80001 - DNA, 655 bp, Homo sapiens
  misc_feature 1..655: note = chr17:13505001-13505656
  misc_feature 1..655: note = hyper
  source 1..655: mol_type = genomic DNA
cgcccgagttcaggttctctcagccaaggagcgaggtccccccgagtccctctgcccgagcgggagacaggaggcccgtgcagagccgtccacccctctccgtagcgccgggttgctccaaactgctcttggaccccacctgtgagccgcgtggctgggctgggctgggctgcgcgggacctgtcagcggcccccgccactctgctcgcaggcgctcaccggctgcctcctgggccgccgctggccgccgccacacgtgggacgccgagggcagcaaacttgctggtgacgtcaaaggcccgggccggaccagcccccggacgagcgcagcggggcgcggaccagcggccaggcggggccagacgggcggggtgggatggagaaaaggtggcgcgggctccgcagcagccgcccaatggcactggagagggcgggggcggcaggggcgacgccccttccccagtgtcccccattcctccccgcggcttcgcccccttccagtggatccggtgtctgcggcggctccggggttgcctgagtgacagctaaggccggccggatctctgggggcctgacttccacccaagacgccactagcttggtgaggggccccagagctctccaccgcagctcagccctccgcagccctgaccct

SEQ ID NO: 80002 - DNA, 30 bp, Homo sapiens
  misc_feature 1..30: note = chr17:13791939-13791969
  misc_feature 1..30: note = hypo
  source 1..30: mol_type = genomic DNA
ttttctttttaagttcgttcaaatgattct

SEQ ID NO: 80003 - DNA, 196 bp, Homo sapiens
  misc_feature 1..196: note = chr17:1387714-1387910
  misc_feature 1..196: note = hypo
  source 1..196: mol_type = genomic DNA
gggacatgagcatgacgggtgcggggggcctgggtgctgagggcctgggtgtggtgggccgggtgcggaaagccgggtgtggagggcccgggtcccagtgtggcagcagagggatcaccgaggctgcgggcacagaacagagacaacatgaaccacttgggactcggacacagggcatggacgcaggcaggaccag

SEQ ID NO: 80004 - DNA, 73 bp, Homo sapiens
  misc_feature 1..73: note = chr17:1412390-1412463
  misc_feature 1..73: note = hypo
  source 1..73: mol_type = genomic DNA
agacccaggctcactcgtgggggttagtgggggttagcgtggggcagagggcggggaacggtctgccagaccc

SEQ ID NO: 80005 - DNA, 362 bp, Homo sapiens
  misc_feature 1..362: note = chr17:14200545-14200907
  misc_feature 1..362: note = hyper
  source 1..362: mol_type = genomic DNA
tctcatccctgcagtcggcttggccagcagcagccgcggggctgcgccagtgcccgcctctggccaggggttcccgcgcctcgagcagcgccctgggcccttctacgggaagaggggatcgcggcgcccgcgacacccaggagctcggacgaccgcagcctcaccactaacccccaacaaaggtacagcgggagtccaggccgagataaagttcccttcccagtccgctggggagacaactggccgcggctgccctctgctccgctcccggctgtcccgcagctgcgaggccggggccagagcgctcccttccgggcgggcatcggagccgctgcggcgccgaccgcccttcgcgcccgggc

SEQ ID NO: 80006 - DNA, 278 bp, Homo sapiens; identical to SEQ ID NO: 36388
  misc_feature 1..278: note = chr17:14200930-14201208
  misc_feature 1..278: note = hyper
  source 1..278: mol_type = genomic DNA

SEQ ID NO: 80007 - DNA, 326 bp, Homo sapiens
  misc_feature 1..326: note = chr17:14202945-14203271
  misc_feature 1..326: note = hyper
  source 1..326: mol_type = genomic DNA
gcgggcggcggctcccggtgagtcacttcgtgagtgacactcagccccgggggtcgcgctggggtcggagccggaaggaatgttctgtccccggaaccgcttgcagccaggagttggaggccctctggccccgcagaggctgggttgcaggcatcgaaaacttcctgaacacgaccagtaagaatttgatctcgagcttccgaactccaaacgcctgggcaagaattcagcaaagcgcagcaccgctcacccgcacttcccccagctagcggttgctgtttcttggaagacgcgtttatccgccccagtcccgggtgggtgggtca

SEQ ID NO: 80008 - DNA, 30 bp, Homo sapiens
  misc_feature 1..30: note = chr17:14203695-14203725
  misc_feature 1..30: note = hyper
  source 1..30: mol_type = genomic DNA
ctaatctcagttaaccggcaggccaagcta

SEQ ID NO: 80009 - DNA, 231 bp, Homo sapiens; identical to SEQ ID NO: 36390
  misc_feature 1..231: note = chr17:14204011-14204242
  misc_feature 1..231: note = hyper
  source 1..231: mol_type = genomic DNA

SEQ ID NO: 80010 - DNA, 332 bp, Homo sapiens
  misc_feature 1..332: note = chr17:14204502-14204834
  misc_feature 1..332: note = hyper
  source 1..332: mol_type = genomic DNA
agagtggccagggcgcgagagtgcaacgtcctcctggccccgagcgcgtcgtcgcgccccgggagcagaccctcgcccagcagttaccgccgtcccgactttccgttccagttgcagctcctgccgggcaacatgtcaagagccgccgccgctacagctgccgccgccacctggggaagagcagcagcagcagcggcggccgcgggcacacgggggcaataaaccgagccacccgggcgtccagcgtgccggggaaccctctctgcgctcactgcccggcgggacccacgccatgtgctgagccatgtccctggccgcgcccgcgggcagcg

SEQ ID NO: 80011 - DNA, 1203 bp, Homo sapiens
  misc_feature 1..1203: note = chr17:14205175-14206378
  misc_feature 1..1203: note = hyper
  source 1..1203: mol_type = genomic DNA
agagtcccgaggtgccggactccccaagccccatctccagctttttcagtgggtctgggagcaagcagctgccgcaggccatcatcatcggcgtgaagaagggcggcacgcgggcgctgctggagtttctgcgcgtgcaccccgacgtgcgcgccgtgggcgccgagccccatttcttcgatcgcagctacgacaagggcctcgcttggtaccggtgagtttccctgccaggggcagggtctccatcgtcgattcagaccctgagctaagggagacatggcgtatgatagggaattggcagggttacagcttcggaccacccggggtagggcagggaaactacggcagattgcgcagcgcatcctgtccgggtgcggtgagggttgcgctccgcttggttctcgtcacaacccacagaaagttctcgcggagcactggtgcccttgaattcatcaggcgacctcgccgcaaagaagaagggcagcgactgagaccgccctcagcaaagcgagccaccctctaaccatgggggtatccgactcgaatcgtattttatgactcgttttaaattttttcctcccggagcccgagacgctgggaatgttctgagcccctttggtcggtctccgccctcaaggaacttctagagcagcttctgcttcccagatggggagagggggtgggggccgcggcgtcccggcgaggccgcagagtctgttaactttttgttacagtccgcctggttaccggaaccccaagggtgtcagacccgcctcgctcgcgagccgcctgggctcgggagggtgagccgggcgggtggcccggcgcctccgcctggcgggcgggcggcgcgcggagcgtggagctgtgctggtccctgtcgggcaaaggcgcgcactgcaaccggctggagcggcgcgaggctttgaaggcgtccgggcctccgggcaccgccgcccgtttccgcctccctgccctcggtgctgggatagggaaagcaaggacgcgtgtctccgcggggcttttacacgtccggagcaaagaatattcggggcccattgattgagaaatgagggttgcttcgaggtcgcggcttccggaaattctgttctcgagtcgggttgcgggtcaggttccaaagggacagtggccccggggtcacaatcactacctctgcccactgctttccgcagctgctggtct

SEQ ID NO: 80012 - DNA, 98 bp, Homo sapiens
  misc_feature 1..98: note = chr17:14212588-14212686
  misc_feature 1..98: note = hyper
  source 1..98: mol_type = genomic DNA
cggagacagatggcggagcttcccagtgcgggggcagggctggcagccgagactggggccgcctcccccgcccctaggctggccgggtagtcctccgt

SEQ ID NO: 80013 - DNA, 18 bp, Homo sapiens
  misc_feature 1..18: note = chr17:1471448-1471466
  misc_feature 1..18: note = hypo
  source 1..18: mol_type = genomic DNA
acccggccactctttcat

SEQ ID NO: 80014 - DNA, 30 bp, Homo sapiens
  misc_feature 1..30: note = chr17:1472708-1472738
  misc_feature 1..30: note = hypo
  source 1..30: mol_type = genomic DNA
ttccgagggcctgggcggggtcttggggcc

SEQ ID NO: 80015 - DNA, 18 bp, Homo sapiens
  misc_feature 1..18: note = chr17:1479669-1479687
  misc_feature 1..18: note = hypo
  source 1..18: mol_type = genomic DNA
gcccggcccaggaactct

SEQ ID NO: 80016 - DNA, 186 bp, Homo sapiens
  misc_feature 1..186: note = chr17:14861051-14861237
  misc_feature 1..186: note = hypo
  source 1..186: mol_type = genomic DNA
tctaggcatggggcacggtgccctgatgctggggtgagtgaagtaaaccaagacatggacagaggatggcagggggctaccaggacctctggcctcaggagaaccaaggtgggactaagtcacccagaaaggacatggggcctgcagatagactaggtgtgtaccggctgccgcagacacagagga

SEQ ID NO: 80017 - DNA, 17 bp, Homo sapiens
  misc_feature 1..17: note = chr17:14914268-14914285
  misc_feature 1..17: note = hypo
  source 1..17: mol_type = genomic DNA
tataaaacccgatgtcg

SEQ ID NO: 80018 - DNA, 38 bp, Homo sapiens
  misc_feature 1..38: note = chr17:1501153-1501191
  misc_feature 1..38: note = hypo
  source 1..38: mol_type = genomic DNA
aaaagaaatgtgatgtgctcacacgtgcccaggcacgc

SEQ ID NO: 80019 - DNA, 20 bp, Homo sapiens
  misc_feature 1..20: note = chr17:15149034-15149054
  misc_feature 1..20: note = hypo
  source 1..20: mol_type = genomic DNA
gagccacaggccgggcgcag

SEQ ID NO: 80020 - DNA, 63 bp, Homo sapiens
  misc_feature 1..63: note = chr17:15164652-15164715
  misc_feature 1..63: note = hyper
  source 1..63: mol_type = genomic DNA
acccaactctgccagcgtagaggaacggtcctggccccagctcagcctcgcgcagactctggc

SEQ ID NO: 80021 - DNA, 41 bp, Homo sapiens
  misc_feature 1..41: note = chr17:15164923-15164964
  misc_feature 1..41: note = hyper
  source 1..41: mol_type = genomic DNA
aacaagcctgagctccggtctgggtgcggtgggacaggagc

SEQ ID NO: 80022 - DNA, 895 bp, Homo sapiens
  misc_feature 1..895: note = chr17:15165949-15166844
  misc_feature 1..895: note = hyper
  source 1..895: mol_type = genomic DNA
gcgtgtgcgggagggcgggactcagggaggagagggggcaggagagagggagggcaggagacagtcacttggccttaaatgcgcctcaagaaaaagtcggtccctgcaaaaccgcggcgacttttactcgaaaccagaggcggctgagctttctcacctcccacctcccttctcccctggccccgtggagacctagtgttgaccgagaaactggctcctcagcccactctgggaagacccagccaaatgtagctcagcggatgcccagggctgggcttctgggcccgccgacgccgaccgcgcccgcgcggggctgaggctggattcctttcccactaatagagggcagcgggcgcttgagcgctggaagaagtccctctcctctcgggtcctggagcccctgccctgtcctggcgtcttagccggacacacctgccccgcgccggtccccgctattactgtctgcacctacgaagcatgccagcttcctaggattggcggggattgatctagcgggctcctcttgggtgcgaattaggggaagaaaagtccggccgactactggatagcatggtctgggattgggctcctcctagcctaggcaaaaccagactaccaccgaataagctctaggcaaagtgttcctgcagcagtcgggcttggctgtcagccttggctggagtcctggccatggggtttggcgggcgggtgcgaggtggccatttgaggtggggttggagcagccaaggaaatcagctgattcatagcctcctaacgtggcccgcccagcgttacagggagagaggctagcccccttcagtctcggcttggcagaggcgcgcccaactgagactcccgtgcgcaggccagccttgaggcacgggacagggagcag

SEQ ID NO: 80023 - DNA, 25 bp, Homo sapiens
  misc_feature 1..25: note = chr17:1520973-1520998
  misc_feature 1..25: note = hypo
  source 1..25: mol_type = genomic DNA
cacacccagccgatatgcacctttc

SEQ ID NO: 80024 - DNA, 295 bp, Homo sapiens
  misc_feature 1..295: note = chr17:15244291-15244586
  misc_feature 1..295: note = hyper
  source 1..295: mol_type = genomic DNA
ctgcccaaacacaagcgaaagctttgcagccaagctaaacagaaacgactttgggcggtgagagaacagctttgatctgaatttaaggagctcggtctacaagaccaggtgattgaactctcctccccgtggctgcagatctgaaggctcggctattgaagcagagggggacgaggaacagcgtgcggggcggccagcaccgcagtggaaaggcacagcgctgctaacgggtaattattagaattaagaaattaaacgaattagcacagtgtcgggggttcggatgccccttccc

SEQ ID NO: 80025 - DNA, 277 bp, Homo sapiens
  misc_feature 1..277: note = chr17:15244987-15245264
  misc_feature 1..277: note = hyper
  source 1..277: mol_type = genomic DNA
cggccgccccggccggctcgccggagctgactggccagttataggagaggcgggagctgtcaggccaggagggaaacccgtcgggcggcggttactatggacgcgctcacgcttagtaaccgaggctccccgccctccgggagacctccttggtttgggaggtgaaaggggtgaagagtagcccaagggagaggcctcggtgatttcccgacctctcctgtgaagcctgattcggaactcttccagctgcgaagaacttggccgattctaaggcaca

SEQ ID NO: 80026 - DNA, 23 bp, Homo sapiens
  misc_feature 1..23: note = chr17:1536225-1536248
  misc_feature 1..23: note = hypo
  source 1..23: mol_type = genomic DNA
atatccaggatatgtcgttaagt

SEQ ID NO: 80027 - DNA, 40 bp, Homo sapiens
  misc_feature 1..40: note = chr17:1543656-1543696
  misc_feature 1..40: note = hypo
  source 1..40: mol_type = genomic DNA
ggagggtggtgctctcggagagagccgctgagctgagggt

SEQ ID NO: 80028 - DNA, 49 bp, Homo sapiens; identical to SEQ ID NO: 44952
  misc_feature 1..49: note = chr17:1543917-1543966
  misc_feature 1..49: note = hypo
  source 1..49: mol_type = genomic DNA

SEQ ID NO: 80029 - DNA, 386 bp, Homo sapiens
  misc_feature 1..386: note = chr17:1544223-1544609
  misc_feature 1..386: note = hypo
  source 1..386: mol_type = genomic DNA
cccagccagggcaggcgagtcaccaccaagctctgagtcccatttgcgaggtctgccaggccttccctcctgctcttttcacttttcctttttccacactgagccgtccccaggtctggcatgaatgggactcagtagtgtcttctaccccatcacacgaaatgcaaaaaatgtaaagtgttttcacccaggggtcctcaaaccctgggccatggactggtactagtccgtggcatgttaggaactgggcgacagcgtagagatgaccagcaggggagcctgaccgcctgagctccgctgccagccagatcagtggtggcctcagattctcataggagcgccagtcctattgtgaactgcgcacgggagggtccaggttccatgct

SEQ ID NO: 80030 - DNA, 21 bp, Homo sapiens
  misc_feature 1..21: note = chr17:1545300-1545321
  misc_feature 1..21: note = hypo
  source 1..21: mol_type = genomic DNA
ccaccgcgcccagccagggat

SEQ ID NO: 80031 - DNA, 139 bp, Homo sapiens; identical to SEQ ID NO: 44955
  misc_feature 1..139: note = chr17:1546311-1546450
  misc_feature 1..139: note = hypo
  source 1..139: mol_type = genomic DNA

SEQ ID NO: 80032 - DNA, 15 bp, Homo sapiens
  misc_feature 1..15: note = chr17:15820731-15820746
  misc_feature 1..15: note = hyper
  source 1..15: mol_type = genomic DNA
ggcgccaggctgagc

SEQ ID NO: 80033 - DNA, 253 bp, Homo sapiens; identical to SEQ ID NO: 36399
  misc_feature 1..253: note = chr17:15820777-15821030
  misc_feature 1..253: note = hyper
  source 1..253: mol_type = genomic DNA

SEQ ID NO: 80034 - DNA, 146 bp, Homo sapiens
  misc_feature 1..146: note = chr17:15847860-15848006
  misc_feature 1..146: note = hyper
  source 1..146: mol_type = genomic DNA
agcctcgctgggaggcggccggagggggctgcagcccccgagggctccttgcagtccggccccgcagcctggagacagctccggtggtgctgcgctgcccgagactgctgcacgagcggggactgcggcctcggctccctgcctgc

SEQ ID NO: 80035 - DNA, 312 bp, Homo sapiens
  misc_feature 1..312: note = chr17:15848567-15848879
  misc_feature 1..312: note = hyper
  source 1..312: mol_type = genomic DNA
gctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggc

SEQ ID NO: 80036 - DNA, 68 bp, Homo sapiens
  misc_feature 1..68: note = chr17:15849143-15849211
  misc_feature 1..68: note = hyper
  source 1..68: mol_type = genomic DNA
ggggagtgcggtccccggcgcccggggaggcgccgtggaaaccccggggaaagcgtcacccccgggga

SEQ ID NO: 80037 - DNA, 30 bp, Homo sapiens
  misc_feature 1..30: note = chr17:15855838-15855868
  misc_feature 1..30: note = hypo
  source 1..30: mol_type = genomic DNA
aaggactgcacaccccgaggtcacccccaa

SEQ ID NO: 80038 - DNA, 38 bp, Homo sapiens
  misc_feature 1..38: note = chr17:1589533-1589571
  misc_feature 1..38: note = hypo
  source 1..38: mol_type = genomic DNA
aaagaagccgggcaccgtgactcatacctgtaatccta

SEQ ID NO: 80039 - DNA, 24 bp, Homo sapiens
  misc_feature 1..24: note = chr17:1608003-1608027
  misc_feature 1..24: note = hypo
  source 1..24: mol_type = genomic DNA
tttttttttttgagacggagtctc

SEQ ID NO: 80040 - DNA, 80 bp, Homo sapiens
  misc_feature 1..80: note = chr17:1623392-1623472
  misc_feature 1..80: note = hypo
  source 1..80: mol_type = genomic DNA
cctgccacactggtccgcagctggtgcactacttttctccctgccggattagcaagagctgaccccgctcaacatgggct

SEQ ID NO: 80041 - DNA, 32 bp, Homo sapiens; identical to SEQ ID NO: 44956
  misc_feature 1..32: note = chr17:1623703-1623735
  misc_feature 1..32: note = hypo
  source 1..32: mol_type = genomic DNA

SEQ ID NO: 80042 - DNA, 34 bp, Homo sapiens
  misc_feature 1..34: note = chr17:16255661-16255695
  misc_feature 1..34: note = hyper
  source 1..34: mol_type = genomic DNA
gagcagccaggagggcgagcggcagggagcatta

SEQ ID NO: 80043 - DNA, 97 bp, Homo sapiens
  misc_feature 1..97: note = chr17:16256941-16257038
  misc_feature 1..97: note = hyper
  source 1..97: mol_type = genomic DNA
ctgcctgttcagtcccgcaggcagaggggctgcgcctgggcctacgctcgcgatacccagaatccactcgcacctgcgaaggcgcccctgccctgtg

SEQ ID NO: 80044 - DNA, 142 bp, Homo sapiens
  misc_feature 1..142: note = chr17:1627248-1627390
  misc_feature 1..142: note = hypo
  source 1..142: mol_type = genomic DNA
tcacagagtgtgttgcgagggccaaatggaatgtgactgttgaagtacttaggaaagttaaaaagctccttcctatggaaggtggcatggaggcgccggggggattccatgtcaaaagtcccagttctggccgggcgcggtg

SEQ ID NO: 80045 - DNA, 316 bp, Homo sapiens
  misc_feature 1..316: note = chr17:16282207-16282523
  misc_feature 1..316: note = hypo
  source 1..316: mol_type = genomic DNA
cttgcacaacaagcacgtcaatgggagcaggatcagctactttcttgtaggtgaattcccgtttttgaagtggggtttcggctccctaatctgcacttttttttttcctaccagtttggagaaacagctgggaagaactggatttgcaggtattgctggagccagagcgaagcccggccactgtcaccatgggctccagcctcgcctctctgggcctggtggtgagcggcttcagcaacaggtttccggtccccgcagagggtcccactctgaactcccgatttacagactgttctcgggccgtgatgaggattaa

SEQ ID NO: 80046 - DNA, 23 bp, Homo sapiens
  misc_feature 1..23: note = chr17:16283522-16283545
  misc_feature 1..23: note = hypo
  source 1..23: mol_type = genomic DNA
tccgcgcccggccaggggcgcgc

SEQ ID NO: 80047 - DNA, 277 bp, Homo sapiens
  misc_feature 1..277: note = chr17:16310319-16310596
  misc_feature 1..277: note = hyper
  source 1..277: mol_type = genomic DNA
ctggctcaccgctccagagcgcgctcccgggtcggcctccgccctccaagccggagggaaatgctgtggtcccgccgtccgcctgcatcctccagttcctttggagggcaggggagtggagcccacaggctctgacacccttacagtccagctctgtgacttggggaagggagtggcgcatgaggagggcgaagctggagtccaaaggaaggtccttccgttcccgcccccgacccgggatccgccgaagcgactgcggaggcgggtcccaggcctg

SEQ ID NO: 80048 - DNA, 159 bp, Homo sapiens
  misc_feature 1..159: note = chr17:16432126-16432285
  misc_feature 1..159: note = hypo
  source 1..159: mol_type = genomic DNA
gactgagggaattagcgttgacaagtagaaagaactcctataatttgataaagactctgcttgaccaaactttagtcaggctcctgaaacttgtcctgggctcatctgtgcggttacttgtaaatctagttttagcaaagaacccggccaagtccgttc

SEQ ID NO: 80049 - DNA, 30 bp, Homo sapiens
  misc_feature 1..30: note = chr17:16440314-16440344
  misc_feature 1..30: note = hyper
  source 1..30: mol_type = genomic DNA
ttagaaggttataggcgcacaatcaaggaa

SEQ ID NO: 80050 - DNA, 812 bp, Homo sapiens
  misc_feature 1..812: note = chr17:16471976-16472788
  misc_feature 1..812: note = hyper
  source 1..812: mol_type = genomic DNA
gtttacaaggccctgcggaggtgatgcgacagccttgccttgcctcctgtcgcctccccttcccggccaagtccctctgcctcttactcctcttcagccgcagggtcgaggtcgagggcagcgggggagtcggggaccgtgcgacgcgcaacgctgggactgggcccacagcagcctccaccccgtctttgccctcccgcaagccacgagcacgggagcccgcgcgtggacgggctcgggctgtcactgatcgcgcggacactcgcgcgctgcgcccggacatcaatacctgtcgctgggacccggccgacgggcagccggagcggccctaaggccacaggcaacaatggcgacgctggcacaggcgcctgcgtggcgggctcagtcccgagcggcagcggatcctcgggctccgccacttcccttccccgcaaagcacagagtgtcccggccaggagctgcacgttccagcccggtcctgagaagcccggcccagaaaccccggcgcctctgcttagccgcgacctcgcctcggcgtcactgcgcatgtgcgccagaggaacgctgcgcgcccgcagagccaatcggagcccaagctgccgcctccccctcccgcgcctctggccctggacctgtctccatggcaacctcctccacccatcgctctgacttgcttgtcagcctgcgaggttccgaagggaacttcaaagtttccccgggcagacgcaggtctggtagacgtcttggaggccagggaggtgccagtagctggaggagcgccgggagttgaagccccgcgccaactacgcaga

SEQ ID NO: 80051 - DNA, 109 bp, Homo sapiens
  misc_feature 1..109: note = chr17:16492360-16492469
  misc_feature 1..109: note = hyper
  source 1..109: mol_type = genomic DNA
ggagcgccggtctcccggtcccgccgggctcacagggacggagcggcctgggattccgcccacccccttcccgccgtcagcgattcctcctcctcggagggtctgggga

SEQ ID NO: 80052 - DNA, 111 bp, Homo sapiens
  misc_feature 1..111: note = chr17:16570208-16570319
  misc_feature 1..111: note = hyper
  source 1..111: mol_type = genomic DNA
cgtggagggagcgatgcccccgcccgggactcctggtgggtgatggcgccgggaggccttggctgggacagatcggggcctcccggtcggtcagcgactcgcgcccggctg

SEQ ID NO: 80053 - DNA, 193 bp, Homo sapiens
  misc_feature 1..193: note = chr17:16570360-16570553
  misc_feature 1..193: note = hyper
  source 1..193: mol_type = genomic DNA
cgcctctcggggtccgctcccccggactggccctgcccacggagcgcgggtagcagccggcggccaggagccagtggcgggagccaccggtgggaaaaccggcaggaggctgcgctggaccccgctgggcagcgccaatccctaaggcagccgggcgggtgagctaacggcggcgggggcggctgagaggctg

SEQ ID NO: 80054 - DNA, 280 bp, Homo sapiens
  misc_feature 1..280: note = chr17:16570673-16570953
  misc_feature 1..280: note = hyper
  source 1..280: mol_type = genomic DNA
aggcggctgaggggctgaggctggtgaggggcttgaggggccgagcggataaggcggctgacgcggctgaagggactgaggggctgaggtggctcaggggctgacgcgggtgaggggctgaggggctgaaaggctgaagggcgggcagcgtgccgggtccctgcggctgggtccaccgcacgtcacgtggcagaatcccggggctgctttctctccggctgctcagccacttgttttctcactgtgaacctcgtgggctcctgctcggtgtcctttctta

SEQ ID NO: 80055 - DNA, 30 bp, Homo sapiens
  misc_feature 1..30: note = chr17:1675342-1675372
  misc_feature 1..30: note = hypo
  source 1..30: mol_type = genomic DNA
tccttctcggtgtggcgcacttcaagggtg

SEQ ID NO: 80056 - DNA, 39 bp, Homo sapiens
  misc_feature 1..39: note = chr17:16830521-16830560
  misc_feature 1..39: note = hypo
  source 1..39: mol_type = genomic DNA
gcaggcaggtgctagcggggagaccggggtgggagctgg

SEQ ID NO: 80057 - DNA, 16 bp, Homo sapiens
  misc_feature 1..16: note = chr17:1696340-1696356
  misc_feature 1..16: note = hypo
  source 1..16: mol_type = genomic DNA
agctgagaccacaagc

SEQ ID NO: 80058 - DNA, 30 bp, Homo sapiens
  misc_feature 1..30: note = chr17:16993611-16993641
  misc_feature 1..30: note = hypo
  source 1..30: mol_type = genomic DNA
ggcagaagggtcttacggccccaacccgtc

SEQ ID NO: 80059 - DNA, 59 bp, Homo sapiens
  misc_feature 1..59: note = chr17:17062602-17062661
  misc_feature 1..59: note = hypo
  source 1..59: mol_type = genomic DNA
cctagatggtttcctcgttctgactcccgatggcaggaggggcgcgagcagggcaaggc

SEQ ID NO: 80060 - DNA, 30 bp, Homo sapiens
  misc_feature 1..30: note = chr17:17067369-17067399
  misc_feature 1..30: note = hypo
  source 1..30: mol_type = genomic DNA
cagaactgggaggcccgagtgttactaacc

SEQ ID NO: 80061 - DNA, 30 bp, Homo sapiens
  misc_feature 1..30: note = chr17:17090124-17090154
  misc_feature 1..30: note = hypo
  source 1..30: mol_type = genomic DNA
tacagaaggaacattcgggaccccgctgtc

SEQ ID NO: 80062 - DNA, 30 bp, Homo sapiens
  misc_feature 1..30: note = chr17:17100986-17101016
  misc_feature 1..30: note = hypo
  source 1..30: mol_type = genomic DNA
cccatcggtgctgatcgcagccagcagccc

SEQ ID NO: 80063 - DNA, 105 bp, Homo sapiens
  misc_feature 1..105: note = chr17:17123888-17123993
  misc_feature 1..105: note = hypo
  source 1..105: mol_type = genomic DNA
ggcaagccctgagcccgaaaccccatactgcgcatgcccagcacacctgcgtttccagctctcacaaaggcttcgacagacctggctcttcgtgctaaaaagctc

SEQ ID NO: 80064 - DNA, 84 bp, Homo sapiens
  misc_feature 1..84: note = chr17:17146203-17146287
  misc_feature 1..84: note = hypo
  source 1..84: mol_type = genomic DNA
aaacggactgtgagccgatgagtagcatttactgcatgggttaattccagagtataaatttgcccttggaggccgggcgtggtg

SEQ ID NO: 80065 - DNA, 67 bp, Homo sapiens
  misc_feature 1..67: note = chr17:17204144-17204211
  misc_feature 1..67: note = hyper
  source 1..67: mol_type = genomic DNA
tctgagttggcggggcgggagttccccagatgccgctgcagttgccctgctgcggctctggcccagc

SEQ ID NO: 80066 - DNA, 30 bp, Homo sapiens
  misc_feature 1..30: note = chr17:17250180-17250210
  misc_feature 1..30: note = hypo
  source 1..30: mol_type = genomic DNA
cagctgcagcccccccgccgcaggctgcac

SEQ ID NO: 80067 - DNA, 100 bp, Homo sapiens
  misc_feature 1..100: note = chr17:17395947-17396047
  misc_feature 1..100: note = hypo
  source 1..100: mol_type = genomic DNA
aagagcagttctctccgttgcctctcgaggaggaggtgcgaagtcctggagtattgtttgggtctcggaatgggcgcataacctgcgctgaccagtttag

SEQ ID NO: 80068 - DNA, 531 bp, Homo sapiens
  misc_feature 1..531: note = chr17:17398606-17399137
  misc_feature 1..531: note = hyper
  source 1..531: mol_type = genomic DNA
cttcttgttccgcagcgccttcttgtgcagcacgtcgcagtactgcaccgagaccttgcggtgcaggtctgggctcatctcgctgggcagcttggccatggcgaagagcgcgcggaacatctggtccaggctgctgttcttcttggccgagatctcgaagtaggcgcagcgctgggggtcgtcgcccaccagctgctcgatctcgcgctggtccacctcgcggtagaagtcgcggtcacccttgttgccgcagatgaccaggggcacgtccacgttctccttggttttgttcttgaggcaagacttggtgtcgaggatctgctgcctgagccgctgcacctcctcgaaggagtcgcggttgtccagactgaacaccaggatgaaaacgtctcctagagggggcacagagagcagaaaaggagaaggtgagggtggccgcccaggggacaagtcgggctgactttgaggccgcgcggggcgcgctagcctctctaagcgcgaagcgcactactcggcgcgcggcagccggac

SEQ ID NO: 80069 - DNA, 153 bp, Homo sapiens
  misc_feature 1..153: note = chr17:17399419-17399572
  misc_feature 1..153: note = hyper
  source 1..153: mol_type = genomic DNA
gatagcagttcttggccgggatactcagctccgagtcgctcgggcacatcttcttgatcatcgcggccagtttcattgggcagaggggccgcgagggcgggcgcggggccgagagaagggcagagagcggctgagggtcgctggggtggcacg

SEQ ID NO: 80070 - DNA, 30 bp, Homo sapiens
  misc_feature 1..30: note = chr17:17466959-17466989
  misc_feature 1..30: note = hypo
  source 1..30: mol_type = genomic DNA
gggtggcaggcaaagcgacaggtgtactgg

SEQ ID NO: 80071 - DNA, 198 bp, Homo sapiens
  misc_feature 1..198: note = chr17:17579330-17579528
  misc_feature 1..198: note = hypo
  source 1..198: mol_type = genomic DNA
ccatccagttttcatcgcagaggaggcggggcggcagcgtgggcaggagctcaggccaggagaatccctactctaagtatgactgtgtgatcttgggcaagtgacttcattccctaagtgtgtttcctcatctgaacaaggaggctattgaaatgcaggtgagacctagtgagacagcggctgcgggaatcacctggc

SEQ ID NO: 80072 - DNA, 39 bp, Homo sapiens; identical to SEQ ID NO: 45009
  misc_feature 1..39: note = chr17:17592178-17592217
  misc_feature 1..39: note = hypo
  source 1..39: mol_type = genomic DNA

SEQ ID NO: 80073 - DNA, 30 bp, Homo sapiens
  misc_feature 1..30: note = chr17:17612465-17612495
  misc_feature 1..30: note = hypo
  source 1..30: mol_type = genomic DNA
gagggcctagtgtgccgggcactgtgctga

SEQ ID NO: 80074 - DNA, 46 bp, Homo sapiens
  misc_feature 1..46: note = chr17:17687009-17687055
  misc_feature 1..46: note = hyper
  source 1..46: mol_type = genomic DNA
tcctcgcccccgccccggatctggtcctggccggggcgcccggtga

SEQ ID NO: 80075 - DNA, 36 bp, Homo sapiens
  misc_feature 1..36: note = chr17:17700921-17700957
  misc_feature 1..36: note = hypo
  source 1..36: mol_type = genomic DNA
aaggggcgtgccaagcgacgacgacagcagcaggtg

SEQ ID NO: 80076 - DNA, 183 bp, Homo sapiens
  misc_feature 1..183: note = chr17:17717969-17718152
  misc_feature 1..183: note = hypo
  source 1..183: mol_type = genomic DNA
gcacagccgctcagccgcctcctcatcccgccgcagccagtggatcaccacagctgtcagagaggcccaccacttggccaccgggtctacgcctgcagaagagggagggtcccctgaaccctcagtcacgctgcacgggggagctgagaagggagccaggacaggggccggggactcaccggt

SEQ ID NO: 80077 - DNA, 30 bp, Homo sapiens
  misc_feature 1..30: note = chr17:17750275-17750305
  misc_feature 1..30: note = hypo
  source 1..30: mol_type = genomic DNA
gcctgcagggaccctcggtgccaggctcgg

SEQ ID NO: 80078 - DNA, 114 bp, Homo sapiens
  misc_feature 1..114: note = chr17:17891258-17891372
  misc_feature 1..114: note = hypo
  source 1..114: mol_type = genomic DNA
caacattgagaccatcgaggggctggacacactggtgaacctggaggacctgagcttgttcaacaaccggatctccaagatcgactccctggacgccctcgtcaagctgcaggt

SEQ ID NO: 80079 - DNA, 40 bp, Homo sapiens; identical to SEQ ID NO: 45011
  misc_feature 1..40: note = chr17:17910311-17910351
  misc_feature 1..40: note = hypo
  source 1..40: mol_type = genomic DNA

SEQ ID NO: 80080 - DNA, 38 bp, Homo sapiens; identical to SEQ ID NO: 45012
  misc_feature 1..38: note = chr17:18070928-18070966
  misc_feature 1..38: note = hypo
  source 1..38: mol_type = genomic DNA

SEQ ID NO: 80081 - DNA, 48 bp, Homo sapiens
  misc_feature 1..48: note = chr17:1811643-1811691
  misc_feature 1..48: note = hyper
  source 1..48: mol_type = genomic DNA
tcgcccgggacttcccgtcctccaagcctgcgtcggctgtgccaggtt

SEQ ID NO: 80082 - DNA, 142 bp, Homo sapiens
  misc_feature 1..142: note = chr17:18127894-18128036
  misc_feature 1..142: note = hypo
  source 1..142: mol_type = genomic DNA
gcttggcagccgcctcgggctcagaggtcagctcctgctccctggacacagctggtggggttggggcctgtcctacctgccccacctaagcttctaggacctcccgcagccccagccctgagccaggcggcctatcctcagc

SEQ ID NO: 80083 - DNA, 38 bp, Homo sapiens
  misc_feature 1..38: note = chr17:18157976-18158014
  misc_feature 1..38: note = hypo
  source 1..38: mol_type = genomic DNA
ggttggggatggtgtcgatgctacgggtggggagcagg

SEQ ID NO: 80084 - DNA, 261 bp, Homo sapiens
  misc_feature 1..261: note = chr17:18163093-18163354
  misc_feature 1..261: note = hypo
  source 1..261: mol_type = genomic DNA
cagtttcctcatttgtaaaatactttctaaggttgtcaccatgagcaaattaacaaagaatgcacgtgtagctcgcagcatacagcaggcgctcagtgagtggcaggttattattccgttttgttttgttttgtgcgccaggttattattcccacttagtgtcagcacccctgtgctcgtacccccctacaaagggaggctccagaagagaagcatccgtcttggtccttgctgttcaagggggctcgccctggctgacac

SEQ ID NO: 80085 - DNA, 222 bp, Homo sapiens
  misc_feature 1..222: note = chr17:1819556-1819778
  misc_feature 1..222: note = hypo
  source 1..222: mol_type = genomic DNA
tgctgggagaggggacgtctcttccgtggaaaagcagcatctgtaatggagtccttagcaatggcagagggaggggtgatgtggggaaatgcacaaagctgagcgtgaagtgtaaatatgatgattgttgtctctttcttgggaggtaaataaatcagctcgatgtagatttgagaggtggctggtgatgctgtgtactcagcgccccgaactcggcctctt

SEQ ID NO: 80086 - DNA, 30 bp, Homo sapiens
  misc_feature 1..30: note = chr17:1824581-1824611
  misc_feature 1..30: note = hypo
  source 1..30: mol_type = genomic DNA
ccaggtgggaggcggcgttgcggaggagcc

SEQ ID NO: 80087 - DNA, 30 bp, Homo sapiens
  misc_feature 1..30: note = chr17:18267413-18267443
  misc_feature 1..30: note = hypo
  source 1..30: mol_type = genomic DNA
gacggagcgagacaacgtctcaagaagaat

SEQ ID NO: 80088 - DNA, 196 bp, Homo sapiens
  misc_feature 1..196: note = chr17:18314944-18315140
  misc_feature 1..196: note = hyper
  source 1..196: mol_type = genomic DNA
ttctcctctcccaatcgtcttctttcccagcctcttctccattttcttgccgcctccatatccccaccttcttctcgcagcagcgtcttcctgccgcgcttttctctcccctcaccatcttctcttcctcttccccaccgtcctctccccacgccctcttctcctcactgtcttctccccgcgccttccccacaac

SEQ ID NO: 80089 - DNA, 86 bp, Homo sapiens
  misc_feature 1..86: note = chr17:1832993-1833079
  misc_feature 1..86: note = hypo
  source 1..86: mol_type = genomic DNA
tgtcccacactaggctgcatgagactgcacaagggagagaggcaggacgccgtgccagagaggcatgtgcacgtgtgtgtgcaaaa

SEQ ID NO: 80090 - DNA, 43 bp, Homo sapiens
  misc_feature 1..43: note = chr17:1835919-1835962
  misc_feature 1..43: note = hypo
  source 1..43: mol_type = genomic DNA
gcggcaaggttgccacggtcagaaaccacgtgcctatggacag

SEQ ID NO: 80091 - DNA, 34 bp, Homo sapiens
  misc_feature 1..34: note = chr17:18538112-18538146
  misc_feature 1..34: note = hyper
  source 1..34: mol_type = genomic DNA
cctcagcccctcagccgcctcagcccctcagccc

SEQ ID NO: 80092 - DNA, 93 bp, Homo sapiens
  misc_feature 1..93: note = chr17:18538206-18538299
  misc_feature 1..93: note = hyper
  source 1..93: mol_type = genomic DNA
ccacgcctctgctcgctcacccgcccggctgccttaggggtcggcgctgcccagcgggctccagcgcagcctcctacccggcatcccaccggc

SEQ ID NO: 80093 - DNA, 120 bp, Homo sapiens
  misc_feature 1..120: note = chr17:18760619-18760739
  misc_feature 1..120: note = hypo
  source 1..120: mol_type = genomic DNA
cctggacaacagagcgaaactccgtctcaaaacaaaaaactaacaaacgaacaaaaaactgatcatttattatacacccagaactgtgcttttagcacagttttgttttgttttgttttg

SEQ ID NO: 80094 - DNA, 30 bp, Homo sapiens
  misc_feature 1..30: note = chr17:1887214-1887244
  misc_feature 1..30: note = hypo
  source 1..30: mol_type = genomic DNA
aaccctgctccctcccggctgggacatgta

SEQ ID NO: 80095 - DNA, 296 bp, Homo sapiens
  misc_feature 1..296: note = chr17:1901493-1901789
  misc_feature 1..296: note = hyper
  source 1..296: mol_type = genomic DNA
cctttgggggaggggcggggagggctgtcgcattgatccggagctgcagggcgagggcggtgcccagacccggcgccccaaggcctcccgcaggccgacccgagccgagcgcgccctttgggcaccggccccgcccgggagggtcttctcgctctagagccgggggcccgcgctgagagatcggggttaccgcgcggggagccgcggccgcgctgggatccgttccctctcgcgggagccgccggccggggatctgcgcaccccacgcgccccgctcgggtcgggcctcccctccc

SEQ ID NO: 80096 - DNA, 157 bp, Homo sapiens
  misc_feature 1..157: note = chr17:1901813-1901970
  misc_feature 1..157: note = hyper
  source 1..157: mol_type = genomic DNA
cgctgcccagcgcgcaggtccctgccggatccccggcggctttcctgcccccactttacagacgtgaacgctgaggcggagggtgggggacgtggggccggctcgcctcctcctgggctcgccgggatgtggcctccgaggtcgccgcggcgctttc

SEQ ID NO: 80097 - DNA, 30 bp, Homo sapiens
  misc_feature 1..30: note = chr17:19211734-19211764
  misc_feature 1..30: note = hypo
  source 1..30: mol_type = genomic DNA
tagttgtccatctgtcgacctgtgcatgca

SEQ ID NO: 80098 - DNA, 34 bp, Homo sapiens; identical to SEQ ID NO: 45015
  misc_feature 1..34: note = chr17:19230161-19230195
  misc_feature 1..34: note = hypo
  source 1..34: mol_type = genomic DNA

SEQ ID NO: 80099 - DNA, 41 bp, Homo sapiens
  misc_feature 1..41: note = chr17:19230676-19230717
  misc_feature 1..41: note = hypo
  source 1..41: mol_type = genomic DNA
tattcatataaagttcggaaaatagggacttggcatggtgg

SEQ ID NO: 80100 - DNA, 300 bp, Homo sapiens
  misc_feature 1..300: note = chr17:1927406-1927706
  misc_feature 1..300: note = hyper
  source 1..300: mol_type = genomic DNA
gcaccaactttgccgcgctccgtaccgggccgggctgctggggcgtctagctacggtggtcgcgaagccagctgtcctcaagttgagctgtgcaccggtcgcgcacactggcggcacggctttcgcgtccctccgctcccagcataatgaaagtttgaggaactggacatcaggcgctggccgctccccaccctcagccgctgggtgcccagagcccatccctagcgatcagagcagaactgcagagaagacgtccgcgtccgggccccgtctggggagctagggcgcgcggggagcgcc

SEQ ID NO: 80101 - DNA, 290 bp, Homo sapiens
  misc_feature 1..290: note = chr17:1927990-1928280
  misc_feature 1..290: note = hyper
  source 1..290: mol_type = genomic DNA
ccagcagcagcccctcggcgggtgcgcccggcaaaacccaccagcccgccgggggctacttcccagaccgggagccccggcgccgggcggcgcccgggctcgcggctctttccggagcgcattcaacttcaacttgcccctgcggctccaactcacctttgcgaagcatgttggccacggggccgccgctccgaggtcggcctaggcgcactccctcccggggtccagattcaaatccctgggcgccagctgcagctaatccgagcgcgtcgaggcgggggcaagccggg

SEQ ID NO: 80102 - DNA, 844 bp, Homo sapiens
  misc_feature 1..844: note = chr17:19436820-19437664
  misc_feature 1..844: note = hyper
  source 1..844: mol_type = genomic DNA
ctctgggtccttccacgccaggtcattcagaacctgaaacccccagcggaggtggagagccggggtgagtcctggcgtccgagacgtggaggacccagcccccggagcgcgttccgttagtttacagagctttttcaaactttgccttccaagtgcaggagttccttggtctttgcaagacccgcaggcgtccgcagtggtgcagagagaggtgcaaggggcgcgcccaaggtcgcaggctgcctggctgcgcgctcagtcgggcccccgggcgccaggcgcggggcgggctctgggcgggcggccggggcggggactgcagagcaggctgcactgcgcggtacccactgccggcctgcgcggtactcactgccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcggtgagtaaggtggcctcagtggcaggccggtaccggcgggctggggacctggtgatttctgcctccgcgggtgactttggcgggctttggggaccgagcgagctgtccgccggcgggctccggggagcatcgtgccaggagccgggcgggcaccccagctcctctgcctgcgtcccggccgctttccgctccgcaccacccgactgggggccccgcggggcactgcgggaacggctggtacgcgcccgggcgcatgttggctcggagaggccggcgg

SEQ ID NO: 80103 - DNA, 30 bp, Homo sapiens
  misc_feature 1..30: note = chr17:19482865-19482895
  misc_feature 1..30: note = hyper
  source 1..30: mol_type = genomic DNA
aagcatgccagaaagcgccagccctgtgct

SEQ ID NO: 80104 - DNA, 312 bp, Homo sapiens
  misc_feature 1..312: note = chr17:19483115-19483427
  misc_feature 1..312: note = hyper
  source 1..312: mol_type = genomic DNA
cctgggcgtctggagcgggtccgggacggggaggggcggggctgggtgggatcgggtcgcccccctcacccccacaccgcgctgcggtcccgcgcccgcgccgccgccagccgctcccagcctccgcatggaggcccctgcggccgccgacgccccggtccccgccgagctccccgccgccgccaaggaccggcccccatagcggctccgggccctcggatggcgtgacggcttgtggggcctgcggggtgcgctgcccccggacctgcggggggaggcggctgagctggcggcgctcgcgggcccagtggt

SEQ ID NO: 80105 - DNA, 262 bp, Homo sapiens
  misc_feature 1..262: note = chr17:1956915-1957177
  misc_feature 1..262: note = hyper
  source 1..262: mol_type = genomic DNA
atccagaacatggggcggactcaggcagcggcgggaatcaggcggactcgtttggaccgaagcctccgccaggcaccgaagccgtgaagtcgcctgcgcagcaaagggagcctccggggggcgcccgagaccttggtgtcgctcgggggccgctggtagccgcgcccgctgcccctcgcccggtgactcagccggtacctctggcggggccatgggggccagaggacagcgcggggggcggcgagcgcggttgctaagctct

SEQ ID NO: 80106 - DNA, 115 bp, Homo sapiens
  misc_feature 1..115: note = chr17:1957480-1957595
  misc_feature 1..115: note = hyper
  source 1..115: mol_type = genomic DNA
ttctcccagaagagacgtcacccacacaaacctgaccttcacgtggggcgcgggaccttgcggggtcccagccgcaggcgcccctgttgtttccttcgggcgggtgggttggaga

SEQ ID NO: 80107 - DNA, 132 bp, Homo sapiens; identical to SEQ ID NO: 36334
  misc_feature 1..132: note = chr17:1959132-1959264
  misc_feature 1..132: note = hyper
  source 1..132: mol_type = genomic DNA

SEQ ID NO: 80108 - DNA, 198 bp, Homo sapiens
  misc_feature 1..198: note = chr17:1959436-1959634
  misc_feature 1..198: note = hyper
  source 1..198: mol_type = genomic DNA
gggccccgaccgagggttgacagcccccggccagggcggcgccagggcgggcaccgcgctcccctcctccgtatcacttcccccaactggggcaacttctcccgaggcgggaggcgctggttcctcggctccctttctccctacttgggtaaagttctccgccctgaatgacttttcctgaagcggacattttactta

SEQ ID NO: 80109 - DNA, 30 bp, Homo sapiens
  misc_feature 1..30: note = chr17:19611097-19611127
  misc_feature 1..30: note = hypo
  source 1..30: mol_type = genomic DNA
agagaaggaggaagacggtctgtgcaaact

SEQ ID NO: 80110 - DNA, 49 bp, Homo sapiens
  misc_feature 1..49: note = chr17:19618412-19618461
  misc_feature 1..49: note = hypo
  source 1..49: mol_type = genomic DNA
caagctgggtactcacggccaccgcgagggtcaccgatgccagctccac

SEQ ID NO: 80111 - DNA, 228 bp, Homo sapiens
  misc_feature 1..228: note = chr17:19622428-19622656
  misc_feature 1..228: note = hypo
  source 1..228: mol_type = genomic DNA
actgcacacaacagacggatcagcagctcactctcaggaacagggctgccaatcccctagaatatacaagcaagtccgggcgatgctggaccctttcccttctcagctgatcacttgtttccaaggcccttatttcctggggcacatggcctatgacattctcccgatgccagttgccgtgtcagccacgttctctgatggaaacagtagaaacgaactgggatcatg

SEQ ID NO: 80112 - DNA, 177 bp, Homo sapiens
  misc_feature 1..177: note = chr17:19648102-19648279
  misc_feature 1..177: note = hyper
  source 1..177: mol_type = genomic DNA
cgggggcgcgcggggcgcggcggaggggagggcggtgcgcccagtctccgcgaccgaggggccaggtggccccaagtccttcctgaacctctctgggtcgcactctccccagcccctccccccacgccccatcgcatggccccgacactggcagaaggcggccgcccagcctgagca

SEQ ID NO: 80113 - DNA, 95 bp, Homo sapiens
  misc_feature 1..95: note = chr17:19769817-19769912
  misc_feature 1..95: note = hypo
  source 1..95: mol_type = genomic DNA
ctcaaaaataaataaataaataaataagaaaagtagcattacttcatccgataagcaacaaagtcagcccacttttaacacgccccttgggcaac

SEQ ID NO: 80114 - DNA, 470 bp, Homo sapiens
  misc_feature 1..470: note = chr17:19770389-19770859
  misc_feature 1..470: note = hyper
  source 1..470: mol_type = genomic DNA
ccgcggggtgggccccgggcacacaggaggatcagcagcagccggtcggtaggcggagcgctgccagaggcttgggcctcacaacaaccctcacaggaccaaaacaaacggcgagacgggctgcgcgcacaatagcatacccgggcggctagccgagtcgggggtctcggctcgcggctgcgccaagtttcagaaccacctagccccgtgcctgccgcccggggcccggcctcgccccggccggcgctcacctggcggtgccgcccccggaagaccacggcgaaggccccgtgtcccacgagatccctcttgctgtactcgaagtcacccaccacctccatggccgcgcccccggggcacacagcggacgggcgggcggcgcagtgcggcgcaggtatcagcaccgcggctccgcgggcccggagcgcgccagcgtgcggcgggtctggggcagccgcagccccgggccc

SEQ ID NO: 80115 - DNA, 135 bp, Homo sapiens
  misc_feature 1..135: note = chr17:19771274-19771409
  misc_feature 1..135: note = hyper
  source 1..135: mol_type = genomic DNA
ccttgaaggccgcagcgccagccggctccctccgccggggaaaggagtgcggccagggcttggcgcccgcagctgggcagatcctcggccgctcctgaggcggggacgaagggcgcgacccgctgcggccacagc

SEQ ID NO: 80116 - DNA, 118 bp, Homo sapiens; identical to SEQ ID NO: 45018
  misc_feature 1..118: note = chr17:19771594-19771712
  misc_feature 1..118: note = hypo
  source 1..118: mol_type = genomic DNA

SEQ ID NO: 80117 - DNA, 150 bp, Homo sapiens
  misc_feature 1..150: note = chr17:19890251-19890401
  misc_feature 1..150: note = hypo
  source 1..150: mol_type = genomic DNA
cagccccagtccatttttaaataaggaaaggaatgtgagctggggccgtagcatgcctgggcatgtagtaaaatcagaaagaaggaaaaggagaagaaaggcggggggtggtacttggaattagagaataagaagcggatcagcctgttt

SEQ ID NO: 80118 - DNA, 41 bp, Homo sapiens
  misc_feature 1..41: note = chr17:19925117-19925158
  misc_feature 1..41: note = hypo
  source 1..41: mol_type = genomic DNA
ggattacaggcgtgagccactgcacccggccatcccaaggc

SEQ ID NO: 80119 - DNA, 30 bp, Homo sapiens
  misc_feature 1..30: note = chr17:19985359-19985389
  misc_feature 1..30: note = hypo
  source 1..30: mol_type = genomic DNA
gccgttctgggcctccgccatccaccgcca

SEQ ID NO: 80120 - DNA, 189 bp, Homo sapiens
  misc_feature 1..189: note = chr17:19995800-19995989
  misc_feature 1..189: note = hypo
  source 1..189: mol_type = genomic DNA
caggtgtgtttccctcgcttctttctctctttcacatttccaagtgaaaatagtcttctctgtgtagaagagtgtgttccttggatctgatatgtctgtctgcctcctgccctgaacacacatttaattgacccatcactgtgtgctgctgagtcagaaggcagagcagcgctccgttgaacaccatca

SEQ ID NO: 80121 - DNA, 34 bp, Homo sapiens
  misc_feature 1..34: note = chr17:20008373-20008407
  misc_feature 1..34: note = hypo
  source 1..34: mol_type = genomic DNA
acaactctagagatacgccaactgctttctcttt

SEQ ID NO: 80122 - DNA, 30 bp, Homo sapiens
  misc_feature 1..30: note = chr17:20014279-20014309
  misc_feature 1..30: note = hypo
  source 1..30: mol_type = genomic DNA
agctgggaagagcctcgcccagcagctgtg

SEQ ID NO: 80123 - DNA, 30 bp, Homo sapiens
  misc_feature 1..30: note = chr17:20108333-20108363
  misc_feature 1..30: note = hypo
  source 1..30: mol_type = genomic DNA
gtcgccagatgcttccgactttgagcacat

SEQ ID NO: 80124 - DNA, 30 bp, Homo sapiens
  misc_feature 1..30: note = chr17:2015149-2015179
  misc_feature 1..30: note = hypo
  source 1..30: mol_type = genomic DNA
tgcagcttgcacacccgctccatgcagttt

SEQ ID NO: 80125 - DNA, 30 bp, Homo sapiens
  misc_feature 1..30: note = chr17:20218717-20218747
  misc_feature 1..30: note = hypo
  source 1..30: mol_type = genomic DNA
atctggtggctctgccgtgttcttctgggc

SEQ ID NO: 80126 - DNA, 30 bp, Homo sapiens
  misc_feature 1..30: note = chr17:20516049-20516079
  misc_feature 1..30: note = hypo
  source 1..30: mol_type = genomic DNA
acaagcagtctgggccgagacagcatgagc

SEQ ID NO: 80127 - DNA, 241 bp, Homo sapiens
  misc_feature 1..241: note = chr17:20747219-20747460
  misc_feature 1..241: note = hyper
  source 1..241: mol_type = genomic DNA
gacgacctactgcttcgacgccttccctaagtgagcggcccgggcggggacggaggcggggcggggacggaggcggggcggggcccgggccgggcgctaagtctcacccgctccacgcccctcccgcagcatcgagaaggtgtcctagatcacgtcgcccgtgctcatcatccacggcacggaggacgaggtgatcgacttctcgcacgggctggcgctctacgagcgctgccccaaggcg

SEQ ID NO: 80128 - DNA, 183 bp, Homo sapiens
  misc_feature 1..183: note = chr17:20755766-20755949
  misc_feature 1..183: note = hyper
  source 1..183: mol_type = genomic DNA
tcaccgagcgcacctcgcaatctctgatcttcgaacccactgaaaaagcacaaggcatggggagtcctgttggttcacgccccgggtgcgaataccaaaagcaactcccgctggaaagcctgcaggaaactcgagacaaagacagaggcaaacgcaacgctgggaagagccaggggtgctgcc

SEQ ID NO: 80129 - DNA, 196 bp, Homo sapiens
  misc_feature 1..196: note = chr17:20755950-20756146
  misc_feature 1..196: note = hyper
  source 1..196: mol_type = genomic DNA
tctgcaaaagcagagacgcgtctcccttcgggcaaagtgactgctacaaagtctgttccctcctgcgcagggacagagacatttaaaggcctgaacggacgtcagcaccagtagagctcgctgggtgagcgccaggcctccccgccccaaggatagcgcgcacagggcgatctgctgctcgcgaggtagaaagtgg

SEQ ID NO: 80130 - DNA, 198 bp, Homo sapiens
  misc_feature 1..198: note = chr17:20771771-20771969
  misc_feature 1..198: note = hypo
  source 1..198: mol_type = genomic DNA
cagtccaggaacctccgtgggcattaccgcagtatataaatgatgctgaagcggaaacacgttttttcaagttcctgtatttttatgtggagttgctcactgcccaacgtagaggactaggaatcaggagtcggtggccgtatgctggaggctggagccgcgggagcgcggctcgcctcgctgcggttgttggcagtg

SEQ ID NO: 80131 - DNA, 78 bp, Homo sapiens
  misc_feature 1..78: note = chr17:20813557-20813635
  misc_feature 1..78: note = hypo
  source 1..78: mol_type = genomic DNA
aacaatacactgtaacgatgatgacagaataatataaaatgagacccctttctgctctaatcatatgaaaatagcaca

SEQ ID NO: 80132 - DNA, 39 bp, Homo sapiens
  misc_feature 1..39: note = chr17:20817539-20817578
  misc_feature 1..39: note = hypo
  source 1..39: mol_type = genomic DNA
agcccagcaatgaaccgagtcagtgacattacagacttc

SEQ ID NO: 80133 - DNA, 39 bp, Homo sapiens
  misc_feature 1..39: note = chr17:20817878-20817917
  misc_feature 1..39: note = hypo
  source 1..39: mol_type = genomic DNA
aaaaaaaaaaaaatgtgactctttcgaaaaaaaaaagag

SEQ ID NO: 80134 - DNA, 114 bp, Homo sapiens
  misc_feature 1..114: note = chr17:21104001-21104115
  misc_feature 1..114: note = hypo
  source 1..114: mol_type = genomic DNA
atgtacctgaagctccgaatgtgcctgacaggaactagcttcctttcatggctaacgagaagcacagccctcagtgtgcacagacgcgaaggtcccgtccgcccagcctgtcct

SEQ ID NO: 80135 - DNA, 145 bp, Homo sapiens
  misc_feature 1..145: note = chr17:21147453-21147598
  misc_feature 1..145: note = hypo
  source 1..145: mol_type = genomic DNA
aggcatctgggacctcggtgtgctgcaggtccacgatccgcttgcccacgtactcatagagcaggacggcccggtcatgacatcctgggggttgtggagacaggtaagcctatgctgactcccatcccagcggactcaggcacca

SEQ ID NO: 80136 - DNA, 64 bp, Homo sapiens
  misc_feature 1..64: note = chr17:21150794-21150858
  misc_feature 1..64: note = hypo
  source 1..64: mol_type = genomic DNA
ccatcccactaaacacgattctcacagccccatgtacagatggggaaaccgaggcccaggaggg

SEQ ID NO: 80137 - DNA, 27 bp, Homo sapiens
  misc_feature 1..27: note = chr17:21168792-21168819
  misc_feature 1..27: note = hypo
  source 1..27: mol_type = genomic DNA
acctgaggctcttaacgattctctgga

SEQ ID NO: 80138 - DNA, 30 bp, Homo sapiens
  misc_feature 1..30: note = chr17:21178051-21178081
  misc_feature 1..30: note = hypo
  source 1..30: mol_type = genomic DNA
ggactctgcaacctccgcctctcggattca

SEQ ID NO: 80139 - DNA, 196 bp, Homo sapiens
  misc_feature 1..196: note = chr17:21859901-21860097
  misc_feature 1..196: note = hypo
  source 1..196: mol_type = genomic DNA
gcaaaacttttcttgcgcatttctgcgctggaacgcctacccgctccgccaaaccaaaactttactatcacccttagtgccgtgtcctgcactttcttggagatttgtaccaggcgctggagactctcccacctggtccatgcccgccgcccggtgagcactgagacccaaccttgtgcaccgccagtcttgttat

SEQ ID NO: 80140 - DNA, 37 bp, Homo sapiens
  misc_feature 1..37: note = chr17:21911061-21911098
  misc_feature 1..37: note = hypo
  source 1..37: mol_type = genomic DNA
tcaggcctgccaggacggtgttcgggtgagtctcccc

SEQ ID NO: 80141 - DNA, 30 bp, Homo sapiens
  misc_feature 1..30: note = chr17:21953249-21953279
  misc_feature 1..30: note = hypo
  source 1..30: mol_type = genomic DNA
acaaagatcatccatcggacatctggtcgc

SEQ ID NO: 80142 - DNA, 120 bp, Homo sapiens
  misc_feature 1..120: note = chr17:2207847-2207967
  misc_feature 1..120: note = hypo
  source 1..120: mol_type = genomic DNA
tttaaaaactagatacgatatagttggaatcgtgtggaaggaagtacatcaggaggcatataagtccatttgggacctgtaatcccggcgactcggaacgctgagacgggcggatcgctt

SEQ ID NO: 80143 - DNA, 36 bp, Homo sapiens
  misc_feature 1..36: note = chr17:2208027-2208063
  misc_feature 1..36: note = hypo
  source 1..36: mol_type = genomic DNA
gtctccaacagagcgagactccgcctcaaaaaaaaa

SEQ ID NO: 80144 - DNA, 86 bp, Homo sapiens
  misc_feature 1..86: note = chr17:2220973-2221059
  misc_feature 1..86: note = hypo
  source 1..86: mol_type = genomic DNA
ccgggataacggagactccatctcaaaaaaataaaaaataaagatgcacatgagatatttaagaggtaaatcgataagatttggtg

SEQ ID NO: 80145 - DNA, 39 bp, Homo sapiens
  misc_feature 1..39: note = chr17:2237982-2238021
  misc_feature 1..39: note = hypo
  source 1..39: mol_type = genomic DNA
gcaaataggtaggcccgccgatctcgaaaagcaagatgc

SEQ ID NO: 80146 - DNA, 30 bp, Homo sapiens
  misc_feature 1..30: note = chr17:2250051-2250081
  misc_feature 1..30: note = hypo
  source 1..30: mol_type = genomic DNA
gccagtggagggtggcgctaggagaatgga

SEQ ID NO: 80147 - DNA, 66 bp, Homo sapiens
  misc_feature 1..66: note = chr17:2264699-2264765
  misc_feature 1..66: note = hypo
  source 1..66: mol_type = genomic DNA
tgtgtgcgcaccaggcgagggagagggacagcttggcatgtcaaagctcttcgccccgggcaggag

SEQ ID NO: 80148 - DNA, 36 bp, Homo sapiens
  misc_feature 1..36: note = chr17:2270585-2270621
  misc_feature 1..36: note = hypo
  source 1..36: mol_type = genomic DNA
tagcggccagccgcgcggcctcggtggacgatgatg

SEQ ID NO: 80149 - DNA, 148 bp, Homo sapiens
  misc_feature 1..148: note = chr17:2298883-2299031
  misc_feature 1..148: note = hypo
  source 1..148: mol_type = genomic DNA
cagcccagccaggcacgggggaaagtgccgggggcacagcagtgaacaaatcaagcagacctgttccccgccaccagggaatagtaggacagtcacgggggctgacagtcacgggggctgacagtccgggctgcgggcaggacaggcg

SEQ ID NO: 80150 - DNA, 44 bp, Homo sapiens
  misc_feature 1..44: note = chr17:2495626-2495670
  misc_feature 1..44: note = hypo
  source 1..44: mol_type = genomic DNA
ttaaaaatcaagggtcggctgagcacggtggctcacgcctgtaa

SEQ ID NO: 80151 - DNA, 44 bp, Homo sapiens
  misc_feature 1..44: note = chr17:2529816-2529860
  misc_feature 1..44: note = hypo
  source 1..44: mol_type = genomic DNA
atgacaaacttgaaccggcatcacctttcttccccccccccccc

SEQ ID NO: 80152 - DNA, 30 bp, Homo sapiens
  misc_feature 1..30: note = chr17:25309119-25309149
  misc_feature 1..30: note = hypo
  source 1..30: mol_type = genomic DNA
ggacggagaccacgacggccgaagccggga

SEQ ID NO: 80153 - DNA, 148 bp, Homo sapiens
  misc_feature 1..148: note = chr17:2538042-2538190
  misc_feature 1..148: note = hypo
  source 1..148: mol_type = genomic DNA
ttgcttgctcagcttcgtcctgagtcatcacccgcaggtggcaatacttgtcacattattcacgctgttttaattgccttcttggccgatgcttccagtagactgtaacttcttgaatgtaaagaccaagtccagccaggtgtggtgg

SEQ ID NO: 80154 - DNA, 40 bp, Homo sapiens
  misc_feature 1..40: note = chr17:25432176-25432216
  misc_feature 1..40: note = hypo
  source 1..40: mol_type = genomic DNA
tattcggccatcttggctcctcccccgtggagattttttt

SEQ ID NO: 80155 - DNA, 142 bp, Homo sapiens; identical to SEQ ID NO: 1616
  misc_feature 1..142: note = chr17:25620573-25620715
  misc_feature 1..142: note = hypo
  source 1..142: mol_type = genomic DNA

SEQ ID NO: 80156 - DNA, 163 bp, Homo sapiens
  misc_feature 1..163: note = chr17:25676870-25677033
  misc_feature 1..163: note = hypo
  source 1..163: mol_type = genomic DNA
gggctgtcacacccccgcctggtgtgcgcatgctaggggcagtgctgacacgctccactggtttcagatcaactttggagaatttggcgatagctagttaaagccgaagatgtgcatgcactgtgatctagcaaccatatgcctcgcaaaacaggccgggcgc

SEQ ID NO: 80157 - DNA, 18 bp, Homo sapiens
  misc_feature 1..18: note = chr17:25680258-25680276
  misc_feature 1..18: note = hypo
  source 1..18: mol_type = genomic DNA
cctgtaatcccagcacgt

SEQ ID NO: 80158 - DNA, 30 bp, Homo sapiens
  misc_feature 1..30: note = chr17:25825913-25825943
  misc_feature 1..30: note = hypo
  source 1..30: mol_type = genomic DNA
ggaagaagcaaagggcggcatgaggcactg

SEQ ID NO: 80159 - DNA, 30 bp, Homo sapiens
  misc_feature 1..30: note = chr17:25879017-25879047
  misc_feature 1..30: note = hypo
  source 1..30: mol_type = genomic DNA
accttctcctttgctcggtagactctaacc

SEQ ID NO: 80160 - DNA, 160 bp, Homo sapiens
  misc_feature 1..160: note = chr17:25907710-25907870
  misc_feature 1..160: note = hypo
  source 1..160: mol_type = genomic DNA
gaagaacagatattgcgggagggaggagggaggcagggcttgtgcaatacaggtgcgtcagtcccttctcacaggctgtaaagaaatacctgaaactggattggttatttatttatttatgagacggcctggagtgcagtggcgcgatcttggctcactg

SEQ ID NO: 80161 - DNA, 60 bp, Homo sapiens
  misc_feature 1..60: note = chr17:25928294-25928354
  misc_feature 1..60: note = hypo
  source 1..60: mol_type = genomic DNA
ccctgcctcccaagccggtacctgcaattccgctcctccctcctgcgttggccgttctgt

SEQ ID NO: 80162 - DNA, 201 bp, Homo sapiens
  misc_feature 1..201: note = chr17:25931558-25931759
  misc_feature 1..201: note = hypo
  source 1..201: mol_type = genomic DNA
ttgccatgctatccacgcggcctttcccctagccaggtgtgagtcagagtaagtacctttgtctcagatctctcccgggagtccccgctagctgagagcagagcggtgttcctcaaggtctccttgacaaaccttgtttactcttaggctcgatgaccagccgaaagcagatgtgttggaagctcacgaagcggaggtgag

SEQ ID NO: 80163 - DNA, 30 bp, Homo sapiens
  misc_feature 1..30: note = chr17:25936581-25936611
  misc_feature 1..30: note = hypo
  source 1..30: mol_type = genomic DNA
ccctggctgttcacccgcttggccaaggaa

SEQ ID NO: 80164 - DNA, 30 bp, Homo sapiens; identical to SEQ ID NO: 45035
  misc_feature 1..30: note = chr17:25957285-25957315
  misc_feature 1..30: note = hypo
  source 1..30: mol_type = genomic DNA

SEQ ID NO: 80165 - DNA, 39 bp, Homo sapiens
  misc_feature 1..39: note = chr17:25977721-25977760
  misc_feature 1..39: note = hypo
  source 1..39: mol_type = genomic DNA
tgttgctgagatgcacggctgtcgcgcagggcacagagc

SEQ ID NO: 80166 - DNA, 30 bp, Homo sapiens
  misc_feature 1..30: note = chr17:25982331-25982361
  misc_feature 1..30: note = hypo
  source 1..30: mol_type = genomic DNA
tgggagtcatggagccgctgctgccagaaa

SEQ ID NO: 80167 - DNA, 30 bp, Homo sapiens
  misc_feature 1..30: note = chr17:26078326-26078356
  misc_feature 1..30: note = hypo
  source 1..30: mol_type = genomic DNA
tccctgtctgtctgccgggcacccagagct

SEQ ID NO: 80168 - DNA, 102 bp, Homo sapiens
  misc_feature 1..102: note = chr17:26085974-26086076
  misc_feature 1..102: note = hypo
  source 1..102: mol_type = genomic DNA
tcagggtgtgggccacgtcccgggccatgcgcacatccccgcaaacatagaggtggcctggctccttgtggagcacacggagcacctcgctggccagctgct

SEQ ID NO: 80169 - DNA, 389 bp, Homo sapiens
  misc_feature 1..389: note = chr17:26120462-26120851
  misc_feature 1..389: note = hyper
  source 1..389: mol_type = genomic DNA
tctaaaagaggaaaacgcttttagtaaaccctcaggaatcccacagagcgcacatccccgccctccgatttctcccagagagagatggggccccgcccgggctcggagcccaccgcttccctcccagggcggacttcggcccgcggggtacctggctctgcgcgggcagcagtcaggcttcggccggaggatcctgcagagcagcctgcacagccggggcccggcggcctcgcacgccgcgcccagcccctcgcgcatggcccggctccttaggcgcagctccgctggctccacgcgcctcccagcgcccgcgctttatcgctcggagcctgcagcccccgccccgggggcggggcgagccgagcagcggcgggggctcttcacccacg

SEQ ID NO: 80170 - DNA, 15 bp, Homo sapiens
  misc_feature 1..15: note = chr17:26120901-26120916
  misc_feature 1..15: note = hyper
  source 1..15: mol_type = genomic DNA
cgggacccaagcacc

SEQ ID NO: 80171 - DNA, 36 bp, Homo sapiens
  misc_feature 1..36: note = chr17:26125647-26125683
  misc_feature 1..36: note = hypo
  source 1..36: mol_type = genomic DNA
ggaattctgagtcatcggtgccgacagggcatgggt

SEQ ID NO: 80172 - DNA, 31 bp, Homo sapiens
  misc_feature 1..31: note = chr17:26263183-26263214
  misc_feature 1..31: note = hypo
  source 1..31: mol_type = genomic DNA
aacaagaagaatggccgggcgcggtgactca

SEQ ID NO: 80173 - DNA, 145 bp, Homo sapiens
  misc_feature 1..145: note = chr17:2627439-2627584
  misc_feature 1..145: note = hyper
  source 1..145: mol_type = genomic DNA
gacggcgagtcctctcggtagagaaggtgcccccgctcggccccgcggaggaactctcgcgcgaggagagggctcgaagctttggaaacgtcgggaagtacaaaaggctggcggttcggggatttggggggagccggggccgcct

SEQ ID NO: 80174 - DNA, 524 bp, Homo sapiens
  misc_feature 1..524: note = chr17:2627798-2628322
  misc_feature 1..524: note = hyper
  source 1..524: mol_type = genomic DNA
cgggcgctgggccgcagcggcctgcgtgcatagaggaagagcgcggggtcgggcatggggtcggcgtcgtcgagggcgccggccccgcggtcccaggcggcccagtcccggccggggcccttggcggcggcctcgtgggcagcaggcgggcggcgggctcgcagtgcgcggcggcgtggcctgggctcggcggtggcgccggggcccgggcgcggggcctgcagtctctggcgcgccgcgtgcagctggcaggagaggtaggcggccgcctcggtgtgcttctgcagctcggtgcccagcacggtggcgcggtggctgcggcggcgcagctcctccaggaagcggcgctcctcggtgcgcaggctgcagcgcagcgcggacaccagcgcctcgcgctgcgccacctcccgccgcagctccgcgttggccgcagcacgcgcctccagctgcgactccagcgcgcggcacttgctctccagctcccgggacgccgcctctggaacggggcagaggccagaggtgac

SEQ ID NO: 80175 - DNA, 45 bp, Homo sapiens
  misc_feature 1..45: note = chr17:2628323-2628368
  misc_feature 1..45: note = hyper
  source 1..45: mol_type = genomic DNA
gtctccccctggcttggaacagaacctgcacggctcagagctccg

SEQ ID NO: 80176 - DNA, 40 bp, Homo sapiens
  misc_feature 1..40: note = chr17:2628710-2628750
  misc_feature 1..40: note = hypo
  source 1..40: mol_type = genomic DNA
actcctccccacgtccccacctgcacgtcctaccgcgctc

SEQ ID NO: 80177 - DNA, 177 bp, Homo sapiens
  misc_feature 1..177: note = chr17:2634225-2634402
  misc_feature 1..177: note = hypo
  source 1..177: mol_type = genomic DNA
tccagaactgcctggcggcactggaggcaggctcggcagtggctacttaccagtctggacacttgcttttcactattttgacagccagtaccgctgagcctgtgttattacctgaacatcagcgctgccccttcccaagccccagttgcgccgtattccccacggcagggagaaggg

SEQ ID NO: 80178 - DNA, 170 bp, Homo sapiens
  misc_feature 1..170: note = chr17:26346789-26346959
  misc_feature 1..170: note = hypo
  source 1..170: mol_type = genomic DNA
atttacagtcccagccgcagtatattcatgagtggctgatttccctataaaaaaatcaacaccggattttaacagtatttttcatttggccaatctgatacagaaaaaatggaatctaagtattgttcaaatttgcatgtctttgatcactactacggctaaacttttgg

SEQ ID NO: 80179 - DNA, 23 bp, Homo sapiens
  misc_feature 1..23: note = chr17:26420105-26420128
  misc_feature 1..23: note = hypo
  source 1..23: mol_type = genomic DNA
accgcacccggcctagtggcttg

SEQ ID NO: 80180 - DNA, 215 bp, Homo sapiens
  misc_feature 1..215: note = chr17:2652439-2652654
  misc_feature 1..215: note = hyper
  source 1..215: mol_type = genomic DNA
agaaataaaggtgtgcgtggcgggaggtggcggggctcgacctcgggccgctctggacgcccggcagtgccaggcagggcccgggtctgggcggtggaggacaacttctgccagcagcccgccgcgagtcctgtccgcctcccgcgcgctgcggtgcccagccccgcgccagccctcccgggggagctggagcttggccgcgctgctcccccctg

SEQ ID NO: 80181 - DNA, 253 bp, Homo sapiens
  misc_feature 1..253: note = chr17:26554500-26554753
  misc_feature 1..253: note = hyper
  source 1..253: mol_type = genomic DNA
tcctggtcactcagccgtcgtgagcgcaggcgcggggcgggcggagcgggacccctggggctctccccctgcggccccgctccaccgggggcgtggctagatctgaccgcgcccttccaggccccgccctcaggtatgggaaactaggccgcccggtcgcgcgcctctccaaaacgttcttcccagactgcgaggaccgcctcggcaggtggcggtaaaagcgcccccatcaagtcacataacatcctgcctc

SEQ ID NO: 80182 - DNA, 348 bp, Homo sapiens
  misc_feature 1..348: note = chr17:26554791-26555139
  misc_feature 1..348: note = hyper
  source 1..348: mol_type = genomic DNA
cgacgtctcccaggcttgcctccccggatcggattcctttcccttcgatcccgcaggccggaggcgcagacctgtggtgaggacacccgaggcctcctgggagacctgcagaccacgcccacctcatttacatgttcactcccgaccctggaaacccggatttcgcctccggacagcggcgtctgggcagggttcgggtactgcagtcccgcgtctggatgcccccgccccctgagctgcagggctgtgtgtggtccttccctggtcccaaaataaagagcgaattgcacagaaacggaatgtgtgcctttgtattttctttcctttctccttcgtggaggtggcgtc

SEQ ID NO: 80183 - DNA, 357 bp, Homo sapiens
  misc_feature 1..357: note = chr17:26578290-26578647
  misc_feature 1..357: note = hyper
  source 1..357: mol_type = genomic DNA
gcacctgcagcccctcgcccagggcgccctccggcggcagcagcacccacacgaggccggccacgaccagagcgcatgagcagcgcagagcccgcgtctggagggggcagggcggacagagccgcgggcggtcacgtgaccccacggctggggtcggcgcgatccctgacggtagcttgcgggtgttccgcgccgtgggcagcctggcgtgcaggggcgctcagccgagggacgtggctatttctgggacacacaccagtgcacggacgccctaagggacatcctggtgcccaggggaatggtgcacacctggacatgcccggtgatgcacgcagaaagcatcgaggtaaaaatgaa

SEQ ID NO: 80184 - DNA, 38 bp, Homo sapiens
  misc_feature 1..38: note = chr17:2658821-2658859
  misc_feature 1..38: note = hyper
  source 1..38: mol_type = genomic DNA
gttctgcggggccggcgctgacccggctccagccgcct

SEQ ID NO: 80185 - DNA, 540 bp, Homo sapiens
  misc_feature 1..540: note = chr17:2659210-2659750
  misc_feature 1..540: note = hyper
  source 1..540: mol_type = genomic DNA
ccccaccaccccctccggtccccaccaccccgcgtccccgcgccgggtctctgcggctctccaaagagatgggcgacggggaccctgtgcgagccgtcaggctttgggggaaccccgtccccctcccgcgggggcgccctttccctgcacttcacctttcacgctcgcacggggcttccgccttccccttcgcccccttcaggtttcccatttgtgcctccctccgttccttctgccacccggggcagggctctggacttgggccccgagaaggcaccacccacagcccccaacccctgcgtggaaaggggtgctttagccccgaaacacaggagcccctgggggtgtgcactctggggacagggcgcagagaagggggcctaggagaccagggcaggggaggggtccccgtgtagcggggcagtcgccctttccccctccgcagtcctggcccgctgggaagtcagagcctgcggtgtcaggttaccggactgcaagctcagagggtttcagacgcagcgctgtcgagtcacctgatct

SEQ ID NO: 80186 - DNA, 38 bp, Homo sapiens
  misc_feature 1..38: note = chr17:26634205-26634243
  misc_feature 1..38: note = hyper
  source 1..38: mol_type = genomic DNA
ggccgggaagcctggcggccgcccgaacaccacccaac

SEQ ID NO: 80187 - DNA, 30 bp, Homo sapiens
  misc_feature 1..30: note = chr17:2666440-2666470
  misc_feature 1..30: note = hypo
  source 1..30: mol_type = genomic DNA
caaacatattttctacgttaacaagttgga

SEQ ID NO: 80188 - DNA, 315 bp, Homo sapiens
  misc_feature 1..315: note = chr17:2680183-2680498
  misc_feature 1..315: note = hyper
  source 1..315: mol_type = genomic DNA
gactgaggtgcccttcgctccgggtccagaggcagccgcgcgccaggcggcgcagaaggtcagtggccccggggctgggattccgcagccagcctggatcgggacgtgagtcctggtgtgactgacggggaatcggagcgtgtgtggagtgtgaacgcgtgtgtttgcagacagacatcggcacgtatggacggcgcgagccggtactgcgttccggaggagccatccggcgtcacaggctgtgctggggaggtggggtgaccgtcctcagaaacccccgcgggcggggcgctgcacacacgtccacctataggg

SEQ ID NO: 80189 - DNA, 30 bp, Homo sapiens
  misc_feature 1..30: note = chr17:26897238-26897268
  misc_feature 1..30: note = hypo
  source 1..30: mol_type = genomic DNA
tgaataggggctgggcgcggtggctcacgc

SEQ ID NO: 80190 - DNA, 48 bp, Homo sapiens
  misc_feature 1..48: note = chr17:26926767-26926815
  misc_feature 1..48: note = hyper
  source 1..48: mol_type = genomic DNA
agtaaacggcagagccgctcttcctccctgtcccgccagctcctgcct

SEQ ID NO: 80191 - DNA, 22 bp, Homo sapiens
  misc_feature 1..22: note = chr17:26927142-26927164
  misc_feature 1..22: note = hypo
  source 1..22: mol_type = genomic DNA
actggatttcaaacacgtcgta

SEQ ID NO: 80192 - DNA, 133 bp, Homo sapiens
  misc_feature 1..133: note = chr17:26961803-26961936
  misc_feature 1..133: note = hypo
  source 1..133: mol_type = genomic DNA
agctcctcaattttgcgggcaggcaacaactccccatgctgcttccgaagggcggccactttagcatccagtagctgtagtcttttggcactctccttactttcatccttcatcagctcgtagttatcatgaa

SEQ ID NO: 80193 - DNA, 23 bp, Homo sapiens
  misc_feature 1..23: note = chr17:27038663-27038686
  misc_feature 1..23: note = hyper
  source 1..23: mol_type = genomic DNA
cgtcctgacccacatcgctctcc

SEQ ID NO: 80194 - DNA, 285 bp, Homo sapiens
  misc_feature 1..285: note = chr17:27038906-27039191
  misc_feature 1..285: note = hyper
  source 1..285: mol_type = genomic DNA
ggggcctccggcgcctcccaggcccctctttatctcagaccttaaccttacaggcccagctctcaccacccatctctggttccagcttgcagtccaaaccccagattttcaccctgcctccagatcgtagccccaattcttagtgttacaacgagccttgcccccagccccattcttagccccgccccggccattctctaaaccgcacactcccgtcccgctccccgccccaccgacccttgggaacccagccgcagccccgcctctgcccgctggcgagagagc

SEQ ID NO: 80195 - DNA, 33 bp, Homo sapiens
  misc_feature 1..33: note = chr17:27039851-27039884
  misc_feature 1..33: note = hypo
  source 1..33: mol_type = genomic DNA
aagttatggccatatcgacgacattccatgcac

SEQ ID NO: 80196 - DNA, 163 bp, Homo sapiens
  misc_feature 1..163: note = chr17:27044581-27044744
  misc_feature 1..163: note = hyper
  source 1..163: mol_type = genomic DNA
cgtctggtgggggccgggcccgcgcagaccctacgattacgcggggccggatagttcctacgattacgcggggccggatggttcctacaataacccggggccgcggagacccgacgtcatctcggggctgaggctgccctaccattacagagcggcccggggg

SEQ ID NO: 80197 - skipped

SEQ ID NO: 80198 - DNA, 24 bp, Homo sapiens
  misc_feature 1..24: note = chr17:27056401-27056425
  misc_feature 1..24: note = hypo
  source 1..24: mol_type = genomic DNA
ctccctctgtcaccccggctggag

SEQ ID NO: 80199 - DNA, 24 bp, Homo sapiens
  misc_feature 1..24: note = chr17:27056845-27056869
  misc_feature 1..24: note = hypo
  source 1..24: mol_type = genomic DNA
gagccaccgcgacaggccagaagt

SEQ ID NO: 80200 - DNA, 30 bp, Homo sapiens; identical to SEQ ID NO: 16185
  misc_feature 1..30: note = chr17:27074858-27074888
  misc_feature 1..30: note = hypo
  source 1..30: mol_type = genomic DNA

SEQ ID NO: 80201 - DNA, 30 bp, Homo sapiens
  misc_feature 1..30: note = chr17:27085505-27085535
  misc_feature 1..30: note = hypo
  source 1..30: mol_type = genomic DNA
gagctgccgcacagtcgaggggtgcacctg

SEQ ID NO: 80202 - DNA, 20 bp, Homo sapiens
  misc_feature 1..20: note = chr17:27170162-27170182
  misc_feature 1..20: note = hypo
  source 1..20: mol_type = genomic DNA
tttttttttctgagtcgaag

SEQ ID NO: 80203 - DNA, 76 bp, Homo sapiens
  misc_feature 1..76: note = chr17:27181283-27181359
  misc_feature 1..76: note = hypo
  source 1..76: mol_type = genomic DNA
gaggctacaaaggatgaagagggctcaaggcctcaaacagagcaaggtaaatgagtttctccggctgctagagcgg

SEQ ID NO: 80204 - DNA, 30 bp, Homo sapiens
  misc_feature 1..30: note = chr17:27271675-27271705
  misc_feature 1..30: note = hypo
  source 1..30: mol_type = genomic DNA
aaaacaaagacaatacgacatacctagatt

SEQ ID NO: 80205 - DNA, 30 bp, Homo sapiens
  misc_feature 1..30: note = chr17:27299598-27299628
  misc_feature 1..30: note = hypo
  source 1..30: mol_type = genomic DNA
ctctccacccaggcacgtttgggcggaggc

SEQ ID NO: 80206 - DNA, 367 bp, Homo sapiens
  misc_feature 1..367: note = chr17:27332366-27332733
  misc_feature 1..367: note = hyper
  source 1..367: mol_type = genomic DNA
tagaggccctggaaccggcggcaaagtcgagcgaagtttggcgggcggcaggggaagcgggaccacgggccgccagctggaccgtcccgactcactgccttgcgccccccggcacgcgccccagcaccctgagatgcctagagtgtggcgaggtagcgcgcgggtgagcgcgtgtgtgcggggagtgggtggcgtgatgaattgcatcagagaaatcccattagatctggggagatgattaaagacgaggtctcggccgggcgcgaatggcgggagccgcggcagcttcccgcccgcgaagcccgcgccccgcccggcttggccggcgccgggggcagcgcagccggcggggcgcggtgcttggact

SEQ ID NO: 80207 - DNA, 100 bp, Homo sapiens
  misc_feature 1..100: note = chr17:27333101-27333201
  misc_feature 1..100: note = hyper
  source 1..100: mol_type = genomic DNA
ggggcgcgggaggagcggcttaccgtaaagtctcatgcaaaggcgcagagacccaggggcaggagcccaggctcccgctccaccgcgactgccctactca

SEQ ID NO: 80208 - DNA, 30 bp, Homo sapiens; identical to SEQ ID NO: 16187
  misc_feature 1..30: note = chr17:27411663-27411693
  misc_feature 1..30: note = hypo
  source 1..30: mol_type = genomic DNA

SEQ ID NO: 80209 - DNA, 321 bp, Homo sapiens
  misc_feature 1..321: note = chr17:27419250-27419571
  misc_feature 1..321: note = hypo
  source 1..321: mol_type = genomic DNA
tgtcacaagtcctgacgtggagggacctgtctagggtgaagggagccacagaggcagctctattctgcctcagccccccgagctctgccccgggcaccttggcccctcaccgctgtcttggctttggcgatgtcatcaatctgcaggtgcaggtcttcgatctccacctccattgctttccgtgctttcacggctgccgcacaggtgaactctgactcctccagctggacacagaccacccccgccccagggagagatgtcagccattccttgggggcaggagggctgtacaggaaagagggagctcggatgccctccttc

SEQ ID NO: 80210 - DNA, 30 bp, Homo sapiens
  misc_feature 1..30: note = chr17:27426754-27426784
  misc_feature 1..30: note = hypo
  source 1..30: mol_type = genomic DNA
gccaaggtgcccgcccggaagaacacctgt

SEQ ID NO: 80211 - DNA, 30 bp, Homo sapiens; identical to SEQ ID NO: 36425
  misc_feature 1..30: note = chr17:27466437-27466467
  misc_feature 1..30: note = hyper
  source 1..30: mol_type = genomic DNA

SEQ ID NO: 80212 - DNA, 30 bp, Homo sapiens
  misc_feature 1..30: note = chr17:27467405-27467435
  misc_feature 1..30: note = hyper
  source 1..30: mol_type = genomic DNA
atgctgctctggctccgttagcagctcaaa

SEQ ID NO: 80213 - DNA, 333 bp, Homo sapiens
  misc_feature 1..333: note = chr17:2756268-2756601
  misc_feature 1..333: note = hyper
  source 1..333: mol_type = genomic DNA
cggccaggcccgggtgggcgcggggagggcggagtggggggcgcccggcccgccaggaggaagcggggtcgccgtgaagttggttattgaacccatgtggagtcaaactcccagggccgggagagccagtgttcgcggggagccgaccccagcccactctgcatcccagctcggcgatccttgcgccgactctgcggggaggcgggggcagaattccgcctcgttcctcccatccgcaagctcccacccggggacccgggcccgggagctgcgagccggggcgggcgccgggctcaggtgccccctgtaagcgctgggcggccgggaggggac

SEQ ID NO: 80214 - DNA, 120 bp, Homo sapiens
  misc_feature 1..120: note = chr17:2757584-2757704
  misc_feature 1..120: note = hyper
  source 1..120: mol_type = genomic DNA
ggaccttggcggaatcggagggccgctgggagggcgcatcggggtggatccctgacggagggaccccaagtccgtcgcccccagaccctttgcagaccgcgaccccgttccccaagcctg

SEQ ID NO: 80215 - DNA, 88 bp, Homo sapiens
  misc_feature 1..88: note = chr17:27716046-27716134
  misc_feature 1..88: note = hypo
  source 1..88: mol_type = genomic DNA
catacactgtatacacggattgcttaggtctgatcaacatgctccttccttggagcacagatctactatggccagcctggtctcgaac

SEQ ID NO: 80216 - DNA, 120 bp, Homo sapiens
  misc_feature 1..120: note = chr17:27716194-27716314
  misc_feature 1..120: note = hypo
  source 1..120: mol_type = genomic DNA
gccaccgggcccggcccagagttaatttttattcatgaaactcatataacaggtttatttatttcagtcgttttgttggttaaagaaccaagattttttatgactacactttgtgtacac

SEQ ID NO: 80217 - DNA, 28 bp, Homo sapiens
  misc_feature 1..28: note = chr17:27716614-27716642
  misc_feature 1..28: note = hypo
  source 1..28: mol_type = genomic DNA
gagccaccgcgcccggccttacactttt

SEQ ID NO: 80218 - DNA, 30 bp, Homo sapiens
  misc_feature 1..30: note = chr17:27909175-27909205
  misc_feature 1..30: note = hypo
  source 1..30: mol_type = genomic DNA
agtgtgcagtgaatacgcatgtgcgtgagg

SEQ ID NO: 80219 - DNA, 196 bp, Homo sapiens
  misc_feature 1..196: note = chr17:27940142-27940338
  misc_feature 1..196: note = hyper
  source 1..196: mol_type = genomic DNA
ggatccaggcttcaccgcggagttcagactctccccaggcattgacggggagaacttggtagggtctgggctccgccacgaccaggtgggggccaggacgccgcgggactgaccgcctccactagagggtggtggccgcgggccgccctggagcctccacgccgtgtcccggccccggccggtgggtgggtgcgcc

SEQ ID NO: 80220 - DNA, 321 bp, Homo sapiens; identical to SEQ ID NO: 36427
  misc_feature 1..321: note = chr17:27940590-27940911
  misc_feature 1..321: note = hyper
  source 1..321: mol_type = genomic DNA

SEQ ID NO: 80221 - DNA, 696 bp, Homo sapiens
  misc_feature 1..696: note = chr17:27949432-27950128
  misc_feature 1..696: note = hyper
  source 1..696: mol_type = genomic DNA
gtgcccttcaaggcgcgtctgcggccccgagcctgaggcccggcctccctgcacccttcttcagcctgctgccctgacactgcgttcttgcgagacgaggtgtctgcgccctccgggagcgctggctgctgtccggccaaatatagacaccacgtcctccccgcccgaaaccgaatttggcggcgcggggggaggaggcgcagacctctgcccctcagggaccccgcccgctccgctggctgcggtgacggccgggtgtggggggctgggtacctggtcctgagcgggctgcggggcgctcacgctgcgaatcctctgcggaaggggcccgagtgcgtagggggccgaggaaggcttcagggcgaaggagccacctctccgggtgtctgtagtatctgggacccgggtgtccagctccgcactctggccgatcctgcggctctctagagcccggcgccgctgcagccccagctgccgctgccatcaacctaagagggcggggctagcataggggcggggccagagcccaagttgccccgccccctccagcggcgggaaagtcgagcgaccccgactcccctcccagcttccgccggcctcggagaaccatcgaaaataaatgtgcagctgtgtgctaggtgcgcacgctgcttccctccctccatgactcccgggtaggctggggaggctcgggtt

SEQ ID NO: 80222 - DNA, 23 bp, Homo sapiens
  misc_feature 1..23: note = chr17:27950259-27950282
  misc_feature 1..23: note = hyper
  source 1..23: mol_type = genomic DNA
cgatcggccgggactgcgggact

SEQ ID NO: 80223 - DNA, 30 bp, Homo sapiens
  misc_feature 1..30: note = chr17:27956058-27956088
  misc_feature 1..30: note = hypo
  source 1..30: mol_type = genomic DNA
gtcaatcctcagtaacgtggacatcaacga

SEQ ID NO: 80224 - DNA, 99 bp, Homo sapiens
  misc_feature 1..99: note = chr17:2801121-2801220
  misc_feature 1..99: note = hypo
  source 1..99: mol_type = genomic DNA
tggtgctttctcccacggctgctgctctctgcatccgtgaaccctgggattgaagtaggggtggggattgccattttgcaatttctgcggagtcttttt

SEQ ID NO: 80225 - DNA, 171 bp, Homo sapiens
  misc_feature 1..171: note = chr17:28088129-28088300
  misc_feature 1..171: note = hyper
  source 1..171: mol_type = genomic DNA
gagcgttcgcggaggcggagggcgcgcggcggactcacagctggttgatggcgttctgcgagatgaccgcgttggcggagaagtaaggaatcatgtcggggccaccgaggctgcaggtgcaagcgaggggcgccttcctcttgcgggccaacgtgctcagggtcatggggc

SEQ ID NO: 80226 - DNA, 67 bp, Homo sapiens
  misc_feature 1..67: note = chr17:28088606-28088673
  misc_feature 1..67: note = hyper
  source 1..67: mol_type = genomic DNA
ggccccaagacactgctgcctcggtaagggagtgaagctactcaagggtggacgagaaaggcttgca

SEQ ID NO: 80227 - DNA, 105 bp, Homo sapiens
  misc_feature 1..105: note = chr17:28089170-28089275
  misc_feature 1..105: note = hypo
  source 1..105: mol_type = genomic DNA
ttacaggcgtgagccagggctcccggcaagattttttttttttaaacagttgaagtaatggtcaaacaaacaaaaaacaatttagattgtcgataacatctacta

SEQ ID NO: 80228 - DNA, 35 bp, Homo sapiens
  misc_feature 1..35: note = chr17:28112487-28112522
  misc_feature 1..35: note = hypo
  source 1..35: mol_type = genomic DNA
atgtttgaatattggcgtttcattttttttttttt

SEQ ID NO: 80229 - DNA, 18 bp, Homo sapiens
  misc_feature 1..18: note = chr17:28299358-28299376
  misc_feature 1..18: note = hypo
  source 1..18: mol_type = genomic DNA
gcccggcccaggcatttt

SEQ ID NO: 80230 - DNA, 30 bp, Homo sapiens
  misc_feature 1..30: note = chr17:2831027-2831057
  misc_feature 1..30: note = hypo
  source 1..30: mol_type = genomic DNA
gccctgggtcctcatcggtaaaatgggcat

SEQ ID NO: 80231 - DNA, 30 bp, Homo sapiens
  misc_feature 1..30: note = chr17:2844357-2844387
  misc_feature 1..30: note = hypo
  source 1..30: mol_type = genomic DNA
gagagttttaagctgcgaactgatctcacc

SEQ ID NO: 80232 - DNA, 465 bp, Homo sapiens
  misc_feature 1..465: note = chr17:28562551-28563016
  misc_feature 1..465: note = hyper
  source 1..465: mol_type = genomic DNA
ttctatccccctccccgaggcggggaagaaggtctggaaagaaacgtgggttcgaggcggagaggaaaagcggacccacctgccaggctgcgcggggaggctggtcccgggctgggcaggcgggctggcctcgcgccctcgaggcacccggcggcgctggctgtgcggaggggcgccggcgcggccgtatttgtacccgcgggccctcacatggtctgatctctagatagccgccgccaaagagctcttgaagaatttttgcgtcactttgaggcgaataaacttaatgcttccccgcggccgcggctccgcgctcccgctggatggggttgcgctcgccagggaggggccgcgctacggggcggggtgcgcgcccgaccccagagccaggaggggagggacccccgacacacacacacgctcgcagggaggagcggagcgcggagcagccggcagggcagggcc

SEQ ID NO: 80233 - DNA, 61 bp, Homo sapiens; identical to SEQ ID NO: 36431
  misc_feature 1..61: note = chr17:28563999-28564060
  misc_feature 1..61: note = hyper
  source 1..61: mol_type = genomic DNA

SEQ ID NO: 80234 - DNA, 272 bp, Homo sapiens
  misc_feature 1..272: note = chr17:2859276-2859548
  misc_feature 1..272: note = hypo
  source 1..272: mol_type = genomic DNA
tgttagacgtggaatcgcgtgtcagaggtccgtgtatttaacatgttgattgcttctgttgcattatcctcctcctgttcatctttctatccgtattgattggtataagctctttacgtctgctaatcctggtctcctaagcctggagatggtaagaatgccccgcgtgggtggtgcatgtgcacctgagcaagttggaagaggaggtttggcatctggatgtttggcggctcacttctggtcaagggagttgggcgcgggtgccctaagcc

SEQ ID NO: 80235 - DNA, 175 bp, Homo sapiens; identical to SEQ ID NO: 36432
  misc_feature 1..175: note = chr17:28705281-28705456
  misc_feature 1..175: note = hyper
  source 1..175: mol_type = genomic DNA

SEQ ID NO: 80236 - DNA, 102 bp, Homo sapiens
  misc_feature 1..102: note = chr17:28715707-28715809
  misc_feature 1..102: note = hypo
  source 1..102: mol_type = genomic DNA
gcatgcagccccagccgtgccccctgggagcctgtggcgggtggctcctaatcctcgctgggcctgggccagtgtctgggccaggggcgacattgccacaag

SEQ ID NO: 80237 - DNA, 30 bp, Homo sapiens
  misc_feature 1..30: note = chr17:28836503-28836533
  misc_feature 1..30: note = hypo
  source 1..30: mol_type = genomic DNA
atgaaaccttgacttcgtagcatgaactta

SEQ ID NO: 80238 - DNA, 30 bp, Homo sapiens
  misc_feature 1..30: note = chr17:28894952-28894982
  misc_feature 1..30: note = hypo
  source 1..30: mol_type = genomic DNA
ccagccgcgtcttcacgtccagcaggatct

SEQ ID NO: 80239 - DNA, 33 bp, Homo sapiens
  misc_feature 1..33: note = chr17:28902754-28902787
  misc_feature 1..33: note = hypo
  source 1..33: mol_type = genomic DNA
agcccgcaggttccacgccggcagctcctgcct

SEQ ID NO: 80240 - DNA, 206 bp, Homo sapiens
  misc_feature 1..206: note = chr17:28973624-28973830
  misc_feature 1..206: note = hyper
  source 1..206: mol_type = genomic DNA
tccccagccccttcccgacctcgccgctcaggctgtgatgggaaggtccctgggagtggggaggagggcaaatttaaacccggaggggatcctgtagcccagttctcctcggttccctaaacctccaggaaagcggagaaagtcacattgtggtggcagcagcgggttttttttttaatctgttaataaaacgcaagtgaatcaaa

SEQ ID NO: 80241 - DNA, 25 bp, Homo sapiens
  misc_feature 1..25: note = chr17:28988903-28988928
  misc_feature 1..25: note = hypo
  source 1..25: mol_type = genomic DNA
aaagagagaggcggccgggtgcggt

SEQ ID NO: 80242 - DNA, 205 bp, Homo sapiens
  misc_feature 1..205: note = chr17:29020865-29021070
  misc_feature 1..205: note = hyper
  source 1..205: mol_type = genomic DNA
cactgcagaagaactcgggtgggcgcccccactttcccgcaagctcgcagagagcatcctccgcccacccggcaagcaccacttcatcacgccaccgccagggtgtcaggcggggctgagcggttgtcatttctctctaacccgtcagaactctgcacttccttgacagttcgctggctggcctccgacccgtagctgatttctt

SEQ ID NO: 80243 - DNA, 30 bp, Homo sapiens
  misc_feature 1..30: note = chr17:29032502-29032532
  misc_feature 1..30: note = hypo
  source 1..30: mol_type = genomic DNA
gctgtgtgtttgaggcgtaaatggaaggaa

SEQ ID NO: 80244 - DNA, 185 bp, Homo sapiens
  misc_feature 1..185: note = chr17:29033276-29033461
  misc_feature 1..185: note = hyper
  source 1..185: mol_type = genomic DNA
cgaaggtctgaggtgcgccagggctctttacgcggcccccagcctctccgcaccctttgtctcctgagcacgccgctcacaagtccaggagacatggatcagatggaggctggagagccgatcccagctgggaccagtggggtttagagggtctagaaaggggtgaggggcgagggtgagggggt

SEQ ID NO: 80245 - DNA, 23 bp, Homo sapiens
  misc_feature 1..23: note = chr17:29232244-29232267
  misc_feature 1..23: note = hypo
  source 1..23: mol_type = genomic DNA
aggtttgtcttaggccgggcgcg

SEQ ID NO: 80246 - DNA, 27 bp, Homo sapiens
  misc_feature 1..27: note = chr17:29234370-29234397
  misc_feature 1..27: note = hypo
  source 1..27: mol_type = genomic DNA
cgcctggccaaccgtaaggaattgaac

SEQ ID NO: 80247 - DNA, 482 bp, Homo sapiens; identical to SEQ ID NO: 36434
  misc_feature 1..482: note = chr17:29249457-29249939
  misc_feature 1..482: note = hyper
  source 1..482: mol_type = genomic DNA

SEQ ID NO: 80248 - DNA, 70 bp, Homo sapiens
  misc_feature 1..70: note = chr17:29298080-29298150
  misc_feature 1..70: note = hyper
  source 1..70: mol_type = genomic DNA
gcctgttggccatggcgggcctgggcctgggctccgccgttcccgtgtggctggccgaggacgacctcgg

SEQ ID NO: 80249 - DNA, 327 bp, Homo sapiens
  misc_feature 1..327: note = chr17:29335342-29335669
  misc_feature 1..327: note = hyper
  source 1..327: mol_type = genomic DNA
ggaaaagcaaaatcccgggtccctcagacaaaagggcgggtggaggaggagaagccgagagtcctgctccggcgccgccggagcaccgcctgcctcagccgaccagcgccgtcgactactgggcctagcccagacgagaggagggaaaggccgcagaggccgcgaggatgctgcggaggcgcgggcggccggctgccgcctagttgtgcagcccagaccaaggaaagagaagtgggaggagcggggagctcggcgtcccgcgtcctccgcggctcaggacgactacgctcggcacgtccgggaccctccggccgtggcggttgcagc

SEQ ID NO: 80250 - DNA, 89 bp, Homo sapiens
  misc_feature 1..89: note = chr17:29335670-29335759
  misc_feature 1..89: note = hyper
  source 1..89: mol_type = genomic DNA
ccaaaagctcgggcctcagcccctgacgctgtggtgactccgccgcgcctcgccgtcgcccctgtccccgtcctgcccgccgcctccgc

SEQ ID NO: 80251 - DNA, 41 bp, Homo sapiens
  misc_feature 1..41: note = chr17:29396500-29396541
  misc_feature 1..41: note = hypo
  source 1..41: mol_type = genomic DNA
gctcaaaaaacacaccgtaacggcagtccatggctgggtgc

SEQ ID NO: 80252 - DNA, 157 bp, Homo sapiens
  misc_feature 1..157: note = chr17:2952123-2952280
  misc_feature 1..157: note = hyper
  source 1..157: mol_type = genomic DNA
tctcgaatacctccccgcccggctgccactggatggcgcgcgcaacctgcggaaccacagggcgacatccagctgcgggcggcgaagggaattggagcgtggacctctccaggcttttcattcgctggttctgccggtgtcccgccttttccatctc

SEQ ID NO: 80253 - DNA, 427 bp, Homo sapiens
  misc_feature 1..427: note = chr17:29718113-29718540
  misc_feature 1..427: note = hyper
  source 1..427: mol_type = genomic DNA
ggcggaggtgaagaacggagtccagagccctccagagatggcagcgaatcccggccctgcctcttgccagctgtgtggcctagagtgagtccgacctctctgggcctcagcttcctccgggatgaatgcagtcacggaacgcgccaatgcaggaggcccccaggacatcctgagcgctcgggagacgccaggcgcggcagcgggcacggatagcggaaaggggcgcgaccccgcggaatcctccggcagggcagggcctttgggtggctccgggtgtccagaggaaggggtgggctcggggacgcggagggaaactggggacgcggagggaaactgaggtcgcggaggacgcggccgttggcagctcgctgcgcctgccggccccgcgtgggccgccccactcgggaggacgcgggctccttttgtc

SEQ ID NO: 80254 - DNA, 469 bp, Homo sapiens
  misc_feature 1..469: note = chr17:29718778-29719247
  misc_feature 1..469: note = hyper
  source 1..469: mol_type = genomic DNA
ggcggccccggagggcgcgcggcgatggcggcggcgggcaggcggcgggcgcggcgggcgaggggtccgggctgagctgcgggccggcccggatggcgggcggcgcgggctggtcgggcgcccccgcggctctgctgcgctccgtgcgccgcctgcgcgaggtgttcgaggtgtgcggccgcgaccccgacggcttcctgcgcgtggagcgcgtcgcggcgctcggactgcgcttcggccagggcgaggaggtaagctggcccgaccccagtcccggcccggggaccccagcccagccccgccgcccctcccccagctcccccgccgggtcacccgcgtggcccgaggcggtggcctccctcccaatcccctccctccgccggagcccaggacctcggccccccccgggtatccctggcccagccgggccctcgctttccgccccccggcgcccgtgccccgagcgtca

SEQ ID NO: 80255 - DNA, 32 bp, Homo sapiens
  misc_feature 1..32: note = chr17:29805337-29805369
  misc_feature 1..32: note = hypo
  source 1..32: mol_type = genomic DNA
aacgtctgccttccgcgcgtgttgggagcctg

SEQ ID NO: 80256 - DNA, 276 bp, Homo sapiens
  misc_feature 1..276: note = chr17:29886452-29886728
  misc_feature 1..276: note = hyper
  source 1..276: mol_type = genomic DNA
ccccggccaggagttcgaggggctcccggaacgtcggggcgcgggccccggctagcggctatggcccccgtgcccaggcagcggtgcgggctcggccttgcgggagggtgcggcctgctgcgagaggtcggccacggctcctgccccgcgccccgcgcccctcgcccgccgagctgagcgcaggtaaccgaggcagagcggagctgggcctcgcaggcgcggcgtgggagcgtggcgaagtttctcggcgcataactcttgcgccccactcgggag

SEQ ID NO: 80257 - DNA, 235 bp, Homo sapiens
  misc_feature 1..235: note = chr17:30243754-30243989
  misc_feature 1..235: note = hypo
  source 1..235: mol_type = genomic DNA
gcacagacttaactacgatgtaactaaaacgccactctacagttaactccctctattccttagatttcattcccggggtcacctctttggcctaggtgcacacaccgcgggctccgctctaggtggggcacaggccttcgcccgccgcatgcaccctgggctgcgcagccccagccagcccgacccgggctcagcgacccctgcccccgggaccccgcaccggggctgagcgctc

SEQ ID NO: 80258 - DNA, 43 bp, Homo sapiens
  misc_feature 1..43: note = chr17:30244921-30244964
  misc_feature 1..43: note = hypo
  source 1..43: mol_type = genomic DNA
gaaaatacttttccccgccgggcgctgtggctcatgccggtaa

SEQ ID NO: 80259 - DNA, 36 bp, Homo sapiens
  misc_feature 1..36: note = chr17:30250325-30250361
  misc_feature 1..36: note = hypo
  source 1..36: mol_type = genomic DNA
taaagctctatattgcgggcagatcgcaaggtcagg

SEQ ID NO: 80260 - DNA, 30 bp, Homo sapiens; identical to SEQ ID NO: 45052
  misc_feature 1..30: note = chr17:30333112-30333142
  misc_feature 1..30: note = hypo
  source 1..30: mol_type = genomic DNA

SEQ ID NO: 80261 - DNA, 32 bp, Homo sapiens
  misc_feature 1..32: note = chr17:30334317-30334349
  misc_feature 1..32: note = hypo
  source 1..32: mol_type = genomic DNA
ccgactcaatgctcccgcgctccccctagcgg

SEQ ID NO: 80262 - DNA, 17 bp, Homo sapiens
  misc_feature 1..17: note = chr17:3036557-3036574
  misc_feature 1..17: note = hypo
  source 1..17: mol_type = genomic DNA
ctcgccagttcccaggc

SEQ ID NO: 80263 - DNA, 180 bp, Homo sapiens
  misc_feature 1..180: note = chr17:30389685-30389865
  misc_feature 1..180: note = hyper
  source 1..180: mol_type = genomic DNA
gggcaaatttaaacccggaggggatcctgtagcccagttccctaaacctccaggaaagcggagaaagtcacattgtggtggcagctgcgggttttttttttttttaatctgttaataaaacgcaagtgaatcaaatccgccctaagggaaggtgggggggcgcggcgaggcagaggccat

SEQ ID NO: 80264 - DNA, 144 bp, Homo sapiens
  misc_feature 1..144: note = chr17:30622364-30622508
  misc_feature 1..144: note = hypo
  source 1..144: mol_type = genomic DNA
gggggagggtgctttcgggtgaagagacctgaatgaacgcctctgctcaggccaaagaggaccattggtacatgctgcttaccttgtctggcttgccccaggcttcgatcttacagggctaaggagcagcgggatggctgtcat

SEQ ID NO: 80265 - DNA, 28 bp, Homo sapiens
  misc_feature 1..28: note = chr17:30710928-30710956
  misc_feature 1..28: note = hypo
  source 1..28: mol_type = genomic DNA
aacaaaaaaacatcgactagagcagtgg

SEQ ID NO: 80266 - DNA, 78 bp, Homo sapiens
  misc_feature 1..78: note = chr17:30822187-30822265
  misc_feature 1..78: note = hypo
  source 1..78: mol_type = genomic DNA
atgtggttgaacagacgccaccaggtctctggctggggctgaggaccaagcccctgggtccttcggtgtaccagggct

SEQ ID NO: 80267 - DNA, 176 bp, Homo sapiens
  misc_feature 1..176: note = chr17:30846483-30846659
  misc_feature 1..176: note = hyper
  source 1..176: mol_type = genomic DNA
ctctggcggcggcggcgggggcggaggctgcggcttcgagcgcgacgcggtcgccaaggcaacgccggccccagcgcccgcggctgaaacgaagccgctgcccgagcccgagcgccagcgcacacgccctccttgcagccccccgcagccccggccggccgcgcttctccgcctcg

SEQ ID NO: 80268 - DNA, 66 bp, Homo sapiens
  misc_feature 1..66: note = chr17:30954269-30954335
  misc_feature 1..66: note = hypo
  source 1..66: mol_type = genomic DNA
ggattgagggagggccgagggagtgagtaggctagcgcacaccagcacaggcggtgccagacgtca

SEQ ID NO: 80269 - DNA, 36 bp, Homo sapiens
  misc_feature 1..36: note = chr17:30986312-30986348
  misc_feature 1..36: note = hypo
  source 1..36: mol_type = genomic DNA
ttggttcttttgtaccgcatgcgggccagggtgccc

SEQ ID NO: 80270 - DNA, 45 bp, Homo sapiens
  misc_feature 1..45: note = chr17:31144850-31144895
  misc_feature 1..45: note = hypo
  source 1..45: mol_type = genomic DNA
agaggtagtaggggccgggcgcggtggctcacgcctgtaatccca

SEQ ID NO: 80271 - DNA, 30 bp, Homo sapiens; identical to SEQ ID NO: 45056
  misc_feature 1..30: note = chr17:31162054-31162084
  misc_feature 1..30: note = hypo
  source 1..30: mol_type = genomic DNA

SEQ ID NO: 80272 - DNA, 155 bp, Homo sapiens; identical to SEQ ID NO: 45057
  misc_feature 1..155: note = chr17:31214020-31214175
  misc_feature 1..155: note = hypo
  source 1..155: mol_type = genomic DNA

SEQ ID NO: 80273 - DNA, 27 bp, Homo sapiens
  misc_feature 1..27: note = chr17:31370236-31370263
  misc_feature 1..27: note = hypo
  source 1..27: mol_type = genomic DNA
tcggcacatccccgttttactgatgag

SEQ ID NO: 80274 - DNA, 30 bp, Homo sapiens
  misc_feature 1..30: note = chr17:31372520-31372550
  misc_feature 1..30: note = hypo
  source 1..30: mol_type = genomic DNA
tgggctttggagttacgcaggtgtggcttg

SEQ ID NO: 80275 - DNA, 118 bp, Homo sapiens; identical to SEQ ID NO: 1281
  misc_feature 1..118: note = chr17:31618291-31618409
  misc_feature 1..118: note = hyper
  source 1..118: mol_type = genomic DNA

SEQ ID NO: 80276 - DNA, 2037 bp, Homo sapiens
  misc_feature 1..2037: note = chr17:31618410-31620447
  misc_feature 1..2037: note = hyper
  source 1..2037: mol_type = genomic DNA
cggagggcaactcacggaggagaagttgtgcggcccgcagagctcgccgcggtacttgcaggagagcagcatgtcctccagctggtggcccaggcggtccatgaaggcggcgctgattccctcgaagtggcgcggaggcaggaagaggcggaagtccgccagcttgcggaaccactggcggcgcggctcgtcgccccgcagcagctcgctgacaagcgggcgcgcggtgcggttgggcagcagcagcccgagccagtggccggcatagtagaggtcccccttggagaggcgcgggaagcgcagcgggttgttgttgcacacagtgacggcggggaagggtaactggcggctccactcgcggtgcacccgcgtgtgtgacgggaagctgagccagtagagcaagcggttcgaggaccaggacagcagcaagccgaaggatgtacagaaggccagcacccacagcgcccgccgctggaaggagcccccagccgccgtgcgcccggcacacatgtgccgcagcccgtgcagtttagcgcggctcagcgatggccgccccctgcgggcgacccctggcccctgcagcgcccgctcgccgcctctgccgcccccgggctgcccggcagccgccaacgccgcgggcgccggctcctcgcgggccatgcggaagcgtcccgggccggtgagcgcggctgcgggcagcccggctccgccaatccggctcattcattcagcccgcggctggcggcagcggcggcggccccggccgggcggagccgccatgggagtccgcagcagcagtggaagcagcagcagcggcagccgcgcgcagcccgcgccagggaagcgtgcgcccgaaaggagctccggtggcgcggcatgcccgcccggcgccgccgctgccgcctccgcgggcgcccgcccggggctgagcgccgcctcagcccgcagcccctggcagtggcctctcccgagcgcctcccaggctttcccggcccctggtcttcctggaggatgcccggcgcccggcactacttctggaggggtcccactgggagccgcctctccagtccctgggtgctgcgcccgccttccctcgtcctggacctcgggggaccctgagccgagtcccccctgccccgcctaaccccagcttttacgctggtcctgggagaagggccactcggccaccatgcctgatctggacatccccagggaccccaccagcccggcccgtagcccagcggtgctgggacacgggagagaaggcgccaaggaacgagcgcccccagaggcgcaccgcggctcctggctgggcgggcggggtgggtgtgtacgggggtgagtggtcgccttgccggctgccgccttctttcccttcccctccaggacccttccttgttactgctccctgggctgcgctcggcagagacctgcttaggcttccccaagtcctgcgcctaagtcctgccaggcgcccgctctcgcctggggctgagagcttctcagggcgtcctgcgggaggctgttcgccgccggggtccttcaaggatgctagccgcagggaagtgtcgcttctcgcctcggctctcccaggtgcctcgcgtctccagaaaagcccagccttgctgtctctcgcgtcttctctctgcccccgcggcgacaagagctggggactgcggggacccgccaacacctcccgggggtgacccggactcgctgctccgcgcgcccttctcctctcgagactccgagctcgcggtggccgtgacgccggctaagctccttccccggttgcccgggagaaccctctttgggccccaggcgaacttgggcagcggccgcgcgacgctggcgcggctgggctccgagcacctgctcctcagctcgctggccccgcggctccgggcgggcggggcggcggcggccgtgagcgccgtgcgctcctggagacgcggtgctgacgcgcccggctcctcctcgctgcattttaattcctggccactgtggccgctgcacaccgagcgggaagcctcttgc

SEQ ID NO: 80277 - DNA, 184 bp, Homo sapiens; identical to SEQ ID NO: 45058
  misc_feature 1..184: note = chr17:32237066-32237250
  misc_feature 1..184: note = hypo
  source 1..184: mol_type = genomic DNA

SEQ ID NO: 80278 - DNA, 82 bp, Homo sapiens
  misc_feature 1..82: note = chr17:32239182-32239264
  misc_feature 1..82: note = hypo
  source 1..82: mol_type = genomic DNA
tgtgaatcactatgtcctaataaactaataaactttataggtgattctggcaggatgtggtggctcacgcctgtaatcccgg

SEQ ID NO: 80279 - DNA, 23 bp, Homo sapiens
  misc_feature 1..23: note = chr17:32239704-32239727
  misc_feature 1..23: note = hypo
  source 1..23: mol_type = genomic DNA
attatagactagggccgggtgag

SEQ ID NO: 80280 - DNA, 30 bp, Homo sapiens
  misc_feature 1..30: note = chr17:32257150-32257180
  misc_feature 1..30: note = hypo
  source 1..30: mol_type = genomic DNA
agtctgttaggtaaccgaggctgcaaacat

SEQ ID NO: 80281 - DNA, 109 bp, Homo sapiens
  misc_feature 1..109: note = chr17:32275435-32275544
  misc_feature 1..109: note = hypo
  source 1..109: mol_type = genomic DNA
gagatcacacaatcacgggctcagagagttgaaagggaccttaaggtcacctaatcctccagatggaaggcttctgccctgggatgcccactcccgccaggatcacagg

SEQ ID NO: 80282 - DNA, 32 bp, Homo sapiens
  misc_feature 1..32: note = chr17:32478151-32478183
  misc_feature 1..32: note = hypo
  source 1..32: mol_type = genomic DNA
gtagagtaggaaaggtccgtgagtaaagggtt

SEQ ID NO: 80283 - DNA, 221 bp, Homo sapiens
  misc_feature 1..221: note = chr17:32483992-32484213
  misc_feature 1..221: note = hyper
  source 1..221: mol_type = genomic DNA
tgggggatgtcagggcggccacgctgatgcactgcggtcgggcgcagcggcacagccttcagagccgccgccgctcggttccttttcccatgatgttttggactccgaatgccgtttctcgccgccggcctccgtccctcctctcctcctcctccaggcccccttttgtgggcagaattccaaatgccagcggccgctgctagcaccggggagaggaggca

SEQ ID NO: 80284 - DNA, 112 bp, Homo sapiens
  misc_feature 1..112: note = chr17:32905966-32906078
  misc_feature 1..112: note = hyper
  source 1..112: mol_type = genomic DNA
gccccggacccatcccgcacgaagctgagccccagagcccccgcggcccgagaggagctgggcacagcagcgaggctgattcccagccagtgcccagcgaactctgggggtg

SEQ ID NO: 80285 - DNA, 252 bp, Homo sapiens
  misc_feature 1..252: note = chr17:32906304-32906556
  misc_feature 1..252: note = hyper
  source 1..252: mol_type = genomic DNA
aggggcgagcggaatcgcgaggtcggcccttggcccgagtctcattaaggagccgcgcgcgccgccaggctaggaatgcggaatggacacgtggacagaggagggggagctaggagtcggggagtctccgtggcgcgcgagctgtgggccgcgcgctcgggggccacgtgaccacggggaatctgggaggggtgggagtgagcgcgccaagctcggcgcccgcttctgcccgggtgggcgctgaatcccgga

SEQ ID NO: 80286 - DNA, 421 bp, Homo sapiens
  misc_feature 1..421: note = chr17:32906598-32907019
  misc_feature 1..421: note = hyper
  source 1..421: mol_type = genomic DNA
cgagtcatttacggcggagcagccggcgcgagcgccgaggaggcggcgacggcggcggcggctgcttcgtgcaactgtggcttcccccacctcctcttcctttttgctcctcgattcttcttcttcccccacacacgtccatggggagccggctcccctgccagcacctcctctcctctcggccccgtaggcaccagctgccgcttccctggccgcaagctgcgcaggtgccggctgccctggcccctggcgccgcgcccgcgtctcaccgcccgcagcccggactggcgcggcgatccgctcgcccaaactgactcggagggagcgggagccgatgcccggcagcatcgagacagcgggcgaacgggcgtccggggacagggtgggggcggcggggaggaggcgtcggagactctgaacc

SEQ ID NO: 80287 - DNA, 481 bp, Homo sapiens
  misc_feature 1..481: note = chr17:32907224-32907705
  misc_feature 1..481: note = hyper
  source 1..481: mol_type = genomic DNA
attagccggctttctcgctccctcgcttctccaagccccatctacatggggcagcccgttctggccgcgccacccttgccccagccgccgagcggctgcctgggcaggaggcgctgagccggcctgtgtggagcctgggccctgatccagactggagaaagcgcgctggagcggaggagcgagccttgcgaggggacaaacatctggccgcccgcctcgggcatccggtctgggcgtcgcctagggtggtggcgaccggcgtcgccagtttcagcaccgcacggaaacttttccttctccagatggattaaagttgtctggattttctctttctttgagaaagacagcattcatttgcacctgacctgggatttttatgctgggctgctgcaggggcttggaggaagaaagcggcgctatccatgtgcggttactaccgaaaccgaggaaactggggattgcgttggaagtcggcaccctc

SEQ ID NO: 80288 - DNA, 99 bp, Homo sapiens; identical to SEQ ID NO: 4394
  misc_feature 1..99: note = chr17:32907706-32907805
  misc_feature 1..99: note = hyper
  source 1..99: mol_type = genomic DNA

SEQ ID NO: 80289 - DNA, 274 bp, Homo sapiens; identical to SEQ ID NO: 4395
  misc_feature 1..274: note = chr17:32907873-32908147
  misc_feature 1..274: note = hyper
  source 1..274: mol_type = genomic DNA

SEQ ID NO: 80290 - DNA, 976 bp, Homo sapiens
  misc_feature 1..976: note = chr17:32908170-32909146
  misc_feature 1..976: note = hyper
  source 1..976: mol_type = genomic DNA
cgcggcgcggactgggggtgaggatgcggcaggcgccactggagggggtacggggaagactggggagaggagcacccacaccccctggactcgcagccgccactccgggtttggcgtctctggctgcagctcgagttaccgccagcccccgagccctccggcgagctcagctgaggggaccgagcccggcgccagaaaagggtggggggagggtgtcgctccagtcctctcctggttataaagaagggttcgaacccgaaggtctggggtcgtgtccgcccacggaaatctagagggatccgagggatcctccggatcgcgtccaggccgccccccgcccccgtctctccctgcagccggccgggctgggggctgttgggatccgccgggatcgcgtctttcctcgccccgggcgcgcaggccggtgcggggccgcgccgcccgtcgcctcgcttcctgcggcggtcctcgggaagggaagtggactgactccgggccggggagccgccgcggctcgcacgcccgcggtcctgtgagctgcatctaaatggccggcttaggcgagcccggagggcgggggtctgggcacccgcacaggccggggcggtgggccgcgggccgcgcgcggagggagcgggctccgcgctctcgcattctgcaatctgttgcgtctgctccccaggctcgccccgggctccgcggtaaagggggtgggagaaggagggattgaggttggcgcgctttggcggtgggacagcgggcatacgggtggggggcagcgggtttttgaacagcccccaagaatgggaaatcagaccagagggaaggaggctgcagcgggccttccgcaagctggagacgctccaggaggcgaggggagcagaccgaggtgggagggagagagctccgaaaggagagtggagaagcggggccctctgctccctcctaacgtgaaaccagccgacctgggatacat

SEQ ID NO: 80291 - DNA, 205 bp, Homo sapiens
  misc_feature 1..205: note = chr17:32953266-32953471
  misc_feature 1..205: note = hyper
  source 1..205: mol_type = genomic DNA
cccgtcacccgcggtcgccaacagctctctgcagcgctccgagcccttcgtggtgttccagaccaaggagctgccggtcctcaacgtctctctggggcccttcagcaccagccaggtggtggcgcgggagctcctgcagccgtccagcaccctggacatccccgagcgcctgacggtgaactggaaggtgcgggccttcatcgtc

SEQ ID NO: 80292 - DNA, 30 bp, Homo sapiens
  misc_feature 1..30: note = chr17:32953682-32953712
  misc_feature 1..30: note = hyper
  source 1..30: mol_type = genomic DNA
ccccagcccccgctgcgccacccacggccc

SEQ ID NO: 80293 - DNA, 64 bp, Homo sapiens
  misc_feature 1..64: note = chr17:32965239-32965303
  misc_feature 1..64: note = hyper
  source 1..64: mol_type = genomic DNA
gagattgcatagaggcgccagccggagtagcagggacccccccccccaacggggtcagctcggg

SEQ ID NO: 80294 - DNA, 211 bp, Homo sapiens
  misc_feature 1..211: note = chr17:33102688-33102899
  misc_feature 1..211: note = hypo
  source 1..211: mol_type = genomic DNA
ggatttgccttgctgcgtgggagcgggcagggatggggaggcttcatgcctcagaaccccttccccagcacctcctggcagggaccctgcttctccacatatctcctctgtcagtctcttccctaaaaacagaacctgaaaattggtctgggaggacctcagccacaacggccactgatagaaataattatagatgcggagtaagcacttc

SEQ ID NO: 80295 - DNA, 30 bp, Homo sapiens
  misc_feature 1..30: note = chr17:33124973-33125003
  misc_feature 1..30: note = hyper
  source 1..30: mol_type = genomic DNA
cctccccagcctcctcgcctttccttgtgc

SEQ ID NO: 80296 - DNA, 30 bp, Homo sapiens
  misc_feature 1..30: note = chr17:33179323-33179353
  misc_feature 1..30: note = hypo
  source 1..30: mol_type = genomic DNA
tgcgtcagacaacagcggctggccagttcc

SEQ ID NO: 80297 - DNA, 28 bp, Homo sapiens
  misc_feature 1..28: note = chr17:3338320-3338348
  misc_feature 1..28: note = hypo
  source 1..28: mol_type = genomic DNA
gagccaccgtgcccggccacacactgtg

SEQ ID NO: 80298 - DNA, 100 bp, Homo sapiens
  misc_feature 1..100: note = chr17:33447192-33447292
  misc_feature 1..100: note = hypo
  source 1..100: mol_type = genomic DNA
acaatgaaaaggaatcgcagaaatcacatcattacagattatacgacaggtgtcaagaagcagcaaagcatccagagggcacctgcgtctatttttcaaa

SEQ ID NO: 80299 - DNA, 27 bp, Homo sapiens
  misc_feature 1..27: note = chr17:33601404-33601431
  misc_feature 1..27: note = hypo
  source 1..27: mol_type = genomic DNA
atggctgaataggaacggctccagtct

SEQ ID NO: 80300 - DNA, 220 bp, Homo sapiens
  misc_feature 1..220: note = chr17:33672862-33673082
  misc_feature 1..220: note = hyper
  source 1..220: mol_type = genomic DNA
gagaaaaaaaaaagacgcggaactgtcttcagggccctcagaagtggtttaaattctccgcaaggaaaccgaggcgggtactgaggtcggtctcgccctttccagggcgcgcagtgaggtcaccccgggaacggctgtcaccgcgggaggagagcagcccagggaactaaagacgagtccagttaccagggaaatgtcctgaacacgtgtggtcatccct

SEQ ID NO: 80301 - DNA, 320 bp, Homo sapiens
  misc_feature 1..320: note = chr17:33673302-33673622
  misc_feature 1..320: note = hyper
  source 1..320: mol_type = genomic DNA
ctgcactacagcctgggcgacagagctagttcctgtttcaaaaaagaaaaaattcctcaaatgttaattatgaaatatttcagaagtacgaaaaagtgtaccaccaccggcgctaccacttccaccttggcaagtgaagccccactacaatggaagcgtcgggcgtatcctcccgggcctctttccctccctccccggcccttccctcttccgatttccctcccgccctttcccctccctcccctcctgacctcgacttccttcccttctctgtctaaggggcagggcggaagatcgagcctcaacgctgccccacaccc

SEQ ID NO: 80302 - DNA, 34 bp, Homo sapiens
  misc_feature 1..34: note = chr17:33688778-33688812
  misc_feature 1..34: note = hypo
  source 1..34: mol_type = genomic DNA
tttgagacagagtctcgctctgtcacccagactg

SEQ ID NO: 80303 - DNA, 904 bp, Homo sapiens
  misc_feature 1..904: note = chr17:33700472-33701376
  misc_feature 1..904: note = hyper
  source 1..904: mol_type = genomic DNA
gtgctgctcccttctcgaacctggcactcgagttacagcccgacgcggattcggctgggctagaccctgaagcacgggtagaaacgcaactccggagtcccaggctgggggcaaggaccctctctgacctctcaagctccagcgcttccgaagcccccttagcgtttccctggaggcgcccaggtcgagtccttatatactagcgggttggcgccatcccacgcacatcccacgcaggagatgcaagagccaatgggcgggtctgctaagcccgcgaactctgccgcgttaaattgcctagaagctcccacccttctgactgttgccacgtagttcttagtttccgggaatttggggattttttcctcccccttcttcccacccttcctccgtctcctcgctccctccatccatctctccctccctatcatctatctattcatctatctggattacagcaaaacaaagaataaagattatgaagaaagagaagaacttcccaggcccaagcagctgtcggctcctgcgctcccaacggggtggccgtttccttcctcgcaccctcttctctcccggtgcctgcggtcccaccttccagatacccctcggagagtccagctgagctctcgccagagctttccccttccaacccgctcgacttgcccagatcccaagctgggcttctctctccatcgccccagaaagtgggtcttggagaccgaggcaagaatttgggcctccgcttctgttccagaccccggaccccttgccaaaatgcggcagatgtgcagattgggccgcgcttggttcctggctgggtttatggagcctgcggctgaggcaggctccgcagaccccgagccagagtgggatttaacggcggccggtgcgctgtgcttggtca

SEQ ID NO: 80304 - DNA, 30 bp, Homo sapiens
  misc_feature 1..30: note = chr17:33701582-33701612
  misc_feature 1..30: note = hyper
  source 1..30: mol_type = genomic DNA
cccgggcggctctgtcggaggcccacttct

SEQ ID NO: 80305 - DNA, 120 bp, Homo sapiens
  misc_feature 1..120: note = chr17:33718792-33718912
  misc_feature 1..120: note = hypo
  source 1..120: mol_type = genomic DNA
gtagacctgccttctcgggccctacacaccctataaatggcctctgcgccctcccaaccgctaccatatttcctgcccccccccatacctgccgccacccagaggcgctgcatccaagtg

SEQ ID NO: 80306 - DNA, 30 bp, Homo sapiens
  misc_feature 1..30: note = chr17:33772552-33772582
  misc_feature 1..30: note = hypo
  source 1..30: mol_type = genomic DNA
ggcccgtataactctcgccctctcttggtc

SEQ ID NO: 80307 - DNA, 444 bp, Homo sapiens
  misc_feature 1..444: note = chr17:33775327-33775771
  misc_feature 1..444: note = hyper
  source 1..444: mol_type = genomic DNA
tctgcctgtttgttccgcccccgcggaaaccgctgctcgctgggcaggggctttctgttttgcagccggaacaggaacacagatagcccgccaagccgccggcgacaccttccaacccctttagctctccgcaccgtccctccccaccgccccgcctccacccgcgccgcgatcaagtcctcatagccttttagggaatttgctcagcaaactagccgaaccccaaaggcaggggagaagcacgcaaataccccgactccaccggctggccggagctggggggcgggggttgctctcctagcttgctccccatccgagtcaacgccagtccagggtcgtgccggactagaccctagggcgtgggtacaaacgggagctccgcagtccccgtaggagcagggaccctctcttacctctcaagctccagcgcgtcaagctccagga

SEQ ID NO: 80308 - DNA, 17 bp, Homo sapiens
  misc_feature 1..17: note = chr17:33877286-33877303
  misc_feature 1..17: note = hypo
  source 1..17: mol_type = genomic DNA
aggtgcagtggctcacg

SEQ ID NO: 80309 - DNA, 38 bp, Homo sapiens; identical to SEQ ID NO: 45062
  misc_feature 1..38: note = chr17:33917230-33917268
  misc_feature 1..38: note = hypo
  source 1..38: mol_type = genomic DNA

SEQ ID NO: 80310 - DNA, 30 bp, Homo sapiens
  misc_feature 1..30: note = chr17:33933196-33933226
  misc_feature 1..30: note = hypo
  source 1..30: mol_type = genomic DNA
agtagtggagactgccggagtttctacttt

SEQ ID NO: 80311 - DNA, 30 bp, Homo sapiens
  misc_feature 1..30: note = chr17:33991634-33991664
  misc_feature 1..30: note = hypo
  source 1..30: mol_type = genomic DNA
ataaatttatatttacgaaacattcattca

SEQ ID NO: 80312 - DNA, 112 bp, Homo sapiens
  misc_feature 1..112: note = chr17:3438826-3438938
  misc_feature 1..112: note = hyper
  source 1..112: mol_type = genomic DNA
cctcctcccagactccgcaccgggcgggggcggcacccaccgaagtagaagccttcgtgttggtacttggggttgaagaaggcccccttggcgtgcgcgttgacgtcggcgc

SEQ ID NO: 80313 - skipped

SEQ ID NO: 80314 - DNA, 30 bp, Homo sapiens
  misc_feature 1..30: note = chr17:34400013-34400043
  misc_feature 1..30: note = hyper
  source 1..30: mol_type = genomic DNA
tgtggtcatcccttccgccgcccaccggct

SEQ ID NO: 80315 - DNA, 399 bp, Homo sapiens; identical to SEQ ID NO: 36457
  misc_feature 1..399: note = chr17:35014243-35014642
  misc_feature 1..399: note = hyper
  source 1..399: mol_type = genomic DNA

SEQ ID NO: 80316 - DNA, 30 bp, Homo sapiens
  misc_feature 1..30: note = chr17:35042671-35042701
  misc_feature 1..30: note = hypo
  source 1..30: mol_type = genomic DNA
gtgctggctccaccccggcttccagagagc

SEQ ID NO: 80317 - DNA, 41 bp, Homo sapiens
  misc_feature 1..41: note = chr17:35054437-35054478
  misc_feature 1..41: note = hyper
  source 1..41: mol_type = genomic DNA
ttggttatgaaatgacgcttgccggtcgagaaagccagatg

SEQ ID NO: 80318 - DNA, 445 bp, Homo sapiens
  misc_feature 1..445: note = chr17:35060232-35060677
  misc_feature 1..445: note = hyper
  source 1..445: mol_type = genomic DNA
agactgcagaaaccccgaaagaggggaggcacaaaccgttcagctcagctgggaagaaatcggctcaagcccatcagagtgacagatacccggggaggctgggcgtgccaagctggaccggtccggccaggctggaagcccagctgcccgctttttctcagtgcctggagaccgcccgccttttcagcaccacggtcagcggccttttcgcaggcgcgcgccccagccccgccccgggttgggctggcatccagcctcccggcccttctgcgtgtccctcggcccaccggcatcccgggctggaggtgtgggtggggcaggcgaccggggtatgagaggcggtggggtgcctcctccgcgcgtctctgcgagtatctgtctcccccatgcgtccgctgctcctcatagaggcgtcgggagagtgtgttcgcgactttctcgcaca

SEQ ID NO: 80319 - DNA, 189 bp, Homo sapiens; identical to SEQ ID NO: 45063
  misc_feature 1..189: note = chr17:35061647-35061836
  misc_feature 1..189: note = hypo
  source 1..189: mol_type = genomic DNA

SEQ ID NO: 80320 - DNA, 424 bp, Homo sapiens
  misc_feature 1..424: note = chr17:35078532-35078956
  misc_feature 1..424: note = hyper
  source 1..424: mol_type = genomic DNA
gggggaggtcagggacggaaataaacaggcggtttggtcttctctttcttccctggcagccttaattgctacttaagcgtgggccctgcacttaacatccggggggcaggcccggtgcgtggtgcacgccgggcgcgctgtgcacagtctccggaggccgccagtgcgaccccgccccacccgcgcacccccgcccggagggccccagcgcgcatgcgctcgccgcagggcggcctgcggggctgtggacgcgaggccagctcgtagggggctgggcggtcagcggggtcaagggacagccacgctgggacggaggacggggacaggggagcccctgcggcgccacttcttcctctccgagtcctgtctgcccttgatggagccactggtggggttacttgctggcggtcggccactttcgccc

SEQ ID NO: 80321 - DNA, 536 bp, Homo sapiens
  misc_feature 1..536: note = chr17:35165308-35165844
  misc_feature 1..536: note = hyper
  source 1..536: mol_type = genomic DNA
gtgtccttgccttgccgtctcccgcattcgggccgctccccgcatttccaccccgctcccactgctgggtaaatgttcatctggacggggacaggatcgggaaccgccgggcagggggtctgcgcggcggcgtcctcccctccccgcccggctctcccgctccatccccgcggcctggccaagggcagcgccaagggcgcccgcggagggcgcagctgccccggacggagcccccgccacccccacagccgcgcgggtgctccagagcatccaacttcatttccacttcaattttatcagcggccggggagccgggcgggagataggaggccggccctgacacgaattagcccggagattgtccgatacgccttggccagggcgccggcgccgcgcgctcgcctccctcgcctctcctttgtgtccgcctcgcctcgcctctcggcctcgccgcgctccattcccgcggcgctggcccgggccgagcgaactgctttgcctttggccacgttgagcgcgccgaggcagccgggggc

SEQ ID NO: 80322 - DNA, 297 bp, Homo sapiens
  misc_feature 1..297: note = chr17:35165845-35166142
  misc_feature 1..297: note = hyper
  source 1..297: mol_type = genomic DNA
cggggctccaggacccgtctgctcctggtgcccccagctcctcagggtccggccgggtcacctgggccgatccaggcgggcaggggcctcgctgctcctcccccgcagcccctctcgccctcccggggaccgtgtgcggggagcagctgggagctgcgtctggaggggctgtccgactggggaacttgtcctgtgccttgtccatgccattacattcatcctcccaagaaccctgagaaatgaggagatcgtcagagaaggggaaactgaggctcagagaggcgacagtactcgccc

SEQ ID NO: 80323 - DNA, 181 bp, Homo sapiens
  misc_feature 1..181: note = chr17:35242096-35242277
  misc_feature 1..181: note = hyper
  source 1..181: mol_type = genomic DNA
gagaaggcaagggggcgggagcgggaggggtggccccgctccacgctcagctgcttctgggtgcagatggagacagaatggaagggggaggggctcagctcttcctcccgggcccctcctcaccctcagctctcctccgacaagcagagggcctgccggaccccagcgatgggctagcctg

SEQ ID NO: 80324 - DNA, 30 bp, Homo sapiens
  misc_feature 1..30: note = chr17:35248683-35248713
  misc_feature 1..30: note = hypo
  source 1..30: mol_type = genomic DNA
gcccctgggtggatacgcccatgcacaggt

SEQ ID NO: 80325 - DNA, 358 bp, Homo sapiens; identical to SEQ ID NO: 12667
  misc_feature 1..358: note = chr17:35285437-35285795
  misc_feature 1..358: note = hyper
  source 1..358: mol_type = genomic DNA

SEQ ID NO: 80326 - DNA, 432 bp, Homo sapiens
  misc_feature 1..432: note = chr17:35289269-35289701
  misc_feature 1..432: note = hyper
  source 1..432: mol_type = genomic DNA
gatatcggcagtgaccgccgccattaggtaaggggagagagtcaattagtgagaggattaattactgtgaggcacgagccccgtttgtcttccttactgggtgttcagacagaggaacacgggcacgcacccaaatacacattgttgtcacgccgtcttagacgttttatttatttgttggattcctgcccagagccgcttttccacgggcgcagagtctcccaccaaacacgctgcctctttctctcagcacgcactcgcctgtcccaaagccgcacacccccagacccgcgggacgccccctccgtgcctgcagggccctcggctccgcgcccgtccccgcggccttcttcgtggcagggtctctctctgggtctaatttctgtttcttttcctccacttctccccgcatttccccgacagatctttcct

SEQ ID NO: 80327 - DNA, 48 bp, Homo sapiens
  misc_feature 1..48: note = chr17:35290025-35290073
  misc_feature 1..48: note = hyper
  source 1..48: mol_type = genomic DNA
aggccaggcacataccgtgacgccccggcctgccggatgctgcccttt

SEQ ID NO: 80328 - DNA, 775 bp, Homo sapiens
  misc_feature 1..775: note = chr17:35290334-35291109
  misc_feature 1..775: note = hyper
  source 1..775: mol_type = genomic DNA
gtgaagtactgcacacgagtagatcatttccatgagagagtgatgggtgagattaaggcaatttgagtccggagagaactagacgggaaggagaggcgggagaccttggcgctcagatccgagcgaccttatccacgcagttccctgcgtggcattactgcggcctcaccgagtctgggcggagtttgcgtggcctctgggaccggcagagtccaggggtgctccgggctggctatttcctccctcctccgggatgggtgtagcagggtgtgtactccgcatggggtaacctcctagagccggctacgccccaggcgcctcctttcacggccttgtcactcttttctgctccttgggctgttctggaaccgaagagagaggagggaaatggctaggggcggccatcatcctcgggatcaatagcagccgagagtgactgggcaggctctgtccatgggccgagcgtcattctggaacctggagggggcgggggcgggggaaggaagggaagtggaagtttgagaggggcaccttcaggctccccaaactgcatggcagctggagagggctgacagaaccctctccaacccgggttctgaccagggtccctctggggctgatcgtcaaggagcttctcaagaaaagaaacctggactgtgaaagtcacctcctaggccctctggggccgtatccgggggtgcctgggaggagggtggaaaggattctgcagtcaccgagctatgggcgaaaatgatccccgcggaccctggtccag

SEQ ID NO: 80329 - DNA, 579 bp, Homo sapiens
  misc_feature 1..579: note = chr17:35291320-35291899
  misc_feature 1..579: note = hyper
  source 1..579: mol_type = genomic DNA
ctctccatgtccctgcgaccgattatgttttaaaacaaaagctcaatggaaacgaaaacaaaacaaaacccaccatttgtctaatgtgctgtccccgtggaggagttaaatctggactccaaacctagaatctggagccaagaggcgcactttgagttgcgctcctggccccccttgcagagacgccagggttggctcctgcggacctgtttactgagccatctggacaccaggacgagcggagcctgacgccctagagcgagcgtcctgtcctcatcctcaactctcctgcctcgctggtccgtctgtggggaggggccttctttcccctatacctaggtcccaaggttcttacacccctaaatggatggagcaacctcctcctgcccaccagagggaggtgacaggccctgggttggggaagggccgacagctaggtccagctgtcgtccggtaggtcccactgaccgccccacactccaccgtgacccctctgctttgcatgagaaggagcccagctgggacgggggcggaggcaagccacccgggactggggccactatagattccagaaagggg

SEQ ID NO: 80330 - DNA, 741 bp, Homo sapiens
  misc_feature 1..741: note = chr17:35291920-35292661
  misc_feature 1..741: note = hyper
  source 1..741: mol_type = genomic DNA
cggcgagaaccgggacagctgcggggaggggaggagtgtgaggacagcagggctggactggccccctccccgcaggcctcacgcagcgcagcaggctgggaggcgcctgggggtccgggtggaagaagtggggaccccatgccacacggcttttggcgcttgcgggggtgccagaagcctaccgagtaccggtcgtcttccgccgggaagtgccgggtccgcaggaggagcgcgaagccgagtccgagcccgcggagcccgccccctagatcgcagaaccgccttctccatcctctgccctgccccgcgtcggggtctgggagcgaccggcggaggccggcggcgcgccggagctgactagtcccctacgctcctccggcccgcagcggggagcccacatgtgtatgtgcaagaaggtgtggagaaggcgttagggtcccggcacccacgggtcagggcagaacgccaacgagtcgcactgcgggtctccgcggcttcggtttccatgacatggtgacgccggcggcaaggcggggggctgcctgtgggccttgaggttgctgggcggtgcgggcggagtcagcaaaggggcgttggcaaagccctaaaaccccacggttccacggagcgcaagccagattctctgaagcagcttccccgttcgtccgaagagggtattccatctgcacagcgggattccctgccagcccaggttcactgcgactccgcttccccgagcat

SEQ ID NO: 80331 - DNA, 35 bp, Homo sapiens; identical to SEQ ID NO: 36469
  misc_feature 1..35: note = chr17:35292896-35292931
  misc_feature 1..35: note = hyper
  source 1..35: mol_type = genomic DNA

SEQ ID NO: 80332 - DNA, 812 bp, Homo sapiens
  misc_feature 1..812: note = chr17:35293669-35294481
  misc_feature 1..812: note = hyper
  source 1..812: mol_type = genomic DNA
gacaatggcaacagccgctgaattgcaaagcccagcagtgcaggggagccgcctgggattccggacccggctgcaccccaaccttccacaaggctcggtcttggactacccccactctacagcagaactctggcctccgcctgcgcctattcccgctctctctctgtccctcccatcgaaacccacgccttaccggagcaggagggggcccaggcacggtgctgcccgccgtccgcgccgcgcggggccgcgggtgccgccgccactgatcctctaaacgcggtctccccgcactctcccgggccgggggatgcagaatggtttacagagggaccgcgaggcgctgattggtcgcaggccgcagtgacgtcggcgggcgctgcattaaggcgagggggcttccagagctcagccaacagccaggagcagtgaccaagccgccggagctggggagagacgcaccggggcggcgactgggccaggagaccagggactgagggacgcgcccggggagggccagcaacaagccgcggcccgggcgcgacagcggcggtccgcgccgagccgttccagccgccggcctactgtagccgctgcgccaggacatttttttttaaagctctccaagctgcccccctcctccccgactcctcccgctgcaaaagaaaaacaaaaaaaaaaaaggaaggaggctagaaaggaaacccagatttgccaccacaacgaaaaaaagaaggggaaaaggaaaaggagagaaagtcgagcgactgtggggttagacggaggcagacagagcgtgggccgagcgatgc

SEQ ID NO: 80333 - skipped

SEQ ID NO: 80334 - DNA, 2654 bp, Homo sapiens
  misc_feature 1..2654: note = chr17:35294492-35297146
  misc_feature 1..2654: note = hyper
  source 1..2654: mol_type = genomic DNA
cccaggcggccgcgagttgtgactggagccacgatgcacggccaggcgcggtgagaagccagcccgtagtgcctcccgaaggagcccgggcgcagggagggtcgccctgaggacacggaggccgccaggcaggccaagggccgaggtgactgggctggggcggtagggaaggagcgagtgcgcctggctgcctccgcacggagttgtccctctctgttttcgattgacacaaacacttctccaaaagcggggaaacctaagcaacaacagcaatcaacaccaagatcttcctcctaccctcccctctttcccttctcccgcggtcggccctcgccccctcccccaggcccagcgcgggcgctcggcgcgtccagacccgcggcgcgatgccggcagtttaggatccaaagcttctctgctccttttgttctttccttcccttttttaaaaaaagaggggggaaatcccagtggtgggcagcctggcacgcacacagtcgccctcataccccgacaaaagcagatgcactttgacttctgacagctctacctcaagccccggagaactcagcggcgctttcctcgcaacccgagctcggcgagtcgtcgtcttcttcttctccgtttttatttatttatttccgttcccgccgccgttctcgctgaccttcactcctccgcgggctctgagcagaagggtcgcattctctcccgcctgagacttcttttcctcgccccgggagctcaggcggcgccgctccagcccggggccccgggactccccggctgcacacttcactgagacgcccccccaggccccgatcagcctcgtttcctccaccctactttgatttcctggtgcgagttttggcttgcacggccgagtgtgtgtcctctttttggagagactggggagctcgtgccgattgtcttcaggagtcatcccctgggctctactttgcccctctctctctctgggcctcatcagaccaaaccaaagaccatggttcactgtgccggctgcaaaaggcccatcctggaccgctttctcttgaacgtgctggacagggcctggcacgtcaagtgcgtccagtgctgtgaatgtaaatgcaacctgaccgagaagtgcttctccagggaaggcaaactctactgcaagaacgacttcttccggtgagtactttcctcccacgcctctgctgctacctccccgcgggcccttcccggccagcttcggatcagaggttagcgtggcctcgctgcccagttaggaactgcttctagagagggcagccaagtcccgcgggcgcccgcctctccgccagctggcgcgctgggagcccgggacgcggccctgcttgcatcctggaaactatgggtctgggtttggctgcatgtgcctgggaagaaagggtctgagcctgactcggcccagaagccccttcaagcttggaagagacagggcagcctcgggcgttgtagcccggactgctgtctttcccggagccaagctctgcagcaactgcattctccaggccttcggggttgtttgccctccaggcagagcccaggctccctcccggccactaccttttccgaccccgagcggtcttggcggtaagctccgagccttttgcgtagagtgtctgggccaactgccctgtcagcggcaggaaagaactcggccttaaagccgatcctgcacgcccgggggtcttccccaaacccggacatgcctccgagtgcagacctggacaaactgctgcactgtagcctgcgaagtgcccggagctttttcctgcttccctggctgccgaagttgtctggtggttcggcttcagccccaggtgactccgactcccacgggctccgctcagtagtcctcctaggaaactgccagccacagccagcaacctccttgatgaaacctgggggaaagccgagacctccagcttgctggtggggagacttctccctaccccccttattcgtttagcattttaattatattatcgtacactcacaattttgccgctccattcacacaaacacacaagtcaacagagaagaacgggcacaaatgcgaattgtaattccaccctacggatgtgaaatatcgcaatttactcggctgacttggtctctgcttttctgagtttgtggtcatagttcaaaccagggagcaggaggaagagggattcaaagccactcagagggccaagacgcgctgtccccagtgccgctccaggactcgtggctggggttgggttgcgtggaaccatgaagcaaagctccgtgctcgctggtatttcgggagaacgcgcaggctgagcctctgagcctccgcgggctgcccggttttcctcaaggactggatcatagcgggagggtggcaaaccgtactcgtacccgctgccagtgggtccctgagcctggcttccacaacccgcggcagagcgcccagagccagctcccgcagctcccgcttttgccaacctgtcccgctttaggcaagagcgtggcggcggccccgctaaggctacggaggggggctctccgcggctatgtttgtttaccaacagcggggctagacatcgccaaccccatgcctatgtgcgggtccttttgcgatgaaggagagaaaagcggcgctcc

SEQ ID NO: 80335 - DNA, 1064 bp, Homo sapiens
  misc_feature 1..1064: note = chr17:35297147-35298211
  misc_feature 1..1064: note = hyper
  source 1..1064: mol_type = genomic DNA
cgcacgtttatatagagttctaattgtaattcgacttttctgaatctaatcggaaaataagtgccccgttccccccgcccacacaggtcactgccttgccaccttctttagacgatgcatctttcctctgggataacgctgggagtgaggctggggcttggcgggtagcttgggcccctggctctaaccgcgtgtatcccctccctaactcttccctggtgccgcgctctctctcctgctgcctcctcacctgcttaaccggaattctgcctctctttatctctctcttcccttctttctgtgctccattcctcctctcctacttcctccactttttacatcttccctctttctcgctgtcatctttctctccgcctgtctccccttgcccctggctgacccatccccgcccccgccccccacccccacccccccgcaggtgtttcggtaccaaatgcgcaggctgcgctcagggcatctcccctagcgacctggtgcggagagcgcggagcaaagtgtttcacctgaactgcttcacctgcatgatgtgtaacaagcagctctccactggcgaggaactctacatcatcgacgagaataagttcgtctgcaaagaggattacctaagtaacagcagtgttgccaaagagaacagccttcactcgggtgaggccccaattcctggctggctaggtgcaagcgggtcctgggggaggaaggctcgccaaggccccggctcatctgtcctttccctcttagccaccacgggcagtgaccccagtttgtctccggattcccaagacccgtcgcaggacgacgccaaggactcggagagcgccaacgtgtcggacaaggaagcgggtagcaacgagaatgacgaccagaacctgggcgccaagcggcggggaccgcgcaccaccatcaaagccaagcagctggagacgctgaaggccgccttcgctgctacacccaagcccacccgccacatccgcgagcagctggcgcaggagaccggcctcaacatgcgcgtcattcaggtcaggccccggcgcgcctctccatcc

SEQ ID NO: 80336 - DNA, 292 bp, Homo sapiens
  misc_feature 1..292: note = chr17:35299152-35299444
  misc_feature 1..292: note = hyper
  source 1..292: mol_type = genomic DNA
attattttggagaggcgtagtctctatgtgtgtacagccccagagaagcggtaactgtgatagtgtgactgttagaaaaactccagctataccacaactctccccctccagacacggcggcctgtccaggtcctcctgtgggattcctgctcaccattggctcagggtccgccctgagtggtcctagtcagagatcgcaccgtcaccactaccctacacacacacacaagcgcgcgcgcgcggtgtcggctagccaggcggtgaaggggtgctggctaggcccggagcaccc

SEQ ID NO: 80337 - DNA, 366 bp, Homo sapiens; identical to SEQ ID NO: 36477
  misc_feature 1..366: note = chr17:35299600-35299966
  misc_feature 1..366: note = hyper
  source 1..366: mol_type = genomic DNA

SEQ ID NO: 80338 - DNA, 453 bp, Homo sapiens; identical to SEQ ID NO: 1287
  misc_feature 1..453: note = chr17:35300260-35300713
  misc_feature 1..453: note = hyper
  source 1..453: mol_type = genomic DNA

SEQ ID NO: 80339 - DNA, 333 bp, Homo sapiens
  misc_feature 1..333: note = chr17:35300812-35301145
  misc_feature 1..333: note = hyper
  source 1..333: mol_type = genomic DNA
cgtggggagggaggccgtgagcacagccgggtgaaggaagtgaagcggcccagggcgctcccgggccagccaggagggttctagctctgggatatcccttattagtgttgtctcagagttcaacaacagcgacaaaaaactcttatagcttcagaaacgccgacctgccgtgcatcaggtgggactatatatatattttttgtctatctggatttttggtttttgtttttgccaaaattgcaaaattctaaatgtaaagccctccgtatcaactcttctaccttcgcaaaactacacatacacacatacacacgtacacggacacactcggta

SEQ ID NO: 80340 - DNA, 592 bp, Homo sapiens
  misc_feature 1..592: note = chr17:35303075-35303667
  misc_feature 1..592: note = hyper
  source 1..592: mol_type = genomic DNA
atgcaatcactggatcggcttgtttttacctttttagcatttatacacattaaatcctagctaacttattcattatagcctctactccctagccccctttaaagacattcatttaaatgaactgcgctcactgggaagctgcattttcctatcaaggctgctgaattatttagcagctttattgtggaatcggggtatttgataagaagcgttttcgagttgggcacacgatgtggattcgattcttctaacaacgtggttgtggcgcagtctctcccctcgtcgcgggattcagaatcctggcgaaaacccgaacaggtggcaacgctcagcagtcaaatttggagccgaaggccccaaggaggaggcctggaaatgtcagggcctgttctccttcccatcagtgctgtgccgcccacctctggccccgaggtgcggggacgtgcggcaccatacctaggcggagctcccgcaggaggcgcagcaggagggaagcgccactgcagtcccctctcgcctgggagggcagcctggtttctccctgtggccatcttaaagccaccacctctgtgcctctcgccacctgccttca

SEQ ID NO: 80341 - DNA, 42 bp, Homo sapiens
  misc_feature 1..42: note = chr17:3541067-3541109
  misc_feature 1..42: note = hypo
  source 1..42: mol_type = genomic DNA
agccaattttagtcccacttgacaatgcgtgctttacatctc

SEQ ID NO: 80342 - DNA, 81 bp, Homo sapiens
  misc_feature 1..81: note = chr17:3585002-3585083
  misc_feature 1..81: note = hypo
  source 1..81: mol_type = genomic DNA
tcctcccactgctgccgaggccgaatccggttctgtagagcatgtactcagaacacttctcctccccgggccctccagccc

SEQ ID NO: 80343 - DNA, 30 bp, Homo sapiens
  misc_feature 1..30: note = chr17:35870444-35870474
  misc_feature 1..30: note = hypo
  source 1..30: mol_type = genomic DNA
gtcctcatagcccaccgaggaggcagcagt

SEQ ID NO: 80344 - DNA, 105 bp, Homo sapiens
  misc_feature 1..105: note = chr17:3599635-3599740
  misc_feature 1..105: note = hyper
  source 1..105: mol_type = genomic DNA
gcagccccccggatgcgcaggaccgccctgtgctgttgcccagctgaaagcagcgatcgcggaggagaggaagtgaaagggggaagggctcctttttattttatt

SEQ ID NO: 80345 - DNA, 49 bp, Homo sapiens
  misc_feature 1..49: note = chr17:36102031-36102080
  misc_feature 1..49: note = hyper
  source 1..49: mol_type = genomic DNA
cacggagaaaggcaccggtcccgaagagggcctgcggccattgtgtccc

SEQ ID NO: 80346 - DNA, 1007 bp, Homo sapiens
  misc_feature 1..1007: note = chr17:36102282-36103289
  misc_feature 1..1007: note = hyper
  source 1..1007: mol_type = genomic DNA
gagaaaggccagctccggccgggagccggggaccgggaagcgcgcagtcccgaccttcctcccctgcctttctcttccaggaggtttactagaactccaggaactccaaaacgcgacttttctttctctttgcttttcgtcttaagggaacacggtgggcaaaagaagggagtgcgtgtgcccgaggcttgggagccccctgtgcagtgacctaggaaccgctagcgatttcttgaaaaattactttaatcaagtccggcgctcccgggagcgggggaggaaaggcagcacccgctcgggacgggagaaaaaagcctccaggtctgtcccgcgtctccaactcggcgagggtctccggctccccagtccctctccctgccctgctggggcctggggctttggggagggaagagcggggctggggtctaaggaccctgggccgggcctggctctccgccggccgggcctgcgggtgtcggcgacccgggggctccgcgggcggctcgggcgctcacagagcccgcgtcccgcgccagagcggtgaggccgcggggccgcacggggcgcctggctgggtgcgcgctgggagcggcgagcagccccgcgcccgcgttttgatctccttcccccctctaagccgcgtttacaacttcaccaatgaataacccgcctctcttttcaacctaatcacggctctttgtgtatctttctgttgatgatttatagaaataaattaataacaccccaactccacgtgctgcagtttatgttacgtctcagctgcggccagcccggcgcggggctgggtgcggaggggcgccccaggtccttccagcgccgcgctagaaagcgggcgcctgcggccgggtgggagggcctaggccctgtggcccccggtggccggcggtgggagcctggttcatccgccaggtcctgagcgacctccccggcagccctggcgccccagccgctcctaggggccactctctcgacccctcttagcctcc

SEQ ID NO: 80347 - DNA, 745 bp, Homo sapiens
  misc_feature 1..745: note = chr17:36103290-36104035
  misc_feature 1..745: note = hyper
  source 1..745: mol_type = genomic DNA
cgactcacaccttccgcctcgcggaactctcttgcaggagttctctcccggtaggggagaaatcacctccgggcgggagagcgacgagggaagaacctcaaacctatgaattataccaaagtgtgtttggggaaaaaaaatctacaagttcccctgattgttttggctagagggcaaaccgccaggccctcggagcacaaattcaaatgcaaggtcatatcccaccccaaaccgccgctgcggacgtgcggccaaggctcagccccgaaatcgcggcgcttcagtgtccgaagccacgcgatgggctctgtcctaaagcggagtggcccgggagcgacgtgctgtctcagggaaccgctcggctccttagataattagtaaccagctgtcaaagtctagggcggtcggggaggacccacaaacgatcccggccctggggatacactgccagccggcctgaactcccggggagaggccgggggtgggcagcgaggtctggaaacgccctcctttctcagactgagaccagatcctctgcgaactgaggtctgagacgcgttcgcccccacaccaccgcgcttcgtttctttggccccgcgcgtgtccacccggaccctgcatggaacatgccctttgcaaatctaaacccgcgttggggatcccggataattccgggccttgcatgggcgcggctaacaagagtgcccaccagggaactcgcctcccagatcccggctccggatgc

SEQ ID NO: 80348 - DNA, 334 bp, Homo sapiens; identical to SEQ ID NO: 4411
  misc_feature 1..334: note = chr17:36104217-36104551
  misc_feature 1..334: note = hyper
  source 1..334: mol_type = genomic DNA

SEQ ID NO: 80349 - DNA, 707 bp, Homo sapiens; identical to SEQ ID NO: 36486
  misc_feature 1..707: note = chr17:36104643-36105350
  misc_feature 1..707: note = hyper
  source 1..707: mol_type = genomic DNA

SEQ ID NO: 80350 - DNA, 270 bp, Homo sapiens; identical to SEQ ID NO: 36487
  misc_feature 1..270: note = chr17:36105458-36105728
  misc_feature 1..270: note = hyper
  source 1..270: mol_type = genomic DNA

SEQ ID NO: 80351 - DNA, 30 bp, Homo sapiens
  misc_feature 1..30: note = chr17:36149200-36149230
  misc_feature 1..30: note = hypo
  source 1..30: mol_type = genomic DNA
agtgtaaatgtgtgccgatagtgttgctat

SEQ ID NO: 80352 - DNA, 94 bp, Homo sapiens
  misc_feature 1..94: note = chr17:36204447-36204541
  misc_feature 1..94: note = hyper
  source 1..94: mol_type = genomic DNA
gcagtagccagtccccgagggcccatcttccagccctgaagcggtaaacgcctcacctctagtggcgagtgcgaggaaccgcaccctagcccgc

SEQ ID NO: 80353 - DNA, 144 bp, Homo sapiens
  misc_feature 1..144: note = chr17:3658786-3658930
  misc_feature 1..144: note = hypo
  source 1..144: mol_type = genomic DNA
taagctgacccaggccgagtcctgttgcctggtctgtattcaggggaacaactggatgtttgagcacacagaaaaaagcgacctcctgtcatcaatatggccacccttttgttgcagtgagccgagactgcaccgctgcactcc

SEQ ID NO: 80354 - DNA, 143 bp, Homo sapiens
  misc_feature 1..143: note = chr17:3658990-3659133
  misc_feature 1..143: note = hypo
  source 1..143: mol_type = genomic DNA
taaaatcgctcttttacaggaatcaccacaggtagggcagagccctggatgggaggcaggagtccctgaatcctaggtgtcctgggcccctcaccaatgggcaagcctgcctggtgctgagtcagccacgtacctcatccagg

SEQ ID NO: 80355 - DNA, 161 bp, Homo sapiens
  misc_feature 1..161: note = chr17:36714931-36715092
  misc_feature 1..161: note = hyper
  source 1..161: mol_type = genomic DNA
ctgcatggctgtggccgcgagcaggggtggtattgcagggggaggagggcaaggttaagttctggggaatatgaggcaggagaaggggttgggaatatttgcgggacagggtgtagccctatgtaggtccctgccgacagtgcggccgcatggctatggct

SEQ ID NO: 80356 - DNA, 177 bp, Homo sapiens
  misc_feature 1..177: note = chr17:36729010-36729187
  misc_feature 1..177: note = hyper
  source 1..177: mol_type = genomic DNA
tcccccggccgcctccgcagccgcggccgccgccgccggtgccctttgctgcaatgcgagagccgccgcggccgccgccgtgccggcccgggccccagtcgccccggtaaccgcgactccacctggcgcggcgctgcgcgccgccgtgcacatcccctctcgcggccccctccctcg

SEQ ID NO: 80357 - DNA, 74 bp, Homo sapiens
  misc_feature 1..74: note = chr17:36829977-36830051
  misc_feature 1..74: note = hyper
  source 1..74: mol_type = genomic DNA
gtaacaccaaagtttcgaccggcggatcagacgatcgaaatgttcctggcggagatctccgggtgcggccggag

SEQ ID NO: 80358 - DNA, 90 bp, Homo sapiens
  misc_feature 1..90: note = chr17:3686092-3686182
  misc_feature 1..90: note = hypo
  source 1..90: mol_type = genomic DNA
gtttagtgactttttcgtctctaaatacactgagtaaacacgatataaggaatgacatttgacatcgcactctcacgggaagacacactc

SEQ ID NO: 80359 - DNA, 30 bp, Homo sapiens
  misc_feature 1..30: note = chr17:36868552-36868582
  misc_feature 1..30: note = hyper
  source 1..30: mol_type = genomic DNA
agtccagccatgtgccgcctagtaagtgct

SEQ ID NO: 80360 - DNA, 30 bp, Homo sapiens
  misc_feature 1..30: note = chr17:36874946-36874976
  misc_feature 1..30: note = hypo
  source 1..30: mol_type = genomic DNA
gtgtcttgggatcagcgcttacggaggtct

SEQ ID NO: 80361 - DNA, 458 bp, Homo sapiens
  misc_feature 1..458: note = chr17:36875921-36876379
  misc_feature 1..458: note = hypo
  source 1..458: mol_type = genomic DNA
aacccctgggggatacgggagaagggccagaggagcctggagtggtcgggtcgactgaacccaggttccctctggccgcaggtcccccatcagcagcctccccgcactcttcgaccagacagcctctgcaccctgtgggggcggccagttagacccggcggccccagggacgactaacatggagcagcttctggagaagcagggcgacggggaggccggcgtcaacagtgaggaggggtggcgccggtcgggacgcctgccctagggccctaacagtcacctttctccccgaggtccccaagcttctttaaggttccgcccttaggccccgccccagccttgactctcggccaccccgggcctcacctcccatccctgccaggccacacgaccggccctggtccctcagcgccccacctttggccttcgtggcctccgggccccgaccttaccaaacc

SEQ ID NO: 80362 - DNA, 40 bp, Homo sapiens; identical to SEQ ID NO: 36491
  misc_feature 1..40: note = chr17:36905467-36905507
  misc_feature 1..40: note = hyper
  source 1..40: mol_type = genomic DNA

SEQ ID NO: 80363 - DNA, 30 bp, Homo sapiens
  misc_feature 1..30: note = chr17:36996160-36996190
  misc_feature 1..30: note = hypo
  source 1..30: mol_type = genomic DNA
cacacacacaaatcccgaagatttgctcac

SEQ ID NO: 80364 - DNA, 30 bp, Homo sapiens
  misc_feature 1..30: note = chr17:37006691-37006721
  misc_feature 1..30: note = hypo
  source 1..30: mol_type = genomic DNA
tatgactttcgttgtcgaatgaccactgct

SEQ ID NO: 80365 - DNA, 32 bp, Homo sapiens
  misc_feature 1..32: note = chr17:37010814-37010846
  misc_feature 1..32: note = hypo
  source 1..32: mol_type = genomic DNA
cctttcacagcttcagccgccccttattctct

SEQ ID NO: 80366 - DNA, 84 bp, Homo sapiens
  misc_feature 1..84: note = chr17:37011083-37011167
  misc_feature 1..84: note = hypo
  source 1..84: mol_type = genomic DNA
aaatataaatagtatcgcttctcggccttttggccaagatcaagtgtaaaatataaatagtggccgggccttgtggctcacgct

SEQ ID NO: 80367 - DNA, 30 bp, Homo sapiens
  misc_feature 1..30: note = chr17:37161944-37161974
  misc_feature 1..30: note = hypo
  source 1..30: mol_type = genomic DNA
gattttctcatcacacgttgatgctactgc

SEQ ID NO: 80368 - DNA, 144 bp, Homo sapiens
  misc_feature 1..144: note = chr17:37183463-37183607
  misc_feature 1..144: note = hyper
  source 1..144: mol_type = genomic DNA
aggtgtcataaaggacggggcggggcgcgcggttgtcaggggcgcaagcgtctcggggctgccagaatggctccggctcagggcgcggcgccagcgcctgtcatgtcccagctgcgcctctgggtcccacggcacctcctcagg

SEQ ID NO: 80369 - DNA, 40 bp, Homo sapiens
  misc_feature 1..40: note = chr17:37192161-37192201
  misc_feature 1..40: note = hypo
  source 1..40: mol_type = genomic DNA
gattatagacgttagccgccacccccgggcagtaactggc

SEQ ID NO: 80370 - DNA, 30 bp, Homo sapiens
  misc_feature 1..30: note = chr17:37211142-37211172
  misc_feature 1..30: note = hypo
  source 1..30: mol_type = genomic DNA
ttgtctgagataatgcgccccagagttctt

SEQ ID NO: 80371 - skipped

SEQ ID NO: 80372 - DNA, 222 bp, Homo sapiens
  misc_feature 1..222: note = chr17:37307531-37307753
  misc_feature 1..222: note = hyper
  source 1..222: mol_type = genomic DNA
cgtccacacctgcccatgcccacacctgactgcccgtccctccccgcccccggcccacccgggccggctcccgccagtcctacctgctccgggctgggggctcagcgcccgggcagcctccctgagcaccagcaccaggagccagagctcgcctcgcatggtgggtgcccggacctgcccccggcctgcttgctgccccggtcctgacgagggagggggccc

SEQ ID NO: 80373 - DNA, 35 bp, Homo sapiens
  misc_feature 1..35: note = chr17:37307992-37308027
  misc_feature 1..35: note = hyper
  source 1..35: mol_type = genomic DNA
tgccctcagccctaacggagcgctcccctagagct

SEQ ID NO: 80374 - DNA, 473 bp, Homo sapiens
  misc_feature 1..473: note = chr17:37321152-37321625
  misc_feature 1..473: note = hyper
  source 1..473: mol_type = genomic DNA
atttgaatgccagaccgaggagccgcagtactaggaaggtccaagcagcgtgcccaatcgctcctccggactacagaggagcccgggaacccagggaagagctccagtgattggtccccctgcctgtcagtctggtgggaggcccagctctctaccctccccgcccgagagtcacttacaaccggtagagaatggtggtctttccttcattgtccagtcccacgatgatgaccgtgtgctctggaagcgtcggaggaagggcagcgtcagggccaaacccgaagaccaagggactgtgtgcccccaccagacctcccaggaaggagatagcgctccccgcaggctggggacctctgcccaccgtaccgcgtctgcttcccacccagctccgacacctgccccactccgggacggtggaaaagacagctgagcccccacctcccttcacattccagaaaagtgtctgaaaggcc

SEQ ID NO: 80375 - DNA, 121 bp, Homo sapiens
  misc_feature 1..121: note = chr17:37321787-37321908
  misc_feature 1..121: note = hyper
  source 1..121: mol_type = genomic DNA
cgccgggacccaagaggagcaggcagggacgggggcaggggaggccgcggggcagtcgaggagcgcccatatacgaccctcggagcccgaggtccccccgtgcgtccgaccacagatcaga

SEQ ID NO: 80376 - DNA, 55 bp, Homo sapiens
  misc_feature 1..55: note = chr17:37331238-37331293
  misc_feature 1..55: note = hyper
  source 1..55: mol_type = genomic DNA
caggcaggtaaaaaccgacagctggggcttaagggcctcccgggagctgggatgg

SEQ ID NO: 80377 - DNA, 625 bp, Homo sapiens
  misc_feature 1..625: note = chr17:37366040-37366665
  misc_feature 1..625: note = hyper
  source 1..625: mol_type = genomic DNA
cccccactctgcatccgggcagcgccagcagtgccccagcacccccgcagcccgcctctccttggcgccccgctcccctccgcctataaatagcacaggacgtgctcgccgtggcgatgacgcggctgggcaggcggaggggaaggaggcagctctgccagagcggtgggcggcgagcgcggcggcgggaggggtgcggcccctccatgctgggctccgatgacaggggcgactgagtcatcccggggacccacgggccacgactgtccccgccgccagcgtttctgtctccggcttgggggactgcggggacgaggctgacctcggatgggtactgagccctcccagacccccggcacgcccggtctcggagggcacctctgggtgggcaagatcggcctcgacggccctggcgcgcaggagcatgtccgcccctgcgcgactcaggtgcacatggaggcggaaagtgaccgcagccccaagccgtttccctccagcgtccccagacctcctcccactttcctcaggtccccttttggctctccccagaccccaccctcctcgggctgctggaggaaagggatgaggcctgggacccctgccatgttgccgcctgcccagcacc

SEQ ID NO: 80378 - DNA, 216 bp, Homo sapiens
  misc_feature 1..216: note = chr17:37369107-37369323
  misc_feature 1..216: note = hypo
  source 1..216: mol_type = genomic DNA
cctttctttctaacccgctttcccctcaactgccaagatcagcctcctcctgcagagcatttacccccgcaccgcagcctgtctcccccgcccactccctccctccgccatagggcctgggctgggcctcaggcactcacctggttctccttgaggctcatgtaaccctgttccttgttcccggagaagggttggcagcagcgccaaacattctcg

SEQ ID NO: 80379 - DNA, 631 bp, Homo sapiens
  misc_feature 1..631: note = chr17:37380799-37381430
  misc_feature 1..631: note = hyper
  source 1..631: mol_type = genomic DNA
caggagtctgggctccgcctgccttcgcggggagtaatttattcatggtgactccctcaggagtaacaatcatccataattagggttaatgatgacattcattaattacgatgacttctctttttgcttctacccgctccccctcctctggtcccgctcccgtggtggggcgcggggctgcctgtctttctggtctggagccacaaccgcaggcccccgtcctcgcccgtgaccgacggccggcgctgctgcaggccccctcgcggactccgcagctgcgcacccccggccgcggcctcgcgtccccgagcccaacagggctaggagcggggaatgcaggactgcggaggggcagggagagacgccctgagacgcggagataaacacccggagacgccgggagagacggggagagacgcacacagagacaccaagacacagacacgcaggttgtagagacaaattcagagacacgagcgaggatagaggcgcggactgagcccgggactgggacccggcggccgctggagggtgcgcctcgcacgcacagccgggcgcgtaccccgcccgcaccgctccacgcgcgccctccggcctcgctgcgcccatctctccaacgaagaccagtggc

SEQ ID NO: 80380 - DNA, 157 bp, Homo sapiens; identical to SEQ ID NO: 1291
  misc_feature 1..157: note = chr17:37381570-37381727
  misc_feature 1..157: note = hyper
  source 1..157: mol_type = genomic DNA

SEQ ID NO: 80381 - DNA, 593 bp, Homo sapiens
  misc_feature 1..593: note = chr17:37381825-37382418
  misc_feature 1..593: note = hyper
  source 1..593: mol_type = genomic DNA
cgggcgtctccgggactctgaagccgttctccagaggctgcccccagttagcccccggcacggcagcccccaacccgcgggagcgggcagagaaagttgccggggtggcgggcgaggggaggccaccacgctgagccgcaggagcgggacgaccccgggcgcgaggaccgagggtctgcagaggatgctgctcgcagcgcggggaggagggaagtggggccgcggggatgagccgagggagggagccaaggagctgtccgtgtccagccggctccgccgtccgctgcgcccgccccccatcccctcccctcccccgccggccccagcccggcacccggcggcccctccgcccagtcctcgccgcccaactttgatttaggaggtcgcctggtcccgccccctgccctacgccgctcccccgcgcagccctgcaaatcaggctctcagctattggctgcctcggtggccaggagggcgaactgggcggagtcttggggggctcgacacgatggggcggggcttggcggggaaagaagcggaggagggagtttcacactgaaaaacccgggatggaggggcgtgaccagattgag

SEQ ID NO: 80382 - DNA, 92 bp, Homo sapiens
  misc_feature 1..92: note = chr17:37388387-37388479
  misc_feature 1..92: note = hyper
  source 1..92: mol_type = genomic DNA
ctcccttggggttaacgcctggggagagatcctgtggcgggggagtctagacccagctgaagcagcctggggacctgcggctggcctgggcc

SEQ ID NO: 80383 - DNA, 204 bp, Homo sapiens
  misc_feature 1..204: note = chr17:3741592-3741796
  misc_feature 1..204: note = hypo
  source 1..204: mol_type = genomic DNA
ctcaaggaatgctctcgggaccagaggtcgacaggtgtgataaagctatgacgccctcgcggtagagttgtgagagagactcacaggtatgcttgcgcccggctgtgcaggcacatgaaggtcaagccacacctggccttcacaggacttctcctcaaacagaaaccccgcccatgagggaagcaagggcgtgtttctgacttg

SEQ ID NO: 80384 - DNA, 30 bp, Homo sapiens
  misc_feature 1..30: note = chr17:3755004-3755034
  misc_feature 1..30: note = hypo
  source 1..30: mol_type = genomic DNA
tcctgagaccacacacgctctgctgtgatc

SEQ ID NO: 80385 - DNA, 38 bp, Homo sapiens
  misc_feature 1..38: note = chr17:37606487-37606525
  misc_feature 1..38: note = hypo
  source 1..38: mol_type = genomic DNA
tcactgctcccggcctcacctttcgacctctgctccaa

SEQ ID NO: 80386 - DNA, 62 bp, Homo sapiens
  misc_feature 1..62: note = chr17:3769760-3769822
  misc_feature 1..62: note = hypo
  source 1..62: mol_type = genomic DNA
gaggggaacagctgccgcagcctggctctctgcctttgtccctcctccgtgacaaggacggt

SEQ ID NO: 80387 - DNA, 30 bp, Homo sapiens
  misc_feature 1..30: note = chr17:37725131-37725161
  misc_feature 1..30: note = hypo
  source 1..30: mol_type = genomic DNA
tgctgctgttggaggcgttcctgccaaatc

SEQ ID NO: 80388 - DNA, 131 bp, Homo sapiens; identical to SEQ ID NO: 36499
  misc_feature 1..131: note = chr17:37752808-37752939
  misc_feature 1..131: note = hyper
  source 1..131: mol_type = genomic DNA

SEQ ID NO: 80389 - DNA, 361 bp, Homo sapiens; identical to SEQ ID NO: 36500
  misc_feature 1..361: note = chr17:37753021-37753382
  misc_feature 1..361: note = hyper
  source 1..361: mol_type = genomic DNA

SEQ ID NO: 80390 - DNA, 365 bp, Homo sapiens
  misc_feature 1..365: note = chr17:37755352-37755717
  misc_feature 1..365: note = hyper
  source 1..365: mol_type = genomic DNA
ttaaccctccccctgcgccgcgccccagcctcggcctgggagcccggccgagcgcgagttcgctgcaagcgggatccgctctgagcccggccggccggcagcctccgcggtattcccggcgcgggcccctccaggggctcccctgcggctcctgggggcaggggtaccctgctgccctccaagactgaggctggatgtggcatctgattgggaagtgggagagatgaagggaagagagaaagccccagtgccctcactcccattctcgggctgttcccaagggagaaggaaaaaactatgtgagtccgttgtgccctcctgcctccgcctgcggtcaagaaagggggcaccggctcaggcttgag

SEQ ID NO: 80391 - DNA, 214 bp, Homo sapiens
  misc_feature 1..214: note = chr17:37756190-37756404
  misc_feature 1..214: note = hyper
  source 1..214: mol_type = genomic DNA
agcgtctccacccaacgctgtgccccagctccctgggcatggccggcgcctagaggttccctcttctcctcccctcggagcgccccagcttcccttccctgccctagggaactaaggtgactccgctcctcgcatctccctcctgaaatccgttgccctccttcctgtgaacccagccccggtcttggccttcttctcacgtccacactcccag

SEQ ID NO: 80392 - DNA, 184 bp, Homo sapiens
  misc_feature 1..184: note = chr17:37757101-37757285
  misc_feature 1..184: note = hyper
  source 1..184: mol_type = genomic DNA
aagcaggcacagccccgtggagcttccagagtatcagggttttcctgccactgatcctcctgggggtcggtgtcccgcagtgatttatcgggctgtctccccgagtcacaaaatcagggctgggggttcactgggggtccatagctcactgtccgagtcatggctggaacgcagctcaacaatg

SEQ ID NO: 80393 - DNA, 679 bp, Homo sapiens
  misc_feature 1..679: note = chr17:37760128-37760807
  misc_feature 1..679: note = hyper
  source 1..679: mol_type = genomic DNA
aggaaggtaaaattgcgtgtgtgtgggtgagtgtgtgggtgtgtcgcctgtgggattgcatttttgcatcgtgtatttggatgcctgatcccctgcctccggtgggcagagggtctccttttgcccctttttgggggaacctccagtaggagccctcagacctctccccgcccacccaccagctaaagccaagaggactccttggaccaaaaaatactctctccagacaccggaaatcgccaggtggcacccaccgaggcacagtccgggcaggggtggggctgcccccaggtctccatccccacccctcaccccaggaggggacagaatggccgcggggaggaggagccggcgagctcacctccttctgccccccggacgccggcgccgggcctgcttgtgcgtgcggtgtggtgtgcgtgtgtctttcatgcaaaccctccctccccaaaccgaccccccaacagtttgccattccatacaaatttggaaacaggtttttaaaaaacagcatgacgcacaacggggacggggcgggggagggcagtggcactggggccccaaatctccgagtcactgattgtaagaacctggggagggggagggggcggcgcgggcccccacttcaccaaagtgcacagatccgcgctcgggcggggcggcccgcaggccgggcggg

SEQ ID NO: 80394 - DNA, 1660 bp, Homo sapiens
  misc_feature 1..1660: note = chr17:37761179-37762839
  misc_feature 1..1660: note = hyper
  source 1..1660: mol_type = genomic DNA
ggttgggggtgagggcgttccaggcccgggctccggcgccctaacttctaccctcttcaagaaagagggagcgcctggctcctttttgcctcggcagctgggtgtctgtttttaaaataataatgagagggggaaacgcgttccattgctcagctgcccccttaccaacgccttgggcctgcagggaggagggggaggaggaaacctcagcgaagatattgggaatgggggaggggtgcctccagggagcccccggagagaggtccctggagaagcactccttgggagagaggaggagggaaccccttggggagagagaaggcgagtcccctgggggaagcgaggcccctgggacaggccacccacaggtaacaggactgcgctgccccaggagagcggcaggaccggtggcccgctccccgcgcccggcgccggggtaggatgggggtgtccctgcgctctgggggctggggacaggggggcgggcaaaggcaaaagaaaaagaagggagccggcgcgaagtctcagttatgaaaaaacgcattgagctcctcgtacatggggccccggtcgtggtgaaggtgcatatcgtaagacaagagattctccgagtggacgcccccgcgcacagccgacgagccgaagactagcccgtggcccgtgggccgcgaaccgggcagcgccgagtagtgcatagagtagtggtagcttttctcgtggtcgggcgaggagtcctgcttgagtgagaagttgccattgagacagagcggggggctgagcgggccctcgtactcggagctgttgtagtccgggctcgcgccgccaccgcctgccgccgcatacagcgtctcgtaggcggcgcagtagccgtgggtccgcagggcgtgcgccgcgccgccgcccaggccgccggccgcctggcactgtgcgcccgccaggcgcgagcacgggtacgggtaggggtgcatggcgaacgggccgcccgagccgtggaagcggccggcaccgtcggcgccttgctccgtgaggaagttgcgagagttgagctgcagacagccggccaccagattggtggtgggctgcgacagacccttgcacagagtctgcacgtaggacactaggtctggccgcttgccggagcgcaggatctccgagagcgcccagatatagttcttggctaggcgcagcgtctcgatcttggacagcttctgcgtcttggagtagcagggcaccaccttgcgcaggttgtccagggctgcgttcaggtcgtgcatgcggttgcgctcccgcgcgttcgccttctgccgccgaagcttggagcgctccaagcgcgccttggtcatcttgcgcttcttgggcccgcgcttcttgggccgctcgccctccgcctcgtccagtccttcttcctcctcctcttcctcctcctcctctccccccagctcgccttcctccttgacctcggccaacgtggcctccgtcccctcttctccacggagagggactggcttggccgcccgggctggccccggagcccctggcccgggcgcaggcggtggcggtggcggcgcgtcgcccttgtcgctcctcggctcgtcgtcttcgccgtcgccccagctggcgaacttgggcacgtccgagagaaggccgggctcgctgaaca

SEQ ID NO: 80395 - DNA, 30 bp, Homo sapiens
  misc_feature 1..30: note = chr17:37763142-37763172
  misc_feature 1..30: note = hyper
  source 1..30: mol_type = genomic DNA
ggtcagggcagggaccgggtgggggtttta

SEQ ID NO: 80396 - DNA, 49 bp, Homo sapiens
  misc_feature 1..49: note = chr17:37763437-37763486
  misc_feature 1..49: note = hyper
  source 1..49: mol_type = genomic DNA
ctcctctagccgatgcgtccccagctcccggagccggctctgggcggcg

SEQ ID NO: 80397 - DNA, 210 bp, Homo sapiens
  misc_feature 1..210: note = chr17:37763928-37764138
  misc_feature 1..210: note = hyper
  source 1..210: mol_type = genomic DNA
gcccctcctcccaaccggcgggtcagatctcgctccctttcggacaacttacctcggagaggagtcaaggggagaggggaggggagggggggagggggcaagagagagaggggggagaagagggatcttctcgcttatttcattgttcccccatcttcagggagcgggggcagcggctcctcaaggcggcgggcgccggcgtcttcagag

SEQ ID NO: 80398 - DNA, 44 bp, Homo sapiens
  misc_feature 1..44: note = chr17:37764263-37764307
  misc_feature 1..44: note = hyper
  source 1..44: mol_type = genomic DNA
cgtctgcactgggggagagccggctcccccgggacccgccgcca

SEQ ID NO: 80399 - DNA, 30 bp, Homo sapiens
  misc_feature 1..30: note = chr17:37768957-37768987
  misc_feature 1..30: note = hypo
  source 1..30: mol_type = genomic DNA
gggcacgccagatggcgtggctgagaatgc

SEQ ID NO: 80400 - DNA, 590 bp, Homo sapiens
  misc_feature 1..590: note = chr17:37783185-37783775
  misc_feature 1..590: note = hyper
  source 1..590: mol_type = genomic DNA
accggagggtgagcccggcagaggcagagacacacgcggagaggaggagaggctgagggagggaggtggagaaggacgggagaggcagagagaggagacacgcagagacactcaggaggggagagacaccgagacgcagagacactcaggaggggagagacaccgagacgcagagacacccaggccggggagcgcgagggagcgaggcacagacctggctcagcgagcgcggggggcgagccccgagtcccgagagcctgggggcgcgcccagcccgggcgccgaccctcctcccgctcccgcgccctcccctcggcgggcacggtatttttatccgtgcgcgaacagccctcctcctcctctcgccgcacagcccgccgcctgcgcgggggagcccagcacagaccgccgccgggaccccgagtcgcgcaccccagccccaccgcccaccccgcgcgccatggaccccaaggaccgcaagaagatccagttctcggtgcccgcgccccctagccagctcgacccccgccaggtggagatggtaaggggcccgtgccccaccccggcagcgtacccgacacaccccgcgg

SEQ ID NO: 80401 - DNA, 177 bp, Homo sapiens
  misc_feature 1..177: note = chr17:37794035-37794212
  misc_feature 1..177: note = hyper
  source 1..177: mol_type = genomic DNA
tctcctggttttcttcgtaccgctctgacagtcggtcaaagtcccgcttcacgttttcctctgtcgcccaacccctcgctctgtacactgaatctcagtggtcttattttcccccacggcttcagctttacaccaactaaatacccagatccacatcttcagcgcagcccttccctg

SEQ ID NO: 80402 - DNA, 147 bp, Homo sapiens
  misc_feature 1..147: note = chr17:37823798-37823945
  misc_feature 1..147: note = hyper
  source 1..147: mol_type = genomic DNA
gccctcacccgggtccggcgccgcccccgaagtggcgggaacaacccgaacccgaaccttctgtcctcgggagcccccagataagcggctgggaacccgcggggcccgcaggggaggcccggctgttccgcccgctaagtgcattag

SEQ ID NO: 80403 - DNA, 314 bp, Homo sapiens
  misc_feature 1..314: note = chr17:37856412-37856726
  misc_feature 1..314: note = hyper
  source 1..314: mol_type = genomic DNA
cccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaaggtgggtctggtgtggggaggggacggagcagcggcgggaccctgccctgtggatgccccgccgaggtcccgcggccggcggggccagaggggcccggacgagctctcctatcccgaagttgtggacagtcgagacgctcagggcagccgggccctggggccc

SEQ ID NO: 80404 - DNA, 219 bp, Homo sapiens
  misc_feature 1..219: note = chr17:37857048-37857267
  misc_feature 1..219: note = hyper
  source 1..219: mol_type = genomic DNA
tgctcctgcttctggcggggtcgggtgtgtgtgtgtgtggtggagtggagggtggcatagcaacctgtcccaaccagagccggggaggaaagggtggcccggagggtggcctcttgctggggtctgggttgggggcgggggagacgtttgctttgaacagattcttggggccagcttagggactgtgctctgtgacttttggagcgcgtggaccatgga

SEQ ID NO: 80405 - DNA, 121 bp, Homo sapiens
  misc_feature 1..121: note = chr17:37879785-37879906
  misc_feature 1..121: note = hypo
  source 1..121: mol_type = genomic DNA
cccagctggtggagccgctgacacctagcggagcgatgcccaaccaggcgcagatgcggatcctgaaagagacggagctgaggaaggtgaaggtgcttggatctggcgcttttggcacagt

SEQ ID NO: 80406 - DNA, 19 bp, Homo sapiens
  misc_feature 1..19: note = chr17:37887184-37887203
  misc_feature 1..19: note = hypo
  source 1..19: mol_type = genomic DNA
tttttttttttgagacgga

SEQ ID NO: 80407 - DNA, 17 bp, Homo sapiens
  misc_feature 1..17: note = chr17:37887620-37887637
  misc_feature 1..17: note = hypo
  source 1..17: mol_type = genomic DNA
cccggtgctgatggcat

SEQ ID NO: 80408 - DNA, 73 bp, Homo sapiens
  misc_feature 1..73: note = chr17:3792191-3792264
  misc_feature 1..73: note = hypo
  source 1..73: mol_type = genomic DNA
ggaccagggtggtggcgtgtgtgtgtgtgtgtgtgtgttgtgggtccccacacaggagcgcactgcatggaga

SEQ ID NO: 80409 - DNA, 30 bp, Homo sapiens
  misc_feature 1..30: note = chr17:38179243-38179273
  misc_feature 1..30: note = hypo
  source 1..30: mol_type = genomic DNA
gaggcaactctgaggcgaggcattccgggg

SEQ ID NO: 80410 - DNA, 44 bp, Homo sapiens
  misc_feature 1..44: note = chr17:38179589-38179633
  misc_feature 1..44: note = hypo
  source 1..44: mol_type = genomic DNA
ctgtctgctgcagcacgtcggcacacatgcgctccaggatcgag

SEQ ID NO: 80411 - DNA, 26 bp, Homo sapiens
  misc_feature 1..26: note = chr17:38237916-38237942
  misc_feature 1..26: note = hypo
  source 1..26: mol_type = genomic DNA
cctttaaaataaaggcgaggctgggt

SEQ ID NO: 80412 - DNA, 349 bp, Homo sapiens
  misc_feature 1..349: note = chr17:38264389-38264738
  misc_feature 1..349: note = hyper
  source 1..349: mol_type = genomic DNA
agaagcaggataaagcgcaaggagacaagaagggagccccgcgcgctttccctccttcctcatcttgcctcctgtttctctggcccacggaggaaggggcccagtgtgtttgtgccggctcgaggctcacgcgggctgccggggtcacatggcccgggcatgtgcagcctgctccatttctaccacaacaactcgctcataaacagcccggctgctgcggcggtggcggtggagacatgtgcaagcgagggggtggggcacgtggccctgcccgagccaagggaaggcgctcgctcagcactgcctccacccctccccagcactggcgctgcctcgtcacaggaaattc

SEQ ID NO: 80413 - DNA, 152 bp, Homo sapiens
  misc_feature 1..152: note = chr17:38347464-38347616
  misc_feature 1..152: note = hyper
  source 1..152: mol_type = genomic DNA
cgccctcctgcctttcgctcctcatcgccttgcactgccatcttcccacccactcccctcaccccctggcgccctggccgcccctccgctgccgtgggtgcagctggagttcgtggactacgtgttccacggggagcgcggccgccgggaga

SEQ ID NO: 80414 - DNA, 265 bp, Homo sapiens
  misc_feature 1..265: note = chr17:38347753-38348018
  misc_feature 1..265: note = hyper
  source 1..265: mol_type = genomic DNA
cggccgtcggcgggatggggggccggaggccggaggcccgcgccgccgcccgcccctgaccccgcctcccacccccgcagctgcaagcagaaccaggacctgctgtctttctacgccgtggtcatggggctggacaacgccgctgtcagccgccttcgactcacctgggaggtgatgagacccctcccgttcctacctgggaatctgggcatcccgggctccccgaagtgcgtcctcccgggacggccgccggcctggagggagt

SEQ ID NO: 80415 - DNA, 30 bp, Homo sapiens
  misc_feature 1..30: note = chr17:38357434-38357464
  misc_feature 1..30: note = hypo
  source 1..30: mol_type = genomic DNA
ggggaaagtattgaccgtgaaggggcatga

SEQ ID NO: 80416 - DNA, 212 bp, Homo sapiens
  misc_feature 1..212: note = chr17:38445259-38445471
  misc_feature 1..212: note = hypo
  source 1..212: mol_type = genomic DNA
ggtaacttgttattgcatcgctcaattggttaagaacttgggctctggcaccagatgcccggggttacattcctgtttttctgtgactttgggccactgtttatctcagttttctcatgtgtaaaataaaggctaataatagtacctactcctaagatcgttgttaaacgagttggtacctaaagtgtttataacagcgcccttccacgtag

SEQ ID NO: 80417 - DNA, 264 bp, Homo sapiens
  misc_feature 1..264: note = chr17:38478595-38478859
  misc_feature 1..264: note = hyper
  source 1..264: mol_type = genomic DNA
gaggccagtagatgccggagatgaacctggaggctcaggacagggcaagagtggggcacgccggggctgggtcctctggctgttccctctccccacagagttacttgaggtcaggcagtctccatgtgtcactgtaccccgcaggcagtgtcaccgtgacccactcgctgtgtgtctgtgtgtacacacctaccttggagtggctttatcccggccctccccccggagcctctgtcccctgggtcctaccgcaggtcctcagcc

SEQ ID NO: 80418 - DNA, 133 bp, Homo sapiens
  misc_feature 1..133: note = chr17:38497512-38497645
  misc_feature 1..133: note = hyper
  source 1..133: mol_type = genomic DNA
aggagacaccttgggcggggctttgctcgccggaagcacgcagagcgtggggaggagggccccctctgcctgtgtttgtgccaacagcacccgcgctgccgcgtcgggttccggcggccggagtcacacatga

SEQ ID NO: 80419 - DNA, 48 bp, Homo sapiens
  misc_feature 1..48: note = chr17:38498548-38498596
  misc_feature 1..48: note = hyper
  source 1..48: mol_type = genomic DNA
ggaggaggaagtgctcgttgacccccagccccgcgctgatcccgcccc

SEQ ID NO: 80420 - DNA, 30 bp, Homo sapiens
  misc_feature 1..30: note = chr17:38604410-38604440
  misc_feature 1..30: note = hyper
  source 1..30: mol_type = genomic DNA
gctgaaacttctggtcgggatggctgggcc

SEQ ID NO: 80421 - DNA, 227 bp, Homo sapiens
  misc_feature 1..227: note = chr17:3866983-3867210
  misc_feature 1..227: note = hyper
  source 1..227: mol_type = genomic DNA
ctgctagctgataagcggcaccttcctgggcgttttctggagccctcaggggagaccctggggccagctgggaggccgagcctgagtctccggccgtccctcgcccgccggtgtctgcgctgcacctgcaggatgccagcgggagcggcgcggcgttggggtggaatacggtccaggatggggtggaataacgcttccagggtggacggggccggagtggaggtggg

SEQ ID NO: 80422 - DNA, 30 bp, Homo sapiens
  misc_feature 1..30: note = chr17:3907085-3907115
  misc_feature 1..30: note = hypo
  source 1..30: mol_type = genomic DNA
tgtgtcagactctgtcgggctggaacaaat

SEQ ID NO: 80423 - DNA, 180 bp, Homo sapiens
  misc_feature 1..180: note = chr17:39682549-39682729
  misc_feature 1..180: note = hypo
  source 1..180: mol_type = genomic DNA
agaataggctacaaaatatcagaggggatttctcttagtatggtgagaattgtgtcacccatttgtgtgtgtgcatgtgcacgcacacacacacacagaggtgagaaaaagaatgcgtaagggtgcgtagtaaaatgtacttattgtcgcaatttttttttttttttgatacagggtctc

SEQ ID NO: 80424 - DNA, 30 bp, Homo sapiens; identical to SEQ ID NO: 36515
  misc_feature 1..30: note = chr17:39683809-39683839
  misc_feature 1..30: note = hyper
  source 1..30: mol_type = genomic DNA

SEQ ID NO: 80425 - DNA, 30 bp, Homo sapiens
  misc_feature 1..30: note = chr17:39705165-39705195
  misc_feature 1..30: note = hyper
  source 1..30: mol_type = genomic DNA
tcctttgtccctaggcggggtgcagcttcc

SEQ ID NO: 80426 - DNA, 180 bp, Homo sapiens
  misc_feature 1..180: note = chr17:39768846-39769026
  misc_feature 1..180: note = hypo
  source 1..180: mol_type = genomic DNA
agatgcggctggagccgcccccgatgccgcctccgatgccgcaggagcccttcatggagctggaggaggtgaactggcggctgcaggtggtcatggtgccaaggagggaggtgagcgagtgagcagttggctgaaagaaggaaaggtgctcaggaaggctgagagcgtgctgtggctgcc

SEQ ID NO: 80427 - DNA, 30 bp, Homo sapiens
  misc_feature 1..30: note = chr17:39788206-39788236
  misc_feature 1..30: note = hypo
  source 1..30: mol_type = genomic DNA
gggcccatctgcatccggcagagacccacc

SEQ ID NO: 80428 - DNA, 36 bp, Homo sapiens; identical to SEQ ID NO: 45073
  misc_feature 1..36: note = chr17:39803800-39803836
  misc_feature 1..36: note = hypo
  source 1..36: mol_type = genomic DNA

SEQ ID NO: 80429 - DNA, 20 bp, Homo sapiens
  misc_feature 1..20: note = chr17:39834139-39834159
  misc_feature 1..20: note = hypo
  source 1..20: mol_type = genomic DNA
acccctctgataaaacgaga

SEQ ID NO: 80430 - DNA, 30 bp, Homo sapiens; identical to SEQ ID NO: 45074
  misc_feature 1..30: note = chr17:39855665-39855695
  misc_feature 1..30: note = hypo
  source 1..30: mol_type = genomic DNA

SEQ ID NO: 80431 - DNA, 144 bp, Homo sapiens
  misc_feature 1..144: note = chr17:401156-401300
  misc_feature 1..144: note = hypo
  source 1..144: mol_type = genomic DNA
cacccctcctggttgcgtgggtggggtggtcctgaagccccgtggcttcctttatttctgccttctctgtagaattcaaacatgaaccctgcagggctagaccaagacacaaatatcaatttctaaaaacacccctttgagggt

SEQ ID NO: 80432 - DNA, 384 bp, Homo sapiens
  misc_feature 1..384: note = chr17:40332806-40333190
  misc_feature 1..384: note = hyper
  source 1..384: mol_type = genomic DNA
catgtccaggagatccgagacggccccgaggatacttgccccccagctcgaacctcaagccccgacctccgtcccactcacgcgttccgtcaaaacgggtggcgatggtgtccaggaaggtgttttgcggggccagcaaccccttcatgaccggcatggccccggggcgtgggttcaaggcgcggcgctggggagctttcagcgcggccgggccggagggggcgcgctgtcggaggggccggggcgccccatgcgccctcctgcctcctcccctccctcttactgccgctgccgctgccgctgcctctgctccgaaccccgtagctctcggctcggctcagcgccgtttcggtcccccccacctccccacgggccaggttcttc

SEQ ID NO: 80433 - DNA, 205 bp, Homo sapiens
  misc_feature 1..205: note = chr17:40400826-40401031
  misc_feature 1..205: note = hyper
  source 1..205: mol_type = genomic DNA
ccaaacagaaagcagcgaattcttgccaacttcccctcctgcttctgcagctagtacgcaatagcatttagtttccagtaaagctccagataaaaacaaagcaaatgtgagacccagaatctacacaatgtcagtgtctcgcttgactgaacgaagggcagtaagatcatatggagctacgctttttcaacgtggtggaagtgtt

SEQ ID NO: 80434 - DNA, 30 bp, Homo sapiens
  misc_feature 1..30: note = chr17:40427458-40427488
  misc_feature 1..30: note = hyper
  source 1..30: mol_type = genomic DNA
acaagtgtttgcaaccgcctcttgctccgt

SEQ ID NO: 80435 - DNA, 334 bp, Homo sapiens
  misc_feature 1..334: note = chr17:40464190-40464524
  misc_feature 1..334: note = hyper
  source 1..334: mol_type = genomic DNA
aaaaagcaggggactcgaggtttggggaaatgatggagatgggcgcgggtgggcagaactctgacccaggcttctccttagcagctgctgctcccagcagcctcgaagctggcggctgagggcccggcgccaagatgcttctcaaccctcggggccaggggcagtcccagagccgcaacaaccgtcccatcctcctccttcccagagaccagcaggtggcaccacgcggctgcgctgttttcagctggctgccggcgactgtgcgaggcggaggtgcagcaagcgggaccggctcgccccggctggacccccgcactgccggctgcagccagtc

SEQ ID NO: 80436 - DNA, 39 bp, Homo sapiens
  misc_feature 1..39: note = chr17:40477850-40477889
  misc_feature 1..39: note = hypo
  source 1..39: mol_type = genomic DNA
attacaggcgtgagccaccgcgcccggccaatcaatttc

SEQ ID NO: 80437 - DNA, 24 bp, Homo sapiens
  misc_feature 1..24: note = chr17:40536417-40536441
  misc_feature 1..24: note = hypo
  source 1..24: mol_type = genomic DNA
gattacaggcgtgagccaccgcgc

SEQ ID NO: 80438 - DNA, 84 bp, Homo sapiens
  misc_feature 1..84: note = chr17:40573790-40573874
  misc_feature 1..84: note = hyper
  source 1..84: mol_type = genomic DNA
gctgcgcctggcccccgcccccgcaggcatgcggggtgattcacctcgcccagactgcgcccagaccgccggaccccgcagggg

SEQ ID NO: 80439 - DNA, 350 bp, Homo sapiens
  misc_feature 1..350: note = chr17:40574086-40574436
  misc_feature 1..350: note = hyper
  source 1..350: mol_type = genomic DNA
tggggaggaggttggcggtcgcgttccccgcttggcacagcccccgctggtgcgtgcctgagccctgaatcacccgctatatcaggcccgcaggcgcagaggccccaggcccgggccccgcagccagtgtccgcttacagcggaccccaacgatcgcgagggacccctgactttcctagaaacttcccccaagtaggaagaagtttgacagagccaattagggagggagcggtctgcgaggggcagcgtcctcgagtccacccgctaattcggttctgctacaagtttgggacccgagggaaggatctgagtggggaggtgcgaggtgcagagcgcgcccctctacgcgc

SEQ ID NO: 80440 - DNA, 84 bp, Homo sapiens
  misc_feature 1..84: note = chr17:40669654-40669738
  misc_feature 1..84: note = hyper
  source 1..84: mol_type = genomic DNA
cctcctggcaaaatgcggctgtgcgtccaggatgcctggatcttccctgtggcccaggactgcaggaggcgttctgagctgtgg

SEQ ID NO: 80441 - DNA, 46 bp, Homo sapiens
  misc_feature 1..46: note = chr17:40689596-40689642
  misc_feature 1..46: note = hypo
  source 1..46: mol_type = genomic DNA
tatggcgggagccaccgtaggtgttttcacccgccccccagcatgg

SEQ ID NO: 80442 - DNA, 123 bp, Homo sapiens
  misc_feature 1..123: note = chr17:40705905-40706028
  misc_feature 1..123: note = hypo
  source 1..123: mol_type = genomic DNA
gtgagtcaacacccccgttccccgaaccctcttaactctgacctagagacgccgagcaccctgtcctgcgggagccgctctggggcgatctccctggccctctctgcccggctcacattagct

SEQ ID NO: 80443 - DNA, 24 bp, Homo sapiens
  misc_feature 1..24: note = chr17:40801969-40801993
  misc_feature 1..24: note = hypo
  source 1..24: mol_type = genomic DNA
ctccctctccgaaaaaaaaaaaac

SEQ ID NO: 80444 - DNA, 152 bp, Homo sapiens
  misc_feature 1..152: note = chr17:40831916-40832068
  misc_feature 1..152: note = hyper
  source 1..152: mol_type = genomic DNA
acgcgcagcgcacgccggcgctcgggccccctggcggccagcagcgtgcggcccagaagcgcgtagcaggctaccatgacgcccagcggcagcgcgaagcccagggccacctgcgccacggcgctcgcccccttcaccgtctgcgtgaggcc

SEQ ID NO: 80445 - DNA, 15 bp, Homo sapiens
  misc_feature 1..15: note = chr17:40893475-40893490
  misc_feature 1..15: note = hypo
  source 1..15: mol_type = genomic DNA
cggcctgctcccaaa

SEQ ID NO: 80446 - DNA, 143 bp, Homo sapiens
  misc_feature 1..143: note = chr17:40912910-40913053
  misc_feature 1..143: note = hyper
  source 1..143: mol_type = genomic DNA
ggggcgactcgaattcggggagcgatcctgggagaccctggagagtcctgggcgccacgcagccgagcccccgaaatagatcccggttccggggttccgggagctgtccagcctcgcggggtgagctacgagagggtgggcca

SEQ ID NO: 80447 - DNA, 30 bp, Homo sapiens
  misc_feature 1..30: note = chr17:40921807-40921837
  misc_feature 1..30: note = hypo
  source 1..30: mol_type = genomic DNA
gtgccataaagtcaacggaaatagtgagct

SEQ ID NO: 80448 - DNA, 324 bp, Homo sapiens
  misc_feature 1..324: note = chr17:40932499-40932823
  misc_feature 1..324: note = hyper
  source 1..324: mol_type = genomic DNA
gctgctcgcgggatccgcaccgcgggagcagctcggaggggcggccctggggggcaagggcgggccgcggggcggcgacgggggcggggccaggccgagctgggggctggggccgcagccgctcagccggagcgcagcgcacccagcgagtccgtctgtcaggccgcctcctctccggccgtctgattttctacccttcggcgccctgctcttcctcatgttggcatccccggccacggagaccaccgtcctcatgtcccagactgaggccgacctggccctgcggcccccgcctcctcttggcaccgcggggcagccccgcct

SEQ ID NO: 80449 - DNA, 82 bp, Homo sapiens
  misc_feature 1..82: note = chr17:40932843-40932925
  misc_feature 1..82: note = hyper
  source 1..82: mol_type = genomic DNA
cgcgccgcttctccgggaaggctgagccccggccgcgctcttctcgtctcagccgccgtagctcagtcgacttggggctgct

SEQ ID NO: 80450 - DNA, 40 bp, Homo sapiens
  misc_feature 1..40: note = chr17:40933234-40933274
  misc_feature 1..40: note = hyper
  source 1..40: mol_type = genomic DNA
cctcaagtttgacatcgagattggacgtggctccttcaag

SEQ ID NO: 80451 - DNA, 30 bp, Homo sapiens
  misc_feature 1..30: note = chr17:40951150-40951180
  misc_feature 1..30: note = hypo
  source 1..30: mol_type = genomic DNA
agagacgattgaagacgccctgcttcactt

SEQ ID NO: 80452 - DNA, 103 bp, Homo sapiens; identical to SEQ ID NO: 16200
  misc_feature 1..103: note = chr17:40975574-40975677
  misc_feature 1..103: note = hypo
  source 1..103: mol_type = genomic DNA

SEQ ID NO: 80453 - DNA, 34 bp, Homo sapiens
  misc_feature 1..34: note = chr17:41131532-41131566
  misc_feature 1..34: note = hypo
  source 1..34: mol_type = genomic DNA
gggaagccaggccctcggacggcagggccactac

SEQ ID NO: 80454 - DNA, 30 bp, Homo sapiens; identical to SEQ ID NO: 45079
  misc_feature 1..30: note = chr17:41188525-41188555
  misc_feature 1..30: note = hypo
  source 1..30: mol_type = genomic DNA

SEQ ID NO: 80455 - DNA, 146 bp, Homo sapiens
  misc_feature 1..146: note = chr17:41278547-41278693
  misc_feature 1..146: note = hypo
  source 1..146: mol_type = genomic DNA
tgcaaagaagaggggcgactttttccgtgtctccggacagctaatcgttttagtgacaggatgagagagcccttcgtgttctgagggaccgagtgggcgaaaagcgccggagagttggagagtctgtggttcagaatgcgaggtga

SEQ ID NO: 80456 - DNA, 35 bp, Homo sapiens
  misc_feature 1..35: note = chr17:41290312-41290347
  misc_feature 1..35: note = hypo
  source 1..35: mol_type = genomic DNA
atactatatggcctgcggaccgctcagctttcatt

SEQ ID NO: 80457 - DNA, 20 bp, Homo sapiens
  misc_feature 1..20: note = chr17:41416854-41416874
  misc_feature 1..20: note = hypo
  source 1..20: mol_type = genomic DNA
ccttgcgggatctgcagact

SEQ ID NO: 80458 - DNA, 280 bp, Homo sapiens
  misc_feature 1..280: note = chr17:41464702-41464982
  misc_feature 1..280: note = hypo
  source 1..280: mol_type = genomic DNA
ttctctgatagaggacgtatcagatattaaactgataagaacagatactacacttgatcttagccaaaaggacgagaagagatgtcgtcgccttcctccctgccatcaccgtcccactctcatctacattcaagacgcggtgagagccccagcctcgctccttgcctcattcactttgtcttgtccacaccaatattgacgccattacacactcgggctgatttcttattctccacgttttaaaagaaaaatctgccgggcgcagtggctcacgccagta

SEQ ID NO: 80459 - DNA, 30 bp, Homo sapiens
  misc_feature 1..30: note = chr17:41651782-41651812
  misc_feature 1..30: note = hypo
  source 1..30: mol_type = genomic DNA
caggcctcctgacaccgtcctgccagttag

SEQ ID NO: 80460 - DNA, 80 bp, Homo sapiens; identical to SEQ ID NO: 36525
  misc_feature 1..80: note = chr17:41723454-41723534
  misc_feature 1..80: note = hyper
  source 1..80: mol_type = genomic DNA

SEQ ID NO: 80461 - DNA, 94 bp, Homo sapiens
  misc_feature 1..94: note = chr17:41723778-41723872
  misc_feature 1..94: note = hyper
  source 1..94: mol_type = genomic DNA
gacgacgggcgcggtcggggactggtttcccaatcttctcccgtcccgaggcttagtgtttcccagcccttcctttccacggttgcggggagtg

SEQ ID NO: 80462 - DNA, 56 bp, Homo sapiens
  misc_feature 1..56: note = chr17:41791451-41791507
  misc_feature 1..56: note = hyper
  source 1..56: mol_type = genomic DNA
ggggcccagctcccccgggcgaccgttcctatctgagttctcgttcctatctgggt

SEQ ID NO: 80463 - DNA, 32 bp, Homo sapiens; identical to SEQ ID NO: 36527
  misc_feature 1..32: note = chr17:41832619-41832651
  misc_feature 1..32: note = hyper
  source 1..32: mol_type = genomic DNA

SEQ ID NO: 80464 - DNA, 66 bp, Homo sapiens
  misc_feature 1..66: note = chr17:41957220-41957286
  misc_feature 1..66: note = hypo
  source 1..66: mol_type = genomic DNA
catacaggttgccctcgtattcgccatgctccaggtagcgcccagcacggacgtcagcctccatct

SEQ ID NO: 80465 - DNA, 516 bp, Homo sapiens
  misc_feature 1..516: note = chr17:41983831-41984347
  misc_feature 1..516: note = hyper
  source 1..516: mol_type = genomic DNA
atcacccatagtgtccgcaggcgagcggaccagcagtgaaagggagaggtttcttccaacctcccacccatccctccatccatacacatacaaagaggtgcggagaagaaaggtctgacaaaggcgctttggagagcgagaggtcgcggggaggtctggacagaactgagggccagaggatggggtcgaaaggccaggcggacgtgcatgcttggaccatcagatcacccctgccccaacggacccagccctaacaccctgggcgctaggacctgggggaggggggcgtgttgtgagccatcaaagaaggctctctacgtgcgcgcccgccggagaccagggatgaggtcactaaatgactgccccggccaacccccaccccgtctttatccgcaccgccccccccttaattgacctaactttctaaccctagctcttcgcttctggcaccggtcccctcccaagtctccagaccctaaccctggctcccgacccgccccgctacagcttgggaag

SEQ ID NO: 80466 - DNA, 209 bp, Homo sapiens; identical to SEQ ID NO: 36530
  misc_feature 1..209: note = chr17:41984363-41984572
  misc_feature 1..209: note = hyper
  source 1..209: mol_type = genomic DNA

SEQ ID NO: 80467 - DNA, 39 bp, Homo sapiens
  misc_feature 1..39: note = chr17:41984976-41985015
  misc_feature 1..39: note = hyper
  source 1..39: mol_type = genomic DNA
gggaggtgaggagaacgcggaggccggcacaactcggag

SEQ ID NO: 80468 - DNA, 38 bp, Homo sapiens
  misc_feature 1..38: note = chr17:42015533-42015571
  misc_feature 1..38: note = hyper
  source 1..38: mol_type = genomic DNA
cgctgaccacagccccggcatcacgtgacctcccgcgg

SEQ ID NO: 80469 - DNA, 422 bp, Homo sapiens; identical to SEQ ID NO: 36531
  misc_feature 1..422: note = chr17:42030329-42030751
  misc_feature 1..422: note = hyper
  source 1..422: mol_type = genomic DNA

SEQ ID NO: 80470 - DNA, 15 bp, Homo sapiens
  misc_feature 1..15: note = chr17:42030779-42030794
  misc_feature 1..15: note = hyper
  source 1..15: mol_type = genomic DNA
cgcccctaggcagac

SEQ ID NO: 80471 - DNA, 187 bp, Homo sapiens
  misc_feature 1..187: note = chr17:42061233-42061420
  misc_feature 1..187: note = hyper
  source 1..187: mol_type = genomic DNA
caggggccgcgtgtccggtgccggccgggctgagtgttccgaggcgagcggctgctgtttgcgcagctaagtggcgtctgtgtacccagcggggcgcagcggtcgcgcgcttatctcccgcaaacaccgcgcccggatccgccggaaccacggccgcgccgccccatttgcacgccccggccgccgg

SEQ ID NO: 80472 - DNA, 1570 bp, Homo sapiens
  misc_feature 1..1570: note = chr17:42082149-42083719
  misc_feature 1..1570: note = hyper
  source 1..1570: mol_type = genomic DNA
cgaggggcaccagcccggggcgccggctcagcaccgcctggtcgcagccccagcccccgcccgaggagtacgcgggcgcggacgacgtctcccagtcgcccgtcgccgaggagccgtcgtgggtgccgagtcccaggcccccggtgccccacgagtccccagagcctccttcgggccgctcgctggtgcagcgggacatccaggccttcctgaaccagtgcggggccagccctggggaggcgcgccactggctcacgcagttccagacctgccatcactccgcggacaagcccttcgccgtcatcgaggtgagcggagcccggcgtgggccgtgacgcagcgaggggatggggttgtgcggccacctgtcctcaggcatggcaggatacgctgcgggctctgcgcagcggaagcgggaaggagcccggcagggcccagaccagcgccgccgggaatgggagaggccgtaagctcctccggaagcctcccgcccagcccgagtgaggatcctgggggaccccacccgccaggtgtgatgctctgaagaaggcccccaacatgggcgcagttaggggttcagaaggacctggacaggagccgcttgcactgcccctcccccaaagatgtcccggagtccaaggtcggagggaggagggcgggaggtaccccagcgtgagacaagggagtggcaagacccaacggggcaaagggcggagcaggtgggcactggtggccagaactgggtcctgacagcttctggaagggtagggtcaccgagacggccctgcaggccaggctgtgggagccagcggctcaggtccgtgtcacgctccttgaaagcccactcctccgcaggtggacgaggaggtgctcaagtgccagcagggcgtatccagtctggcctttgccctggccttcttgcagcgcatggacatgaagccgctggtggtcctggggctgccggcccctacggctccctcgggctgtctttccttctgggaggccaaggcgcagctggccaagagctgcaaggtgctggtagacgcgcttcgacacaacgccgccgctgctgtgccattttttggcggcgggtctgtgctacgcgctgccgagccggctccccatgccaggtgagtgcccgccctgcccgcccaggcgtcctcagagcgtgctactctgcccgccctgccccgtccggcaggcctggagggggccctctcgagcaccacgtctggcccacagctacggcggcatcgtctcggtggagacagacctgctgcagtggtgcctggagtcgggcagcatccccatcctgtgccccatcggggagacggccgcgcgccgctccgtgcttctcgactccctggaggtgaccgcgtcgctggccaaggcgctgcggcccaccaaaatcatcttcctcaataacacaggcggcctgcgcgacagcagtcataaggtgcggccctttctttcaccttcccccacgccggcgatccgggccttctcttgcgcccctcgcacttctccccgacgggccgcagactcactagcaagccgggtgggtagaaaa

SEQ ID NO: 80473 - DNA, 129 bp, Homo sapiens
  misc_feature 1..129: note = chr17:42091732-42091861
  misc_feature 1..129: note = hyper
  source 1..129: mol_type = genomic DNA
agtccccgtagtggacgtagcccccgatgtaggcggcgtaggtgctaatggccaattggagtgcggcccccagcgcgaaccagcgccgcttcacgccaaaggacatgaaactagcgcacagcacggctg

SEQ ID NO: 80474 - DNA, 59 bp, Homo sapiens
  misc_feature 1..59: note = chr17:42092128-42092187
  misc_feature 1..59: note = hyper
  source 1..59: mol_type = genomic DNA
tcttgcccacatcaccgccccctgccgcgtttagcggctgcgtaggcctgctcaccggc

SEQ ID NO: 80475 - DNA, 169 bp, Homo sapiens
  misc_feature 1..169: note = chr17:42092188-42092357
  misc_feature 1..169: note = hyper
  source 1..169: mol_type = genomic DNA
tgcctcagccctctcagcgtacagcatgagctggctgaagcagccccaaaaggggcagcgtgtgagcagcaccgaacccaactgcatgatcagctgcaacatccaccgtctcgaacctatcttcgacgccatcttgggaaagggcagtccgctgcggcctcaccccagt

SEQ ID NO: 80476 - DNA, 89 bp, Homo sapiens
  misc_feature 1..89: note = chr17:42142826-42142915
  misc_feature 1..89: note = hypo
  source 1..89: mol_type = genomic DNA
agatgccataaaaaattactcctccaaaaaaaaattccaataaacccacctgtggctcacataaaaagggaagccgtggcacatttatc

SEQ ID NO: 80477 - DNA, 80 bp, Homo sapiens
  misc_feature 1..80: note = chr17:42222379-42222459
  misc_feature 1..80: note = hypo
  source 1..80: mol_type = genomic DNA
ggccctagattgtttaagtctttaacgaaatcccatttcttctcattccttagtcctttcccagccgtagcaaaaacaaa

SEQ ID NO: 80478 - DNA, 75 bp, Homo sapiens
  misc_feature 1..75: note = chr17:42287799-42287874
  misc_feature 1..75: note = hyper
  source 1..75: mol_type = genomic DNA
cgactgagccttgagcgccgcctctcgggccttgtacttggcctgcggggatggcccgggcgtcagccttccacc

SEQ ID NO: 80479 - DNA, 120 bp, Homo sapiens
  misc_feature 1..120: note = chr17:42301918-42302038
  misc_feature 1..120: note = hypo
  source 1..120: mol_type = genomic DNA
ctgcgcccggcctgtcccttgttatttttttattgctgtgtaagtcagagatagtaaagtacacatactttaagtatacaacttttttttttgagacggagctttgctcttgtcacccag

SEQ ID NO: 80480 - DNA, 23 bp, Homo sapiens
  misc_feature 1..23: note = chr17:42329685-42329708
  misc_feature 1..23: note = hypo
  source 1..23: mol_type = genomic DNA
acaacccccggcctctatcggtc

SEQ ID NO: 80481 - DNA, 325 bp, Homo sapiens
  misc_feature 1..325: note = chr17:42330572-42330897
  misc_feature 1..325: note = hypo
  source 1..325: mol_type = genomic DNA
ccatgacagtgagggcgttggcatgggtgacggaacgcacggtggtggcactgagccagggcatcccaaagagggcggccaccccacccatgcctactaccagcagcaggtccaggtggaagccggagcccttgaccatcttgcgctcaggtttgctgacaatcagcctacggtaggggaaggtgaggggtaagcagggttctcccctgcctcctccaccccctccttccttctccatacttggtgtccttgtagctcagttttgtcttctgtgcccctcgctctttgagttccttgctcccctccctcccgccccatcttgaga

SEQ ID NO: 80482 - DNA, 135 bp, Homo sapiens
  misc_feature 1..135: note = chr17:42331636-42331771
  misc_feature 1..135: note = hypo
  source 1..135: mol_type = genomic DNA
cccggccacgttttttttttcttaaaaagagctctccaaattatacaacttctggtcccacaaaacctggaactgcccctggcttttcactattcctgctagtcgggagggccacacacccgcagggactagctt

SEQ ID NO: 80483 - DNA, 58 bp, Homo sapiens
  misc_feature 1..58: note = chr17:42335454-42335512
  misc_feature 1..58: note = hypo
  source 1..58: mol_type = genomic DNA
aggtaataggggtagcggcgccggatatcacgcaccaggcccccgaagagctggcctg

SEQ ID NO: 80484 - DNA, 30 bp, Homo sapiens
  misc_feature 1..30: note = chr17:42335968-42335998
  misc_feature 1..30: note = hypo
  source 1..30: mol_type = genomic DNA
atgtaggcatctatgcggaacacctagggg

SEQ ID NO: 80485 - DNA, 30 bp, Homo sapiens
  misc_feature 1..30: note = chr17:42364250-42364280
  misc_feature 1..30: note = hypo
  source 1..30: mol_type = genomic DNA
tccataatttcattacggtgtgtaattgaa

SEQ ID NO: 80486 - DNA, 79 bp, Homo sapiens
  misc_feature 1..79: note = chr17:4236625-4236704
  misc_feature 1..79: note = hypo
  source 1..79: mol_type = genomic DNA
gaagaaaaaaacttacgggcgaagctgttccctaaacagctaaaatatgtaaaatgtaaaagacgggccgggcacggtg

SEQ ID NO: 80487 - DNA, 44 bp, Homo sapiens
  misc_feature 1..44: note = chr17:42390058-42390102
  misc_feature 1..44: note = hypo
  source 1..44: mol_type = genomic DNA
caaaggtgggcccagcgcccctcccccagcggtccctcccccag

SEQ ID NO: 80488 - DNA, 74 bp, Homo sapiens
  misc_feature 1..74: note = chr17:42392337-42392411
  misc_feature 1..74: note = hyper
  source 1..74: mol_type = genomic DNA
tggtcatcgattacacgccctacctaaagttcacgcagaggtgagcggctccatgactgcggcggggcggggga

SEQ ID NO: 80489 - DNA, 291 bp, Homo sapiens
  misc_feature 1..291: note = chr17:42392465-42392756
  misc_feature 1..291: note = hyper
  source 1..291: mol_type = genomic DNA
cgcagacgcgcggggggaggggcgggaccggccgtgcccactgctccctctcccaagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaaggtgcgcgacgccggcgggcccggggggcgggcgggccgggcgggggatccgggcatcccggggcgggg

SEQ ID NO: 80490 - DNA, 205 bp, Homo sapiens
  misc_feature 1..205: note = chr17:42392796-42393001
  misc_feature 1..205: note = hyper
  source 1..205: mol_type = genomic DNA
cgggctgagccggcgccccgcagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgtgagcgcacggcctgccctaacc

SEQ ID NO: 80491 - DNA, 155 bp, Homo sapiens
  misc_feature 1..155: note = chr17:42393420-42393575
  misc_feature 1..155: note = hyper
  source 1..155: mol_type = genomic DNA
accaccctgatcttgcggcaagatccccaagacgatcttacacttcagggattcccacactatcctccactgacgtccccatcaccccagctgaccccaacaacactgcaccattccctccaactcccaatatttgtgcacgaatccctgtcacc

SEQ ID NO: 80492 - DNA, 329 bp, Homo sapiens
  misc_feature 1..329: note = chr17:42393870-42394199
  misc_feature 1..329: note = hyper
  source 1..329: mol_type = genomic DNA
aactccaagctctaccggaggtaagccccagccaggtggggcttgggcctgagagcgggtcgtcctggggaagaagggcttcctctaccggcgcaccagctctcgctctgccgcagacacagcttcatgagcacggagccgctgtcagctgaagccagtctgagctcggactcccagcgcctgggagagggcacgcgggacgaggagccctggggtcccatcggtgagctcccccaacccaacacccagtacccctccagaaagggctgaggcaaggccctgaggcctcaaggcatgtcctcattcattctcttagtcttttttttttt

SEQ ID NO: 80493 - DNA, 41 bp, Homo sapiens; identical to SEQ ID NO: 16204
  misc_feature 1..41: note = chr17:42395128-42395169
  misc_feature 1..41: note = hypo
  source 1..41: mol_type = genomic DNA

SEQ ID NO: 80494 - DNA, 30 bp, Homo sapiens
  misc_feature 1..30: note = chr17:42395520-42395550
  misc_feature 1..30: note = hypo
  source 1..30: mol_type = genomic DNA
gctgcaagtccctggcgagcttcaaatcca

SEQ ID NO: 80495 - DNA, 24 bp, Homo sapiens
  misc_feature 1..24: note = chr17:42401293-42401317
  misc_feature 1..24: note = hypo
  source 1..24: mol_type = genomic DNA
caccgcacccggcccactgtgaga

SEQ ID NO: 80496 - DNA, 124 bp, Homo sapiens
  misc_feature 1..124: note = chr17:42402772-42402896
  misc_feature 1..124: note = hyper
  source 1..124: mol_type = genomic DNA
cactggaaaccccagcgccttctggacggcgagggtgacgcactggccctcttcctcggtgtcctcaggtgcgtggcggcggcagtgagaatgagttcttcgagatcgccgggagaccacacaa

SEQ ID NO: 80497 - DNA, 20 bp, Homo sapiens
  misc_feature 1..20: note = chr17:42587335-42587355
  misc_feature 1..20: note = hypo
  source 1..20: mol_type = genomic DNA
ccagacgccttctcaaaaaa

SEQ ID NO: 80498 - DNA, 612 bp, Homo sapiens
  misc_feature 1..612: note = chr17:42635148-42635760
  misc_feature 1..612: note = hyper
  source 1..612: mol_type = genomic DNA
ctccatcccggaccacggcttctgccagcccatctccatcccgctgtgcacggacatcgcctacaaccagaccatcatgcccaaccttctgggccacacgaaccaggaggacgcaggcctagaggtgcaccagttctatccgctggtgaaggtgcagtgctcgcccgaactgcgcttcttcctgtgctccatgtacgcacccgtgtgcaccgtgctggaacaggccatcccgccgtgccgctctatctgtgagcgcgcgcgccagggctgcgaagccctcatgaacaagttcggttttcagtggcccgagcgcctgcgctgcgagcacttcccgcgccacggcgccgagcagatctgcgtcggccagaaccactccgaggacggagctcccgcgctactcaccaccgcgccgccgccgggactgcagccgggtgccgggggcaccccgggtggcccgggcggcggcggcgctcccccgcgctacgccacgctggagcaccccttccactgcccgcgcgtcctcaaggtgccatcctatctcagctacaagtttctgggcgagcgtgattgtgctgcgccctgcgaacctgcgcggcccgatggttccatgtt

SEQ ID NO: 80499 - DNA, 414 bp, Homo sapiens
  misc_feature 1..414: note = chr17:42733506-42733920
  misc_feature 1..414: note = hyper
  source 1..414: mol_type = genomic DNA
ctatcagcaaatcatcgggccggtgcctgccagtccgggccaatcccgaacacatttactttgagcgggaaaagctcagaagcggcgagagagcgtggtccgctaaccgccccttcctctccttgtctctggggggtaacggagcctggagtggtcgcccattggatgggcatcggaccaatggcgggctgcgaaacgggaggggcgggcctcacagcggggcggggcgcgcctgtgccgtgtcgcgtgccgagccgcgagccccaggcaggccaggtaacggcctctgcccccgcccctccctccccgctcggacttcccttacccgcacactggctccaggcagcgcccgggcggcggaggcggctgcggagacggcggggtgcgggctgagggagccgggcctggacgccc

SEQ ID NO: 80500 - DNA, 43 bp, Homo sapiens
  misc_feature 1..43: note = chr17:42734191-42734234
  misc_feature 1..43: note = hyper
  source 1..43: mol_type = genomic DNA
gcggggggcgcggcgcgggctgactggacgggccggacggagc

SEQ ID NO: 80501 - DNA, 17 bp, Homo sapiens
  misc_feature 1..17: note = chr17:42737897-42737914
  misc_feature 1..17: note = hypo
  source 1..17: mol_type = genomic DNA
cccggccagaattacat

SEQ ID NO: 80502 - DNA, 82 bp, Homo sapiens; identical to SEQ ID NO: 45090
  misc_feature 1..82: note = chr17:42787212-42787294
  misc_feature 1..82: note = hypo
  source 1..82: mol_type = genomic DNA

SEQ ID NO: 80503 - DNA, 82 bp, Homo sapiens; identical to SEQ ID NO: 45091
  misc_feature 1..82: note = chr17:42787534-42787616
  misc_feature 1..82: note = hypo
  source 1..82: mol_type = genomic DNA

SEQ ID NO: 80504 - DNA, 54 bp, Homo sapiens
  misc_feature 1..54: note = chr17:42835736-42835790
  misc_feature 1..54: note = hyper
  source 1..54: mol_type = genomic DNA
tggttggagtgacagcgatccctgaagccctcctggaggccggggcatctttgg

SEQ ID NO: 80505 - DNA, 30 bp, Homo sapiens
  misc_feature 1..30: note = chr17:42849487-42849517
  misc_feature 1..30: note = hypo
  source 1..30: mol_type = genomic DNA
ctgggagatcagatccgacatgggagctgt

SEQ ID NO: 80506 - DNA, 30 bp, Homo sapiens
  misc_feature 1..30: note = chr17:42865115-42865145
  misc_feature 1..30: note = hypo
  source 1..30: mol_type = genomic DNA
ttggggcaaacaatgcgggctgccaactcc

SEQ ID NO: 80507 - DNA, 1049 bp, Homo sapiens
  misc_feature 1..1049: note = chr17:42906582-42907631
  misc_feature 1..1049: note = hyper
  source 1..1049: mol_type = genomic DNA
tcccaatcagacaatcgcaaaaaaaagaacaaaatctaaaccatacattcacgtacatcttttcaactcagagctccaaacgcagccgccaaccacacaactgcccacaatcacagcggtagcgcctactcttaattttgaagctagagacttaaggaaacacacacacacacaaaacagttctcaagtttgacaaagtgggggaaaagtcattttaagtaaagacaacgagttaatcaggaggcgatgagcccagtccttccgccccgctttcccgcttccagccctcgaacgaaccctcctctaacccccgggaggcaggagttccagcggggagatgcgggaagcctcagacgagcccgcacgccgccggagacgcagggatcgaggtcggggagacaaagagcagcccgcgaagagcccgggcggcgaggggcggcccggctccgccctgcgcccctaaccgcccgggtagttgtcggcaccgccggggcgccgccgagtgcgcgccgcttctgtccgggctccccgaccgtcgcccgacacctccgcggcccaggacacccccgagccgtttccctcccgatttgggagccgcgcgcctggggacaaagagggagggtgcgccggggacagtggcaggacgcgggccggcgacgcccctccggactcggcgggaacccctcggcggcgcccccctccttctcccgctctggccgcgctcctccccggacctccggaggttctcctcggcccctccccgggctccccaagagttctcccgcctccccctgggaccccgcccctggcccgcttctcctcagccggccctgcggccgcccctcacccggcggcgggttcccccggagccgcctcctccgccgggcctcggcccgtcccgccggtcgcggcctcatgtgccccgcgtcgccatcgccttcaccctcgcctctcctccacctcctccgccgctgccgccttcgcctcagtctccagccgaggcagaagccgctcccgccgctgccgccgccgccgccgcctcccgctcc

SEQ ID NO: 80508 - DNA, 497 bp, Homo sapiens
  misc_feature 1..497: note = chr17:42907654-42908151
  misc_feature 1..497: note = hyper
  source 1..497: mol_type = genomic DNA
cgcctgcgcactgcgcgctgcggtgggggcgggggcgtcccgccgcggcccgggagcggggggcgcgcggcacgtggcgctcgagtgggaggggggcgccccagaacgcgcgggaagcgacgcgagcgccaactttccgcggtcgagtcctcgccgctctctcggatagtccgggacgcggcggaggcgcggcgcgcgtgggagtcacccgcgtggagtctggaccccgggtgggcgcagacttcgctccggacagttcattcttccaagctgattttcgggcgagagtcccccgccagccgcgcctcagtttgagcgggccgctaacggcgccgtgggttctcgccttacctgggtatcctgggttggtttagcgggcccagagttgtcttctgcgcgctccgccgaggccttggtccattgtagcacgggatgctaatgtctcctcccaggttctgctctacaattcctcgaggatctggcgggccctgcgtgga

SEQ ID NO: 80509 - DNA, 200 bp, Homo sapiens
  misc_feature 1..200: note = chr17:42988598-42988798
  misc_feature 1..200: note = hyper
  source 1..200: mol_type = genomic DNA
ctcaccggttctcctcgccctctagcagcttcctgtaggtggcgatctcgatgtccagggccagcttgacattgagcaggtcctggtactcctgcaagtggcgggccatctcgtccttgaggctctgcccctcttcctccagccgcgccagcgcctcctgataactggccgcctcccgcacgtgccgctcctcctgctcg

SEQ ID NO: 80510 - DNA, 254 bp, Homo sapiens
  misc_feature 1..254: note = chr17:43001692-43001946
  misc_feature 1..254: note = hypo
  source 1..254: mol_type = genomic DNA
tggagatggaagtcacgagccaggtggacgggtgttggcagcagactgcactggacttaagcctgtggggattagcttggagcctcacctaagacctgggggccactaagaaggcagaactcctagcaacccaccgccaaggccgtagaagggtggaacagacctccaggtgcaattactcccaaacccacggagaagaggaggccctttagggcgtattgggctgtgaagtgaagagccgggctcagacctca

SEQ ID NO: 80511 - DNA, 12 bp, Homo sapiens
  misc_feature 1..12: note = chr17:43037677-43037689
  misc_feature 1..12: note = hyper
  source 1..12: mol_type = genomic DNA
tgttgctggcgt

SEQ ID NO: 80512 - DNA, 299 bp, Homo sapiens; identical to SEQ ID NO: 36547
  misc_feature 1..299: note = chr17:43044508-43044807
  misc_feature 1..299: note = hyper
  source 1..299: mol_type = genomic DNA

SEQ ID NO: 80513 - skipped

SEQ ID NO: 80514 - DNA, 228 bp, Homo sapiens; identical to SEQ ID NO: 12730
  misc_feature 1..228: note = chr17:43045038-43045266
  misc_feature 1..228: note = hyper
  source 1..228: mol_type = genomic DNA

SEQ ID NO: 80515 - DNA, 158 bp, Homo sapiens
  misc_feature 1..158: note = chr17:43045371-43045529
  misc_feature 1..158: note = hyper
  source 1..158: mol_type = genomic DNA
cgagctcaccagcacggggatgagcaccaccagcaccagcagcatcaccacacccgcggcggccgctagcagcgtctttcggcccgcgcggagcctggggagcgccgggccgcccggccgcgccgtcggggcaatggtgccggcgggcagggggcgcg

SEQ ID NO: 80516 - DNA, 233 bp, Homo sapiens; identical to SEQ ID NO: 36551
  misc_feature 1..233: note = chr17:43047752-43047985
  misc_feature 1..233: note = hyper
  source 1..233: mol_type = genomic DNA

SEQ ID NO: 80517 - DNA, 126 bp, Homo sapiens
  misc_feature 1..126: note = chr17:43099263-43099389
  misc_feature 1..126: note = hyper
  source 1..126: mol_type = genomic DNA
ggtgggcaggggacacgccctttggcacccagggcccgcagcccaggctcagaggacgtgggcgaacaacgcaccttttgagttagcgctcagggtcaggcagagcctccgcgcccacctggcccg

SEQ ID NO: 80518 - DNA, 104 bp, Homo sapiens
  misc_feature 1..104: note = chr17:43175938-43176042
  misc_feature 1..104: note = hypo
  source 1..104: mol_type = genomic DNA
aaggccccaaaaatgcgggtgtctgcactgtagttgaggagcatgtgccactgtgagtcacagctccgcccttagcatcccacctctggcgtatctggtaaggc

SEQ ID NO: 80519 - DNA, 18 bp, Homo sapiens
  misc_feature 1..18: note = chr17:43233608-43233626
  misc_feature 1..18: note = hypo
  source 1..18: mol_type = genomic DNA
caccgtactccagcctgg

SEQ ID NO: 80520 - DNA, 41 bp, Homo sapiens
  misc_feature 1..41: note = chr17:43298625-43298666
  misc_feature 1..41: note = hyper
  source 1..41: mol_type = genomic DNA
gagatggctccccctcgtcctcagctcgtctctgggctaag

SEQ ID NO: 80521 - DNA, 30 bp, Homo sapiens; identical to SEQ ID NO: 45093
  misc_feature 1..30: note = chr17:43318029-43318059
  misc_feature 1..30: note = hypo
  source 1..30: mol_type = genomic DNA

SEQ ID NO: 80522 - DNA, 51 bp, Homo sapiens
  misc_feature 1..51: note = chr17:43321296-43321347
  misc_feature 1..51: note = hypo
  source 1..51: mol_type = genomic DNA
atgctatgcttcagccgcatcccgcgcctgccggagcgcatgaccacactc

SEQ ID NO: 80523 - DNA, 224 bp, Homo sapiens; identical to SEQ ID NO: 36552
  misc_feature 1..224: note = chr17:43339109-43339333
  misc_feature 1..224: note = hyper
  source 1..224: mol_type = genomic DNA

SEQ ID NO: 80524 - DNA, 305 bp, Homo sapiens
  misc_feature 1..305: note = chr17:43339632-43339937
  misc_feature 1..305: note = hyper
  source 1..305: mol_type = genomic DNA
gaactccttcctctccgaagacctcgggggtggggctcgcgcttccgcagcgggcctagagcgagaggcaggcggcaggtaagcctggctgtgctggacaggacttgcacccgctctgcacgccagcggctcagggctgccgcccttttcgtggtcccagggcccttccaagaaccggctaaaccaacccaagccgcgcgcacacacacttgtgcacacagggagtgtggagccagattcgataaggcaccccgtgtgccccagctccatgaccaaggaactcagcaccccgtgtgccccagctc

SEQ ID NO: 80525 - DNA, 41 bp, Homo sapiens
  misc_feature 1..41: note = chr17:43827217-43827258
  misc_feature 1..41: note = hypo
  source 1..41: mol_type = genomic DNA
tccaggcagtagactcgctgtgtgcccggaccagtgaggca

SEQ ID NO: 80526 - DNA, 193 bp, Homo sapiens
  misc_feature 1..193: note = chr17:43974207-43974400
  misc_feature 1..193: note = hyper
  source 1..193: mol_type = genomic DNA
aacgaatccatgcctcgccctcctgtgatgaacctggtacgcacggttttctggttaattctatcgctgaaaactggtgcggggggcgcacttctgagacggaagagcatctaggagctgaatcctccacgcgggtcgcccaggttgatctgaatttctggggaatggcttggctgcccgcccgggaccaggc

SEQ ID NO: 80527 - DNA, 32 bp, Homo sapiens
  misc_feature 1..32: note = chr17:4436418-4436450
  misc_feature 1..32: note = hypo
  source 1..32: mol_type = genomic DNA
ggacaggtggggccccgcggggtgggcccagg

SEQ ID NO: 80528 - DNA, 68 bp, Homo sapiens
  misc_feature 1..68: note = chr17:4446308-4446376
  misc_feature 1..68: note = hypo
  source 1..68: mol_type = genomic DNA
gcaggtagagagaggcgttgaagtggtagagggcggtgggggagtcgggctggcggccagcctgctgc

SEQ ID NO: 80529 - DNA, 38 bp, Homo sapiens
  misc_feature 1..38: note = chr17:4487283-4487321
  misc_feature 1..38: note = hyper
  source 1..38: mol_type = genomic DNA
actgggaggggacagcgcgtagtcgcagagtcagggag

SEQ ID NO: 80530 - DNA, 317 bp, Homo sapiens
  misc_feature 1..317: note = chr17:44919021-44919338
  misc_feature 1..317: note = hyper
  source 1..317: mol_type = genomic DNA
cgggtaggggctggccgggagcaggaccgggaggaactggaccctctggactggggagtgcggggtagatgaaggcagaggagatggaggttctgcagtgtgaggcaggcggacagggaagcctgcatccagctgagagaccttgagcaaccacgtcctcctctgagctccgcgtttgccgtgtgcaaagtgaaggggtaggccgaccccgcagggcccttcttgcgctcctctgcggtgtgtgggggggtctctggtccgcgagaggacagtccctgccgcgccgagcgtcctccagcgtccgcggccgccgcgag

SEQ ID NO: 80531 - DNA, 113 bp, Homo sapiens
  misc_feature 1..113: note = chr17:44928624-44928737
  misc_feature 1..113: note = hyper
  source 1..113: mol_type = genomic DNA
aggcagaatctcctccgtccccgcctcgtaccctcctccccgcctctccaggcccggggggcttcacgttcagccaccgcgaccccgggcgggcgcggcgccaggtgagcgct

SEQ ID NO: 80532 - DNA, 172 bp, Homo sapiens
  misc_feature 1..172: note = chr17:44929063-44929235
  misc_feature 1..172: note = hyper
  source 1..172: mol_type = genomic DNA
cgccgcctcctacttcgggtcagtgcccgccgcgccccccgcccgctccccggcctgcctgtctctccctcctgcgctacagctgggccaatttttccctcccgctgtccttggccccgccgaggtctcgaactcagaccctagcccggcgcgacccaacccacttcgcagt

SEQ ID NO: 80533 - DNA, 105 bp, Homo sapiens
  misc_feature 1..105: note = chr17:44929255-44929360
  misc_feature 1..105: note = hyper
  source 1..105: mol_type = genomic DNA
cggtctccagcttccccggctccgaatccatcgccctgttcagtgtccgagtctctggtcgccccccagccgccgctctcctcatcccgccgggtctcggactct

SEQ ID NO: 80534 - DNA, 136 bp, Homo sapiens
  misc_feature 1..136: note = chr17:44929567-44929703
  misc_feature 1..136: note = hyper
  source 1..136: mol_type = genomic DNA
gggacgggctgttcccggtctcggggcagaggatcgtgcgcgtccagggagaatgggggaaacctcggacggtgagagcgccagctggagacgcaggaaggaaccgtgcgctggggaaatgcgaccacatctcaga

SEQ ID NO: 80535 - DNA, 46 bp, Homo sapiens
  misc_feature 1..46: note = chr17:44953620-44953666
  misc_feature 1..46: note = hypo
  source 1..46: mol_type = genomic DNA
gtggcctcaggaccacgtgtaagtgccatggcgtatcaggctcctg

SEQ ID NO: 80536 - DNA, 30 bp, Homo sapiens
  misc_feature 1..30: note = chr17:44953868-44953898
  misc_feature 1..30: note = hypo
  source 1..30: mol_type = genomic DNA
tcacccagcttctgccggcccagcaagtac

SEQ ID NO: 80537 - DNA, 38 bp, Homo sapiens
  misc_feature 1..38: note = chr17:45022231-45022269
  misc_feature 1..38: note = hypo
  source 1..38: mol_type = genomic DNA
ctgggattactggcataagccaccgcagccggccttaa

SEQ ID NO: 80538 - DNA, 82 bp, Homo sapiens
  misc_feature 1..82: note = chr17:45055719-45055801
  misc_feature 1..82: note = hyper
  source 1..82: mol_type = genomic DNA
actcccaccctgccccgaacgtcttaaaaaacaaacaaacaaaaaaaactggtaagaaccctcaccccacattctcccaccc

SEQ ID NO: 80539 - DNA, 474 bp, Homo sapiens
  misc_feature 1..474: note = chr17:45055831-45056305
  misc_feature 1..474: note = hyper
  source 1..474: mol_type = genomic DNA
cgggcgtccaagtcccttcccgcgcccccgccgacagtctcgccgcgtccccgcccgggcgccccaggcacgtagctgcccgcccggaggcggcggcagagcgcagagagcggggcgagggtccgggtctccggggtccttcttgcagcagcgctggcgagggcggacccagatggcgctcagtacagccccaggatggctgcgcccacgtccttggagggccggcgctcctgcaccagaaagttgatcatgctctcggacttgatgagcaggttgcagcccaggaagaagacgccgaagaccacggtaagcgacagcacgcagagcacggcgatctgcgccacccgcgacacccacaggctgcgctcgtcgggcgccagccccgcggggaccccgtcgctggcggccagcggtgcgccccctggacagcagcccagccacgtgcccagcccgtgggtgcggtttcccagggcg

SEQ ID NO: 80540 - DNA, 277 bp, Homo sapiens
  misc_feature 1..277: note = chr17:45056574-45056851
  misc_feature 1..277: note = hyper
  source 1..277: mol_type = genomic DNA
gcgagcaacaggcggcgcaggagctggagccggagaacctagtgtgcttagcggtcgcccgctgggttcctcgcgcgcctggccgcccctcccctagcaacggcccggccccgccccgccggtccccgcggcatctccgaggggcgggaatcccgccgcgggcgcagcctccccggagtcccggtgctggagggggtcgggagatccggcagcctctgtccgcgggccggcgaaactccaccccctcctggcacccgctgtccgttcttggctagaa

SEQ ID NO: 80541 - DNA, 17 bp, Homo sapiens
  misc_feature 1..17: note = chr17:45187461-45187478
  misc_feature 1..17: note = hypo
  source 1..17: mol_type = genomic DNA
tttttttttttgagacg

SEQ ID NO: 80542 - DNA, 45 bp, Homo sapiens
  misc_feature 1..45: note = chr17:45268793-45268838
  misc_feature 1..45: note = hypo
  source 1..45: mol_type = genomic DNA
attattatctggacacgtctattaaagtggactacagttgtattt

SEQ ID NO: 80543 - DNA, 243 bp, Homo sapiens
  misc_feature 1..243: note = chr17:45331432-45331675
  misc_feature 1..243: note = hyper
  source 1..243: mol_type = genomic DNA
cctggctggcgcggtcggagccgggagctggggaccttcctggcccggcggtggcggggctgagaggtgcctggtgcctgggagcgggtcctccgagacgccgaagccatcagccaggctgagcgccttcccggccgccgcggcgcgcacggtgcggtgggcgcatctctgagccccgcgctcacccggggctgcgcgcgtcgcgggtggtcctggtcgggccaaggacgactggcccaggag

SEQ ID NO: 80544 - DNA, 30 bp, Homo sapiens
  misc_feature 1..30: note = chr17:45331924-45331954
  misc_feature 1..30: note = hyper
  source 1..30: mol_type = genomic DNA
gtccccaggtggcagcggtgcctctgctcc

SEQ ID NO: 80545 - DNA, 786 bp, Homo sapiens
  misc_feature 1..786: note = chr17:4544270-4545056
  misc_feature 1..786: note = hyper
  source 1..786: mol_type = genomic DNA
gggaatttgggctttcgcggaagaaaaaaagttaacaggaccgggtagaacacccggtagatgtgacatgagatatgacgggaggtgggtcgggaaatcgagagcgttctcctgtcttgactccccatcccttccctctcaccacccactccaccccaggtgataaagcctgaaaggtagagatccaacagcgctagcggttgaaacggtttttaaaatagagaaagcgagaggaccgacggcggctccagtgactgctgagtttccagacaagggagctttgtgcaatgaggggcgcacaggagcatgccctcaattccaaggagatcgggtagcggcaacatttattgagcgcttactgtgtgccaccgactgccctaaagccccccacccccgtggcctccgcgcgctttgagcccaatgcgcgggcccttggcaaagagaatcggccagaggccaacgggggcgcatgtcctccccggtatttgactgactcggagccaggggcgcagcccaccccgcccggctctggggagctcaccttgccccgtgcgggccacagtcgcttcccgagcgccgcctccccgtgctggccgaccagccacagctgcacctggttgttggaaccggcatagagcgaggccccagtggacacgcggatgcggtagagacccatcttgctcaaagatgtttcgctccttctggtggagaagggtggacgagctaaataacccagcctgagaccccgccctctcggaggtcgcttggggtcggaatgtgggtggc

SEQ ID NO: 80546 - DNA, 129 bp, Homo sapiens
  misc_feature 1..129: note = chr17:45786739-45786868
  misc_feature 1..129: note = hypo
  source 1..129: mol_type = genomic DNA
gggcttccccatccccgagtcgcccgccgccaccgcctacgcccacgccgagcacgcgcagtcctggccgtccatcaacgtgagtggggcgcccgcgttccgcccaccccggaccgggccttgagattg

SEQ ID NO: 80547 - DNA, 1106 bp, Homo sapiens
  misc_feature 1..1106: note = chr17:45810394-45811500
  misc_feature 1..1106: note = hyper
  source 1..1106: mol_type = genomic DNA
agaaagcaagatcttcgaactacagggtgcgcgcaggctctcgcttctctccaccatggggggccctgcagtactcgccaagagcgtagaatttgcctagtattagccacgagagggcggggtggggcgaggcggagcagggccgaggtggcggagtgggggggagccggagagcttcataaagccacagcaaagcgctgcgactctagtgacagcggcccgctggagaggaagcccgagagctgccgcgcgcctgccggacgagggcgtagaagccaggcgtcagagcccgggctccggtggggtcccccacccggccctcgggtcccccgccccctgctccctgcccatcccagcccacgcgaccctctcgcgcgcggaggggcgggtcctcgacggctacgggaaggtgccagcccgccccggatgggcatcgtggagccgggttgcggagacatgctgacgggcaccgagccgatgccggggagcgacgagggccgggcgcctggcgccgacccgcagcaccgctacttctacccggagccgggcgcgcaggacgcggacgagcgtcgcgggggcggcagcctggggtctccctacccggggggcgccttggtgcccgccccgccgagccgcttccttggagcctacgcctacccgccgcgaccccaggcggccggcttccccggcgcgggcgagtccttcccgccgcccgcggacgccgagggctaccagccgggcgagggctacgccgccccggacccgcgcgccgggctctacccggggccgcgtgaggactacgcgctacccgcgggactggaggtgtcggggaaactgagggtcgcgctcaacaaccacctgttgtggtccaagtttaatcagcaccagacagagatgatcatcaccaagcagggacggtgagtgcggcgcgccggcccttggggcctctgtgcccgcgccggaacaagaacgtctcgtctgtttttctggctcgacaatgcttctgactccgtgtccctcactgctttggcttcagcgtagggagacaggggaatggggttgttaggaggacagggaaagctccggaggggcgtctgtgcccaggc

SEQ ID NO: 80548 - DNA, 567 bp, Homo sapiens
  misc_feature 1..567: note = chr17:45867017-45867584
  misc_feature 1..567: note = hyper
  source 1..567: mol_type = genomic DNA
gcccggccttacttgtactttcaaccacgtcccccactccaaaattctgcgcctccctcaagccagttcctcctctgcttcctcctcgcagcagccggcgcgtctttgttccgtccaggcatcttcaacgcgtccctccctctggacgctgccgaggaaatactgaagtggtagaggatgtggggaggccgtccaagagtggaggtgtcccgggcctgctctctccaggaggaggagtgcaggctggggtccacctccccggtccagcagtgctggggaggggaccccgcacgtgtgcccggagcgcggacacggtgatgcggctgcccctcgccccggccccaggctcgctgcgccctccctccccggtcgcctctgcgtttctcccgccagcaggagaccgagtctgagcgcagccgccgaccctgcgccttccctgtgcactcaaagaccgccagctctgggggagcccggggacccacgccgctctgggcacaggcgaccgaggccaaggcgctccgggtctctccagttccggcgtcttctggtcctcgggctccgctccgc

SEQ ID NO: 80549 - DNA, 76 bp, Homo sapiens
  misc_feature 1..76: note = chr17:45970972-45971048
  misc_feature 1..76: note = hypo
  source 1..76: mol_type = genomic DNA
tttttttcacctctgcggtcttcatgatggggcctccaggataggagaagcatagctaccccgtttttctcccaga

SEQ ID NO: 80550 - DNA, 30 bp, Homo sapiens
  misc_feature 1..30: note = chr17:46030424-46030454
  misc_feature 1..30: note = hypo
  source 1..30: mol_type = genomic DNA
acaatcttctccaggcgggtgttaaagtcg

SEQ ID NO: 80551 - DNA, 184 bp, Homo sapiens
  misc_feature 1..184: note = chr17:46036392-46036576
  misc_feature 1..184: note = hypo
  source 1..184: mol_type = genomic DNA
cattctctctcccctcggatgggcatcgctggagagtggaaaacatctgctacatactcagtgtctctgccacttcctgggcccagtgctaccagcttaggtgcccaatccacccaccagctaccttcctccatggaccaggtgtgcgtgtcaggcaaagggtgaggcacggggtagagaaaag

SEQ ID NO: 80552 - DNA, 32 bp, Homo sapiens
  misc_feature 1..32: note = chr17:46080796-46080828
  misc_feature 1..32: note = hypo
  source 1..32: mol_type = genomic DNA
ttggggaggagcaggcgcgggggtgggtgtgc

SEQ ID NO: 80553 - DNA, 38 bp, Homo sapiens
  misc_feature 1..38: note = chr17:46089245-46089283
  misc_feature 1..38: note = hyper
  source 1..38: mol_type = genomic DNA
gccctcgggagttcccgccgcaccgaccccagccaggc

SEQ ID NO: 80554 - DNA, 521 bp, Homo sapiens
  misc_feature 1..521: note = chr17:46089581-46090102
  misc_feature 1..521: note = hyper
  source 1..521: mol_type = genomic DNA
taataaatacatttgcggcccctcattggacagttggcctaatttgtttctttttcgcggggtggggggagcagccgcgcccgcgccccctggctcccagcagccctgtgcaaagcagatgttccgccgcagacgcggagctgcgcctagccgcgcgccccggaggccgcggttgccatggcgacggcggggccgcctgctgtcgccgagcacgctgtctcgcccgctcagtgattacctccatctccgcagtgttcgccatacggcccggattctaatcagatcccctcccccctcccccctccctcctccgcccggcccactaccccttcagctcccacagccttgggactcattgagaactgcccgcgcatccctgacggtgcccaggaaggcagagtgggggagagacgacccgcactcagcctgtgtttagggaggactggacccagtgcggttcgcaagaggttctgtgtccccaggccatctttggtgacattgaaccccgggagtccagctcc

SEQ ID NO: 80555 - DNA, 54 bp, Homo sapiens
  misc_feature 1..54: note = chr17:46100803-46100857
  misc_feature 1..54: note = hyper
  source 1..54: mol_type = genomic DNA
gcccggctgcggtcccgccagcggggagccatccatcaccgcctgaatgccagc

SEQ ID NO: 80556 - DNA, 69 bp, Homo sapiens
  misc_feature 1..69: note = chr17:46124901-46124970
  misc_feature 1..69: note = hyper
  source 1..69: mol_type = genomic DNA
agcaagactaagctgcgtgggaggccaaacgaggggggtcctttgggctgtttctaccatgacaaaaat

SEQ ID NO: 80557 - DNA, 142 bp, Homo sapiens
  misc_feature 1..142: note = chr17:46125006-46125148
  misc_feature 1..142: note = hyper
  source 1..142: mol_type = genomic DNA
cgccaacgttccgccaacgtcccaccaccctcatgatatccgtccgcggtactgctccagcgaaggtacccttgcctgggccatgaggcgcaaccgtccctcacagctggggtggcttctccaggttcgcaccgaggggaag

SEQ ID NO: 80558 - DNA, 17 bp, Homo sapiens
  misc_feature 1..17: note = chr17:46176758-46176775
  misc_feature 1..17: note = hypo
  source 1..17: mol_type = genomic DNA
cccgaccctactattta

SEQ ID NO: 80559 - DNA, 81 bp, Homo sapiens
  misc_feature 1..81: note = chr17:46177127-46177208
  misc_feature 1..81: note = hypo
  source 1..81: mol_type = genomic DNA
attccacctcaattgcgttaaaccaacacgtctaaatgtaacaccaatttatgaaaaaccctcatttgaaactttgaaaaa

SEQ ID NO: 80560 - DNA, 146 bp, Homo sapiens
  misc_feature 1..146: note = chr17:4622963-4623109
  misc_feature 1..146: note = hypo
  source 1..146: mol_type = genomic DNA
ggagtaaggacccagcggaagtaagcaatgtgggtgagcaggaaaggagggttctgggcagagagaaaacaaagactcagaggtggggcagcctggggtgttggaggaatggggaggtgccatcgtgccctcgggcaggagcagcc

SEQ ID NO: 80561 - DNA, 24 bp, Homo sapiens
  misc_feature 1..24: note = chr17:46344157-46344181
  misc_feature 1..24: note = hypo
  source 1..24: mol_type = genomic DNA
caccgtgcccggccctgttttcct

SEQ ID NO: 80562 - DNA, 251 bp, Homo sapiens
  misc_feature 1..251: note = chr17:46507487-46507738
  misc_feature 1..251: note = hyper
  source 1..251: mol_type = genomic DNA
tgggcgggagagaggcgggacggggcgcgggccctggtcgggaggcggacgggctggaaggcgacccggctgcaccgcgaggcacctgtacctcagccgcggtcgccgcccgcccagcccggccgcggggcggggccgtgggtccccgggcgcgtcaggaagtggcgcgggcggcaggcggggaccggaacggggcgcggggcgtgggtgcacgtggcgctcacgccggagccccacggtagaaggattgg

SEQ ID NO: 80563 - DNA, 256 bp, Homo sapiens
  misc_feature 1..256: note = chr17:46570216-46570472
  misc_feature 1..256: note = hyper
  source 1..256: mol_type = genomic DNA
tgcttttcagcacttcgtaaatcacccatccgcccgggcagtttgctgctgccacgtctcggttctccctccgcgcgctccctgtccccccactcacctcggaagagggcacacccggggacgactccggagctgtcaccacaaagggcaggagggcaaaggggaaatggtgtctgtgcttcccagagccctcagcgccccggaagggtacggggcagcctccaggaaagctgtcaggagacgcttcctcccgagg

SEQ ID NO: 80564 - DNA, 48 bp, Homo sapiens
  misc_feature 1..48: note = chr17:46619087-46619135
  misc_feature 1..48: note = hyper
  source 1..48: mol_type = genomic DNA
cgcaggggcgggggcagatcccggctgggccggcgcctcctgcagcgg

SEQ ID NO: 80565 - DNA, 1106 bp, Homo sapiens
  misc_feature 1..1106: note = chr17:46620352-46621458
  misc_feature 1..1106: note = hyper
  source 1..1106: mol_type = genomic DNA
agggtgggagaggctcgatttttccagtagacggccaaggagcgcgggggtcgaaaggaccgggaggaggaaacaggttagggaaactgcaggtcgatggcacagagcgtactggtgaaaaaatccagctcttcctcggaaaaagggaccgggctgtcgagagaaccctgtaggctaggggagaggcctccggatagctggagacaggagtcggccgcgaagaagttgaggtcgggaaggaaaggtgaatcctggcgccccgagaagacgtcttctggcaatggcccgggctccagcccgccggccccgcgcagcgcgcagccgggactcgacgcgcctgcgccctctaagcgaacggctaaaggccgggggtccgcgcttaaggcccccggcaccacctccggcgggtgacagcaggcttcccacgccgcccgcgaggcggaggggccgcccgggctggccgcgggttcctcggcagggtcgcagatgtcctccagggctcccgggcaggcaggctccccatccggcggctctcggtgctgcgtctgccgcttgtgcttcatgcgccggttctgaaaccagactttgacctgcctttcggtgaggtccagcaaggccgcgatctcgacgcggcgtggccggcacaggtacttattaaagtggaattccttctccagttccagcagctgcgtgttggtgtaagccgtgcgcagcctgcgcgccccgccgccaccagcctccggcagtcccaggccatctgcagggaaaacaggctcggcgtcatagcgggccgtgtactcagcccaacctcagttcggactaccccatcctccaaaaccagtatcacctctccccttcctcgccaccccacccccgcccccaccccaaagccgctcgctttactgcttttgggttttcttctctccctctctagtctacagccccggcccgggtcagggcaaagcattcagagccgcccacgggccacgcagggggcggagagcggctcccttcggcgccggaacctcagatccccctcccaagccctcccagtggacccctcaattcggaactttccaactcaaccggagcgagggtcagaaaga

SEQ ID NO: 80566 - DNA, 232 bp, Homo sapiens; identical to SEQ ID NO: 36569
  misc_feature 1..232: note = chr17:46621779-46622011
  misc_feature 1..232: note = hyper
  source 1..232: mol_type = genomic DNA

SEQ ID NO: 80567 - DNA, 443 bp, Homo sapiens
  misc_feature 1..443: note = chr17:46654951-46655394
  misc_feature 1..443: note = hyper
  source 1..443: mol_type = genomic DNA
actgtatctccctggcgaaaaagtcgctggtgagaatggtgaagaggatggggaacctacttcaaaggcgcagggcccaccaggccataaaaatttatgggggatgtaattatgtggctctgaaaacaggcgaccgtaaatctccggcaatggcgagtttatagcggggacaattggcttccccagctcaacccccccccaacccatgcctccgaagtccctttggtgtaaagctccaggggtgggagggggaaggggtgcccacgcactcacccgtgctcacgtgaactttgcgcatccaggggtagacgacgggctctttgcacgcggagtgggacgggctggggtgcagggggttctgggcgcagggaggcggcggggggctgctgctgaccgcctcgcagcgctggccgggctccgggaggagggccccggcgggtggc

SEQ ID NO: 80568 - DNA, 24 bp, Homo sapiens
  misc_feature 1..24: note = chr17:46655395-46655419
  misc_feature 1..24: note = hyper
  source 1..24: mol_type = genomic DNA
gcgcaggagcccgaggggacagac

SEQ ID NO: 80569 - DNA, 111 bp, Homo sapiens; identical to SEQ ID NO: 1297
  misc_feature 1..111: note = chr17:46655450-46655561
  misc_feature 1..111: note = hyper
  source 1..111: mol_type = genomic DNA

SEQ ID NO: 80570 - DNA, 437 bp, Homo sapiens; identical to SEQ ID NO: 1298
  misc_feature 1..437: note = chr17:46655562-46655999
  misc_feature 1..437: note = hyper
  source 1..437: mol_type = genomic DNA

SEQ ID NO: 80571 - DNA, 374 bp, Homo sapiens
  misc_feature 1..374: note = chr17:46656057-46656431
  misc_feature 1..374: note = hyper
  source 1..374: mol_type = genomic DNA
cgcaaaccctagatcccttaagaagttggggctcccggtgtagccctcctgttctgcctcacctctgcccagcattctgtaccttccaaaggccccagtctcctcccctcggcgggagggagcgctagcaccctgcgtctctatggggagttaggttactggcgggttgggggctccgtctcgaaaggggaacccatacgggggccagagcacagagcttggggcttttctctgcagctggatggggaagggtaggggtgagagaggaggcgtccagagctagagggcgggtgcgcagagggacttgtcagagatgaatggaaccgcgggcggatcgataggaaattcatgcactaattcggggagacttcgcc

SEQ ID NO: 80572 - DNA, 480 bp, Homo sapiens; identical to SEQ ID NO: 4434
  misc_feature 1..480: note = chr17:46659429-46659909
  misc_feature 1..480: note = hyper
  source 1..480: mol_type = genomic DNA

SEQ ID NO: 80573 - DNA, 417 bp, Homo sapiens
  misc_feature 1..417: note = chr17:46663408-46663825
  misc_feature 1..417: note = hyper
  source 1..417: mol_type = genomic DNA
ccgcaaggctcagcccggatccactaggggagaggcagtccagagggcggcctcgcagactgggaactgtttccggggaggagaagctagaggatactgcagagagtgcatttttctctccaagaggaactttagggggagaagagacaagagaggagacgcctaaatcactgagaaaaggaataagaagagagggaagagaaacgttaaaacttggggacaaggtgctttttgggatccgacaggttcccgaattgcccgaagtccaatactctccaggctcccaaatttcccctcttcctcttggagcctgcaatcagtaaattcgccaaaagaaagaacgaaagatccgcctaaacctgccggcgtgcccccacccccggtctacagaggcggaggtggctgcggcggtgtggc

SEQ ID NO: 80574 - DNA, 682 bp, Homo sapiens
  misc_feature 1..682: note = chr17:46670849-46671531
  misc_feature 1..682: note = hyper
  source 1..682: mol_type = genomic DNA
gtggctggaggaggccgaggagcggttgacgctgaggtccatcccattgtaattgtagccgtaagagccggtgtgcatggcagcgggatccctgtaagagccgctcagagagctgccactgccataatttagcaactgatagtccgggccatttggataacgccccgagaaggagtttacaaagtacgagctcatttgggtgattttggagggcttgatttgtggatcgtggtcgttataaccctgtgcttcacgatttatgatgtattaatgaattatagcgatgcactgtacttcgttttgctatgtatgcggccaaatatggggggggggttggaaggggggtggggggcgttagggaatcacgtgcttttgttgaccagtcgtaaattctcgctgatgacctcaagaggtaattcatgctctatggttacaaataatgacgatccgagaatcgttagggccgattcaatgcgagcctccgagagagggggaaaaaaggagaagggggagaaacagagagaaggttggctttggcctctgagcagagcgcgccacctcccggcgaccgacgggagcgcgggcgtgagaccgccatggcggcgggcggctgcctccctgctggctccctgcaggctccctgcagtcgccgggagagaaagaaacccggccaaggctcagc

SEQ ID NO: 80575 - DNA, 835 bp, Homo sapiens; identical to SEQ ID NO: 36578
  misc_feature 1..835: note = chr17:46674922-46675757
  misc_feature 1..835: note = hyper
  source 1..835: mol_type = genomic DNA

SEQ ID NO: 80576 - DNA, 1216 bp, Homo sapiens
  misc_feature 1..1216: note = chr17:46687590-46688806
  misc_feature 1..1216: note = hyper
  source 1..1216: mol_type = genomic DNA
ttaaagctaaaaggccgagaggaagggtgggggcgggctgggggctcgcagcgccgtggtgccggcgaagagagatccgccgggaagcagagcgagcctgagagcaccgagcaaatatgggggcggggatggcctgctgggtcgcggcccagtgggtgcagccttccagggccgacctccggctgggagcactctggacgcggaaaggggcgcccagccgggaaggaggcgccttcagggtaatgtgccccggcccctggggctcaggacagctcggtgcgcggcgttacctgagcttcgcatccaggggtagatccggaagttactctcggccgccaagtccgagtccctctgctccttggcgcccgccgccttggcggagtcgccgggacacaccccggagaggttctgctcaaagggcgcgcagtgcatgttgaaggaactcggctcgagcccatagccggccgcgtagacgccggccgcgctctggcccgccatgccccccccgccggggtacaagccctgcatcgaggcggcgaaggaagcgcccgaacccgctccatagcccgggcgctgggggttggaagcaaacgcacaagaagtttgttctgggaaggctccggtagcgaaaaccgaacttgaggctggatatttagaaaataaagtattcgcataatacaatgaactcataatttggccggatgatttgtaggcagggacgttttagtgtcggttttacgagattccttgatatattacagaattagagtccagatttacaccaaaaaggaccccctttttcctctccggaccacgtgaccccgcccacgtgacgtcccctccgccaatggccgggccgtctccccacggctcccggtaatgtggaaaaaattgtgtggcgttggatttataaaatatgatcaataatgaatgggaaagccgagccctgtggattggggctgggggctcaagggccgctgccgactcccgcgggctggaggccgcttgcaggcgagatttggggaggaagagattgagtggaagggaaaataaataacctcggggcgatccgtgtcaccctccacccatcctcttcagcccgttaccgagcgagagacaaacgcagggattgaatgcacgcaactgggtgggtgggtgcttggggcaggtctgttctttattaaaccaggccaattctgcacggcaaggccttttg

SEQ ID NO: 80577 - DNA, 378 bp, Homo sapiens; identical to SEQ ID NO: 36580
  misc_feature 1..378: note = chr17:46689986-46690364
  misc_feature 1..378: note = hyper
  source 1..378: mol_type = genomic DNA

SEQ ID NO: 80578 - DNA, 276 bp, Homo sapiens; identical to SEQ ID NO: 36581
  misc_feature 1..276: note = chr17:46690429-46690705
  misc_feature 1..276: note = hyper
  source 1..276: mol_type = genomic DNA

SEQ ID NO: 80579 - DNA, 53 bp, Homo sapiens; identical to SEQ ID NO: 36582
  misc_feature 1..53: note = chr17:46690852-46690905
  misc_feature 1..53: note = hyper
  source 1..53: mol_type = genomic DNA

SEQ ID NO: 80580 - DNA, 606 bp, Homo sapiens
  misc_feature 1..606: note = chr17:46691213-46691819
  misc_feature 1..606: note = hyper
  source 1..606: mol_type = genomic DNA
aaagccgggtggggacgaatggacccaccttgaaaagcccccagagcctctgccccagaagaaaagtttcttcagggtaattaaactataaagcaattgagaagtgcaaaagttgagcgcccccactcccaccaccctctcttcactaccccccataaaacagtaaaaggggaaaaaaaggaggagaagaagaagaaaagtaaggcaggatgaggggtttatagattcaggaaatgtttctaagcgacccccttcaagggaaagaaaaaagaaagaagaaagaaagataagaaagaaaggggaaaagcggcaggcgatcggaacggagccggcaagtcttccagaagctggaggaaatgcgccccggcctgccaggccttgggcccttccggccccctcctgcccttgtcggccccgaggcgagctcaccttgcgggcgcatccaggggaagagctgtgtgggcgacgggctctgctcggagccctcggcctcctcgcccaggccgctggcggcggcaagcttgcagtctgcgtactgcaccaggtctggatcctgcgcaccgaataggctctggcgttgcagcgggtcgtagccgtagaaattgc

SEQ ID NO: 80581 - DNA, 437 bp, Homo sapiens
  misc_feature 1..437: note = chr17:46691987-46692424
  misc_feature 1..437: note = hyper
  source 1..437: mol_type = genomic DNA
cgcagtcataataattggggcgcagggactccccggttttgtatttggagaacagtgagttgacgaaataagagctcattttattgaattttgaggcggcggcggcggcggaggctatagttgggggctgttggggagggggtggggagggggaaagggagggagagagagaaaaaaacgcggattcgccggctcctagtcaccctcgccaggaaaggagagggaaagagaggagggaaaaaaagaaaagaaagaaaaggcgaagaagatctcgaagccgacacactttttgtggtttccaggaatagaaaaggacagagaagcctccaaaagtctaagcttgcatggcagccgcggctcgctcgccctccccccaccccccaccccccaaacaaaaatataccaccacttaaagaggtcctcgctttacatttcga

SEQ ID NO: 80582 - DNA, 27 bp, Homo sapiens
  misc_feature 1..27: note = chr17:46696538-46696565
  misc_feature 1..27: note = hyper
  source 1..27: mol_type = genomic DNA
aatcaagaggctgcccgcgcccagacg

SEQ ID NO: 80583 - DNA, 226 bp, Homo sapiens
  misc_feature 1..226: note = chr17:46702529-46702755
  misc_feature 1..226: note = hyper
  source 1..226: mol_type = genomic DNA
cggttgcggactctgcgcggctacagcgcgagatctgctaggaacaatcctccgccaagctgttgcatcgcaaataaaatcctaatgagctccctcccccttccccttggccggcttttacggtctgcgcgtggcgcggggagctctgccagccgcacggccccgggcagcccagtgcgctccggcccttgccctcgccggctctcggcctcgctggccgctggcc

SEQ ID NO: 80584 - DNA, 30 bp, Homo sapiens
  misc_feature 1..30: note = chr17:46703929-46703959
  misc_feature 1..30: note = hyper
  source 1..30: mol_type = genomic DNA
caccgcactccatatcgaggatggattgtt

SEQ ID NO: 80585 - DNA, 50 bp, Homo sapiens; identical to SEQ ID NO: 36586
  misc_feature 1..50: note = chr17:46710940-46710990
  misc_feature 1..50: note = hyper
  source 1..50: mol_type = genomic DNA

SEQ ID NO: 80586 - DNA, 197 bp, Homo sapiens
  misc_feature 1..197: note = chr17:46713933-46714130
  misc_feature 1..197: note = hyper
  source 1..197: mol_type = genomic DNA
cggctggggaagcagctctgtggtctcccggcgggtgaggccgagacagagaccaacctctaggcggcgccctggcgttgagtccgcgctgaacaagattctctcgcagctctgcgtcccgcgccgggtgaaggggcgtgttcctgcaggcgctcggggctcggcctggagctggcggccggcacgtcgcctttggc

SEQ ID NO: 80587 - DNA, 181 bp, Homo sapiens
  misc_feature 1..181: note = chr17:46714131-46714312
  misc_feature 1..181: note = hyper
  source 1..181: mol_type = genomic DNA
ccctctgccaaccaagagaaacacggttaaatgagtgcgctgggacagaaatccacagctaatcaaggccccatccgctcccaccccctggcccttacctcctaactccatctccgacgctagggagccttccacagcccgaatctcctttgatgtccccagcagccggctagagggcagc

SEQ ID NO: 80588 - DNA, 39 bp, Homo sapiens
  misc_feature 1..39: note = chr17:46719480-46719519
  misc_feature 1..39: note = hyper
  source 1..39: mol_type = genomic DNA
aagaagatgctcactcggtaagggcgagggagcccggca

SEQ ID NO: 80589 - DNA, 484 bp, Homo sapiens
  misc_feature 1..484: note = chr17:46723716-46724200
  misc_feature 1..484: note = hyper
  source 1..484: mol_type = genomic DNA
ttggagaggtagggtcgggtgccagcggacagggaggccaaggcgttttcgggtgcgccccgaggccctacccgggaagctgcctcggtctggagatcaaggttaagccggtggccccgggaagcccacgcctgccacgggcggttggtcctgaaagctcgggccacggggctgcccagcttggagaggggcctttcacgccgcagtccccagctgcgagaggaagggctgcgcccgcctcctcacctacctctcggaaccacgccgtcccccgcgcgtcttcgtagactgcaggagtccagggcgtctggggactgtgacggcgcccaaggcgggggatgtggcggctctgggtcgccgccttctgcccccgcctctgtgaggcctctcgaggcagtgtctgtgtctggggcagcgacgccgacggcgctgggggcgcgaaggggctcacgctcctgcgttcccctggcgccggtgagtggcg

SEQ ID NO: 80590 - DNA, 152 bp, Homo sapiens
  misc_feature 1..152: note = chr17:46724752-46724904
  misc_feature 1..152: note = hyper
  source 1..152: mol_type = genomic DNA
cgctcacaccctgggcgggaggcgactgatccacacttagggctccgaatccggagaaagagagcgccggaccctcctccgcccacctcccgccccagccgcagcccagcgacttcccgccatcctcggccaccgagcggctcctgcctggg

SEQ ID NO: 80591 - DNA, 115 bp, Homo sapiens
  misc_feature 1..115: note = chr17:46755586-46755701
  misc_feature 1..115: note = hyper
  source 1..115: mol_type = genomic DNA
cctagagacgctccccgcctgctccaggtggccggcaccctagacggggcaggaagggcaggcgccaagcctcaagtctcaaacacggtgcggggctgcgcggcaaggagaaacc

SEQ ID NO: 80592 - DNA, 1013 bp, Homo sapiens
  misc_feature 1..1013: note = chr17:46795361-46796374
  misc_feature 1..1013: note = hyper
  source 1..1013: mol_type = genomic DNA
attataaaacatacacgttgaaacaatttttttaatttaaaaggggctgtttataaaaaagttttaaaagtagctctgtgttttaagacccgtgttctacttgctgcgatcgggatagtttttttttccactttgaggctctttttttttttttttaaggggcaggaacatcattttgcatcaggccctgtaaaaaaaaaaagggggggggggtgggtaggaaccaggatgttggggaaaattatttcaatgtgttgagtctgaagctttttggaaagcaatgtagatgtgatctcgtttgctctgaatcgaattccacagaaaccgctgtgccgaatactgcaaatccttaactttcataaacgccggcaccgaactcaacgcaaaactacccaagtgccaaagaccatttctgggaagctcattccatgagaccttcgcatttttccaaatcaaaggcttcccttcggatctaattatttctcctctacagggctgcgggagggggaggggatgtgagactagggcaacagattaagattgaaagtcctttctcgcagcttcattttcgcccccacactgtcccaaatgcttagaaccctcctcgtcagaatgggaacggtgcccccgcttgtcctaaaagacacagaccaggtccgtgaacttgacccaggcgcccacgcctcttttccccgaaggtcagacaaaggcagaagggttggctggattctttcccgggccgcgaaggcctggggatcgcaagttgaggaggagaagaccgcaaacccctttggttcaagcaagctctgcggcaggtaaaaggcaaattggtggggacgggtaggacagggagagcattatctggctaactcccgcaggcctcttccgatttgtcggcggggacctgactccctgcggtgtctctggccccaaatacggaggccaggagcttttcgttgtctcgcccgatttggtatcttattagccggtgtcgctgagccgcgggggactcc

SEQ ID NO: 80593 - DNA, 47 bp, Homo sapiens
  misc_feature 1..47: note = chr17:46796498-46796545
  misc_feature 1..47: note = hyper
  source 1..47: mol_type = genomic DNA
ggagatcgagtgtttgatcttcccttgctccaggatcctgaattctt

SEQ ID NO: 80594 - DNA, 33 bp, Homo sapiens
  misc_feature 1..33: note = chr17:46796605-46796638
  misc_feature 1..33: note = hyper
  source 1..33: mol_type = genomic DNA
cgcacacgcagcactactaccgtctgagcaggc

SEQ ID NO: 80595 - DNA, 365 bp, Homo sapiens; identical to SEQ ID NO: 36594
  misc_feature 1..365: note = chr17:46796849-46797214
  misc_feature 1..365: note = hyper
  source 1..365: mol_type = genomic DNA

SEQ ID NO: 80596 - DNA, 455 bp, Homo sapiens; identical to SEQ ID NO: 36595
  misc_feature 1..455: note = chr17:46797274-46797729
  misc_feature 1..455: note = hyper
  source 1..455: mol_type = genomic DNA

SEQ ID NO: 80597 - DNA, 1760 bp, Homo sapiens
  misc_feature 1..1760: note = chr17:46799288-46801048
  misc_feature 1..1760: note = hyper
  source 1..1760: mol_type = genomic DNA
tttaaataataataacgttatcaatattaattttgcttatgccaggactccatcccattggagacaaacattaagtcttatggcagaccttacagcgggtgctagttcccactcccaagcctctcccccgcctaggtcctgcaggtcccgcgtgctgcgaaacattttctttgtccctttctgcccagggcggctgccggtctctccaggaaccgcgagtaggtgctcccgccaggtggtatcggtgaaagcctgctgctcacccttcccttgtttcccaaaacttctgaaggctcccaaattcctgggagaccctctcccagggcctcctgatgcagctaccatactgagcgatccgtcgataacgcccttggcccaccgatcagtttaccttattagagagaaaagcactcttggaggtagtaagatgggccggtccttgatctgagaaatgggcgcacaacatcgctgttctctctgcaaaggtggggaccagaatccagcttgcctgaccttgcaagcaagcatcggcctaaaggtttcagcctcccagtggcgctctgtttgcacgccttaggctaggagaggaaggacgggagcacagcactgggtgcccctctccctgtagagtctggggcggggctcagtaagaaggcctgcggttggtggctccccacctcatagctgcaagtaggggcgaaagctggagtgtctcctcccagcagcctcctcgcctccccgcaaacctccgaatctccctggacctcctggttgctgtggcccttcctcccctgattggcttcctccctctttcccaaggccagagaagtcctctcttcccctcaccttcctccctcttcccataaaacttttaggaaaatgggggcgggggcggtggagaccaccagcctggaacttcaagttcaatggcaaagtccctgaccctccccccaggctgggcgccagcattattctaggggcgattaaactcttttgctgccccctgtgcacctcccagttcgggggcagtttaggggaggagagaaggtaatggtggaattctttccctcactctcccccgaccacttcgtcccctccccctcatcccctctacacagaactaactggtagggagagaggaagaaaggctggcatcggttcctcattggatgttttaaatctgtctcaggcccaggccagtgcctggggggaggggcggggtgtcctgcttttgggctagaggcccggggccgctcccgagctttctcccctcttccctggagagcgactgttcgggagggtgagaatggtataaatttcaaaaacaacgaaaccttcttttgccccctccgcagcagtcgcctccgggctttattgcaagtttacggtaacgagttcatctatttaattcgcggttgcagctcggggatttctattagacaggacgggttggggccggggggcacagggtctcccctgaaggaaacccaattagagtgcagcacttagcaccttcaatataactttaatgaagggggggaggggagctgcagggaagagaagtttgctctaggttggggaaggaaagctggagctgctcccgagaactggggggcctggatgaggctttttcctgcttcgagggctttccagcttccggcccgggaactactatttggagtagggatcgcctgcagggaaggcggggcggattctcggctggcggcggcctcgcagggttcccggaagcgctagccagc

SEQ ID NO: 80598 - DNA, 220 bp, Homo sapiens
  misc_feature 1..220: note = chr17:46801108-46801328
  misc_feature 1..220: note = hyper
  source 1..220: mol_type = genomic DNA
cgagattcaaaaagagcttccggaggtagtttctacgcattgcgccactactcccttattcggcttctggaggcctaataaaatccacttgctttggagttagaaattatttcgggcctggagcccgcgtagacgcgaccctgtgatcccatttcgtagcttgctgagagattcgctgcgggagtttggctctgagggaggggaacggtctggagggcag

SEQ ID NO: 80599 - DNA, 30 bp, Homo sapiens; identical to SEQ ID NO: 36601
  misc_feature 1..30: note = chr17:46801636-46801666
  misc_feature 1..30: note = hyper
  source 1..30: mol_type = genomic DNA

SEQ ID NO: 80600 - DNA, 905 bp, Homo sapiens
  misc_feature 1..905: note = chr17:46802007-46802912
  misc_feature 1..905: note = hyper
  source 1..905: mol_type = genomic DNA
cgatgaaagcctgcccgcaggttctcctggagtggtgagcctctgtcggaagggggcgcccacgtctttttaatggtcctaacacaccagtggaataaatctctaagattccacatcttttgtttgctctgaatttattgcgagtgaaaaacagagaaaatcctcaagtttaagtttctgatagcagagtgtgggagttagagcatggggagtccagaggttccagacccccaaaggtctctaccagggccatctccgttagtggcggtggcagcccctcttgtggcctttttcctctctccaaggggtcaccccgcaccatgccgctccccctcatctatcttgccccctccccacaggcccatctgcgctgaactctcgccagttccgaagtcggcgagggagggggtttacttgcccgatcgttggtgggtttgagcttatagaggcagaggagtaagaacctgcgatattgaaagctacccacatggggcttccttgaaggaggacgtggaaggcagaaagtgacctgctctgagcggcgcatgtaaccgaggaccttaagctggaccacggggcttggacgattttttaaatcaggaaatcgacctcatcttcctcctcctcgtcctcttcccctgaacccccagtccgcatgcactcacactctttggccttttccctcagtcccgggctcctctttggtaaatagatttgtaggtgtctaagtcacgtcccaccctcactccttcccaggagaggagacagggctaggatcccacccgaccgcgggccataaacacttggctgcggcggccgccgcggggtttctaggagagctggctccgggagggaaatgtcctcgaggtagtggcggccgcggcccaccaccaactgctcgccac

SEQ ID NO: 80601 - DNA, 192 bp, Homo sapiens; identical to SEQ ID NO: 36603
  misc_feature 1..192: note = chr17:46802993-46803185
  misc_feature 1..192: note = hyper
  source 1..192: mol_type = genomic DNA

SEQ ID NO: 80602 - DNA, 71 bp, Homo sapiens
  misc_feature 1..71: note = chr17:46803745-46803816
  misc_feature 1..71: note = hyper
  source 1..71: mol_type = genomic DNA
tccctgcaaagggatcgccttccaaatttattcataattagctcaattcatgaaagcggtttctaaagtgc

SEQ ID NO: 80603 - DNA, 321 bp, Homo sapiens; identical to SEQ ID NO: 36605
  misc_feature 1..321: note = chr17:46804107-46804428
  misc_feature 1..321: note = hyper
  source 1..321: mol_type = genomic DNA

SEQ ID NO: 80604 - DNA, 539 bp, Homo sapiens
  misc_feature 1..539: note = chr17:46805572-46806111
  misc_feature 1..539: note = hyper
  source 1..539: mol_type = genomic DNA
gcaaactcagtggggcggctggggtactcttccccggccgtgggagtctccgcggggtacgcggccagggtggctgcctgggcacagggtttcagcgagctccgggacactcggcaggagtagtacccgcctccaaagtaaccataaggcacgggagctggggacgtcccctggggcaccccagggcatgggtggcattgctttggcggctccgccgagcctggcagatccaagggggcatagttgacagcaggcatcagcgtaggcgccgctgggtggctggtcagaggggagtgggcgaccagattccgcccccctcccgctcccagcaagccttcgatatccttggctccatccaaggtggcataattgccgggctccatggagccgagggtcggctcatgaggtgcgggggcggggaatctagggggcacccagctcgctctccccacccaggccgggggaatccaaagcgttttaaatcgctcccagctcgcaagtcgcctgcattcgctcagcacggccgtcttgacgcaaga

SEQ ID NO: 80605 - DNA, 303 bp, Homo sapiens
  misc_feature 1..303: note = chr17:46806788-46807091
  misc_feature 1..303: note = hyper
  source 1..303: mol_type = genomic DNA
tggaatgagctgctccgggccccagggaggtgccctggacgccccttacccagggactcgctactgcccagaatgctctggaggccctgattcgggtgaggctgagggaagaggcgggagacacgaacgtagacgtagaagacatgcgatctggatggaacccaggacactccacttccggacctgaaggggaaatggagcctctagagtggcctgtggaagggtctggatttccctttaagtaaagacatacggagggacggagacccacaggacttgagggagggacggggagagggagag

SEQ ID NO: 80606 - DNA, 848 bp, Homo sapiens
  misc_feature 1..848: note = chr17:46810248-46811096
  misc_feature 1..848: note = hyper
  source 1..848: mol_type = genomic DNA
tctacatgggttcagcggggaagtccctgcacaacccaggcgtcctgatcttccagactgactgggctgagcctggccttcccctaaccccacagatgcctttgtgtcctgctgggagcctcctggcagaccctccgggagcccggagcctcccccagctttctttactgacccagccaaaagcgctgaaagcctcagcgtgctcctttacatacccgccagacacctccaggaaggtaaaggccaagttgaaagttaagagtctgtttacctccaggagcccattcagctcggccccacagacagcctgtgacctttacagcccggcctttgagcgcggccgccgcgcccccgggggttccggcaacggggacttggcacctcggtgtcagctcccgcccccacccaggctagggacccgccaacgaggggtgggggcgggaggcgcccacccgtcgcactagtgggcatttgctaaactacgttttatttttttgtaaagtgagcgcccgctgccttcgttctcccaactggagcaaactctgtggcggcgacgatggcggccgtcaggtcggtggtgatgaatagagaggatttctctgcagcgcgacgctcccctctcccgaaaggttggctccacggtcccgccggccgcgcaggtctggctgaactgcttggggtcgcccggctcctctcgattttatgaaaatggcctaattgaggtgtgctcttttctttccttcctcttttcatcttttccttccgtctgcattttctctcctctgtcttaggcttggtatcttcttttctttttatatttgtgtttttctcaccgcctttgcttcctt

SEQ ID NO: 80607 - DNA, 146 bp, Homo sapiens; identical to SEQ ID NO: 12785
  misc_feature 1..146: note = chr17:46811354-46811500
  misc_feature 1..146: note = hyper
  source 1..146: mol_type = genomic DNA

SEQ ID NO: 80608 - DNA, 55 bp, Homo sapiens
  misc_feature 1..55: note = chr17:46811594-46811649
  misc_feature 1..55: note = hyper
  source 1..55: mol_type = genomic DNA
cgctggagatgaagggtgactccggcctttcgccctgaaacgaagtcaagcgggg

SEQ ID NO: 80609 - DNA, 47 bp, Homo sapiens
  misc_feature 1..47: note = chr17:46812568-46812615
  misc_feature 1..47: note = hyper
  source 1..47: mol_type = genomic DNA
cacggatttttcatgcgtgtctagtgcaggcacggttattagtgctt

SEQ ID NO: 80610 - DNA, 106 bp, Homo sapiens
  misc_feature 1..106: note = chr17:46815930-46816036
  misc_feature 1..106: note = hyper
  source 1..106: mol_type = genomic DNA
aggccaagctttggacgagggaaagcacagactgacgccgaccagcccatcctccccggccttgcactgcccgagatccgtgcaggtcaagcgggcaaggtgggac

SEQ ID NO: 80611 - DNA, 499 bp, Homo sapiens
  misc_feature 1..499: note = chr17:46816240-46816739
  misc_feature 1..499: note = hyper
  source 1..499: mol_type = genomic DNA
tcctggatggtaaagcgccctgcggcccgcgggtcaggtctttaacggtccagccagcgcagcaagagagctggggagtcttcttgcagtcccttcctcctactcacgcaaagatctcctctatgctggtaggtgcacctgccctccaccgatcctcaccctgagcgcaggtcgtacctcaaggcgaaaacccgcttagtgcgttggcgggtggagagctgccgccttcttgatccgggactgagaagctgcactccctgacgccactgtggccagcacctcgggccgcgcagacccctacatctctaatcccatagccctccaggggtccttggggcagtccctttggaaagtcttcgaagtgcagggtactttaagtaccctgtagacgccttttatttaatccgcacaacaaaagaacggggcaggagtggggggaaattgttacttccgttttgtagataagagaactgagccgggacggtggctcacgcctgca

SEQ ID NO: 80612 - DNA, 557 bp, Homo sapiens
  misc_feature 1..557: note = chr17:46824358-46824915
  misc_feature 1..557: note = hyper
  source 1..557: mol_type = genomic DNA
cgcttactggttctcaagtcagagtcccccttcccggggctccttctggggactccgggggagagggatctctctgtccatcctgcaactcctctcctggcatagatgccccgcacccccaccttgggccatccttatctgcctgttccccatcacgattgatcctccagggtcgccaaggctcctgctgactacaaaaacatccccaagattcccttcttgacccggttcaggcatatctctttatacttccatgtctccgtttctctatatttttactgtggaggactcagaagagagctgaggctattgtccggggaggaaaggaattcgggcaaatttgtgggtaggggcccagacccaagacccgtgtttctcctgcgtgggttggagtctgtctcaggtcgctccagggacatcaagagcccgcgccgccgagagcccgcgccgccgtccagcgggaagcagcggacccacaggggcctccagccgcctccccgctcccgccccgtgtttctcctgggcctccagctccgtggagagagctgagagttctc

SEQ ID NO: 80613 - DNA, 767 bp, Homo sapiens
  misc_feature 1..767: note = chr17:46824916-46825683
  misc_feature 1..767: note = hyper
  source 1..767: mol_type = genomic DNA
gcccgcgggcttcctcaccaaatccccaaaaaccgacgcaggcacagagggctgactgtgttttgagtaatgcacgcgaggcagtccaatccggcgagatggcccgaagcggggcccagcggtcgggggtgtgggtctggagagagagggtctccccacttccttcctccggctgctcggtcacccatcgactacccgggcggaagcggggcgcagaggggcgcagagggaggcattgccctccaggagtatctattcccatcggggtatggtgaatgccatctaggcccatgctccattcccagggccccctcggttcctccaaaggcgtccacccagaagcagccccagtgtcgcgcattgactcccgccggccaagtcgccgccgaaacaggatctcctaaagcgggctccaccgggtcccagggcgaaaaggtccgaagatctacgctgtcggaaagacctggagaactcgggaagcccagcaacaacaaacaggtttcaacttggaaacaaaccattaaagtttggcttagtttttggtgtgaatggtgcaaataatttctcctcttcactcttcagtcgatctcagctgtatagagctgctctgcaagctaaaaagaaattagtatctattccccccgccaacaatttttttttaacccgggctaccagcttaagcaactggtatcattcttgttgaattaagctctgaaagctcgcctcagaaaaaaagtttttattttaaaaaacgaattattaagtcg

SEQ ID NO: 80614 - DNA, 97 bp, Homo sapiens
  misc_feature 1..97: note = chr17:46826997-46827094
  misc_feature 1..97: note = hyper
  source 1..97: mol_type = genomic DNA
aaagacctcagtcctcgcatccccaccccgacccccggcagcctctttcgctctaagcctcagcctagggcaaactcccctccgcaggtcatcagcc

SEQ ID NO: 80615 - DNA, 172 bp, Homo sapiens; identical to SEQ ID NO: 36616
  misc_feature 1..172: note = chr17:46827330-46827502
  misc_feature 1..172: note = hyper
  source 1..172: mol_type = genomic DNA

SEQ ID NO: 80616 - DNA, 131 bp, Homo sapiens
  misc_feature 1..131: note = chr17:46827625-46827756
  misc_feature 1..131: note = hyper
  source 1..131: mol_type = genomic DNA
cgccagcattttgccggggtttatgcctcaatcccgcattccagccacttccacgaattacttggaagacagaatggtttgtgcccatttatcctacctggagcacagacaagaaacggccaaaaaatgaa

SEQ ID NO: 80617 - DNA, 221 bp, Homo sapiens
  misc_feature 1..221: note = chr17:46829434-46829655
  misc_feature 1..221: note = hyper
  source 1..221: mol_type = genomic DNA
agacgcacctccaggcgaccctgcagactggggtcgggaaaaggacaggctgagaagtctagaaaggcaaagaagttaacgatgtttggcagtctgaggtcttatcagtgtgttggggtcaggtgggggccgaggcaacaagctcaggcagacgccagccggggctgggacggtgcaggtgaggaggggctgcctgggggacagcccgcctcactgaccca

SEQ ID NO: 80618 - DNA, 157 bp, Homo sapiens; identical to SEQ ID NO: 4459
  misc_feature 1..157: note = chr17:46829979-46830136
  misc_feature 1..157: note = hyper
  source 1..157: mol_type = genomic DNA

SEQ ID NO: 80619 - DNA, 466 bp, Homo sapiens
  misc_feature 1..466: note = chr17:46830189-46830655
  misc_feature 1..466: note = hyper
  source 1..466: mol_type = genomic DNA
cggtagggatgcctgggagtctagggagtggcgggggtgtttcttggcccggcagggtggggtttccaagcgtgatctcctcgccctggcagagccggggtgccgggtgggggcaggctcgggggcctgcctgcggtgaatcaggcttgtgacctcaggccgtccaggtaaacatcctctgcgctttggaaactgttgggactagaaaggagcgggcggcagggagagggaagggggaaggagggattctgagtggaggagacctctgaaatcctctctcctgccaggaaaccagggcggtcttccaagcgggcagccacgttgcctacttgaggccaaggcagaagcatcaatcacatggggcgtagtttctgtctggctaaagaacggctcacgcggacctcgggaatgcgactgtggaaacgacggggaagctggaagggctgggtggcgggggaagctggag

SEQ ID NO: 80620 - DNA, 600 bp, Homo sapiens
  misc_feature 1..600: note = chr17:46831726-46832326
  misc_feature 1..600: note = hyper
  source 1..600: mol_type = genomic DNA
acactgtaaaattggcgtaaccaccattccctcccagtctttctctggagtcctaatgggaacagtgacggaatgaaagtgaccacgctggaacccgaagcgctgttcccctccgtggcttcacactgatctccacactagaattccgtgtctgcagttcaagttcaaactactgtggtcggggaagggctacagagatctcgcttggccgtggagtcaccggccccgtccagtcttgcttgggacacatactggtttacactctctcgggttcagtttcctcatctgtaaatggggctcgtatccccctcataaagtggtttgggggataataaagcttgtaaaagcgctttgccccagtgcttggcacataatacgcgctacgttaacaatgtcgcgtacacgcccgaaccggaggaaccccattccacgctccttctggaaccgaattcacctctgaggctttggggcttcagagccggagccgcttgggcaaaaccagcagaacagcgagagggaacgggctggtctagccctgccctgagcatttctactgagacccccggtcctgcttcttccagcctctgctggatttctctc

SEQ ID NO: 80621 - DNA, 398 bp, Homo sapiens
  misc_feature 1..398: note = chr17:46832489-46832887
  misc_feature 1..398: note = hyper
  source 1..398: mol_type = genomic DNA
cgtcgacccggggtctttttccgccaaggagctcggggctcaagaactcgggactgggctgtgggcggggcatggttttcctctctgggcgtcctaatctccaatttcaggcaaattcgctaggaagaaccttcccgagcgcgccttctccaacaggacctccaagccagcctcacgcacgcaggcctggctctctcctgcagaatccccacctgccctataactacccacttcagatatgggggaatggaggagatattccaatcacgccatctacctacagtttccacggccccttctgttgaatggtattttcctttagggtccctagaagcagagcaaatgaaaaggccagggggaaaaaaaaaaaaaaaagaaagaaccggtgaattggctct

SEQ ID NO: 80622 - DNA, 57 bp, Homo sapiens
  misc_feature 1..57: note = chr17:46863338-46863395
  misc_feature 1..57: note = hypo
  source 1..57: mol_type = genomic DNA
tcctctaaaagatgccggctcctgtgtgccttcagggctccccgcaccgccccgtcg

SEQ ID NO: 80623 - DNA, 61 bp, Homo sapiens; identical to SEQ ID NO: 36623
  misc_feature 1..61: note = chr17:46918852-46918913
  misc_feature 1..61: note = hyper
  source 1..61: mol_type = genomic DNA

SEQ ID NO: 80624 - DNA, 116 bp, Homo sapiens; identical to SEQ ID NO: 45097
  misc_feature 1..116: note = chr17:46946208-46946324
  misc_feature 1..116: note = hypo
  source 1..116: mol_type = genomic DNA

SEQ ID NO: 80625 - DNA, 41 bp, Homo sapiens; identical to SEQ ID NO: 44973
  misc_feature 1..41: note = chr17:4699211-4699252
  misc_feature 1..41: note = hypo
  source 1..41: mol_type = genomic DNA

SEQ ID NO: 80626 - DNA, 353 bp, Homo sapiens; identical to SEQ ID NO: 36624
  misc_feature 1..353: note = chr17:47072676-47073029
  misc_feature 1..353: note = hyper
  source 1..353: mol_type = genomic DNA

SEQ ID NO: 80627 - DNA, 225 bp, Homo sapiens; identical to SEQ ID NO: 12797
  misc_feature 1..225: note = chr17:47073103-47073328
  misc_feature 1..225: note = hyper
  source 1..225: mol_type = genomic DNA

SEQ ID NO: 80628 - DNA, 172 bp, Homo sapiens; identical to SEQ ID NO: 36626
  misc_feature 1..172: note = chr17:47073388-47073560
  misc_feature 1..172: note = hyper
  source 1..172: mol_type = genomic DNA

SEQ ID NO: 80629 - DNA, 501 bp, Homo sapiens
  misc_feature 1..501: note = chr17:47073908-47074409
  misc_feature 1..501: note = hyper
  source 1..501: mol_type = genomic DNA
cctcccccttcagttcgctccggttagccctagctatcactcctcttccttgtctcccaccgttcctgtctcctggagtcatctccggccagttccgcgtgttcccctcaggaccccgaaacgttatcatttaacagccggaccccgggtgcgaaccaccctttctcccgtggggatctcaaaacattatttcctgcggcttcctcgttctccactgggataccccgttcccagctttccagtcccgcgctcgcagggtcccccggtcctgcatccccggaggcgggggagtttcgtggggctggcgtggggaaggcggagaccccccccatttaaacatctagggaaaaggttcctttctttttaaatcaccagctcgtgcgaccctctcctgaagaccccagagtcttcggcttctctttgtctgtctcggccgtcccccgcctgtcagtcgctagcagttaaccggggaggggtgagcaaccccgccccccaaaacga

SEQ ID NO: 80630 - DNA, 1038 bp, Homo sapiens
  misc_feature 1..1038: note = chr17:47074697-47075735
  misc_feature 1..1038: note = hyper
  source 1..1038: mol_type = genomic DNA
tgggggctgtcaccacgtggcttctcctttttttttttttttttttttccgctccattttttttcaagtcgattttatttagaggcggcgccagggcggccgcggagaaacgtgacacaccagccctctcggaggggtttcggaccgaagggaagaagctgcgccgtgtcgtccgtctccctgcgcgccgcgggcacttctcctgggctctccccgaactctcccgcgacctctgcgcgccctcaggccgccttccccgccctgggctcgggacaacttctggggtggggtgcaaagaaagtttgcggctcctgccgccggcctctccgcctcttggcctaggaggctcgccgcccgcgcccgctcgttcggccttgcccgggaccgcgtcctgccccgagaccgccaccatgaacaagctttacatcggcaacctcaacgagagcgtgacccccgcggacttggagaaagtgtttgcggagcacaagatctcctacagcggccagttcttggtcaaatccggctacgccttcgtggactgcccggacgagcactgggcgatgaaggccatcgaaactttctccggtaagaacacagccacctcccggaaaagccacaacgagagccccgaacaacggagacccgcaccttccggttcctctcccgccaactcctctcttcccgggcctgcggggtttggcctccgtacccaccctcgacctacccccttcgatgccccctccctcgctctgcgcctcccacccccgcgcagaaacattcgggatttcctcatccctttctcccagcctgagataaggagctctggcttcccccatccttcctccccaccgacggggcgggagcccccactggcagtagtggggggttgaatttagggacacggggatgacccctggctgggcgttatttccacgcccagcccctccctatccgccggtggacgcccccccagctggaaaaccccggctcccgttcctcagtcttaggcctttccaggcgtggaaggggtacccggac

SEQ ID NO: 80631 - DNA, 416 bp, Homo sapiens
  misc_feature 1..416: note = chr17:47075879-47076295
  misc_feature 1..416: note = hyper
  source 1..416: mol_type = genomic DNA
cggcgccgggtcgccatgctgcttcccgagacgccgaggctgggccgagaggcgcgcgcggtggcagtgagggaccctccccgccaggccccgctccgctcccccaggtccaccccttcccaaaccagccccgacaggtgaccgctccgtggcccaaagcccgtcttcctggccaacagagaaaaataaagtttcattctgcacactgcctcccgccccgcgccccactttctgaggaacggggagccctttctttcctggctccttcccacatctgggagctgtgtaggcagcgcacccacacaaatggcctcgcacctttcccaaatcgggattccagagcgatccactcaacaagcctcagtgatttaataaagcaaaaattaaaaaatgaataataacgaatttacagactc

SEQ ID NO: 80632 - DNA, 270 bp, Homo sapiens
  misc_feature 1..270: note = chr17:47081179-47081449
  misc_feature 1..270: note = hyper
  source 1..270: mol_type = genomic DNA
gttgggtggatttcccgcttcccttttaaaggggagcggctggagtctcacagtgttacccacgggagaggggtcggagacgggtggtagactcagctcagggcaaggctatatttgcttttggagttgccggccttcccttcccctttcaaaaaagagagagagtagagagagagaaagtggcggcggcgctgcaggctcttcctggagcgctcgccccggcccggcggccctaaccttccccgcccgcccccgcgccagtcccagccc

SEQ ID NO: 80633 - DNA, 170 bp, Homo sapiens
  misc_feature 1..170: note = chr17:47170202-47170372
  misc_feature 1..170: note = hypo
  source 1..170: mol_type = genomic DNA
ctcactattacacctcgtagactgcttgaataatttctgcttcccatccccatgatcctgaatttgggggatgtgaaggttctagtgcacagtggagtgttcttgttggaatgcacggtcatggtttcactgaattaggagctgaaactgccttccgggagtttggaaag

SEQ ID NO: 80634 - DNA, 30 bp, Homo sapiens
  misc_feature 1..30: note = chr17:47170926-47170956
  misc_feature 1..30: note = hypo
  source 1..30: mol_type = genomic DNA
cgtgcggattctaaccgcactgcattgtgg

SEQ ID NO: 80635 - DNA, 480 bp, Homo sapiens
  misc_feature 1..480: note = chr17:47210020-47210500
  misc_feature 1..480: note = hyper
  source 1..480: mol_type = genomic DNA
gggggccgtcccaagcgtcctgcacctgccctactcgccgagaatttgcccgggtcggtgccagggcggggcagtcggcggcctggctgctaggctccgtgacatccggcagtctgagggcggcgggattcgggatgacttcgggcgggtgagtgtccccggggcagagcagagcgagaggtgaaacttcgggagcagggagcgccgcgggtcctttctggcgtctgcagagcgggcaggtgctggggacgcagacgccggagccagggagcgggcggttggagtcttaagtccaaccggttccccgcataggtggctgcagaggcgaggtgacggcgcgtgcggaacgaactctgcacccccaggaatggggagcgctggcttttccgtgggaaaattccacgtggaagtggcctctcgcggccgggaatgtgtctcggggacgcccgagtgtgggaatcggctcgggagtgcgggctt

SEQ ID NO: 80636 - DNA, 81 bp, Homo sapiens
  misc_feature 1..81: note = chr17:47226409-47226490
  misc_feature 1..81: note = hypo
  source 1..81: mol_type = genomic DNA
ttgtctcaaaaaaaaaaaaaaaggagttgataaatgcattcccgttcttcttaggcatcaacatctcggtggctgcagggt

SEQ ID NO: 80637 - DNA, 102 bp, Homo sapiens
  misc_feature 1..102: note = chr17:47227368-47227470
  misc_feature 1..102: note = hypo
  source 1..102: mol_type = genomic DNA
ttgtatttcctcttccgttaattacctgtttatgttctttaccatttaaaaattttggaggtcggggggggtcagccccccacctggccagccgccccgtcc

SEQ ID NO: 80638 - DNA, 30 bp, Homo sapiens
  misc_feature 1..30: note = chr17:47287915-47287945
  misc_feature 1..30: note = hyper
  source 1..30: mol_type = genomic DNA
gacttcctcttgtcccggaatgagcatgcc

SEQ ID NO: 80639 - DNA, 281 bp, Homo sapiens
  misc_feature 1..281: note = chr17:47307520-47307801
  misc_feature 1..281: note = hyper
  source 1..281: mol_type = genomic DNA
aagccagcactctggcgcacccccggctggcgggcgctgggctccaatgcgggcggggggtgcgcggctcggggaggggtattgtgggtggcagggagcaaggggacaccaattccttggctttgtcagagtcggggacggagggataccccagcactatgttcctgggtaggagagagaaggggactcactcctgagctccagaactcccccagtgccacgcgcgtgaaggagcgccttcaaactccacagcccccaccccgcgccgggaccccagccct

SEQ ID NO: 80640 - DNA, 275 bp, Homo sapiens
  misc_feature 1..275: note = chr17:47308444-47308719
  misc_feature 1..275: note = hyper
  source 1..275: mol_type = genomic DNA
ccgcctccagggcttcggttcttgagatttgcagaagtgcacctccacctcctgcccattccgctgtcgcgtcctaaacccagtgggaggcacgggatgacccagccctcgggacccttttccccagattataggttactgaggattgcgggggttggcgggaggaatgactccctacccccacccccgcccgtaaagttggtggagcgggtggtgacagacagtttgccccttttgcagatggccctataaataaaaaacgcactttctcccct

SEQ ID NO: 80641 - DNA, 30 bp, Homo sapiens; identical to SEQ ID NO: 45100
  misc_feature 1..30: note = chr17:47330524-47330554
  misc_feature 1..30: note = hypo
  source 1..30: mol_type = genomic DNA

SEQ ID NO: 80642 - DNA, 19 bp, Homo sapiens
  misc_feature 1..19: note = chr17:47336379-47336398
  misc_feature 1..19: note = hypo
  source 1..19: mol_type = genomic DNA
gccacggtgccaggcccta

SEQ ID NO: 80643 - DNA, 28 bp, Homo sapiens
  misc_feature 1..28: note = chr17:47355143-47355171
  misc_feature 1..28: note = hypo
  source 1..28: mol_type = genomic DNA
gagccaccgcgtccggcctccaatcaat

SEQ ID NO: 80644 - DNA, 30 bp, Homo sapiens; identical to SEQ ID NO: 45101
  misc_feature 1..30: note = chr17:47449030-47449060
  misc_feature 1..30: note = hypo
  source 1..30: mol_type = genomic DNA

SEQ ID NO: 80645 - DNA, 118 bp, Homo sapiens
  misc_feature 1..118: note = chr17:47547799-47547917
  misc_feature 1..118: note = hyper
  source 1..118: mol_type = genomic DNA
gggtgggggaggggacgccgacacggagctgccatcggatgcgacggaccccaccgagcaccccagccacggagcggcttccgcgggcagcctggggcctgggcggggtcctagggag

SEQ ID NO: 80646 - DNA, 30 bp, Homo sapiens
  misc_feature 1..30: note = chr17:47559443-47559473
  misc_feature 1..30: note = hypo
  source 1..30: mol_type = genomic DNA
gtttacctagagctgcggtttcacttcttt

SEQ ID NO: 80647 - DNA, 41 bp, Homo sapiens
  misc_feature 1..41: note = chr17:47572358-47572399
  misc_feature 1..41: note = hyper
  source 1..41: mol_type = genomic DNA
gagaggaacaggaaccgcagtggggacgccctggtccccgg

SEQ ID NO: 80648 - DNA, 2283 bp, Homo sapiens
  misc_feature 1..2283: note = chr17:47572971-47575254
  misc_feature 1..2283: note = hyper
  source 1..2283: mol_type = genomic DNA
aaggacctctgatgccgggaccacgaaggagggtctagggttcccggagcgcagaggcgactctccagggtggagatgagggcaagaccggagcacggatgccggtcctcaggtaccgcagggggcggtgggggagctgggaggggtctttcaagagggggcatggggctctccgatgcccaggttcttcggaagaggacactcgaatgccgggatcccgaagggactttcccctcagcatctcggtctctggagagtcgtgggacagaaccaaggcgagagaaggagggggaactggacggggactagagatgagaggggcgagctgggctggggcggggagcccgggacgacgggatggaacaatggaggaggtcggagggactggaggcagaggggacccggcaaggacaatggggaccggccagacaatgggggggaggggcgtcggagggagaggttggggagcgggagagaggttgagaagtgggttagggagggcagaagaggggcgacggcgagggcggcagagagatggaagcagaaggaaaggagacagagcggggcgcggaccctgaagtggtcggggtcccgcctgcccgctgagggacagtgagacgagaagagagagcagaggcttggacatttccagcgcctgtccccgcgctcctgctcgcggcctctcccagtcccggaattggggctgcggatctaaggctgggaggggagtgcccacttcgccggggcgaacccgctcccggggttcccccacggccggcgggctcctccgacgcgcgtgttctcacggcttgaagcagcgcagcggatcgcgagggacggagcgggtgtgcccctacccgggctggcggtggctacgtctcggggtgcagagcgccggggcgcactaggcggggacccttcctggccgcgcgcagctctggctacgcaggcgggaggcggcaggcagggggcgctgcggggcgaggcaagtgcagtccgccgctgcctgcctgcgagtctggggctgcgcgccgctccccacctagctgcgcgacccgagcgccgcgcccaccgcgctccgtgggctcccgcgcctcgaagggtcgggatccggtctgagcctctcctggctctcggtgcaagccgctgggcacctaacgagacgggggcgcccggacgcctcggattctgtagcgcggtatcccgggccaccgactcggcaaaggtcggcgggtcctccgggtggtccgacgagattgtcagatgtggcctgctttatggccatgaaccgaatgccctggaaggtctggcaacggaggaggcgtcttcactctccccgccagcatctttcatcagagcactgcgccccaaattccggctttacagatacggagactgaggctctgagagtttaaacgacttggccaagatctcacagcaagttgggccagagtcgtggctagactccccgacctgattcccagctcggtactcccccaccttttcagggggcagccgctgtcccagctcggggtcacggctgcgtttcccagcagggcggggggggttgacactgtccccagagtccgtcggcggtagagcctgcgggtgaggtgggcagagattctgtccgggtgcgggccccagcccgaaagctcagccccagttccctggagctgtcaggacctgtggctgcgtccggggatttgggagcgaccgcgggcacgtctgctgactaacgccgctggttagagacgctgctcagacgcgggtgggcgagcgtagaccaggagagcggggaggagggaccggatcccagaggggcaacgacttgggctccgggtctgggcaagagcgagggtccccgcgcgaagacccaaggaaggaggggagctgggcgtggaggacctgggcgcttgggaaggtgtaccccgacaggaacctgccgtctgcagcccctgcggctcccgcctccgcctcggcgcgcggctgctcggtctgggatggctgtgcgcggtccgagtttcttcctgggccgcggtgagagagagagggctgaaaccagagcgcgtcccggcgggtcggctggcgggccgcgccggtaatggaggcactttgtcattcagacgtctgtaaccagagccgccgggctggctaatgcgcctaatagggatggaacgagggcagcaaatgggcgtgcgtgagcggccgggctgagctgggtggatggtggatggggaggcagctccgcgggggacgggcccctaccgcactgttccagcc

SEQ ID NO: 80649 - DNA, 30 bp, Homo sapiens
  misc_feature 1..30: note = chr17:47643694-47643724
  misc_feature 1..30: note = hyper
  source 1..30: mol_type = genomic DNA
gtggaaagggactggcgggtgagcgggcct

SEQ ID NO: 80650 - DNA, 30 bp, Homo sapiens
  misc_feature 1..30: note = chr17:47644064-47644094
  misc_feature 1..30: note = hypo
  source 1..30: mol_type = genomic DNA
cctcatttcaggaaacgctggcatgggaaa

SEQ ID NO: 80651 - DNA, 64 bp, Homo sapiens
  misc_feature 1..64: note = chr17:47653309-47653373
  misc_feature 1..64: note = hyper
  source 1..64: mol_type = genomic DNA
gcagctggggcccttcgaggcgctcggggcgcacatctgggacctcgagcgggggccgtgccgc

SEQ ID NO: 80652 - DNA, 97 bp, Homo sapiens
  misc_feature 1..97: note = chr17:47657497-47657594
  misc_feature 1..97: note = hypo
  source 1..97: mol_type = genomic DNA
cctcacctgtcagaccggggttctcccggatctggatggcgccgccctctcagcagcgggcacgggtggggcggggccgggccgcagagcatgtgct

SEQ ID NO: 80653 - DNA, 36 bp, Homo sapiens
  misc_feature 1..36: note = chr17:47756022-47756058
  misc_feature 1..36: note = hypo
  source 1..36: mol_type = genomic DNA
acgcatggtggctgacgcctgtaatcccagcacttt

SEQ ID NO: 80654 - DNA, 62 bp, Homo sapiens
  misc_feature 1..62: note = chr17:47840698-47840760
  misc_feature 1..62: note = hyper
  source 1..62: mol_type = genomic DNA
tggcataaagggaagcgcacgtgaagtggtggagaatggaactccagcgcagttgagaggga

SEQ ID NO: 80655 - DNA, 32 bp, Homo sapiens; identical to SEQ ID NO: 16208
  misc_feature 1..32: note = chr17:47851118-47851150
  misc_feature 1..32: note = hypo
  source 1..32: mol_type = genomic DNA

SEQ ID NO: 80656 - DNA, 31 bp, Homo sapiens; identical to SEQ ID NO: 16209
  misc_feature 1..31: note = chr17:47851390-47851421
  misc_feature 1..31: note = hypo
  source 1..31: mol_type = genomic DNA

SEQ ID NO: 80657 - DNA, 163 bp, Homo sapiens
  misc_feature 1..163: note = chr17:47865437-47865600
  misc_feature 1..163: note = hyper
  source 1..163: mol_type = genomic DNA
gttttgcctcctccccgcgacatcaactaactcacttgctgttagctaagggcaaggacaatgtctcctctaccagacaggaaacttgatggcggacgctatccgttagttcctttttcaattccccattcccaccccttcgagaccacgatgtttcttaaaa

SEQ ID NO: 80658 - DNA, 376 bp, Homo sapiens
  misc_feature 1..376: note = chr17:47928151-47928527
  misc_feature 1..376: note = hyper
  source 1..376: mol_type = genomic DNA
ccctgacacacagcacgcgctcagttaaccctaacttaattgttgtgatgatgaggaggatgatgattttattccttcgaaggagcgctggtctcctggccccctctcagtctcccgacctcgccagcgccagagccatcctgcatggtcccgacctcgtcagcgccagagccgtcctgcatgaggcaggatgtggtgggcgcacagcagggacgaggcggggggcacggggcagaaaggagagggcgacgggaagaaggcagagaaaacccaaaaggtccggaaggctgggagggaggcagggcacaggctggaaaccgcggctatttgcagcgtcgccctcgggctgcggtcaggctggcgctggcagtcctgg

SEQ ID NO: 80659 - DNA, 113 bp, Homo sapiens
  misc_feature 1..113: note = chr17:47967958-47968071
  misc_feature 1..113: note = hyper
  source 1..113: mol_type = genomic DNA
ctccgggcccgacgccggcccagcccagcagtgccgggcgccgggcccaagccgaccccctgttttggctctgccgcctgatttctaccgcaggcagatatcttccgagaccc

SEQ ID NO: 80660 - DNA, 15 bp, Homo sapiens
  misc_feature 1..15: note = chr17:47968095-47968110
  misc_feature 1..15: note = hyper
  source 1..15: mol_type = genomic DNA
cgctaccccagggcc

SEQ ID NO: 80661 - DNA, 39 bp, Homo sapiens
  misc_feature 1..39: note = chr17:47979358-47979397
  misc_feature 1..39: note = hyper
  source 1..39: mol_type = genomic DNA
ggggcaccctctctacggcgggcccgccccctgccccgc

SEQ ID NO: 80662 - DNA, 605 bp, Homo sapiens
  misc_feature 1..605: note = chr17:47987509-47988114
  misc_feature 1..605: note = hyper
  source 1..605: mol_type = genomic DNA
agggagctgggctttcggaggtgagaggaaccgcgaggcagcagcggtgtggggaaggcactcagctttcctggaggagcggctcccggtggcggcgggctgcctggaggaggaggcagggccaggctgggcgctgaggaggccgccccggtggcgctcccacgacccgggcaaggcagtctgggcgccgtctccggtctcggggcctgcggtcggggcaccgcggtgccgcgtttgagccggtcagctccctgcggaaattacaggggcgctcggcgctgcggtcgcgccccccggggcagcgcccgctggttggaggcgtttaaattgaaagcagctttggggagagggggcggacgcgggccgccgagcaaggggagggggcggcccggcacagcgaccccattgtctgtgcccgccgaggggtggaaccttgcggtgagctcggcgcggcgccccctccccgagctccggcccagcggcgctctcagctggttcccacgctgcgcagcgctggccacgacccctcgtcccttctccacctgggtctgcctcttggctcgctgactgcaagcctggcagcgcgcacgcgcacacttcctcca

SEQ ID NO: 80663 - DNA, 85 bp, Homo sapiens; identical to SEQ ID NO: 36640
  misc_feature 1..85: note = chr17:48040403-48040488
  misc_feature 1..85: note = hyper
  source 1..85: mol_type = genomic DNA

SEQ ID NO: 80664 - DNA, 677 bp, Homo sapiens
  misc_feature 1..677: note = chr17:48041100-48041777
  misc_feature 1..677: note = hyper
  source 1..677: mol_type = genomic DNA
ggtggcagaagtatacgtctgtgcatctatgtgtttgtggtgtttttggtgtgtgtgtctgtgtgtgcgcgcgcgcgctctgtgttgtattgtgtgcgctagtgcacgcattgtcttcgatgttgccgctagaggaaccttccaactcccactactcccacctccggctttcaccctgcacccggcgatgaagacgtcggcgaaacgcctactttccatgcctaggtctgggaaggtctgaagatcccggcggagctgccttcgttcggggccgggcaaattcgttgcagccgggttggcctcagggcctctcgccggctcgctatgtttccccggggcgccctggcaggccagccggcggtctgtcagtccagctcctggtgcgggcgcctcgttttggtccaccgggtccggggctgggacaccgagggaaaacttcagagctccgggccaccgagcctggaagttacgcgtcccccagcccacgcgtccccaatcccggggtatttcctgctccctcatccagcgaagttcagcgtcgcgtgtctccccagcggcgcagcctgcctccaagacaccctcaaaaccgcctcattttttgttaaccgttttctctctctctctctctctgtctctctctctcttcctccgtccccccaccccgtgtcccaagaatt

SEQ ID NO: 80665 - DNA, 102 bp, Homo sapiens; identical to SEQ ID NO: 12812
  misc_feature 1..102: note = chr17:48042039-48042141
  misc_feature 1..102: note = hyper
  source 1..102: mol_type = genomic DNA

SEQ ID NO: 80666 - DNA, 435 bp, Homo sapiens
  misc_feature 1..435: note = chr17:48042213-48042648
  misc_feature 1..435: note = hyper
  source 1..435: mol_type = genomic DNA
cggagaggggggacgcaggtctcttcagactgcccattctccgggcctcgctgaatgcgggggctctatccacagcgcgcggggccgagctcaggcaggctggggcgaagatctgattctttccttcccgccgccaaaccgaattaatcagtttcttcaacctgagttactaagaaagaaaggtccttccaaataaaactgaaaatcactgcgaatgacaatactatactacaagttcgttttggggccggtgggtgggatggaggagaaagggcacggataatcccggagggccgcggagtgaggaggactatggtcgcggtggaatctctgttccgctggcacatccgcgcaggtgcggctctgagtgctggctcggggttacagacctcggcatccggctgcaggggcagacagagacctcctctgctaggg

SEQ ID NO: 80667 - DNA, 234 bp, Homo sapiens
  misc_feature 1..234: note = chr17:48042750-48042984
  misc_feature 1..234: note = hyper
  source 1..234: mol_type = genomic DNA
cggagggaattcccgctaccgggaaggtcggaactcggggtgatcaaacaaggaatgcatctcacctccgtgggtgcttgtgctgcgcaaggaattattaccggagcggttgcgatggcctttgcccggcgacccaagaagagtaagcaaactaccgtccacccagcggatcaggtccaatccctgcgcctcggcccaatccctagagccccgcggcgccgtatcccctccccc

SEQ ID NO: 80668 - DNA, 258 bp, Homo sapiens
  misc_feature 1..258: note = chr17:48046722-48046980
  misc_feature 1..258: note = hyper
  source 1..258: mol_type = genomic DNA
gctggctggggggcccgtccggcccaacgccggaggcttggaaaagagagttggcagcgggagcggactacgtgccgggccatggcccttctgcccgggccctggccacaatgacctctttgccctgccccctccccggccgggacgcctccaaagctgtcttcccagacctcgcccctgtcccgtcggtagcggctgcctacccgcttggcttgtcccctacaaccgcagcctcccccaatttgtcctactccaggc

SEQ ID NO: 80669 - DNA, 1787 bp, Homo sapiens
  misc_feature 1..1787: note = chr17:48048796-48050583
  misc_feature 1..1787: note = hyper
  source 1..1787: mol_type = genomic DNA
accaccccgttgagccgtagggagcagcgggcctggagggaggccttggggctccatgatcgcgacccgggcagatctcgtaacttgctggaactggggtagggaaaggcagctgtccgggaaggaacttggagggggtctgctgggagagttggggcgcggagggctatgcgaattcagcaaccgggtcggcctcagagactctgcgtccccgctcgaattgcgcagtccacgcagccagagaggcgcgggtgggctctgggctgccagcccagagctgccagcagtggggtcgaggcaggggaggcaggacaggcgcgggcgggagcggaaacccaacggtttttctgggaattggttgaggcagggtcgaggagggaggatctcagaagcccgcagcgcccgaggccacgggtgagggatgcgggggaggtgacggcagctggtgaccgcggctggccgagggcgggtacactgacgtgtggagggtgagcccgactaggggaagaaggtggggggacgcgggcggacagaagccgctctctctcggctcaggtcggctggacagacccgcagggaatgcggcgaacgctgccctaagcgcccgggcattgcggctgctccatccgccctactcctcccattgcctgggacctctgcagcgtccccgtagagccgcgcaggttagggtggctggcttggaagaacagaaacccctcggcccaaccctcccctgtccctcagcattctagggctgggctgtcccgcggccgagattcctggagagctaggcgggccagagctgaccagatcccccgcggcggcaccgcagcgcgatccaggagtggccccgccgggctacgctgcgcgctcttggaacccgggtcaccttccctgccgccggaaccgctctgtgcgcgctgcccaacgaaggaaggggctgccccacgcagacccggcttctgggggtccctggaaacccaggcggccacggtgtggcgggggagacatggtcacttttcctgcagggtgcgcctgagcagaggggcagcccgttacagtaggcgaggccagggcaaacccggggtcactatcagcgctgcgagactggtattcaaggtcctctcagccgggcctctcacccaccccgctggccgcagccggaggctgccacgcggacaccgtctcaagcctctgagcattgctctgagcctctgcctgcaatgtccttcctctgtcatctctaggcctcggctcagccctggacctagcctttctgccccgccctaccccaagctggcgccaccgcccgtggctgaactccgacctcccaccgcaggcgccgcggtaccctggctgtggccctcggcgctttcttcctagggtcacaggacccatacgagtgggagctccctgggagcagaactgcgtcttgtatcacctggcgcggtgaacgtgggggttgaaacgctccacgcggaaggtagagggcaggggccaagggggcgatcctggtggctgcgctttttgctatttgctgccgacggcatgcagacgagatgcaaataagcttatgaaactgtccgtcctaccccctcgctccctcctcgccccctacaccgtgttgtgctgcccaccagactcggagaagccgcggctgtccccggaaccctccgagcggcgccctcaggcccccgccaaaaagctccgcaagccgaggaccatctactccagcctgcagctgcagcacctaaaccagcgtttccagcacacgcagtacctggcgc

SEQ ID NO: 80670 - DNA, 1051 bp, Homo sapiens
  misc_feature 1..1051: note = chr17:48070654-48071705
  misc_feature 1..1051: note = hyper
  source 1..1051: mol_type = genomic DNA
agagttccaggagcccgcagggcccttcagtggccagccaggctcggcagcgcgcggggaactacggggtcccgcgcgcccccgcggccctggacagccaaacaccaacctgtgtctgcgtgaggcccagctgcgcggccagctcggcgcgctcgggcagcgccaggtactgggccttctggaagcggcgctgcagggcggccagctggtagctggagtagatcgtacgcggctttcggaccttcttgggcttcccattcaccatgcgcacctctgcttccggctcctccttcaccgacactgcggggaacgcaccgggcggaagagggggcggttcagcctcggcctgcgactcctgcgaccctccagggccccgccggacgcccctcgcttccgcccaccgactcgccgcgggattcccggccgcgcgctccgctgcccgcggcccaggggggagccgcggccccagagccagaactggccgcggcccacaacgcggcgctcccagctccgcgcccggccgccgcagcactgtccccggcgccagccgccgcctgcgccaggaccgcctcggcttcgctcacgacgccttcccggctcgcctcccagcctcggggctcctcgccgcccggctgctagccgcccccttcccagtcccatctcgccgtcggttgtttctctcgctccttcccgtccgccccccgccctttaaaaaagtttcattttagaatctctttagattttcagaaaagttgcaaggatagtgcagactttctttctttccctgtcccccttcttccccccttccttctctccttcctttcttgtttcttctgccctttctctcactgtctttccatacttccctcttgctgccttcacttttccctttttcagcttctctgcctctcggtggctgcttccctccgctttcccgcaacttccgtgggtccttctcattgccccctcacgactcctagtctccccatcccttatccaaaggagggcccctagagtttccagcccctgccgcctacccccaagccctctg

SEQ ID NO: 80671 - DNA, 74 bp, Homo sapiens
  misc_feature 1..74: note = chr17:48071806-48071880
  misc_feature 1..74: note = hyper
  source 1..74: mol_type = genomic DNA
cgatcctcatccgggaccgcggcgcactgcgcacatcgcgccccaaatgcttgcacacccggggctggaaggtc

SEQ ID NO: 80672 - DNA, 88 bp, Homo sapiens
  misc_feature 1..88: note = chr17:48190266-48190354
  misc_feature 1..88: note = hypo
  source 1..88: mol_type = genomic DNA
ttggcctcctgctctcggcgccggagcttctcccgctgccgcgcagccttctcctgggccttgcgctccttctcggcagctgctgcca

SEQ ID NO: 80673 - DNA, 277 bp, Homo sapiens
  misc_feature 1..277: note = chr17:48206298-48206575
  misc_feature 1..277: note = hyper
  source 1..277: mol_type = genomic DNA
ctgaagaggagaaagcgacagagagaagtgcaactgggagaggccgggaagaggtggatgggaaaggagactagcggtcggggaggcagttgtggagccagagaggtggtccccccttcccatatcgccggccgtccactggccccaggcttggggtagtcctcaggagtcgggcaccccctcaaagcactgttggagatggggtgaggttggggacagggcacctactccactctcagagcccttctccccagtcagagcccggtggctagtttct

SEQ ID NO: 80674 - DNA, 30 bp, Homo sapiens
  misc_feature 1..30: note = chr17:48207718-48207748
  misc_feature 1..30: note = hyper
  source 1..30: mol_type = genomic DNA
ggccagtgggccagtcgggggctcagacga

SEQ ID NO: 80675 - DNA, 30 bp, Homo sapiens
  misc_feature 1..30: note = chr17:48225911-48225941
  misc_feature 1..30: note = hyper
  source 1..30: mol_type = genomic DNA
accagctcaccctcacgatctgcttccctc

SEQ ID NO: 80676 - DNA, 33 bp, Homo sapiens
  misc_feature 1..33: note = chr17:48239531-48239564
  misc_feature 1..33: note = hypo
  source 1..33: mol_type = genomic DNA
tccagctctcctgaccgacgccccaactgggga

SEQ ID NO: 80677 - DNA, 39 bp, Homo sapiens
  misc_feature 1..39: note = chr17:48278705-48278744
  misc_feature 1..39: note = hyper
  source 1..39: mol_type = genomic DNA
gcccccgggaccaagcgcaaggcgcgatatagagtatcc

SEQ ID NO: 80678 - DNA, 30 bp, Homo sapiens
  misc_feature 1..30: note = chr17:4841792-4841822
  misc_feature 1..30: note = hypo
  source 1..30: mol_type = genomic DNA
gcccctccactcacccgccacagtgtgagg

SEQ ID NO: 80679 - DNA, 30 bp, Homo sapiens
  misc_feature 1..30: note = chr17:48503171-48503201
  misc_feature 1..30: note = hyper
  source 1..30: mol_type = genomic DNA
ctttggcccccggctcgcaagtagcggggc

SEQ ID NO: 80680 - DNA, 30 bp, Homo sapiens
  misc_feature 1..30: note = chr17:48550296-48550326
  misc_feature 1..30: note = hypo
  source 1..30: mol_type = genomic DNA
gatgatgcccaacatcgataaataacacca

SEQ ID NO: 80681 - DNA, 177 bp, Homo sapiens
  misc_feature 1..177: note = chr17:48585866-48586043
  misc_feature 1..177: note = hyper
  source 1..177: mol_type = genomic DNA
aggaggtttccaagccgtctccgcccaagttgatcggtggatgcgcgcccccgcgcggggcaccggttgctgtggacgcagtggcggccgttggctggcgggtgcggcgcagcctcggtgtctctgggccggcggtgcagggcaacgtttcatggtgccgggcggcaccatgaagtc

SEQ ID NO: 80682 - DNA, 369 bp, Homo sapiens
  misc_feature 1..369: note = chr17:48611939-48612308
  misc_feature 1..369: note = hypo
  source 1..369: mol_type = genomic DNA
taaacaagttgtggccgtggcattcccacagaaggcccacgacccgctggaaggaaagagatagcagacaaaaggtaggctgcgctgtgggccaggcactctccacctcgcccactcccacggtatcttattctctgggcccccaacaaaacctgccaaggcatgttttcaaagcgtggggctgctttgaactgagcccagcactggcggggctggggtggaaggagcgtggaatcgggtgcgagaggacagtctccttcagattcctgcttctggcagcctggggaccagttggggcacgggctgggatggagggtggagccgaaaggtgtttggtgggtgggggacagttcacgggtgaagtggagg

SEQ ID NO: 80683 - DNA, 30 bp, Homo sapiens
  misc_feature 1..30: note = chr17:48617944-48617974
  misc_feature 1..30: note = hypo
  source 1..30: mol_type = genomic DNA
gaaggtggcctgagtcgcccacacctgcag

SEQ ID NO: 80684 - DNA, 195 bp, Homo sapiens
  misc_feature 1..195: note = chr17:48619096-48619291
  misc_feature 1..195: note = hyper
  source 1..195: mol_type = genomic DNA
tcagagcctagcctccgccggaggagcccactcttcttcccaacttccacgacctcccggtgtagggctctgaaccccgggtcactcaaagccactctcgttctgcaggtctcagcgctccgtcccccaccaacccgttcggcgcgggcgagccgggcaggccgacgctaaaccagatgcgcaccggctcgccgg

SEQ ID NO: 80685 - DNA, 390 bp, Homo sapiens; identical to SEQ ID NO: 36652
  misc_feature 1..390: note = chr17:48619346-48619736
  misc_feature 1..390: note = hyper
  source 1..390: mol_type = genomic DNA

SEQ ID NO: 80686 - DNA, 30 bp, Homo sapiens
  misc_feature 1..30: note = chr17:48620645-48620675
  misc_feature 1..30: note = hypo
  source 1..30: mol_type = genomic DNA
ccacacaggaggaatcggaccccttctggg

SEQ ID NO: 80687 - DNA, 882 bp, Homo sapiens
  misc_feature 1..882: note = chr17:48636387-48637269
  misc_feature 1..882: note = hyper
  source 1..882: mol_type = genomic DNA
gggcaaccagggagacgacggcgcagcagccactctgccacttcccccatcccctccccccatcggccggggcgggaactgagacgaccccaaccctctgcggtggcgggaggtgcgcgggggctgcgtgggtggtgcagccttaggagagtgaacaacgcccaggggtgatggcctcagcaaagtgaggggtggtgatggaggtcatccgacccatcccgccgcctctccgcagtggcgcaagcgccccaaaatctccggagagggaactgactgacccactaggttccgccgtgtctacctctcgcagatgttggggaagtgcttcccggcgtctaatcctcgctgttcccccctccaccggcgcccagcacacccgcggcgctccgctcccgggtacccacagctttctggagtggcgccggcggcaggagagagctagagccgactgagccccagaactcggggaggtaggcggggcaagggccggggtctgcgcgtgcgtgtgcacgcgtggaaagcacaaacccacgagggcccgctgccggtagggttaaggtgagtgagtgaaggcggcagacccgcgaagttccagttccgcggacactctttccctaagccacatagggacttaagagaaactgaggcacgaagttggggggtggcggtggtggggactttgaaggtcgagtcgataaagcccagctctgtgcttccgccccctcccacacactcgagacccccacaggttccttcttaggggtcctcgctctgctccgcagcccctcctggggatccgggctctgcggtccagcgcgacctgcctggggccacgtgttcaagcacgaagcccctgcgtggagtccacgcccttcaaaaggt

SEQ ID NO: 80688 - DNA, 71 bp, Homo sapiens
  misc_feature 1..71: note = chr17:48637706-48637777
  misc_feature 1..71: note = hyper
  source 1..71: mol_type = genomic DNA
gatgcctggggcctgcggccctacgccaggaccccgcgccgaatactctgattcttcgggctccctccaag

SEQ ID NO: 80689 - DNA, 103 bp, Homo sapiens
  misc_feature 1..103: note = chr17:48638942-48639045
  misc_feature 1..103: note = hyper
  source 1..103: mol_type = genomic DNA
gggcagcgcggactccgaggcggaggggctgccgtacccggcgctggccccggtggttttcttctacttgagccaggacagccgcccgcggagctggtgtctc

SEQ ID NO: 80690 - DNA, 501 bp, Homo sapiens
  misc_feature 1..501: note = chr17:48639331-48639832
  misc_feature 1..501: note = hyper
  source 1..501: mol_type = genomic DNA
aagagagctgtgccccgctggctcgcagctggacgccctccagatgtggtcaggggagggtcgtcatcctccagatgtgggaagcttcgggagcctgggagctgtactctgcccgcgccggttagcgagctgggtttggtttccgagtttggtggggggtgggtgggggcggtggggaggaagctgcggggacggaggaggggggaccgcaatctcctgggtttccctccttcccccgccccaaagtttgcggcggattctagggtctgatcccccaacctggtccttgaggctgaggtttttactgacctagaaggagatgttggggggcggggaccaggtcctggcccacctcaccccccacctcgcgggttggaggcacaacaaggagattccggcggcggctgatgtcaggggcgcagaatgagaacaagatgtggtggaggggagctgtctgcccccggagctgggagtggagcccctttccgctagagcccagtg

SEQ ID NO: 80691 - DNA, 449 bp, Homo sapiens
  misc_feature 1..449: note = chr17:48652975-48653424
  misc_feature 1..449: note = hypo
  source 1..449: mol_type = genomic DNA
gaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgca

SEQ ID NO: 80692 - DNA, 35 bp, Homo sapiens
  misc_feature 1..35: note = chr17:48673781-48673816
  misc_feature 1..35: note = hypo
  source 1..35: mol_type = genomic DNA
gcgccgtgcatgtctcgtgccgtggttgctggttc

SEQ ID NO: 80693 - DNA, 71 bp, Homo sapiens
  misc_feature 1..71: note = chr17:48678374-48678445
  misc_feature 1..71: note = hypo
  source 1..71: mol_type = genomic DNA
cctccccctctcagccgttgcctccatgcctgggcaggttccgcctcctgtgtcaccggatcatcacccac

SEQ ID NO: 80694 - DNA, 88 bp, Homo sapiens
  misc_feature 1..88: note = chr17:48687158-48687246
  misc_feature 1..88: note = hypo
  source 1..88: mol_type = genomic DNA
gagctgaggggaagccgcccctgaggggccctgcccagcgcacctggtccggccagtgaccaatgtcgtgtttcgttcttttagatct

SEQ ID NO: 80695 - DNA, 158 bp, Homo sapiens
  misc_feature 1..158: note = chr17:48712444-48712602
  misc_feature 1..158: note = hyper
  source 1..158: mol_type = genomic DNA
acggagcccctgagacggcctgggcgcccgggagggggcgatgggctcgggagggaggttggctgcgccgcccggagccgggtcccacgcggtgtcggggacctgccctgctctgcccttcccggctgcagcactggggagcccgggaaagtgaggaa

SEQ ID NO: 80696 - DNA, 24 bp, Homo sapiens
  misc_feature 1..24: note = chr17:48799846-48799870
  misc_feature 1..24: note = hypo
  source 1..24: mol_type = genomic DNA
gcgcccggccggctcctcttatgc

SEQ ID NO: 80697 - DNA, 105 bp, Homo sapiens
  misc_feature 1..105: note = chr17:48805065-48805170
  misc_feature 1..105: note = hypo
  source 1..105: mol_type = genomic DNA
gagctggagaaaaatcggtgaatttggcaaattttaaatagtattgtagtgtgtatgtttttgttgggtggggtagtgtagataggtaggcaagaacttggtttt

SEQ ID NO: 80698 - DNA, 36 bp, Homo sapiens
  misc_feature 1..36: note = chr17:48846173-48846209
  misc_feature 1..36: note = hypo
  source 1..36: mol_type = genomic DNA
atttaggggaacacacgttcttcttttaattcattt

SEQ ID NO: 80699 - DNA, 43 bp, Homo sapiens
  misc_feature 1..43: note = chr17:48911187-48911230
  misc_feature 1..43: note = hypo
  source 1..43: mol_type = genomic DNA
tgtctggcttcattacggggactggcctcgaagggaagtttat

SEQ ID NO: 80700 - DNA, 30 bp, Homo sapiens
  misc_feature 1..30: note = chr17:4891311-4891341
  misc_feature 1..30: note = hyper
  source 1..30: mol_type = genomic DNA
tctggggacccagcccgacttcattgtagc

SEQ ID NO: 80701 - DNA, 273 bp, Homo sapiens
  misc_feature 1..273: note = chr17:49008614-49008887
  misc_feature 1..273: note = hyper
  source 1..273: mol_type = genomic DNA
agggcccgcctggctcgctgcggccgcttatcagagccggctgtggcgccggttacgtaaccgggcggctaatgctgttttacttgtcgatgaaacccaaattaaaagaggaaattattgtcctgatgctcaactcgcctaatccccatctgtctcctctctggtcccccgcgctgccgagcgctcgcatctaaaggtcttgaacgcgttccaggtttctaatttcgtttgcttatgcaaccaaaaatattatggccgcgtttcctgggggtg

SEQ ID NO: 80702 - DNA, 38 bp, Homo sapiens
  misc_feature 1..38: note = chr17:49012104-49012142
  misc_feature 1..38: note = hypo
  source 1..38: mol_type = genomic DNA
tcacacatcaacactcgcgtacacgcactggggtgtgc

SEQ ID NO: 80703 - DNA, 30 bp, Homo sapiens
  misc_feature 1..30: note = chr17:49021785-49021815
  misc_feature 1..30: note = hyper
  source 1..30: mol_type = genomic DNA
gggaggtggggctgtcggtgctccagggtc

SEQ ID NO: 80704 - DNA, 120 bp, Homo sapiens
  misc_feature 1..120: note = chr17:49229481-49229601
  misc_feature 1..120: note = hypo
  source 1..120: mol_type = genomic DNA
cgcttgaacccggatggcggagtttgcaatgaaccgacatcgtgcaactgcgctccggcctgggcgccaaagcgatactcggtctcaaaaagaaaaaaaagaaaacaggagaataatgaa

SEQ ID NO: 80705 - DNA, 124 bp, Homo sapiens
  misc_feature 1..124: note = chr17:49462711-49462835
  misc_feature 1..124: note = hypo
  source 1..124: mol_type = genomic DNA
ctggcgggatccatccgccatccttcccctcacatgggctcctctaggcccgctcccgcatccctttctgtcccctcccacaaccacagcgactcttcccataaacaaccgtgacctggtcatg

SEQ ID NO: 80706 - DNA, 27 bp, Homo sapiens
  misc_feature 1..27: note = chr17:4976841-4976868
  misc_feature 1..27: note = hypo
  source 1..27: mol_type = genomic DNA
gtgtaataaagcagacggtgggccagg

SEQ ID NO: 80707 - DNA, 179 bp, Homo sapiens
  misc_feature 1..179: note = chr17:4981370-4981549
  misc_feature 1..179: note = hyper
  source 1..179: mol_type = genomic DNA
gagagttaaaagggtcgcgcaaacggtccccgcgggaatgcgaagcggattctcgagttcttgagcctagagcaatgcttggggagcgacacgagggcgcagagcggcagatcgcggagcggaagttcatccccggagccgttctaggaaacccggaggactcaggtcgtcaatgattc

SEQ ID NO: 80708 - DNA, 34 bp, Homo sapiens; identical to SEQ ID NO: 36347
  misc_feature 1..34: note = chr17:4981951-4981985
  misc_feature 1..34: note = hyper
  source 1..34: mol_type = genomic DNA

SEQ ID NO: 80709 - DNA, 582 bp, Homo sapiens
  misc_feature 1..582: note = chr17:5000354-5000936
  misc_feature 1..582: note = hyper
  source 1..582: mol_type = genomic DNA
cccagtgggaaggagcggggacgattctggcgatcacatgaggaagggagcagcctcagcagcgcaggtggacacagtcgtcaaccactcgctggccgcctgcgacgtgaagcacctgcgctgggcgcggcgggtaagcgccgacactagcgggcgcctgaacagtccagcggcgtcagcgctgcggagcaggaaagggtcccaaacgcagggcggccatgcagcgtggcgcccacctgtccctctcctcgaagcgctgagccagcacgatgcacataagggaaggaggaaggtggcttgagggcagtgaccgagcggacagcggaagcccatttcaggagccccggtacccgagctcgggcccctttccaatcccccaggcgtccttcccatgtccttgtctcctagtcctgggaatccacggccactccactctcctgcagtaccgcggacaagaacaccatgtactcttcacaggcaggtgtcttctggtggacccaactctgttggtacttgtcgtctccaaaaagtccccaaatgcgctagaggccagccagcccggtatccgagaggtaagagccc

SEQ ID NO: 80710 - DNA, 69 bp, Homo sapiens
  misc_feature 1..69: note = chr17:5001149-5001218
  misc_feature 1..69: note = hyper
  source 1..69: mol_type = genomic DNA
gggcgggctctggggcgtccgcggaggctcccgcgtgcgtgtgcggggtggggtcggggtggcagttgg

SEQ ID NO: 80711 - DNA, 40 bp, Homo sapiens
  misc_feature 1..40: note = chr17:5014692-5014732
  misc_feature 1..40: note = hyper
  source 1..40: mol_type = genomic DNA
aagacaaaggaggcgcgaggaaaaacgcggagctcgcgtc

SEQ ID NO: 80712 - DNA, 40 bp, Homo sapiens
  misc_feature 1..40: note = chr17:50234619-50234659
  misc_feature 1..40: note = hyper
  source 1..40: mol_type = genomic DNA
ggtactctccagtcccgcatcctcccgcagtctcttgaaa

SEQ ID NO: 80713 - DNA, 99 bp, Homo sapiens
  misc_feature 1..99: note = chr17:50235160-50235259
  misc_feature 1..99: note = hyper
  source 1..99: mol_type = genomic DNA
tccaagtgcatcactcgacgggaaaacggggggaaggggggagcccgacacggcacacacacatacacactcgcacacacttccgagcgagtgcacact

SEQ ID NO: 80714 - DNA, 751 bp, Homo sapiens
  misc_feature 1..751: note = chr17:50235728-50236479
  misc_feature 1..751: note = hyper
  source 1..751: mol_type = genomic DNA
cctgcttccggggggcggggaaggagcagacacagcagacacacagagaaagagaggcagggattattgcccgaaaccgccagccgccggcagcctccgccgaccctccctgctccccaggtccgcgcgcagcctgcagcctctcagccgggttccggcagtgcgtccagggcgccgaggggaagggctgggccccggggactggggcgcggtgggggcacacagactctccaggtcgcgcgcgcccttcctgctcctctgctattttcctgaactccccagaacccccagttgcctggcttccatcgcccgcaactagcgccgctgtcgagattttccgcaatacaactgcaggggtcgttatttcctcgcctacggatccctacgcttcccaactcagagaggaggaggacaggtgggggcgggagggggaggaggagaaggaggcttggccaggtgagcgtcctcgccgccgccgggcgtcccagcgtcagctccgcagcccggcacccgggggcggaggcaggaggcccgggcggggaggtgaggctgagcgcggccatgaggaggaggaggaggaggctgggtgtcacagcttcaggccaccttggccgccgcctcggccccagtccctggcagccgcctccgcactccgccccgccctggctgcctctgttaccctccaggattttcgagtttctcttcttaaaaagaacttcgtgctgcgggttcggcgcgggagacccaggca

SEQ ID NO: 80715 - DNA, 60 bp, Homo sapiens; identical to SEQ ID NO: 36657
  misc_feature 1..60: note = chr17:50236690-50236750
  misc_feature 1..60: note = hyper
  source 1..60: mol_type = genomic DNA

SEQ ID NO: 80716 - DNA, 30 bp, Homo sapiens; identical to SEQ ID NO: 36658
  misc_feature 1..30: note = chr17:50237251-50237281
  misc_feature 1..30: note = hyper
  source 1..30: mol_type = genomic DNA

SEQ ID NO: 80717 - DNA, 30 bp, Homo sapiens
  misc_feature 1..30: note = chr17:5039277-5039307
  misc_feature 1..30: note = hypo
  source 1..30: mol_type = genomic DNA
gtggccaggtgatctcggctttcagccaag

SEQ ID NO: 80718 - DNA, 48 bp, Homo sapiens
  misc_feature 1..48: note = chr17:5094851-5094899
  misc_feature 1..48: note = hyper
  source 1..48: mol_type = genomic DNA
gggaatggggcacgccgagaccaagaagccgaccgagagcaagaaggc

SEQ ID NO: 80719 - DNA, 30 bp, Homo sapiens; identical to SEQ ID NO: 45112
  misc_feature 1..30: note = chr17:51321147-51321177
  misc_feature 1..30: note = hypo
  source 1..30: mol_type = genomic DNA

SEQ ID NO: 80720 - DNA, 21 bp, Homo sapiens
  misc_feature 1..21: note = chr17:51787080-51787101
  misc_feature 1..21: note = hypo
  source 1..21: mol_type = genomic DNA
aggcacggtggctcacgcctg

SEQ ID NO: 80721 - DNA, 178 bp, Homo sapiens
  misc_feature 1..178: note = chr17:51900906-51901084
  misc_feature 1..178: note = hypo
  source 1..178: mol_type = genomic DNA
agctagacgcgccctcgatgtcaataccagaaaccccaactacgaaatcatgcacatgatcgaagagtatcgcaggcacctggacagcagcaagatctcagtcctggagcccccgcaagaacatcgcatctgcgtctgcgtgaggaagcggcctctcaaccagcgagagacaacctta

SEQ ID NO: 80722 - DNA, 50 bp, Homo sapiens
  misc_feature 1..50: note = chr17:52978290-52978340
  misc_feature 1..50: note = hyper
  source 1..50: mol_type = genomic DNA
aggcgcggggagagacgcccaggcaggcaggggaccgtgggatcctttcc

SEQ ID NO: 80723 - DNA, 20 bp, Homo sapiens
  misc_feature 1..20: note = chr17:5320631-5320651
  misc_feature 1..20: note = hypo
  source 1..20: mol_type = genomic DNA
aagtaaatagccaggcgtgg

SEQ ID NO: 80724 - DNA, 120 bp, Homo sapiens; identical to SEQ ID NO: 44976
  misc_feature 1..120: note = chr17:5320771-5320891
  misc_feature 1..120: note = hypo
  source 1..120: mol_type = genomic DNA

SEQ ID NO: 80725 - DNA, 270 bp, Homo sapiens
  misc_feature 1..270: note = chr17:53341212-53341482
  misc_feature 1..270: note = hyper
  source 1..270: mol_type = genomic DNA
tcacaaaggcctttacgtcccactgaaaaacggttttctttcatttgtgcccattcgttcttgcagccccttccccagatcgaagactagggtcttagtaaggagaggtaaggagggaggggaagaacctgcctggccccccgcggagctctgcagggggcgtcgcggctgcacgccagcgcccgcaccaccccaggcgggaagggagttatcacacagggggtcgcacgcagatctcggggaccgtgggtgccacgaggtcaaactggc

SEQ ID NO: 80726 - DNA, 846 bp, Homo sapiens
  misc_feature 1..846: note = chr17:53342183-53343029
  misc_feature 1..846: note = hyper
  source 1..846: mol_type = genomic DNA
gtgctgcaaggtccccgaaaatcggcgcgagcggcgacgctaaacacgcggcggcggggcgagcgggccaggcgggcggtgccgcgcgtggccccgcccccgcacgcctatgggcgcgaggtgcgggccctgacgtcactcttgtcagggccgcggcacatgggcggccggatgcgctgagcccggcgctgcggggccgcggagcgctggggagcagcggccgccggcgcggggaggggggtggggtgggacggcgcaccgcctccggtgctggcactaggggctggggtcggcgcggtgtcttctgcccttctgcagccgtcgacatttttttttctttctttttttcaattttgaacattttgcaaaacgaggggttcgaggcaggtgagagcatcctgcacgtcgccggggagcccgcgggcacttggcgcgctctcctgggaccgtctgcactggaaacccgaaagtttttttttaatatatatttttatgcagatgtatttataaagatataagtaatttttttcttcccttttctccaccgccttgagagcgagtacttttggcaaaggacggaggaaaagctcagcaacattttagggggcggttgtttctttcttatttctttttttaaggggaaaaaatttgagtgcatcgcgatggagaaaatgtcccgaccgctccccctgaatcccacctttatcccgcctccctacggcgtgctcaggtccctgctggagaacccgctgaagctcccccttcaccacgaagacggtgagcgctgccgcggccccgctccgggaagggacgacgctccgggggtccccctccgcggccgggcac

SEQ ID NO: 80727 - DNA, 627 bp, Homo sapiens
  misc_feature 1..627: note = chr17:53343030-53343657
  misc_feature 1..627: note = hyper
  source 1..627: mol_type = genomic DNA
cccgctggagcatcccccaaccccgctcccgccctgtcccgcggcgccccggccccgcgctgatgaaattgaggagctcacccagcacccttcctccccttcctcctcctccatgaaaggggagggacccctcctgagctacatttaaaagagcttcgggcacccggcctccctgggtcccgctcctgcggcgcgggtgggaggtgtaacttgacaggtcaggatcgttccctagaacgaggcacacccgcacgcagagcgagcccgcctgcggagggcagagcctcccgggctggggaggagaaaccctggggcctggttctgtgcggggcagggggcgggggtcggcttgagggagggggtttcactgcgtagcctgggttttggggttgtgttacagcttctgttactggttagtatttggaactcacgaggtgtgagagaagactcgttttcttctggtgaagggtagctgagaaagcggggtgggggctggggccggtggggggagtggtctctcggcgggaagccgtgcacgcctccagcgttgacactttcccggtgcactttttctggtgggaggggagagcggagcaggctcacgtgtaaccgcgcaggagcctcctc

SEQ ID NO: 80728 - DNA, 40 bp, Homo sapiens
  misc_feature 1..40: note = chr17:53479136-53479176
  misc_feature 1..40: note = hypo
  source 1..40: mol_type = genomic DNA
gaaaatgttttctgccggccgggcacggtggctcatgcct

SEQ ID NO: 80729 - DNA, 35 bp, Homo sapiens
  misc_feature 1..35: note = chr17:536397-536432
  misc_feature 1..35: note = hypo
  source 1..35: mol_type = genomic DNA
ccccacgatcaatcacgccccgcaatggatcaggc

SEQ ID NO: 80730 - DNA, 87 bp, Homo sapiens
  misc_feature 1..87: note = chr17:53916938-53917025
  misc_feature 1..87: note = hypo
  source 1..87: mol_type = genomic DNA
aactggggtgcaggacgagtgtcctcataagaagtcaaaggtttggtgataaacaacaactggccgggcgcggtggctcacgcctgt

SEQ ID NO: 80731 - DNA, 357 bp, Homo sapiens; identical to SEQ ID NO: 36663
  misc_feature 1..357: note = chr17:53922649-53923006
  misc_feature 1..357: note = hyper
  source 1..357: mol_type = genomic DNA

SEQ ID NO: 80732 - DNA, 28 bp, Homo sapiens
  misc_feature 1..28: note = chr17:54150661-54150689
  misc_feature 1..28: note = hypo
  source 1..28: mol_type = genomic DNA
cttaacatcctaacgttttattatgaaa

SEQ ID NO: 80733 - DNA, 22 bp, Homo sapiens
  misc_feature 1..22: note = chr17:54266818-54266840
  misc_feature 1..22: note = hypo
  source 1..22: mol_type = genomic DNA
ccgcgcccggcctgccctgact

SEQ ID NO: 80734 - DNA, 157 bp, Homo sapiens
  misc_feature 1..157: note = chr17:5436596-5436753
  misc_feature 1..157: note = hypo
  source 1..157: mol_type = genomic DNA
aaaggggccaggcaccgtggctcttgcctgcaatctcagcaattgggaagatcttgctcacgtccaggagtttgagattagcctgagcaacatgggaagccgccctctctacagaaaaaagaaaaatatcagccaggcatggtggtgagcatctgca

SEQ ID NO: 80735 - DNA, 30 bp, Homo sapiens; identical to SEQ ID NO: 16216
  misc_feature 1..30: note = chr17:54473510-54473540
  misc_feature 1..30: note = hypo
  source 1..30: mol_type = genomic DNA

SEQ ID NO: 80736 - DNA, 52 bp, Homo sapiens
  misc_feature 1..52: note = chr17:54588100-54588152
  misc_feature 1..52: note = hypo
  source 1..52: mol_type = genomic DNA
atagcctgaccctcacggggttcacacccaagaaccacgccaagactgtgtc

SEQ ID NO: 80737 - DNA, 124 bp, Homo sapiens
  misc_feature 1..124: note = chr17:54670716-54670840
  misc_feature 1..124: note = hyper
  source 1..124: mol_type = genomic DNA
cctgccaagcgccaccgccgccgccaccgccgctgccgccgccgccgccgccgcctgtgagctccggcgggcagccggactgtcggcttcccggggcatctgggtccggcggggcacagccctg

SEQ ID NO: 80738 - DNA, 1166 bp, Homo sapiens
  misc_feature 1..1166: note = chr17:54671198-54672364
  misc_feature 1..1166: note = hyper
  source 1..1166: mol_type = genomic DNA
ccggacgaagagcagcgagaggaggaggggagagcggctcgtccacgcgccctgcgccgccgccggcccgggaaggcagcgaggagccggcgcctcccgcgccccgcggtcgccctggagtaatttcggatgcccagccgcggccgccttccccagtagacccgggagaggagttgcggccaacttgtgtgcctttcttccgccccggtgggagccggcgctgcgcgaagggctctcccggcggctcatgctgccggccctgcgcctgcccagcctcgggtgagccgcctccggagagacgggggagcgcggcggcgccgcgggctcggcgtgctctcctccggggacgcgggacgaagcagcagccccgggcgcgcgccagaggcatggagcgctgccccagcctaggggtcaccctctacgccctggtggtggtcctggggctgcgggcgacaccggccggcggccagcactatctccacatccgcccggcacccagcgacaacctgcccctggtggacctcatcgaacacccagaccctatctttgaccccaaggaaaaggatctgaacgagacgctgctgcgctcgctgctcgggggccactacgacccaggcttcatggccacctcgccccccgaggaccggcccggcgggggcgggggtgcagctgggggcgcggaggacctggcggagctggaccagctgctgcggcagcggccgtcgggggccatgccgagcgagatcaaagggctagagttctccgagggcttggcccagggcaagaagcagcgcctaagcaagaagctgcggaggaagttacagatgtggctgtggtcgcagacattctgccccgtgctgtacgcgtggaacgacctgggcagccgcttttggccgcgctacgtgaaggtgggcagctgcttcagtaagcgctcgtgctccgtgcccgagggcatggtgtgcaagccgtccaagtccgtgcacctcacggtgctgcggtggcgctgtcagcggcgcgggggccagcgctgcggctggattcccatccagtaccccatcatttccgagtgcaagtgctcgtgctagaactcgggggccccctgcccgcacccggacacttgatcgatccccaccgacgccccctgcaccgcctccaaccagttccac

SEQ ID NO: 80739 - DNA, 183 bp, Homo sapiens
  misc_feature 1..183: note = chr17:54673501-54673684
  misc_feature 1..183: note = hyper
  source 1..183: mol_type = genomic DNA
aaccctttgcatgcccggaagctacggtggtacgaactgaggcaatcccttggaatcaacaaggctcacagcctccgggatcttgcaggtccgagccccgaaatcccaggccctcggccggaggtgctggggatatcagggagatttgacactggcctcccctctccccggggacctaaggaa

SEQ ID NO: 80740 - DNA, 155 bp, Homo sapiens; identical to SEQ ID NO: 36666
  misc_feature 1..155: note = chr17:54673918-54674073
  misc_feature 1..155: note = hyper
  source 1..155: mol_type = genomic DNA

SEQ ID NO: 80741 - DNA, 399 bp, Homo sapiens; identical to SEQ ID NO: 36667
  misc_feature 1..399: note = chr17:54674738-54675137
  misc_feature 1..399: note = hyper
  source 1..399: mol_type = genomic DNA

SEQ ID NO: 80742 - DNA, 171 bp, Homo sapiens; identical to SEQ ID NO: 36668
  misc_feature 1..171: note = chr17:54675138-54675309
  misc_feature 1..171: note = hyper
  source 1..171: mol_type = genomic DNA

SEQ ID NO: 80743 - DNA, 42 bp, Homo sapiens
  misc_feature 1..42: note = chr17:54755949-54755991
  misc_feature 1..42: note = hyper
  source 1..42: mol_type = genomic DNA
taaccccccaggaagcgctccacgtgctgctggtgcgagcgc

SEQ ID NO: 80744 - DNA, 136 bp, Homo sapiens
  misc_feature 1..136: note = chr17:54756259-54756395
  misc_feature 1..136: note = hyper
  source 1..136: mol_type = genomic DNA
ctagctggagcccagcgttggagtcataaagaagagctggcaggagagtgatgtacagccctgggccctcccgagtgactggcgttaacctccaacggagagacgctcaccccgtttacgacggagccctttgttt

SEQ ID NO: 80745 - DNA, 95 bp, Homo sapiens
  misc_feature 1..95: note = chr17:54911779-54911874
  misc_feature 1..95: note = hyper
  source 1..95: mol_type = genomic DNA
gttgcctggcctgaacgcccggcctttcggtggagggcagcttgcccctgtatgttgcgcccttccgtgggtcagaccggcggcaaggtgaggcg

SEQ ID NO: 80746 - DNA, 32 bp, Homo sapiens
  misc_feature 1..32: note = chr17:55037248-55037280
  misc_feature 1..32: note = hypo
  source 1..32: mol_type = genomic DNA
tcatcagaagcatcccgggaaggatgctcgtt

SEQ ID NO: 80747 - DNA, 30 bp, Homo sapiens
  misc_feature 1..30: note = chr17:55139041-55139071
  misc_feature 1..30: note = hypo
  source 1..30: mol_type = genomic DNA
ttgttcattttcatacgattagtaattaaa

SEQ ID NO: 80748 - DNA, 82 bp, Homo sapiens
  misc_feature 1..82: note = chr17:55184753-55184835
  misc_feature 1..82: note = hypo
  source 1..82: mol_type = genomic DNA
acttggttcctcaaccggtgaccttccccagtgagcccttcccaaggaactagcgccaagttgggctcgctgattaacatta

SEQ ID NO: 80749 - DNA, 181 bp, Homo sapiens; identical to SEQ ID NO: 45118
  misc_feature 1..181: note = chr17:55364048-55364229
  misc_feature 1..181: note = hypo
  source 1..181: mol_type = genomic DNA

SEQ ID NO: 80750 - DNA, 30 bp, Homo sapiens
  misc_feature 1..30: note = chr17:55568360-55568390
  misc_feature 1..30: note = hypo
  source 1..30: mol_type = genomic DNA
acctggccagggttccggggtggggaggac

SEQ ID NO: 80751 - DNA, 180 bp, Homo sapiens
  misc_feature 1..180: note = chr17:56024224-56024404
  misc_feature 1..180: note = hyper
  source 1..180: mol_type = genomic DNA
tccccaactccatctcggacgcatcttcttcctctctctgctcaacacaggagttccctgttcacacaccttgccattggctgacacagccaatggtgaaactcccccagctgaccctccctggagctcactagctctctcccagctgtgggtacagcctgaaaccgaaactaatctcag

SEQ ID NO: 80752 - DNA, 79 bp, Homo sapiens
  misc_feature 1..79: note = chr17:56031530-56031609
  misc_feature 1..79: note = hypo
  source 1..79: mol_type = genomic DNA
gtggctcaggtgctgcgggatcacccagggaaggctcattcctctcgctacaagacgctgactgcggatcaggtgggga

SEQ ID NO: 80753 - DNA, 20 bp, Homo sapiens
  misc_feature 1..20: note = chr17:56092600-56092620
  misc_feature 1..20: note = hypo
  source 1..20: mol_type = genomic DNA
taagagctgaaatcacgaga

SEQ ID NO: 80754 - DNA, 569 bp, Homo sapiens; identical to SEQ ID NO: 36671
  misc_feature 1..569: note = chr17:56234271-56234840
  misc_feature 1..569: note = hyper
  source 1..569: mol_type = genomic DNA

SEQ ID NO: 80755 - DNA, 186 bp, Homo sapiens
  misc_feature 1..186: note = chr17:56326821-56327007
  misc_feature 1..186: note = hyper
  source 1..186: mol_type = genomic DNA
gcgtcccctccgcctcgagcagaggctccttcccccatggggtcctgggctttggagccccggagccggcctgccgaagctcagcgaggatcgtgctggtttcaggaggaagcctgcgctgggcgccgccaacagggctctggcgcgctggctgcccgcggagtacgaggacgggctctccctgcc

SEQ ID NO: 80756 - DNA, 79 bp, Homo sapiens
  misc_feature 1..79: note = chr17:56327222-56327301
  misc_feature 1..79: note = hyper
  source 1..79: mol_type = genomic DNA
cccggagcccggccacgtggcggtcacgttctggccgccgcaggccagataccctggggtctcccgggcagatggcctc

SEQ ID NO: 80757 - DNA, 30 bp, Homo sapiens
  misc_feature 1..30: note = chr17:56435300-56435330
  misc_feature 1..30: note = hypo
  source 1..30: mol_type = genomic DNA
gttagagagccgccccgaaggggctgctga

SEQ ID NO: 80758 - DNA, 30 bp, Homo sapiens
  misc_feature 1..30: note = chr17:56680534-56680564
  misc_feature 1..30: note = hypo
  source 1..30: mol_type = genomic DNA
tacacatgggctccccgctggcaggggagc

SEQ ID NO: 80759 - DNA, 30 bp, Homo sapiens
  misc_feature 1..30: note = chr17:56742978-56743008
  misc_feature 1..30: note = hypo
  source 1..30: mol_type = genomic DNA
acccacaactcattgcgtttacctcactaa

SEQ ID NO: 80760 - DNA, 30 bp, Homo sapiens
  misc_feature 1..30: note = chr17:56781879-56781909
  misc_feature 1..30: note = hypo
  source 1..30: mol_type = genomic DNA
agtaagaatcctgttcggtcagtttagcaa

SEQ ID NO: 80761 - DNA, 1055 bp, Homo sapiens
  misc_feature 1..1055: note = chr17:56832946-56834001
  misc_feature 1..1055: note = hyper
  source 1..1055: mol_type = genomic DNA
ttcagagttggagagcgggcgagtggagtgtcctttagactccgcggactcgacgggagggaccctgcaatgcttaattagaaccggttgccatggcgacagtctctaggcagcgtgggctgagctctccgtaggaataaagggtgggccgccgctggaccctgcgcgcgcccgccaccaactttccctccagatccgagaggggcggcgcgctccgcccccgggccgcgcacgtcggtgctcggcggcgcgcacgcctgcgggagccctctccaggcaacctagtgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagctattcctgggcgagtttcgcggaccgtgcggcggcggcgagccggagccggaacccgaacccgaacccgaacccgaacccgagtccgagcccgagcccgaacctgaactggtagaagctgaggcggccgaggcttcggtagaggaacccggggaggaggcggccacggtagccgcgacggaggagggggaccaggagcaagacccggagcccgaggaggaggcggcggttgagggtgaggaggaggaggagggcgcggcgacggcggcggcagccccggggcactcggccgtgccgccgccgccgccccagctgccgcctttgcccccgctcccgcgaccgctgtcagagcgcatcacccgcgaggaggtggagggcgaaagcctggacctgtgcctgcagcagctctacaaatagttaagtagctgggcttggctggtggtgggcccgcggtccccaccgcgccggcctcggacgcggctccctcggcccctcaaactgctctcttttctgctcctctcccccgcacccgcgcctgccgccgctgaaagcgcccccgctgctcggacccgggcggtcggctgagagctgccca

SEQ ID NO: 80762 - DNA, 362 bp, Homo sapiens
  misc_feature 1..362: note = chr17:56834019-56834381
  misc_feature 1..362: note = hyper
  source 1..362: mol_type = genomic DNA
cgcccgcctcggcccccacgcctcctacccggccttgaagccgctctcctgagccccggcgccctcccgccgggcccgggcccctcatcccctttcacctcggcccccagcttctagctccacttcacgcaacctttccctttcctgcctggaaaggtccttcctcccaggcttgagctccctcttcttcccagatcccttctttctccgggaggtttcctcccaccccagtctgtcttttcccgggctgagtgccttgttgtttggcggcagagacgcgactcctttctagactgagctgcgaggtgcctcctgcgtaactgcaacaatgatggttataccggccccgtatccagatgaga

SEQ ID NO: 80763 - DNA, 102 bp, Homo sapiens; identical to SEQ ID NO: 45120
  misc_feature 1..102: note = chr17:57297027-57297129
  misc_feature 1..102: note = hypo
  source 1..102: mol_type = genomic DNA

SEQ ID NO: 80764 - DNA, 97 bp, Homo sapiens
  misc_feature 1..97: note = chr17:57299480-57299577
  misc_feature 1..97: note = hypo
  source 1..97: mol_type = genomic DNA
attggaaccagggaccgacttttagtattcaagttgctgtcacagaagcaattttcttttttctttttgtgtttttgtttgtttgtttttttgtttg

SEQ ID NO: 80765 - DNA, 22 bp, Homo sapiens
  misc_feature 1..22: note = chr17:57787544-57787566
  misc_feature 1..22: note = hypo
  source 1..22: mol_type = genomic DNA
cagactccgtctcaaaaaaaaa

SEQ ID NO: 80766 - DNA, 30 bp, Homo sapiens
  misc_feature 1..30: note = chr17:57866235-57866265
  misc_feature 1..30: note = hypo
  source 1..30: mol_type = genomic DNA
tgtttgcagatatggcggtggaaaaagcac

SEQ ID NO: 80767 - DNA, 26 bp, Homo sapiens
  misc_feature 1..26: note = chr17:57879973-57879999
  misc_feature 1..26: note = hypo
  source 1..26: mol_type = genomic DNA
tgtagtgcagtggcacgatctctgct

SEQ ID NO: 80768 - DNA, 30 bp, Homo sapiens; identical to SEQ ID NO: 45121
  misc_feature 1..30: note = chr17:57881555-57881585
  misc_feature 1..30: note = hypo
  source 1..30: mol_type = genomic DNA

SEQ ID NO: 80769 - DNA, 47 bp, Homo sapiens
  misc_feature 1..47: note = chr17:58212262-58212309
  misc_feature 1..47: note = hyper
  source 1..47: mol_type = genomic DNA
cacccaagccagcaccgtggctggaaagcttacgtataggataaggg

SEQ ID NO: 80770 - DNA, 735 bp, Homo sapiens
  misc_feature 1..735: note = chr17:58212587-58213322
  misc_feature 1..735: note = hyper
  source 1..735: mol_type = genomic DNA
tctctaagcacagggcggtggcgaaagggaagggctgcagggtggagtccggcaccaagacctcccggcccggcttctagcagcacacggacgcttgagatgatttcttctgaaaacgggcagtggttgaaaaccactgcttcaaaacacagactggaggagtggtaaatactaacgaggagttttagcaatggactctgttaacagagtctggtcgcctgagaagggcctcggaggactggccaggttggagaacgatttcaactgcgtactggacgacacacagaagactgcggggagccttagcccctacccggcctgcagtgctctctggggcacacggcagccccacgacgcctttgggtttcttcgagcgctactcgcacgcaccagcgcccacacagctgcaacgccaaacgcccgccagcaccttagggccgcgggagtcccttccccaggcccgccccacacgccggccttttctgccgcttcccaagccggagccaatcagcgctcagcagcgaccggcagggacgaccaatcgacttatcctgcgttgtgctaaagacctagaaatcgagcgtggtacattcgatcgacggaacgtctgggccctagtgctaagttgggtgactgttcggtggttgtctcggggggttgcaggaagatcctgtttccttggcgtagaaggagaggttgaccccgaagagttaagattctcgaagcacactattt

SEQ ID NO: 80771 - DNA, 40 bp, Homo sapiens
  misc_feature 1..40: note = chr17:58216263-58216303
  misc_feature 1..40: note = hyper
  source 1..40: mol_type = genomic DNA
actcaggagatggggcgttgtgtataggcaagtcgctaac

SEQ ID NO: 80772 - DNA, 272 bp, Homo sapiens; identical to SEQ ID NO: 36678
  misc_feature 1..272: note = chr17:58216565-58216837
  misc_feature 1..272: note = hyper
  source 1..272: mol_type = genomic DNA

SEQ ID NO: 80773 - DNA, 434 bp, Homo sapiens; identical to SEQ ID NO: 36679
  misc_feature 1..434: note = chr17:58216865-58217299
  misc_feature 1..434: note = hyper
  source 1..434: mol_type = genomic DNA

SEQ ID NO: 80774 - DNA, 268 bp, Homo sapiens; identical to SEQ ID NO: 36680
  misc_feature 1..268: note = chr17:58217356-58217624
  misc_feature 1..268: note = hyper
  source 1..268: mol_type = genomic DNA

SEQ ID NO: 80775 - DNA, 446 bp, Homo sapiens
  misc_feature 1..446: note = chr17:58218611-58219057
  misc_feature 1..446: note = hyper
  source 1..446: mol_type = genomic DNA
tgagtgtgcagccagcgcccaattcagacggcgccccaggccaaggctggcccgcttagggaccgcgctcgggctggacgtcgcgctcagcgcgcagggcccccatggacgtcgcgccgctgacctagctgtcagacatcgccacgaggagttggcaggctcgggaggccgaaacgctgtgctcacctcgagcactgccaggctgctggagaggctttccggggcacagaagctgcagcggcgcggggcggtgggctgtgagcgagcatatgtaggggagcgtttcccgcgagaaagcagaacctgcgccagccgagggccctagggctgctggtaggaggactgttctctatcgtccagctgctcccgacctcttctctgaactggccctgctctggggaacagcgccctgcttctttgtgcgacgatcacgcttgactcattgg

SEQ ID NO: 80776 - DNA, 294 bp, Homo sapiens; identical to SEQ ID NO: 12837
  misc_feature 1..294: note = chr17:58227104-58227398
  misc_feature 1..294: note = hyper
  source 1..294: mol_type = genomic DNA

SEQ ID NO: 80777 - DNA, 325 bp, Homo sapiens
  misc_feature 1..325: note = chr17:58228072-58228397
  misc_feature 1..325: note = hyper
  source 1..325: mol_type = genomic DNA
caacgcacgccttcttttctcacccagcctcctccgtctgcccgtgggtttccgtccgtcccgctgggactcagcgctgggtgactgccccgcggccagagcaagggcggtctggcagggtcctggaagccgcgcttcccacacgggttccttgcccctgagggtcgcaagctcccctggcctccctaacctccagcgctgaattgggagcctggcgggggcggggggtgggggacccggagccccaaggcctctgcggagccggtctttccggacagggtgattttcgtttaaagattaatggtgaagccgagctcttaattat

SEQ ID NO: 80778 - DNA, 88 bp, Homo sapiens
  misc_feature 1..88: note = chr17:58471337-58471425
  misc_feature 1..88: note = hypo
  source 1..88: mol_type = genomic DNA
ccccaccaatatttcgtgtttttctactcacctttcctggcaaaccagatcagcagcgtggcattagtcacagcgctgccctttccag

SEQ ID NO: 80779 - DNA, 230 bp, Homo sapiens
  misc_feature 1..230: note = chr17:58498747-58498977
  misc_feature 1..230: note = hyper
  source 1..230: mol_type = genomic DNA
cccctctcctgtgcccgaggtggccgctgggtggcaggggaggcccgggccgacggcggtcccaccgcactgtcgcgaaggcaggcgaagaacagggccacactgagtggggacaactgggcccgggcccagaggacacgaaggaaggtccgggagaaggaattcctagtttcagggaagaaaaggtggctcgagtgaggaaactgcgggggcaacggtctctcgtcgcc

SEQ ID NO: 80780 - DNA, 367 bp, Homo sapiens; identical to SEQ ID NO: 36685
  misc_feature 1..367: note = chr17:58498978-58499345
  misc_feature 1..367: note = hyper
  source 1..367: mol_type = genomic DNA

SEQ ID NO: 80781 - DNA, 30 bp, Homo sapiens
  misc_feature 1..30: note = chr17:58896180-58896210
  misc_feature 1..30: note = hypo
  source 1..30: mol_type = genomic DNA
acatcttaggtataccgtttatgctgacag

SEQ ID NO: 80782 - DNA, 30 bp, Homo sapiens
  misc_feature 1..30: note = chr17:59277972-59278002
  misc_feature 1..30: note = hypo
  source 1..30: mol_type = genomic DNA
ttttgattatcaatgcgggtggtagtgagg

SEQ ID NO: 80783 - DNA, 30 bp, Homo sapiens
  misc_feature 1..30: note = chr17:59380675-59380705
  misc_feature 1..30: note = hypo
  source 1..30: mol_type = genomic DNA
atgtaaacaagcacccgtgtttggggatac

SEQ ID NO: 80784 - DNA, 128 bp, Homo sapiens
  misc_feature 1..128: note = chr17:59467426-59467554
  misc_feature 1..128: note = hyper
  source 1..128: mol_type = genomic DNA
ttttcttgcgcctgccggtgctcttctcccgcccgcctggccctgctgtcagcgccccctagtgccgggccggccgcgcatgagggcggtgggacagatcgcccacaactcctcggcttgcttttggg

SEQ ID NO: 80785 - DNA, 341 bp, Homo sapiens
  misc_feature 1..341: note = chr17:59473906-59474247
  misc_feature 1..341: note = hyper
  source 1..341: mol_type = genomic DNA
cgcgggggagcccggtccggccgctaaaccgggctggctggcgccagggctccgggaggtgcggtccggcggggaagccgtgatgggaagcgactctgtccagggagtgtccttcaccaccacactcctcacgtccaggcagtgatcgacggcctggcggcaccctcacagcgggcccatagcacggggccacacacgtcccctgagcttagcctgggcacattcgtctgccaccgagggcttaagccagtctgcagcccgcgccccgtcactcggacgcaagtccgtcgtccgctctgccacgcggccgcacagcccgagcttcctgctgcccactgccc

SEQ ID NO: 80786 - DNA, 403 bp, Homo sapiens; identical to SEQ ID NO: 4476
  misc_feature 1..403: note = chr17:59474741-59475144
  misc_feature 1..403: note = hyper
  source 1..403: mol_type = genomic DNA

SEQ ID NO: 80787 - DNA, 3321 bp, Homo sapiens
  misc_feature 1..3321: note = chr17:59475357-59478678
  misc_feature 1..3321: note = hyper
  source 1..3321: mol_type = genomic DNA
atctggtcacctcaccggctgcgcaaacgtgtccacaacgggtccctccccgagaggccacatctcgcctaaggtggagccagcaggtatttgcctgtggaaaactgcagtggatcctgccccgtctgcgtagactgcgcagctcggagtcaaagattcgttctggccagagaggaggtactaagagaggtgcgacctagccaagaacgaggtcgtggagaaaaccctgtgggggcggcgctcacatatgcggtgatgaggagttgtgagggccctggggtcggccccgaaaagtagggataacggtcgcagaggccatactgcttccgccggtcccgaatccgcactgccaggagagatccggccttcaaacgctgctcccaacgttcaacaacgaagtgccctgcgaccggtgtgcgcagtgggcgggcgcctgcatgggtcaatgttggatgtacgcgcccaccacgcggttgtacgggtgggaatgtcacccgtggctagtgcatgctctgtcttttccttcagaaaacgaccttcaggaatcagcctgagtgttcgcgcccgagcccgattggaagcaggtgcgtggtcgcttcactctccccgtgcacaccttgagttatagctctcgctgcgcacagagggcaccacacggggcccgacacacacacacacacacacacacacacacacacacacacacacaccatcacttcatgggggggaaactgaggctgccggaagacagaaaacgaagactgatcacagaagagggggcttcaatcacaggtgctcgcagacaccccaactccctcacgcgttactcagcactccttaacttaggagacgtgcgcttccgagagatgagaagaaactaaaaaagtggttggcagggcgaagagaggaagccggtatttcggaagaaggagactttcgtctccggtaccggatagggcgaaaattcgttgggtcgcgggtggagaatccggggtccgcccgcgcggtgccgccctgtgctcagcgaaaggtgcgctcaccttcctggccccgaggatccgctcctcccggccgctggaaagctcagggcggggcccgggcctgcggagaactccaggttccttccgagtcttccggtgaaggcgggcgcgggtagggggtccccgcgtttccccagcgcaaggccgcgtcccgctcccgcccgcgccggccccagcagggctcggccatggctccactcaccagctcccgccacctgggatccgctcccggacctcggccgcccgagcctcccgactcgcccgcccaccggcctcgctttccagtgcctgctgtctctttccggggcgcagggacccccaggcggcgccacgacccggagctgggtcggaggccaggctggggctcgggccagagcggccgggcctctgggcgcgggagaaggagggcgccccctctccgctcggggtcgtgtcaatgctttgcacttggggccggcgtgcggctgcgggtccttccccaaggccccgggacccgggctcccctcgcctcaggccctttcggcgggtcaggtcggccctccgcgctctccagtccggcgcaggcagccgcaggcgcgggcgggcggtgggggccggggcaggaggaggggtctcggggcccggcggcccgtcattggttaatattttattctgttgacatgttttcttactgctgaggcttccgacaccttctcccaggccccccctcccggccggagcttggcctgagctgtcaaaaccccgcccccggagacccacaattggtccaaaaagcgtaaaatcagcaatcaaggggggcctggctcgttagcgcaggggatccgagctgggcaggacatgtgagatagtcacagttttccagagatcacgacaagatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggtagggctgccggccggctggaaggcgcgcgggcgggcgggcgggctggggcacgggactgcacggatcagagcagagctggggactcccggctcccggctcccggctccaggttctggccctgacgccacgcttcgctcccacggacaaccaagttgacttttctcgtttggcaccggagcgatttttttttaaaacaaaaacgctaaaatcctccgaatgaaataaaacgaaaacatactgctaaagaatagccccaaccgttctgagtcccagcgcagaggaggccccgcggcttggccctggcggtctcctccgccccgcgctctcgctcttctgcgtccgggtccgtctccgagctcgggggaaattcagcctctctcagactctgctccgaccccgaagcccctagtgggacctgggcccagctaaccccacgctggttgctcggttcctggcagcgagccccgggtcagccgagccctccgcctcaccgggctgggagccctttctccaccgcgggcatccgagccctggacgcatccgccgccccaggccttaaagcctgaagaaagccacagccccggcccctccacccttcgactcagccaccgagaatccaggcctcgggttcaccctcttcccccgaactgcacggccaggatgtcttatcaggctctgtagcccagttcccaatacaaacaccctccagatttatttctgggagcttccgtcccaagtgggta

SEQ ID NO: 80788 - DNA, 32 bp, Homo sapiens
  misc_feature 1..32: note = chr17:59483112-59483144
  misc_feature 1..32: note = hyper
  source 1..32: mol_type = genomic DNA
aggcgggctgggtcccgcggccagcgcagcaa

SEQ ID NO: 80789 - DNA, 324 bp, Homo sapiens
  misc_feature 1..324: note = chr17:59488100-59488424
  misc_feature 1..324: note = hyper
  source 1..324: mol_type = genomic DNA
cctgcctcagacctgcgggcaggtccgggaacccgacagggacagagaagcccgttttccagcctaaatagaagctcgtgggcagcgcgtttgctggaggtcgctttgggctgaaacgcctctcatactcctagaggagcggcgcgtttgcgtcccgcggcttctcactttcagcaggacattaggagggagacgagagtcggctgcgcgcccgcggcggcctacgtacagggctgcggacaccagggggcagcaccgacttagggtcgcgggaggggtgcgggtgcgggcatgggcgcgggggaggcgggtgcctgcgaaggc

SEQ ID NO: 80790 - DNA, 478 bp, Homo sapiens
  misc_feature 1..478: note = chr17:59488634-59489112
  misc_feature 1..478: note = hyper
  source 1..478: mol_type = genomic DNA
cggctgggccttgtcccagacaaaggctaggccactcccatgtccaattaagccaccctcctccccggcctcccagccctcattgtccccggggtcgccaattagcctaggcgcccggcgtacccgccgctccggtgccgcaaggcctccttaacccttcagggcctggcccggggtccttggacggcagagccgccggcacacgcgtggcaggagggccagtgctgggacgatggcgatacctgctggcggcctagcctgtcgcctcgggctctcgcgtgtggggcgtgtgaggtctaagagggaattgtgcgtgtcggtgtggggtggcgcgtgcgattcccggaggaactcggagatggagggtgtgagtgcaggggctccgagagacccctagcggctaagccgcccggatcccaaggcccaggggacctcatttcctctcgggttaatcggaatcttccgagccctcaagccc

SEQ ID NO: 80791 - DNA, 172 bp, Homo sapiens
  misc_feature 1..172: note = chr17:59490094-59490266
  misc_feature 1..172: note = hyper
  source 1..172: mol_type = genomic DNA
ggagggcttgaggctcggggtggggccttctcccctgctgccagaaccgcccggcagcgccagctcggcgaccttccaggctgctgcagaccccagcttgtcctcttctgcgcgcccgcggggctgggccctcgcgttctctctgcgggaagtgagccgccggcctccggcc

SEQ ID NO: 80792 - DNA, 275 bp, Homo sapiens; identical to SEQ ID NO: 1315
  misc_feature 1..275: note = chr17:59528876-59529151
  misc_feature 1..275: note = hyper
  source 1..275: mol_type = genomic DNA

SEQ ID NO: 80793 - DNA, 12 bp, Homo sapiens
  misc_feature 1..12: note = chr17:59529253-59529265
  misc_feature 1..12: note = hyper
  source 1..12: mol_type = genomic DNA
cgacctcgggac

SEQ ID NO: 80794 - DNA, 509 bp, Homo sapiens; identical to SEQ ID NO: 36697
  misc_feature 1..509: note = chr17:59529843-59530352
  misc_feature 1..509: note = hyper
  source 1..509: mol_type = genomic DNA

SEQ ID NO: 80795 - DNA, 351 bp, Homo sapiens; identical to SEQ ID NO: 36698
  misc_feature 1..351: note = chr17:59531667-59532018
  misc_feature 1..351: note = hyper
  source 1..351: mol_type = genomic DNA

SEQ ID NO: 80796 - DNA, 89 bp, Homo sapiens
  misc_feature 1..89: note = chr17:59532269-59532358
  misc_feature 1..89: note = hyper
  source 1..89: mol_type = genomic DNA
cgatcccgccggggccctagatatagttggacccagcgcgctggccggagcgggcagctaccctactggcgcagcggccctgtgtgggg

SEQ ID NO: 80797 - skipped

SEQ ID NO: 80798 - DNA, 532 bp, Homo sapiens
  misc_feature 1..532: note = chr17:59533874-59534406
  misc_feature 1..532: note = hyper
  source 1..532: mol_type = genomic DNA
cgagagcgaggaggccttccgggccccgggcccagcgctcggagaggccagcgcagccaacgcccccgagcccgcgctggcagcgccgggcctcagcggagccgcgctaggcagccccccgggacccggggccgacgtcgtcgccgccgccgccgcggagcaggtagggctgcgccagccgtcgggtagaagtcgggcgtcggtctgtctgcggggccgcctgtgtccgtctttccgtccgattgtcggcaggactcgctttcaggaggacctggctgcattcaggacggtctgcccgttcgttctccactggacatggctcgctttctctgccttttgggtccttctccactttgagccctcggggctactctgggacaagcaagagctagagctagagatagaggagagggcggtaagagagagggagacccccgtagcatctgagcgagcctggaccaagtgtccagctccaacaacccgtagagggcctgggacccaacggcgagggggcaggaggaggccaccccgc

SEQ ID NO: 80799 - DNA, 711 bp, Homo sapiens
  misc_feature 1..711: note = chr17:59534556-59535267
  misc_feature 1..711: note = hyper
  source 1..711: mol_type = genomic DNA
cgcctctccctgtctgtgtctgccccgggagcctgtggcgatggcccgccacagaaatgttcatgagtgagcaggagtgtcgtctaacctgcgctggccactatgtgtgtcctctgagggttcctccgtaggtgcagctttaaaggaggaagttttagccaccgattaattcttttatattcacgaatagttcaaaatcgttctgtgaaacgaaatctggagccatgggctccgggcgggcagggttccgcacagctcttcgggtctggttcttctttcctcaggctccgcgtggagccctgggcctggcagacacaagtttctctccctcccatccccagaccatcgagaacatcaaggtggggctgcatgagaaggagctctggaagaagttccacgaggcgggcaccgagatgatcatcactaaggctggcaggtcagcgctgggagatttacttccggggatggcggtggggagcaaggggggccagggaggtcccttagaagtcctctcggccccggcctggtggcctgtgggaggcctctctgcctcctcgggcgtcagtgccacctcccttcgcagcttgggactgggccgccaaagcccgcagggggccaccgcagccgcgcgggccttgcgggaaagaccgaggggaggggcagcgctatgcaaatgaatccaaacagggatcgcgacgctcaaaagtccca

SEQ ID NO: 80800 - DNA, 37 bp, Homo sapiens
  misc_feature 1..37: note = chr17:59535526-59535563
  misc_feature 1..37: note = hyper
  source 1..37: mol_type = genomic DNA
gtgttgttgggggagcggctctcggtggctgccagaa

SEQ ID NO: 80801 - DNA, 728 bp, Homo sapiens
  misc_feature 1..728: note = chr17:59539215-59539943
  misc_feature 1..728: note = hyper
  source 1..728: mol_type = genomic DNA
gtccccagggacctccgagaaagtcggggctgcagcggggttggggcttgggggaccctccaggtggagagaatctaggggtatcccctagtctctgtccctttccccaggaaaggggctgagagtaagcgccttgaatttggccaccgctttggccggggagctcccgcggctctcgcagcgcagctagaacttgcgtgttccctcagcagtgagttcgcagttacgggtttgttgccagaattaaaaaagccccaaacccttgccccgcgccccgcgcgcctccaacaccgagaaacgtccgaggaagcttatcttagcagttcattctaaagccatttccgagtatgaatagataaaggctccagctccgcaccctttcagagcctgtttcatgatcagaggagaagccccgggctttcatctcctcccgggccggcgagcaggcggcttgtttattcccctggcggagccgtttccgcgtgtgccgtggggagggcgggggagcccccatctgtctgggggcgcgggagcccgacggcgcgaggggaactgggggagcatggagagggcgcttggggcgcggagagaaggtgcggggcacgtggaaagcgtgccgaggggctgggaagagggagggacaggaggacggggtgggagcagggagagggtagggggcatagggagagggtgcagggaggggagagggggagcgcgcaaggaggggg

SEQ ID NO: 80802 - DNA, 971 bp, Homo sapiens
  misc_feature 1..971: note = chr17:5973275-5974246
  misc_feature 1..971: note = hyper
  source 1..971: mol_type = genomic DNA
tgggaagcagtgattcgggatgtgtgtgtcaggcagtgtgcggctgtcgctgtgagtctgcatgggagagtggcggcgtgctctcctctgcgcggcagtgccccgtgtgtttgtgggtctgtgtctgggtgtgagcgtcatggtgcgtgtgttagagcccgtggggccccggtgaaaggctgtggctctgggtgactggtgtgtgtgtgtgtgtgtgtgtgtatcagagtgggtggcggcgtctctgctcggcagtggcgcgtgtggcccgccccgcgcgcgtgttctcgcgggccggggcagggcgtgggccccctccggcggagccgcgacccctcccccgggcggcgggaggtgcgcaccggcgcctctaggacccggcggcggccggccgctgtccccgggccgcgcgagtgagcatgtgcagagcccggcgcccgctcgcccgcccgctgcccgccccggctccgcgcccgcccgcccgccccgccgttcagcccggacgccagcagccccggggagccaggcggcggcgccctgtgcccgggcgcgtgggtccgcttgccgcgggcggccggagacgtgcgggcgccggggcttctgggctccgggcactgcggggggctgcgggctcggcgcccggggaaggcgggccatgggcgcgggtgcgggcgccccagccggccgcgatcgcggggtgagtcctgtctctcggcgctccagccggacccccgcgcgggctgcgagcagggtgttccccttgccgcgggcaaacaagtttgtgcagacgcggttgggagcgcggcggggctgcacctgctccggctgcagggcgggcttgccgggggcaccttcccgggggcccggggcggctcggccggggcaggggagagtgagcgggtgcgtgcaggggttgtgggggggcgggggcggcgctcggcgcggccgggatggggtgggggtgcgcgagg

SEQ ID NO: 80803 - DNA, 28 bp, Homo sapiens
  misc_feature 1..28: note = chr17:5974297-5974325
  misc_feature 1..28: note = hyper
  source 1..28: mol_type = genomic DNA
cgggagggcgctgcggttggtcccgggg

SEQ ID NO: 80804 - DNA, 30 bp, Homo sapiens
  misc_feature 1..30: note = chr17:60214776-60214806
  misc_feature 1..30: note = hypo
  source 1..30: mol_type = genomic DNA
gatacggctggatgacggggacgcccaggg

SEQ ID NO: 80805 - DNA, 158 bp, Homo sapiens
  misc_feature 1..158: note = chr17:60216617-60216775
  misc_feature 1..158: note = hypo
  source 1..158: mol_type = genomic DNA
gggtacagtgagaaccggccctcgtacacctggcgctctaggcggttcttggtctcccgtagctcccggcacagtgctttctcccattggtcccgcagggtcttcagggtcttccgcgcgtgcgtgacctccttgcttggcaacgtgggcttctccac

SEQ ID NO: 80806 - DNA, 41 bp, Homo sapiens; identical to SEQ ID NO: 45124
  misc_feature 1..41: note = chr17:60221577-60221618
  misc_feature 1..41: note = hypo
  source 1..41: mol_type = genomic DNA

SEQ ID NO: 80807 - DNA, 195 bp, Homo sapiens
  misc_feature 1..195: note = chr17:6023680-6023875
  misc_feature 1..195: note = hypo
  source 1..195: mol_type = genomic DNA
ggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagccctt

SEQ ID NO: 80808 - DNA, 30 bp, Homo sapiens; identical to SEQ ID NO: 45125
  misc_feature 1..30: note = chr17:60242060-60242090
  misc_feature 1..30: note = hypo
  source 1..30: mol_type = genomic DNA

SEQ ID NO: 80809 - DNA, 21 bp, Homo sapiens
  misc_feature 1..21: note = chr17:60499390-60499411
  misc_feature 1..21: note = hypo
  source 1..21: mol_type = genomic DNA
agactccgtctcaaaaataaa

SEQ ID NO: 80810 - DNA, 32 bp, Homo sapiens
  misc_feature 1..32: note = chr17:60669597-60669629
  misc_feature 1..32: note = hypo
  source 1..32: mol_type = genomic DNA
gcacgagccactgcgcccggccagaactacat

SEQ ID NO: 80811 - DNA, 42 bp, Homo sapiens
  misc_feature 1..42: note = chr17:60670437-60670479
  misc_feature 1..42: note = hypo
  source 1..42: mol_type = genomic DNA
ctgtgtggcccagttcctaacaaggcacggacctgtactggg

SEQ ID NO: 80812 - DNA, 70 bp, Homo sapiens
  misc_feature 1..70: note = chr17:60704531-60704601
  misc_feature 1..70: note = hyper
  source 1..70: mol_type = genomic DNA
gctgctggagacgcccgcagaaagaggcgggatggcggggcggatgctggcggcccgggtctggccacct

SEQ ID NO: 80813 - DNA, 30 bp, Homo sapiens
  misc_feature 1..30: note = chr17:60705143-60705173
  misc_feature 1..30: note = hyper
  source 1..30: mol_type = genomic DNA
actgagcgccgcgctcggggatggggcccg

SEQ ID NO: 80814 - DNA, 387 bp, Homo sapiens
  misc_feature 1..387: note = chr17:60705569-60705956
  misc_feature 1..387: note = hyper
  source 1..387: mol_type = genomic DNA
gctcttgaggacccccgcgcaccgcgctcccggaccacccggcgccggcccgtcctcggcaggggacctgcagggcgcgcccggggagccagggctctctgtccgggagttcccgggcccagtctcctcgctctgccccaggactgatgcgttaggacggctttccaactatccgcgagggttcgtttcccccaccttccccccgccccctgcatctcgtgggcgttgatattttcttttccacacttagtcttcaaggaggcttgtggcgcgcggcatccgccccgcgtgagctcggcagccctgtgaggaggctcctgccactgggacgcagcaacaggctgggcgccgccgtgctgtgatgttgcgtagcgtgggcagctctgg

SEQ ID NO: 80815 - DNA, 30 bp, Homo sapiens
  misc_feature 1..30: note = chr17:6070721-6070751
  misc_feature 1..30: note = hypo
  source 1..30: mol_type = genomic DNA
tgccgttcccagcctcgttaacctccctaa

SEQ ID NO: 80816 - DNA, 30 bp, Homo sapiens
  misc_feature 1..30: note = chr17:60739876-60739906
  misc_feature 1..30: note = hypo
  source 1..30: mol_type = genomic DNA
attatctcatttcatcgttaccagagtctt

SEQ ID NO: 80817 - DNA, 84 bp, Homo sapiens
  misc_feature 1..84: note = chr17:60743917-60744001
  misc_feature 1..84: note = hypo
  source 1..84: mol_type = genomic DNA
gcgagcagcagggtgcggatctgctgagcatcacggagatccacgagcagacctacatcaacggtgagccggggcctgatgcct

SEQ ID NO: 80818 - DNA, 156 bp, Homo sapiens
  misc_feature 1..156: note = chr17:60744464-60744620
  misc_feature 1..156: note = hypo
  source 1..156: mol_type = genomic DNA
cacccctgtgggcagcgggcaccagcgcacccagcagcctggacggggaggccggggcggggctggtactggttactgggtagaaggttcaaggcgacgtgcacccaggttagaaagcgcggaggaccccgtggtctggggcggagctggagctga

SEQ ID NO: 80819 - DNA, 42 bp, Homo sapiens
  misc_feature 1..42: note = chr17:60747365-60747407
  misc_feature 1..42: note = hypo
  source 1..42: mol_type = genomic DNA
ctgaaggaaggggcccgctgggaggcccgggtgtgggcatgc

SEQ ID NO: 80820 - DNA, 30 bp, Homo sapiens
  misc_feature 1..30: note = chr17:60754622-60754652
  misc_feature 1..30: note = hypo
  source 1..30: mol_type = genomic DNA
ccttcagggtacagccgtgggggctgcgtg

SEQ ID NO: 80821 - DNA, 167 bp, Homo sapiens
  misc_feature 1..167: note = chr17:60765906-60766073
  misc_feature 1..167: note = hypo
  source 1..167: mol_type = genomic DNA
ttggcctccatgcctcgcagagggacttccagtgggtggagcaggagcctttgatgtatgccaactgggcacctggggagccctctggccctagccctgctcccagtggcaacaaaccggtgaggatgccctccctgttcccctccgcaccgcgctgccctaagcct

SEQ ID NO: 80822 - DNA, 173 bp, Homo sapiens
  misc_feature 1..173: note = chr17:60766934-60767107
  misc_feature 1..173: note = hypo
  source 1..173: mol_type = genomic DNA
gctctcctacctcaacggcaccttccggctgcttcagaagccgctgcgctggcacgatgccctcctgctgtgtgagagccgcaatgccagcctggcctacgtgcccgacccctacacccaggccttcctcacgcaggctgcccgagggctgcgcacgccgctctggattgggc

SEQ ID NO: 80823 - DNA, 91 bp, Homo sapiens
  misc_feature 1..91: note = chr17:60843863-60843954
  misc_feature 1..91: note = hypo
  source 1..91: mol_type = genomic DNA
aaaagaaaagaaaagaaaaaaagaacgttaaaatgcggtgtttaatagtttaacagcacattgagattgcccttgacgtaggtgtctttca

SEQ ID NO: 80824 - DNA, 234 bp, Homo sapiens; identical to SEQ ID NO: 45129
  misc_feature 1..234: note = chr17:60856637-60856871
  misc_feature 1..234: note = hypo
  source 1..234: mol_type = genomic DNA

SEQ ID NO: 80825 - DNA, 30 bp, Homo sapiens
  misc_feature 1..30: note = chr17:60869374-60869404
  misc_feature 1..30: note = hypo
  source 1..30: mol_type = genomic DNA
tgtggcaaaactggccgagggcagtcttga

SEQ ID NO: 80826 - DNA, 43 bp, Homo sapiens
  misc_feature 1..43: note = chr17:60885448-60885491
  misc_feature 1..43: note = hyper
  source 1..43: mol_type = genomic DNA
cccttcctcccctgccggggctacaggggtcgaggggctgggc

SEQ ID NO: 80827 - DNA, 56 bp, Homo sapiens
  misc_feature 1..56: note = chr17:60885492-60885548
  misc_feature 1..56: note = hyper
  source 1..56: mol_type = genomic DNA
ggcgggccggtccagggcgcaggagccgcccattaattgcgcggggacggccctga

SEQ ID NO: 80828 - DNA, 30 bp, Homo sapiens
  misc_feature 1..30: note = chr17:61151401-61151431
  misc_feature 1..30: note = hypo
  source 1..30: mol_type = genomic DNA
aatttcaaaaaataacgatagatatttctt

SEQ ID NO: 80829 - DNA, 85 bp, Homo sapiens
  misc_feature 1..85: note = chr17:6120251-6120336
  misc_feature 1..85: note = hypo
  source 1..85: mol_type = genomic DNA
gacggcactggcaaacgcttagttaccaccatcctatattcataaacatgtatacccttttcgcacaaataggttcttttttttt

SEQ ID NO: 80830 - DNA, 107 bp, Homo sapiens
  misc_feature 1..107: note = chr17:61553987-61554094
  misc_feature 1..107: note = hyper
  source 1..107: mol_type = genomic DNA
gatcagccccatccccgccgcacgagcggcgcctgcggacagctcctggggccccggccttgtcactccggaggcgggaggctccggggggtcgggctgggaagatc

SEQ ID NO: 80831 - DNA, 87 bp, Homo sapiens
  misc_feature 1..87: note = chr17:61580782-61580869
  misc_feature 1..87: note = hypo
  source 1..87: mol_type = genomic DNA
gcctgtgagaatggccgtcctcagcttcacgctcgaataaacctgttaaactggattctgatcttttttattatttcaggttgacag

SEQ ID NO: 80832 - DNA, 87 bp, Homo sapiens
  misc_feature 1..87: note = chr17:61580929-61581016
  misc_feature 1..87: note = hypo
  source 1..87: mol_type = genomic DNA
ggaggattgcccgatcatatggtaattctatgcttcattttttttgaggacccaccagactgttttccgcagcggctctgccatttt

SEQ ID NO: 80833 - DNA, 30 bp, Homo sapiens
  misc_feature 1..30: note = chr17:61586953-61586983
  misc_feature 1..30: note = hypo
  source 1..30: mol_type = genomic DNA
tcttcacctccttggcgctgccacctgccc

SEQ ID NO: 80834 - DNA, 106 bp, Homo sapiens
  misc_feature 1..106: note = chr17:61600692-61600798
  misc_feature 1..106: note = hyper
  source 1..106: mol_type = genomic DNA
ggacgctgctgagcccgaggacagacggagacgccgggagccagtggcgcctgtggctccgggcaggggccgcggccgaaagatgccggtccgcaggggccacgtc

SEQ ID NO: 80835 - DNA, 66 bp, Homo sapiens; identical to SEQ ID NO: 45132
  misc_feature 1..66: note = chr17:61607855-61607921
  misc_feature 1..66: note = hypo
  source 1..66: mol_type = genomic DNA

SEQ ID NO: 80836 - DNA, 30 bp, Homo sapiens
  misc_feature 1..30: note = chr17:61611741-61611771
  misc_feature 1..30: note = hypo
  source 1..30: mol_type = genomic DNA
gcacagcactgggtgcggagagtatctggc

SEQ ID NO: 80837 - DNA, 33 bp, Homo sapiens
  misc_feature 1..33: note = chr17:61616015-61616048
  misc_feature 1..33: note = hyper
  source 1..33: mol_type = genomic DNA
catcctaggtgggtccggcggagtggaccaggc

SEQ ID NO: 80838 - DNA, 26 bp, Homo sapiens
  misc_feature 1..26: note = chr17:61677513-61677539
  misc_feature 1..26: note = hypo
  source 1..26: mol_type = genomic DNA
gccaccgcgcccggctgtcctgcttc

SEQ ID NO: 80839 - DNA, 37 bp, Homo sapiens; identical to SEQ ID NO: 44939
  misc_feature 1..37: note = chr17:616989-617026
  misc_feature 1..37: note = hypo
  source 1..37: mol_type = genomic DNA

SEQ ID NO: 80840 - DNA, 202 bp, Homo sapiens
  misc_feature 1..202: note = chr17:61777872-61778074
  misc_feature 1..202: note = hyper
  source 1..202: mol_type = genomic DNA
ctcccggcctggctccgggataaccgggcggggcctgggccattcactgcctcggtttcccccggttggcctcgcgcgtaggcgccggcgcccccatccccgcccagagctgtggggccgcagagacccagccggggcgaccccggagcctggcccggggtccctcgggcggccgagtcctcccgccgccaggggccgcccc

SEQ ID NO: 80841 - DNA, 15 bp, Homo sapiens
  misc_feature 1..15: note = chr17:61778234-61778249
  misc_feature 1..15: note = hyper
  source 1..15: mol_type = genomic DNA
ggtatgcgtggttcc

SEQ ID NO: 80842 - DNA, 160 bp, Homo sapiens; identical to SEQ ID NO: 45134
  misc_feature 1..160: note = chr17:61817857-61818017
  misc_feature 1..160: note = hypo
  source 1..160: mol_type = genomic DNA

SEQ ID NO: 80843 - DNA, 89 bp, Homo sapiens
  misc_feature 1..89: note = chr17:61847615-61847704
  misc_feature 1..89: note = hypo
  source 1..89: mol_type = genomic DNA
agccaccgtgcccggactaatttttttttttctgtagtgtacttttgtcactagagaagaggcattgcagactgcggaacaggtttggc

SEQ ID NO: 80844 - DNA, 189 bp, Homo sapiens
  misc_feature 1..189: note = chr17:61926136-61926325
  misc_feature 1..189: note = hyper
  source 1..189: mol_type = genomic DNA
tttcaaaacaaaaaaacaagactttttgcaaattatccattgtcaaaactccgccaaatacatctcccagcccgccagggagcagccagcagaggccgcaagctcggccaagcgagccgggatgtccaaggcgggaacgtggcttcgcgcgcaactctctgagacgcgggccggctcacgtgtccgggc

SEQ ID NO: 80845 - DNA, 118 bp, Homo sapiens; identical to SEQ ID NO: 36709
  misc_feature 1..118: note = chr17:61926507-61926625
  misc_feature 1..118: note = hyper
  source 1..118: mol_type = genomic DNA

SEQ ID NO: 80846 - DNA, 73 bp, Homo sapiens
  misc_feature 1..73: note = chr17:62020120-62020193
  misc_feature 1..73: note = hypo
  source 1..73: mol_type = genomic DNA
gaggatgggtcttcccgagtgcctcagctcagtgctgccctgccggtccagcccgccccgctcacccacaatg

SEQ ID NO: 80847 - DNA, 30 bp, Homo sapiens
  misc_feature 1..30: note = chr17:62022052-62022082
  misc_feature 1..30: note = hypo
  source 1..30: mol_type = genomic DNA
agttgtcaatgatgacgccaatgaagaggt

SEQ ID NO: 80848 - DNA, 144 bp, Homo sapiens
  misc_feature 1..144: note = chr17:62029028-62029172
  misc_feature 1..144: note = hypo
  source 1..144: mol_type = genomic DNA
cctctccagcctccccggccccgtcagcctccccgaggctgagcatgatgtccttggggctcaggatcttgccatgcagcagccccaggaggaaggccttggcaaagccgatgcccaacttgatgcgcccgatggcaatctgca

SEQ ID NO: 80849 - DNA, 30 bp, Homo sapiens
  misc_feature 1..30: note = chr17:62032715-62032745
  misc_feature 1..30: note = hypo
  source 1..30: mol_type = genomic DNA
ccagcactgccctgccgcacgcctgcaaca

SEQ ID NO: 80850 - DNA, 23 bp, Homo sapiens
  misc_feature 1..23: note = chr17:62054825-62054848
  misc_feature 1..23: note = hypo
  source 1..23: mol_type = genomic DNA
agcaagaccgtgtctctaaaaat

SEQ ID NO: 80851 - DNA, 48 bp, Homo sapiens
  misc_feature 1..48: note = chr17:62066209-62066257
  misc_feature 1..48: note = hypo
  source 1..48: mol_type = genomic DNA
gcagagcaaaggagccgccagcaccccccaccccggcctcctgccgca

SEQ ID NO: 80852 - DNA, 92 bp, Homo sapiens
  misc_feature 1..92: note = chr17:62221901-62221993
  misc_feature 1..92: note = hypo
  source 1..92: mol_type = genomic DNA
taaatgttgagataacgaaagttaaaacagcaacaaaaataaatagagactactaaacacttgtcaaagtcattattgctttggattaaaga

SEQ ID NO: 80853 - DNA, 30 bp, Homo sapiens
  misc_feature 1..30: note = chr17:62773492-62773522
  misc_feature 1..30: note = hyper
  source 1..30: mol_type = genomic DNA
ttcgtctgggcatcccggactcagtcctgg

SEQ ID NO: 80854 - DNA, 54 bp, Homo sapiens; identical to SEQ ID NO: 36710
  misc_feature 1..54: note = chr17:62776217-62776271
  misc_feature 1..54: note = hyper
  source 1..54: mol_type = genomic DNA

SEQ ID NO: 80855 - DNA, 1364 bp, Homo sapiens
  misc_feature 1..1364: note = chr17:62776506-62777870
  misc_feature 1..1364: note = hyper
  source 1..1364: mol_type = genomic DNA
ccggcaggttaggcccggaccatcgccctgggcggggcttccgaggtggtgccggagaggtttcgcggaatcggagctggcaacggcagcgaatagggacagcgacgctcaggagtgctgtcacccatacccaaagaagctgcgtctgggcggggcgaggaggaacctgaatgcctctgctggggaccttggggggcattgggacgaggaccggagcagaaagccggggtccggagccaggaaggctgcgtctgaaggggcgctggctggtcgctagcggagcccaaggagggtgggcctcccctgtcccgccttcccccttcccttctcccccggggatttgctgtcccggagtccctgcgtccctcccgcctgcggctctgggaatgccggtctggggctggttgtctagtgcgggcgttcccgttcgcggggaggtcattggcaccctgaatcacccactgcgagcccttccaaccggattgtagacctgccagctccgggcccacctcccccaacagggcctttcccggagcaacccggccgggcctggaaaaactccgagagggattcccagcgcagggacgcccaccggagcgcagtgtctcgggctggataagaaggggacccggccacagctccttcgccaacctgcgggaacacagagaaggggagggattggtgggggccgagaggatccctggagcgcgagagcgcacccgtcgccaggaggtcccctgcgtccactgcccaggcgacgcaagctacagcggcgtcaacgcctgggtcggcgctaggggcctgggcctgctccccacccgcctccagagggagggcagcccttcgcctaccttctcctccccgtgggatgcggcccgagcagctcccgccccagcacggagacaaggggagcaggcgcgcggagctcccgggtgcggacccgccacctgccgcacccttccctccccaaccctgcccctttccccacccccaccccacctcccacctcaactcccgctcggcggcccactgcctgcccgggcacctcggggcgtccgctcgccggcctcgtctccacttgtcccggcaggcgcgcgtgggctcggcgtcccgcgctccctcctcgaccgcgcggctccggcgctgccaggtttcctgtatagcactataaccagtgaggcaccggcggagagcgcccggcagaacttcctcccggactggggctgggctgcggttgcgagagacaatccccggcgtcctggcttcctgtcgcctctgggccaggcccgcgcctgaagaggaaagatgccaccccctcccctgcatttcccgggatcctgggccactcccgggatcctggctgt

SEQ ID NO: 80856 - DNA, 30 bp, Homo sapiens
  misc_feature 1..30: note = chr17:62782754-62782784
  misc_feature 1..30: note = hypo
  source 1..30: mol_type = genomic DNA
gctgggtgcacaggtcgcagtggtagacat

SEQ ID NO: 80857 - DNA, 30 bp, Homo sapiens
  misc_feature 1..30: note = chr17:62831104-62831134
  misc_feature 1..30: note = hypo
  source 1..30: mol_type = genomic DNA
cttttcaaaggaatacgactataagtggca

SEQ ID NO: 80858 - DNA, 30 bp, Homo sapiens
  misc_feature 1..30: note = chr17:6294932-6294962
  misc_feature 1..30: note = hypo
  source 1..30: mol_type = genomic DNA
gtgaaacctcatgcacgaccttaggtggac

SEQ ID NO: 80859 - DNA, 221 bp, Homo sapiens
  misc_feature 1..221: note = chr17:6297080-6297301
  misc_feature 1..221: note = hypo
  source 1..221: mol_type = genomic DNA
ggagctcattccagccggctggacgtgagggctcagtaatggggcagtcttagcattcagaggagaaaaccatgagggcgtgggttcaggctgctaaaataagaaccaaaaggcaaaggttgataatagcattaattttaatcaaatccatcatttatggaggcatggttctcagtgttctacccttgaccacaggaagacagcaccgatgacttaccttc

SEQ ID NO: 80860 - DNA, 42 bp, Homo sapiens
  misc_feature 1..42: note = chr17:63063928-63063970
  misc_feature 1..42: note = hypo
  source 1..42: mol_type = genomic DNA
ttaatacctacaggccgggcatgggcgcggtggttcatgcct

SEQ ID NO: 80861 - DNA, 38 bp, Homo sapiens
  misc_feature 1..38: note = chr17:63152807-63152845
  misc_feature 1..38: note = hypo
  source 1..38: mol_type = genomic DNA
ggatgagaaagccctcggctcctcggtggagagagcta

SEQ ID NO: 80862 - DNA, 30 bp, Homo sapiens
  misc_feature 1..30: note = chr17:6347790-6347820
  misc_feature 1..30: note = hyper
  source 1..30: mol_type = genomic DNA
cggccttagtggtgtcgggtgagtgcgggc

SEQ ID NO: 80863 - DNA, 131 bp, Homo sapiens
  misc_feature 1..131: note = chr17:63533315-63533446
  misc_feature 1..131: note = hypo
  source 1..131: mol_type = genomic DNA
ggccgtgcactctgccgccctcttagaaactaaatgcctgtaatgcggctcccacctcacacctgcccatggacctggctgggagacaagccccacacgggacactgcggtccgcccggcacttacccaaa

SEQ ID NO: 80864 - DNA, 30 bp, Homo sapiens
  misc_feature 1..30: note = chr17:63973353-63973383
  misc_feature 1..30: note = hypo
  source 1..30: mol_type = genomic DNA
atcaacacaactactcgacactttagcttg

SEQ ID NO: 80865 - DNA, 27 bp, Homo sapiens
  misc_feature 1..27: note = chr17:64197672-64197699
  misc_feature 1..27: note = hypo
  source 1..27: mol_type = genomic DNA
aaaatagaggatgggcggggcgcagtg

SEQ ID NO: 80866 - DNA, 30 bp, Homo sapiens
  misc_feature 1..30: note = chr17:64412556-64412586
  misc_feature 1..30: note = hypo
  source 1..30: mol_type = genomic DNA
gagcatccatgtggccggcagctggggact

SEQ ID NO: 80867 - DNA, 147 bp, Homo sapiens
  misc_feature 1..147: note = chr17:6454672-6454819
  misc_feature 1..147: note = hypo
  source 1..147: mol_type = genomic DNA
ctccatctcaaaaaaaaaaaagaaaagcctggagtctggacactggtgtctgatttgaccatatttgaccataaccttcccattggggaccaaagaaagtgagtttaccatctccttgcaggatgcaatgcccgtcccaagatacac

SEQ ID NO: 80868 - DNA, 37 bp, Homo sapiens
  misc_feature 1..37: note = chr17:6456361-6456398
  misc_feature 1..37: note = hypo
  source 1..37: mol_type = genomic DNA
ttacaggcacgaaccaccgcaccgagcccctggccac

SEQ ID NO: 80869 - DNA, 32 bp, Homo sapiens
  misc_feature 1..32: note = chr17:64671946-64671978
  misc_feature 1..32: note = hypo
  source 1..32: mol_type = genomic DNA
cagttctggttcctccgcggggtcccacgcca

SEQ ID NO: 80870 - DNA, 272 bp, Homo sapiens
  misc_feature 1..272: note = chr17:64672325-64672597
  misc_feature 1..272: note = hypo
  source 1..272: mol_type = genomic DNA
tgttcttcccagtaacgtgaccgggaaaatgtgagccagaggaaacttgagagctccgtggtgcggctgagctggtggggtgagggttttttccctttttctatctggtccagcccatcggccacttgagatgctcctgaactgagtaaccaagctgttcggagggtactttctcagcaggacaagccctgagctctggaaaaacgcagctagaataacgaggaagcagaggggcctctcccacaccaggcttgccccgacaggtcagcttg

SEQ ID NO: 80871 - DNA, 30 bp, Homo sapiens
  misc_feature 1..30: note = chr17:64751173-64751203
  misc_feature 1..30: note = hypo
  source 1..30: mol_type = genomic DNA
ccacagtcaccttcccgatttctgccagga

SEQ ID NO: 80872 - DNA, 289 bp, Homo sapiens
  misc_feature 1..289: note = chr17:64825601-64825890
  misc_feature 1..289: note = hyper
  source 1..289: mol_type = genomic DNA
agttctctaaggagccgctcgtgtgtaacaccatagcccatgtgaatccgtgctgacatccgcacagatgaacggatcagatgagatttaatctccctgaggcccatgggcacgagtcactggagttttatggggtccagtaaagagcaaggaaaagtccgggtcttacaaggctgtaatcgcctcttagaaagagtctcccctaaccacctggtgccttagccctgcagggagctgtccagatgctgacccatttaagcgcagcttcctcggccgccttcagaccttc

SEQ ID NO: 80873 - DNA, 467 bp, Homo sapiens
  misc_feature 1..467: note = chr17:64831006-64831473
  misc_feature 1..467: note = hyper
  source 1..467: mol_type = genomic DNA
gcctctcctctcccacgccggcccccaactcttcacctgccacccccacaagggtgctcaccccagaggtgctcacctcccgggctgggagaccgcatctgaccggtcccaaaccccgcctgcagctggcagcgccggggtggggaggccccgccctcggccccgccccctgcccgcccctccctctcggggtccggggcgcgagctgcggcggcggcggccacggtcattggcgccgagcggttccggctgactggacggggcgggcgtcccgggcagcctagcgcggtacctcccgccccgcgcgcccagccggcgagggacattggaccagggtcgggggtcgcggccgctccagcgaggtaagagccgggaagaccgggagagaccacctcttccatcctgggggggtccctgggggacggtctcccaccggtgctgggccgcggcgccgggctgcgccccca

SEQ ID NO: 80874 - DNA, 561 bp, Homo sapiens
  misc_feature 1..561: note = chr17:64960744-64961305
  misc_feature 1..561: note = hyper
  source 1..561: mol_type = genomic DNA
gccgaggggggagggcgagcggagagggaggagcccccggccgccgccgccagcccgcccggcggccgcgcagcccgcactcgtcgccgcgcctcggagtttgagccccagcgctgccggagcgcaggcacgcccggggcgcggggtcggagcgcgcagcgcggcgccgccccccggccctcggccccccaaccccggcgcccccggagcggcgcgcggagggaggagggcgggcgggcgcggcgggccgggccggcgggcggcggactatgaggcgcccaccatggtgcgatgcgaccgcgggctgcagatgctgctgaccacggccggagccttcgccgccttctcgctcatggccatcgccatcggcaccgactactggctgtactccagcgcgcacatctgcaacggcaccaacctgaccatggacgacgggcccccgccccgccgcgcccgcggcgacctcacccactctggtctgtggcgggtgtgctgcatcgaaggtacggccagccccgacccctcgccgccccacacacacacacacacacacacacatat

SEQ ID NO: 80875 - DNA, 260 bp, Homo sapiens
  misc_feature 1..260: note = chr17:64961365-64961625
  misc_feature 1..260: note = hyper
  source 1..260: mol_type = genomic DNA
gccggggagagggtgggcgcggcgctggctccgcgcgagacacaaaggagccggagctggcgggcgggtcccttcgcggccagctgtacatcagctctggtccctctcggctggggacctccccagcacaccgatcccacaaactctccacgcgcacaccccctcgcccacagacacaatgaaacacaccgaaactcaagcacgcgcgcgtagcccgggacccgagcgatccccaggggccgcgccggcacccccggggg

SEQ ID NO: 80876 - DNA, 314 bp, Homo sapiens
  misc_feature 1..314: note = chr17:64961827-64962141
  misc_feature 1..314: note = hyper
  source 1..314: mol_type = genomic DNA
gggcagaagtaggggcgggggcgcggtcggagccggggtaggggctgagttcctagcggatctagggtagctgggtaggcccagcccgacgcccgcctcgtctcccacggagtcaccggcccgctcctcgctgtgcggtggggtggtaaggggagcgacaccgagtctcccccaacggagacagcgacctcggtcgcggcccctcagcagggaggctgcggagacctcagtaggaaactagggtgtgcaggaccgatctgcggaccgggaacagactgggaggggcgtggtcatctcgtcggagctgggcgctg

SEQ ID NO: 80877 - DNA, 59 bp, Homo sapiens
  misc_feature 1..59: note = chr17:65021078-65021137
  misc_feature 1..59: note = hypo
  source 1..59: mol_type = genomic DNA
catcgtcctcagtgccggcatcctcttcgtggctgcaggtgagccgcccgcccgggctg

SEQ ID NO: 80878 - DNA, 61 bp, Homo sapiens
  misc_feature 1..61: note = chr17:65254229-65254290
  misc_feature 1..61: note = hyper
  source 1..61: mol_type = genomic DNA
cctgaagacagaaggcgaccctctgaagacaggtctagagacttaacgtatgatgttcctg

SEQ ID NO: 80879 - DNA, 30 bp, Homo sapiens; identical to SEQ ID NO: 45139
  misc_feature 1..30: note = chr17:65298508-65298538
  misc_feature 1..30: note = hypo
  source 1..30: mol_type = genomic DNA

SEQ ID NO: 80880 - DNA, 90 bp, Homo sapiens
  misc_feature 1..90: note = chr17:65363297-65363387
  misc_feature 1..90: note = hypo
  source 1..90: mol_type = genomic DNA
cttaagggccttacacgttttatgtgttatcattcataccatgctggtccctagaaaatagcttgagatcttaaaaaagcttaggatcct

SEQ ID NO: 80881 - DNA, 30 bp, Homo sapiens
  misc_feature 1..30: note = chr17:65712223-65712253
  misc_feature 1..30: note = hypo
  source 1..30: mol_type = genomic DNA
taactacaataactgcgatagacttctagg

SEQ ID NO: 80882 - DNA, 80 bp, Homo sapiens
  misc_feature 1..80: note = chr17:65778166-65778246
  misc_feature 1..80: note = hypo
  source 1..80: mol_type = genomic DNA
caggcaccacccctatactccatcacctggggcttattattgtgccaaatttgtctgcctgaagccgtcttcccttagga

SEQ ID NO: 80883 - DNA, 36 bp, Homo sapiens
  misc_feature 1..36: note = chr17:65789836-65789872
  misc_feature 1..36: note = hypo
  source 1..36: mol_type = genomic DNA
gttagaaaagataaccgaccccagttggctgcgatg

SEQ ID NO: 80884 - DNA, 612 bp, Homo sapiens; identical to SEQ ID NO: 36353
  misc_feature 1..612: note = chr17:6616271-6616883
  misc_feature 1..612: note = hyper
  source 1..612: mol_type = genomic DNA

SEQ ID NO: 80885 - DNA, 207 bp, Homo sapiens
  misc_feature 1..207: note = chr17:6616884-6617091
  misc_feature 1..207: note = hyper
  source 1..207: mol_type = genomic DNA
cttcgggccagccctctaggggcagcctgggccctagcatctcgcgctgtccaagcctctcctgcgctgccgaggcagaggtgcgtcccggggctgccaagcggggcgtgttttggtcactggtgctgcccgctttggcgtaaggcgccctcccgcgtccgcatctgctctttcctgggctctgaagggtcccggatgaaactctct

SEQ ID NO: 80886 - DNA, 39 bp, Homo sapiens; identical to SEQ ID NO: 45141
  misc_feature 1..39: note = chr17:66421027-66421066
  misc_feature 1..39: note = hypo
  source 1..39: mol_type = genomic DNA

SEQ ID NO: 80887 - DNA, 30 bp, Homo sapiens
  misc_feature 1..30: note = chr17:66426439-66426469
  misc_feature 1..30: note = hypo
  source 1..30: mol_type = genomic DNA
gagaacaatccaggacgtattattctggca

SEQ ID NO: 80888 - DNA, 30 bp, Homo sapiens
  misc_feature 1..30: note = chr17:66430633-66430663
  misc_feature 1..30: note = hypo
  source 1..30: mol_type = genomic DNA
tgccagcggtccctgcgggacttctgcggg

SEQ ID NO: 80889 - DNA, 96 bp, Homo sapiens
  misc_feature 1..96: note = chr17:66434324-66434420
  misc_feature 1..96: note = hyper
  source 1..96: mol_type = genomic DNA
tgccatgcatagctacgggaggaagtggctgagccccggaacctttaactgcacgttctggcagccctgccacccctttggcgatacaaggtcatt

SEQ ID NO: 80890 - DNA, 41 bp, Homo sapiens
  misc_feature 1..41: note = chr17:66462815-66462856
  misc_feature 1..41: note = hypo
  source 1..41: mol_type = genomic DNA
gtgctgagattacaatcgtgagtcaccgtgcccaaccatgt

SEQ ID NO: 80891 - DNA, 143 bp, Homo sapiens
  misc_feature 1..143: note = chr17:66506934-66507077
  misc_feature 1..143: note = hypo
  source 1..143: mol_type = genomic DNA
ttgcccttttgatatcgcctatgtatccctatcagaaggcagtgaataacataactaaataaatcatctgatggacagtacccttagagcctggtggatttgggggagcagtcggcctccgagggcagcgctgcccaatagga

SEQ ID NO: 80892 - DNA, 1229 bp, Homo sapiens
  misc_feature 1..1229: note = chr17:66596286-66597515
  misc_feature 1..1229: note = hyper
  source 1..1229: mol_type = genomic DNA
agccgtgggtggagccgctgcagccctgggccgggggcgtcaggaaactcgagactggggcgcggggaggccccggccagagcgcccgctctcccgcgtcccgggcggggtcctcacctgttccagcgggccaccttcctccggtaataccgcagcgcctcctggctggccaggagcgagtcctcggctcccaggagaggcggctcctccgggacgttgtacagcgggtgggcgaagagggcctgcaacttggagctcgacccgctgtggctgccgccagccggttcagtccggggctcggttcgggaaaagttgtgcacgatcgtgccggggtccgaggcagctgcggccgagtcccgcgccagggaggaggcgcggccggtgcacgggcacccccgcgggcgctcccgaggccgcagctggcgctgtacttggggccagaggtggaagtagaggtcggcggagagcagcgcgcccagcagcagcagagtcagtaggcggtcccggcgcagccccggcatggcgtgctggccaagggggacgccgggggcaggccggctgtctccggggtcccgggaggggtcgcggggtgcgggcagaagaggtgcctggagtcccgcgggtgggccggggtcagtgagaccggaatgctccccgcgcgggctagtcccctgtggaggggtgtcgctcctcaacttggggaccaggtgcacggagcaccggggctctcggagtcagcgggcgtcgcttctccgcgccgagtgagccgagggaatggggttcccggggtgcccgcttcttgcgccttttctcccgtgcgcccgcccgcccggacgctcgcggcaggtgaagggccccggggcgccggcgccggctgccaccgcgggcggacgggcgacggggcggggggcgaccgcggagggcggacggaggccgccggctgcaaagcccggggcgtctctcctgaggatgctgtcgctcggcggcggctgctagtgctcccgcgactcctcctgcgggcggcggagacgccagtgccggcggctggcacgggcggcgcgagtggggagttggcgaagcaggagcggctccggggagcttgtctgtgcgcctggactcctagaggcagaggtagcgcggggcctccccgagcctggcctggcgccggcacccccacccactctccgctggcacctgcctctggcgcagctgacggccaactcccgatc

SEQ ID NO: 80893 - DNA, 30 bp, Homo sapiens
  misc_feature 1..30: note = chr17:6662975-6663005
  misc_feature 1..30: note = hypo
  source 1..30: mol_type = genomic DNA
tttaggttgggtgtacgatgtgtcagcaga

SEQ ID NO: 80894 - DNA, 37 bp, Homo sapiens
  misc_feature 1..37: note = chr17:66643278-66643315
  misc_feature 1..37: note = hypo
  source 1..37: mol_type = genomic DNA
cacctcttatgggggcgccagctgcggggaggggtct

SEQ ID NO: 80895 - DNA, 492 bp, Homo sapiens
  misc_feature 1..492: note = chr17:6679303-6679795
  misc_feature 1..492: note = hyper
  source 1..492: mol_type = genomic DNA
gcgcagaagcaagggcgggggcgtgccatcctcacccggagcgccggccgagcctcccgcctcccaacgcctggccagggccccgtctcgccctctgcacatgggatccactgaccaggcaactgcaggtttggggctctgcgacccgggggcaggaacagagccttgcaggcggcagcgcgtcacaaaggcggccggagcttggcatttagcttgggccagagcaaggcgcagacccggggcgcccatggagttggcgtcggagcaacagctgcgcgggcggagcaggtaggcgcgctccagtccctgcagcccgagcggggttcagcgaacgggtaacgggagaatgcgggccggagcaggctggggtggcggtgggatgccccgaggcccgcggcggggaggcgggctgctctcatcaccccctctgggaagcatctttggctgcaggagttgccaggccaactccccctcccgcggtgggtaggacat

SEQ ID NO: 80896 - DNA, 30 bp, Homo sapiens
  misc_feature 1..30: note = chr17:66834845-66834875
  misc_feature 1..30: note = hypo
  source 1..30: mol_type = genomic DNA
ggagaattcaatccacgctttgggaagtac

SEQ ID NO: 80897 - DNA, 42 bp, Homo sapiens
  misc_feature 1..42: note = chr17:66872604-66872646
  misc_feature 1..42: note = hypo
  source 1..42: mol_type = genomic DNA
tttgctgctgcccctcggggtccatcccggtcgacggctcat

SEQ ID NO: 80898 - DNA, 53 bp, Homo sapiens
  misc_feature 1..53: note = chr17:66959344-66959397
  misc_feature 1..53: note = hypo
  source 1..53: mol_type = genomic DNA
atcccaccaaagccccgaggaaaccccaaatttcatctcgaggacaccagtcc

SEQ ID NO: 80899 - DNA, 423 bp, Homo sapiens
  misc_feature 1..423: note = chr17:6735130-6735553
  misc_feature 1..423: note = hyper
  source 1..423: mol_type = genomic DNA
tggccaaaggcttagcgcaggcgcaaattctgcggaccccagagccagagacccaggagtgtggcgtgtgggaagggtagggccagatgctccggccacctcaacctaccgcgaagacgcggggcaccaagcagaagacagcggccaaagccccgagctgggagtcaggagacctgcgtctagtccgagccctcccgcgggcgggatcatctcgggtcgcgctgtaccccggctctcagacttcccggctgtacagtggggttgggctgggcgatgcctccaggacctcgcagtcgcaggcgaaattgagggttaaaaatcaggaagccaagttgattgtttctgtaagctacaatgagtttcctccagagtttgtataggtctgttaccacaactggcttatttctgcgtggggcgcccgat

SEQ ID NO: 80900 - DNA, 22 bp, Homo sapiens
  misc_feature 1..22: note = chr17:67410388-67410410
  misc_feature 1..22: note = hypo
  source 1..22: mol_type = genomic DNA
tccctctcgggaaaaaaacaac

SEQ ID NO: 80901 - DNA, 30 bp, Homo sapiens
  misc_feature 1..30: note = chr17:67410790-67410820
  misc_feature 1..30: note = hyper
  source 1..30: mol_type = genomic DNA
ggccttcgcgcccttcgcaggaaggacgtc

SEQ ID NO: 80902 - DNA, 30 bp, Homo sapiens
  misc_feature 1..30: note = chr17:68164507-68164537
  misc_feature 1..30: note = hyper
  source 1..30: mol_type = genomic DNA
ctcaaggaggccttacgaggtttaaataaa

SEQ ID NO: 80903 - DNA, 36 bp, Homo sapiens
  misc_feature 1..36: note = chr17:68164768-68164804
  misc_feature 1..36: note = hyper
  source 1..36: mol_type = genomic DNA
ttttaggggtctgcgcgctctcgcctggctgctggg

SEQ ID NO: 80904 - DNA, 1064 bp, Homo sapiens
  misc_feature 1..1064: note = chr17:68165132-68166196
  misc_feature 1..1064: note = hyper
  source 1..1064: mol_type = genomic DNA
gggcgctgcagcctccgcggggggcttcgaagggccgaggggctccggcagagagggagtggagagggagacgcgccgggaccgacgaacaatcctgcccctgcggcaaaggtctctacccggcgctggcacctcgcaggcccctcgaggagcacgcagggcaagcggcccaagagcgggggaaccgggaagtgtgtggggctccagacggagtaggaagctttgcccaaggccaggctgcaatcaggcagccgcaacagccgggcgcggagcttcccacctgctgctgtcccagctgggccgcaacttcctcctccccggcccgggcccgactccccggccgggctccgagggtggagggggacgaggcggcggcaggttccctccgctggcaacgcctcgcagcatcctcccctccccgccgcggttcccggggccggccgcgcggccaggcgcgctgcgattggccggcagcggccgggggcggggccaggagagccggtgtcgcacggaccgcctcaaaagagcccaggatattgcagagcgcactggagccctggccagcgcgcagccttcccggcgccggcgggctgggtcttgggaattctggtttgctttggctcactcgctttttacaaaccactggatcttacatgcctctgtaccccccacttccactccatgtccccatgctcctgcgccagcaacaggtaagggctgctgtgttttcttccttttcgctcgctgccggtgtgtcctggggaatggactctggccgccgtcccctaccctaccctgccccgctgctccagaggtgcccagctgtcacactgctgtagcgctcacccacactccggagtcccagatcatgcctatatagtttgtgtgcgcaccagaacatccccagagctaaaaatactgagacatgcttggaacagttgagcaatagaaacagatttctctgcagcatctgtttgtgctcataacttccaatgcaccagctgtagcgagatactgggtttggaggcaagggcgagagcgtctgtgttcggttctcactctaa

SEQ ID NO: 80905 - DNA, 34 bp, Homo sapiens
  misc_feature 1..34: note = chr17:68268160-68268194
  misc_feature 1..34: note = hypo
  source 1..34: mol_type = genomic DNA
ttaaaaaaatattgtcggccgggcgcagtggctc

SEQ ID NO: 80906 - DNA, 30 bp, Homo sapiens
  misc_feature 1..30: note = chr17:6882316-6882346
  misc_feature 1..30: note = hypo
  source 1..30: mol_type = genomic DNA
cacacccagcacacacgcctcccatacacc

SEQ ID NO: 80907 - DNA, 230 bp, Homo sapiens; identical to SEQ ID NO: 36358
  misc_feature 1..230: note = chr17:6926198-6926428
  misc_feature 1..230: note = hyper
  source 1..230: mol_type = genomic DNA

SEQ ID NO: 80908 - DNA, 30 bp, Homo sapiens
  misc_feature 1..30: note = chr17:692622-692652
  misc_feature 1..30: note = hypo
  source 1..30: mol_type = genomic DNA
gtgggtcacatgccccgcacacaaattcgc

SEQ ID NO: 80909 - DNA, 200 bp, Homo sapiens
  misc_feature 1..200: note = chr17:6946212-6946412
  misc_feature 1..200: note = hyper
  source 1..200: mol_type = genomic DNA
tcaccctgaatgacccgggcatcccacttccctcaccagcgaggaggcccaggccgaggtagagatgcagcagatcgctggcgaaagccgagaagacgaagcccagcgaggcgaggacgcccccaaccatcaccacggggcgggccccccagcgcgtgctcagggcgctgcccacggggcctgaaagggggcggagtcaa

SEQ ID NO: 80910 - DNA, 15 bp, Homo sapiens
  misc_feature 1..15: note = chr17:6946476-6946491
  misc_feature 1..15: note = hyper
  source 1..15: mol_type = genomic DNA
cgaactaatggttct

SEQ ID NO: 80911 - DNA, 124 bp, Homo sapiens
  misc_feature 1..124: note = chr17:6946872-6946996
  misc_feature 1..124: note = hyper
  source 1..124: mol_type = genomic DNA
ccacgcctgtgcttccgctggggagctggcatccctgagatccagcctctggctgctcgcccggggtgggcccgtcactccgagcgcgatggcgcggggcggagggagccggagcctggcctag

SEQ ID NO: 80912 - DNA, 30 bp, Homo sapiens
  misc_feature 1..30: note = chr17:6947321-6947351
  misc_feature 1..30: note = hyper
  source 1..30: mol_type = genomic DNA
gcgcgtgaggccagacgccagtcccacggg

SEQ ID NO: 80913 - DNA, 30 bp, Homo sapiens
  misc_feature 1..30: note = chr17:6978470-6978500
  misc_feature 1..30: note = hypo
  source 1..30: mol_type = genomic DNA
agtgagcacagtcctcgcctccacccagcc

SEQ ID NO: 80914 - DNA, 167 bp, Homo sapiens
  misc_feature 1..167: note = chr17:70026568-70026735
  misc_feature 1..167: note = hyper
  source 1..167: mol_type = genomic DNA
tttgcctcctgccctcgctgctgttaatctgcaacacgccacagcctctagatcgctgccgttcagagtcggatgtcatgggggcgactggcaggggttctttcttctttcggtttgatacatccttccttccgctgctcctcgcaatcaaccgctaggggaaggag

SEQ ID NO: 80915 - DNA, 67 bp, Homo sapiens
  misc_feature 1..67: note = chr17:70026970-70027037
  misc_feature 1..67: note = hyper
  source 1..67: mol_type = genomic DNA
aaggagttggagctccgtgatggtgagctttcagacttccccctacaacctccgcctccccaaaggc

SEQ ID NO: 80916 - DNA, 751 bp, Homo sapiens; identical to SEQ ID NO: 36721
  misc_feature 1..751: note = chr17:70112816-70113567
  misc_feature 1..751: note = hyper
  source 1..751: mol_type = genomic DNA

SEQ ID NO: 80917 - DNA, 372 bp, Homo sapiens; identical to SEQ ID NO: 1322
  misc_feature 1..372: note = chr17:70113647-70114019
  misc_feature 1..372: note = hyper
  source 1..372: mol_type = genomic DNA

SEQ ID NO: 80918 - DNA, 485 bp, Homo sapiens
  misc_feature 1..485: note = chr17:70114152-70114637
  misc_feature 1..485: note = hyper
  source 1..485: mol_type = genomic DNA
cgcacctctgtgtctccgctcccggcggcagacctcgcggcgcttgctcaagagcgggtatccgaaagcacgtcccgaacacggagaagcgccctccgtctcctgcctcgtgacctgcgccctttccctccctcaccgcatcagatggaggaccctggctcctttcgcccctggcaaaatgctctagccaacactgggtcaacagccttagtttccagatctgtaacctgaacatcaggagcgggttcctttccttctacctgtgtctgaggtcctctggtcggggactgcgcgcgtcttcccaggtcagggaggaggggtcggggcgacctgagaaagacacaacgaagcgaatggagcccctgaatggggaaaggggagtggacaccaggaggcccctgcagaaatgcaggaccgatccactcgcgagctgacaatgccacgcgctagacttggcctgacggtggcaacgcttggcacctggg

SEQ ID NO: 80919 - DNA, 30 bp, Homo sapiens; identical to SEQ ID NO: 36724
  misc_feature 1..30: note = chr17:70115315-70115345
  misc_feature 1..30: note = hyper
  source 1..30: mol_type = genomic DNA

SEQ ID NO: 80920 - DNA, 76 bp, Homo sapiens
  misc_feature 1..76: note = chr17:70116259-70116335
  misc_feature 1..76: note = hyper
  source 1..76: mol_type = genomic DNA
ctcccccagacagggcgactcggctgacgtttttgacccggccaggaggcaaagaccaaaacgtcagagcagtagc

SEQ ID NO: 80921 - DNA, 38 bp, Homo sapiens
  misc_feature 1..38: note = chr17:70117768-70117806
  misc_feature 1..38: note = hyper
  source 1..38: mol_type = genomic DNA
ggtgctcaaaggctacgactggacgctggtgcccatgc

SEQ ID NO: 80922 - DNA, 640 bp, Homo sapiens; identical to SEQ ID NO: 1324
  misc_feature 1..640: note = chr17:70215667-70216307
  misc_feature 1..640: note = hyper
  source 1..640: mol_type = genomic DNA

SEQ ID NO: 80923 - DNA, 303 bp, Homo sapiens
  misc_feature 1..303: note = chr17:70216392-70216695
  misc_feature 1..303: note = hyper
  source 1..303: mol_type = genomic DNA
cgtcaaagccgggtccagggaaggggggcatgccatgggcgtattgttggcctgcgagttccgtcaatgggaaaagtcatgtttcctccgaaggaaacaagtggaaattgtcggggaggggaagggctggtgggtggctgggaagcagagctcggccagttgctactaaggctgccttcgaactgtccctccccactgccagtttctgcaaatgggcaagtctggtccttctggaaggcagttctggggaggggcagtggaagggaacgttttaatatcaggaagaaccgatgtaaatcctag

SEQ ID NO: 80924 - DNA, 98 bp, Homo sapiens; identical to SEQ ID NO: 44977
  misc_feature 1..98: note = chr17:7047830-7047928
  misc_feature 1..98: note = hypo
  source 1..98: mol_type = genomic DNA

SEQ ID NO: 80925 - DNA, 33 bp, Homo sapiens
  misc_feature 1..33: note = chr17:70585967-70586000
  misc_feature 1..33: note = hypo
  source 1..33: mol_type = genomic DNA
aaaaaaaatttacatcggccgggtgcagtggcc

SEQ ID NO: 80926 - DNA, 121 bp, Homo sapiens
  misc_feature 1..121: note = chr17:70588010-70588131
  misc_feature 1..121: note = hyper
  source 1..121: mol_type = genomic DNA
ggggccgagcgggtgcgccgaggacgcgggggcgtctcccccagctgaggttcggtccctccaggcagccaaggcttggcagcgctagaggctgaaggacaacggccgagaacgcccagga

SEQ ID NO: 80927 - DNA, 189 bp, Homo sapiens
  misc_feature 1..189: note = chr17:70588893-70589082
  misc_feature 1..189: note = hyper
  source 1..189: mol_type = genomic DNA
tcctctggataccagcgccgcaccgcgcacccgcgccgcctgcgcgccctgcagtcggctgggccattcggcccttatataccaggcggacccgcgccgggacggggcggagcggggtgggcggggagggggtggggaaggccgaacggcttcctgggagtcgtagttcgactacgtagtcctgtcgta

SEQ ID NO: 80928 - DNA, 57 bp, Homo sapiens; identical to SEQ ID NO: 44940
  misc_feature 1..57: note = chr17:706526-706583
  misc_feature 1..57: note = hypo
  source 1..57: mol_type = genomic DNA

SEQ ID NO: 80929 - DNA, 38 bp, Homo sapiens; identical to SEQ ID NO: 16227
  misc_feature 1..38: note = chr17:70657503-70657541
  misc_feature 1..38: note = hypo
  source 1..38: mol_type = genomic DNA

SEQ ID NO: 80930 - DNA, 30 bp, Homo sapiens; identical to SEQ ID NO: 16228
  misc_feature 1..30: note = chr17:70712704-70712734
  misc_feature 1..30: note = hypo
  source 1..30: mol_type = genomic DNA

SEQ ID NO: 80931 - DNA, 77 bp, Homo sapiens
  misc_feature 1..77: note = chr17:708414-708491
  misc_feature 1..77: note = hypo
  source 1..77: mol_type = genomic DNA
ttcagcacctccacccgcccctgccgcgtgatcacctcgccctgcgggtccagcatgatgagcgtggggatgcctgc

SEQ ID NO: 80932 - DNA, 101 bp, Homo sapiens
  misc_feature 1..101: note = chr17:7107617-7107718
  misc_feature 1..101: note = hypo
  source 1..101: mol_type = genomic DNA
agagggagcccataacggagggtcccatcagcgtggctaccctttcagcctcttagccaagcccactccgccaccctgagagctgctcaagggcccagcct

SEQ ID NO: 80933 - DNA, 146 bp, Homo sapiens
  misc_feature 1..146: note = chr17:71160732-71160878
  misc_feature 1..146: note = hyper
  source 1..146: mol_type = genomic DNA
cccggggctggcccacggtaaacacagctttgctaacttgtttggctaaggaaatcacagaggtcccggtataagtctgggtcaccccggccgccactccagctgcctagaatatatgggtggaagggaatcgactctgtgaaatc

SEQ ID NO: 80934 - DNA, 41 bp, Homo sapiens
  misc_feature 1..41: note = chr17:71161118-71161159
  misc_feature 1..41: note = hyper
  source 1..41: mol_type = genomic DNA
atgtgccgaggggcccgggctggctgggccagtcccagcgg

SEQ ID NO: 80935 - DNA, 255 bp, Homo sapiens
  misc_feature 1..255: note = chr17:71161183-71161438
  misc_feature 1..255: note = hyper
  source 1..255: mol_type = genomic DNA
cgcaagaccaccagcgcccagagccccagtctgaggcttggcgccgggggtctgcgggcgaggggagctctctacgtgcgaggggctagcgggagccggcacaagagggtcgaggagccaggaaccccaaacgtccggcgccaggcgctagccaagctgctgcgcgccccggcgcccagctggctcggggacagccgctgggtgtcggagaccggagctagcggattgcagcggaaaagcaaaggtgaggggtgt

SEQ ID NO: 80936 - DNA, 979 bp, Homo sapiens
  misc_feature 1..979: note = chr17:71161498-71162477
  misc_feature 1..979: note = hyper
  source 1..979: mol_type = genomic DNA
aagcgcacttgggcacctgtgtgcatctgcgctgatggtggtgtgcccatccgagtgcctgagcttaggtcccggtgcgtgattctccgctcttgtgccttttggggtgattgtagtaggaatgaacgacaacgggtacccttgcctgagtaagggggctgtgggtagagtgtgctggaacggacgtgtcctcgcagcctcatgcccgtgtgcgtggcgtgtgccctttagcccgagatttcaggtagctgcgacgggtgacaacttctctcccagccccctacaaaagagacctggcgcgaggggagcgaggccgtgagatgccagctggggctcctgcgggagcgcacccggagatccgagcctgccagaggcaggcggcgggcgcagagcggagaaagaggggcttctctccctagacgctgaacgatctaggatccgtccccgtcccccacctcgggacagaaaggacagtttgtctaggtttggagagaaaaaaccactgcataggccgtgcccaaaagccgctggccaagtcccccaagcgactgtcttctgcgccccgatgtctctgtcctcagcgccccccccccacacccggcacccctgctgtgcgtttcgatactgggcgtgctggcgccacaatctccgctcttgcctcgtcttcctggaaatggcacagagttctttgggaaacccttgctctgaggatcagcgagttggatggccaggaggaggactttctgtgccagccgggagcaaccggctccgcggtcctgacactcgcccctccatttctcaaccccgtaggccagcaccgccccggcttttcccaggcgctcacgcgccgcggtggccctcaggggcttttgtcaccctgccagtgggggctctcgctctagccgcacagagaccaagccgggttctgcaggccctgagggaggcggggggtgggaagtgaatgcgggaaacatgatgg

SEQ ID NO: 80937 - DNA, 25 bp, Homo sapiens
  misc_feature 1..25: note = chr17:71183402-71183427
  misc_feature 1..25: note = hypo
  source 1..25: mol_type = genomic DNA
gagccaccgtcgccggccccaagtg

SEQ ID NO: 80938 - DNA, 19 bp, Homo sapiens
  misc_feature 1..19: note = chr17:71190303-71190322
  misc_feature 1..19: note = hypo
  source 1..19: mol_type = genomic DNA
gggtgcggtggctcacgcc

SEQ ID NO: 80939 - DNA, 30 bp, Homo sapiens
  misc_feature 1..30: note = chr17:71191269-71191299
  misc_feature 1..30: note = hypo
  source 1..30: mol_type = genomic DNA
gcctgattttagaaacgtattgattttcat

SEQ ID NO: 80940 - DNA, 30 bp, Homo sapiens; identical to SEQ ID NO: 45149
  misc_feature 1..30: note = chr17:71201620-71201650
  misc_feature 1..30: note = hypo
  source 1..30: mol_type = genomic DNA

SEQ ID NO: 80941 - DNA, 30 bp, Homo sapiens; identical to SEQ ID NO: 45150
  misc_feature 1..30: note = chr17:71202377-71202407
  misc_feature 1..30: note = hypo
  source 1..30: mol_type = genomic DNA

SEQ ID NO: 80942 - DNA, 36 bp, Homo sapiens
  misc_feature 1..36: note = chr17:71202740-71202776
  misc_feature 1..36: note = hypo
  source 1..36: mol_type = genomic DNA
tgacagttagaaatacggtagcgatgggtgactaac

SEQ ID NO: 80943 - DNA, 126 bp, Homo sapiens
  misc_feature 1..126: note = chr17:71246047-71246173
  misc_feature 1..126: note = hypo
  source 1..126: mol_type = genomic DNA
acagaggagctgccacgtgcaacccagacctgttggtaggagctgagcaaagtataatgatcgtggatttcccatagactcgagcttttggttttatgtacattttgctcccgttttatggataac

SEQ ID NO: 80944 - DNA, 39 bp, Homo sapiens
  misc_feature 1..39: note = chr17:71283415-71283454
  misc_feature 1..39: note = hypo
  source 1..39: mol_type = genomic DNA
cataaatgaggatcccgcctgtgacgtctccactgtgga

SEQ ID NO: 80945 - DNA, 31 bp, Homo sapiens
  misc_feature 1..31: note = chr17:7136114-7136145
  misc_feature 1..31: note = hypo
  source 1..31: mol_type = genomic DNA
aagcagaggttgggccgggcgcggtggctca

SEQ ID NO: 80946 - DNA, 30 bp, Homo sapiens; identical to SEQ ID NO: 45151
  misc_feature 1..30: note = chr17:71375377-71375407
  misc_feature 1..30: note = hypo
  source 1..30: mol_type = genomic DNA

SEQ ID NO: 80947 - DNA, 30 bp, Homo sapiens
  misc_feature 1..30: note = chr17:71378704-71378734
  misc_feature 1..30: note = hypo
  source 1..30: mol_type = genomic DNA
cctgctgtgctgtaacgtgttttatcggtt

SEQ ID NO: 80948 - DNA, 61 bp, Homo sapiens
  misc_feature 1..61: note = chr17:71391476-71391537
  misc_feature 1..61: note = hypo
  source 1..61: mol_type = genomic DNA
tgatcttatagcccacggactcagggttcccattgtattccatctccgggagaggctgcag

SEQ ID NO: 80949 - DNA, 30 bp, Homo sapiens; identical to SEQ ID NO: 45153
  misc_feature 1..30: note = chr17:71417363-71417393
  misc_feature 1..30: note = hypo
  source 1..30: mol_type = genomic DNA

SEQ ID NO: 80950 - DNA, 30 bp, Homo sapiens; identical to SEQ ID NO: 45154
  misc_feature 1..30: note = chr17:71427753-71427783
  misc_feature 1..30: note = hypo
  source 1..30: mol_type = genomic DNA

SEQ ID NO: 80951 - DNA, 30 bp, Homo sapiens
  misc_feature 1..30: note = chr17:71439688-71439718
  misc_feature 1..30: note = hypo
  source 1..30: mol_type = genomic DNA
ctgagtttaaaaatacgagggctgccccag

SEQ ID NO: 80952 - DNA, 30 bp, Homo sapiens
  misc_feature 1..30: note = chr17:71475104-71475134
  misc_feature 1..30: note = hypo
  source 1..30: mol_type = genomic DNA
tcacccatggtacaacgcacattcatgcac

SEQ ID NO: 80953 - DNA, 30 bp, Homo sapiens; identical to SEQ ID NO: 45155
  misc_feature 1..30: note = chr17:71484009-71484039
  misc_feature 1..30: note = hypo
  source 1..30: mol_type = genomic DNA

SEQ ID NO: 80954 - DNA, 30 bp, Homo sapiens; identical to SEQ ID NO: 44979
  misc_feature 1..30: note = chr17:7156905-7156935
  misc_feature 1..30: note = hypo
  source 1..30: mol_type = genomic DNA

SEQ ID NO: 80955 - DNA, 1254 bp, Homo sapiens
  misc_feature 1..1254: note = chr17:71639013-71640267
  misc_feature 1..1254: note = hyper
  source 1..1254: mol_type = genomic DNA
ctctggattgcctggcgcacgaggcggcgtggggagtgggttgcagcccccacagtccggacccctagggtgggtctggccccctcctgagcctgcgagagtgaaggcctagccctgcgagtcctggagctcggtccaggcttcgtctccctccgcccccagcaggcgccgctcggacaccgctgacaccactgtctggatcggcgaaccccaaagtcgaggaaccgccggtgcagccgcccttcacctcggggacctgcccggggaccagggggacgtctgggcatccaccctcaggaagcgggcagcgcagatcacacctcggatccttcgtagcactcccaaacccaaagccaccagcccttctccaccgcgaggctgctcccggcagccacaggtcacagcagcgagcggctgcacagactatcgagcgaacagcggaggctggaggcaggggcggggatgctgggtgtgggtggatgggtaggaggggaggcctcagaccctccctgtgcaccaccccccggtgggtccgcggctgcacccgcgaccttggctccaggcccgcgcagcgaagcacccccagccccagcggctggccgagcagccaggggcgggctcccgtacgtggccaagccgggcaattgctctccccgggcgagcaacccggcatccagcgctcgcccaccccactccctcgccccggggaggccatcgcctgcccggcaggggccctgcccttccccgcagacaccgagcagggaaccaggagctcggtctgggaagctcagcgtagccgagcgtggagcccggcacggaatgtcgctcccctcccaagccggcgcagggcagccacagcagacggggggaggggagcgcccctcccacttcaccttgggctcttctctgcctccccaggtcgtccccaccttcccccattcggaagccacaagtctcggagagactgccccacccccaaaagagccccaaaacttgggagatggggtgtcttgaaactccctggagagggctctgccacggctaagccgggtgtccaggaggtcaccgtgaggccggccagctcccgccgcccctcccccgcccactctcccagccccctccctgtccccacgtgggggtccctccttaccttgggctctggccgcgcggatctgatgcagagctagcagtgtccagatcaaaagcccccacatggtgaccagcctggagaggggtcctcggggtctcccttcc

SEQ ID NO: 80956 - DNA, 123 bp, Homo sapiens
  misc_feature 1..123: note = chr17:71640470-71640593
  misc_feature 1..123: note = hyper
  source 1..123: mol_type = genomic DNA
gccaggccgccctctcggactagggcgcctctctcccttagcaccccaactccgacttctcccaaacagggcggcctctgcgatccggccgggtcgccggccgagctccggaataaatggaca

SEQ ID NO: 80957 - DNA, 301 bp, Homo sapiens
  misc_feature 1..301: note = chr17:71640832-71641133
  misc_feature 1..301: note = hyper
  source 1..301: mol_type = genomic DNA
gcaggcagcatctggcggggccgaaccaccccctctgggctccaccgccctcgcgccgaatcgggagacgccgggtctcctccgggggcgctggggccgggcgcgccctcggctccgcgcccagccggctagcaaactttgcgggtcccggagccgggcgcgcagccctgagcgcccatgtccgcgccagccgcggggcggcgggggagggtgctgggcttcgcgacgcgggctgtcgccggcgcccgggcgcagagcctcctgccggcccgaggatggagaccggcggctctgccctccg

SEQ ID NO: 80958 - DNA, 325 bp, Homo sapiens
  misc_feature 1..325: note = chr17:71641358-71641683
  misc_feature 1..325: note = hyper
  source 1..325: mol_type = genomic DNA
gagctgcgggggcagcgtgagccggggacgagcgcggcggaggcggagacgcggagaggggggccgagcgctaccccgtggccgcgactggagagcagcctgcgcgccgggaggggcggcggcggcggcggcggccccgagccaggcccgggagcgagccccgcagaaatacaatccgactgcgcggccgcgggcgcccagcggctctgggacccgcaggggggcagcagtgccaaccttctgccgcgccgggagagatgcgcgcgagcccctccgctctctgcccagcctttccttccagcctcgctcgcgcccctgtctcaaa

SEQ ID NO: 80959 - DNA, 41 bp, Homo sapiens
  misc_feature 1..41: note = chr17:7164579-7164620
  misc_feature 1..41: note = hyper
  source 1..41: mol_type = genomic DNA
ggtgaaagggtgcagcgaagagaagccgagacggtggtccg

SEQ ID NO: 80960 - DNA, 21 bp, Homo sapiens
  misc_feature 1..21: note = chr17:71879558-71879579
  misc_feature 1..21: note = hypo
  source 1..21: mol_type = genomic DNA
ctccaaaatccgaaacgctcc

SEQ ID NO: 80961 - DNA, 185 bp, Homo sapiens
  misc_feature 1..185: note = chr17:71897979-71898164
  misc_feature 1..185: note = hyper
  source 1..185: mol_type = genomic DNA
attcgcacctgattacgctgcgcggacacaacagaggcgcccggacccgcagccctgccttcgccgcctttgctgggctgtttgcgcttcgtttccttctcgccgccccatggcgcgctttctctcttctttatttcgccggttctccccgctcctaacctgcttaacaacttacctcgctctcc

SEQ ID NO: 80962 - DNA, 245 bp, Homo sapiens
  misc_feature 1..245: note = chr17:71898228-71898473
  misc_feature 1..245: note = hyper
  source 1..245: mol_type = genomic DNA
cgtggctgcgccagcatttaataaaagctgctgaccgggaaatccgagctaactgaattacttcctcattaaagaggcgggcagattcttgggccccgcgtgcagccaccctcgctgcctccctccccgccccgctccgccctgctggtcccgcctgccgtccgcaattaggcggcagatgcttgccgcccggtggtggcctgggttctgcagggactgagggggctcgtcggcttctctccagg

SEQ ID NO: 80963 - DNA, 990 bp, Homo sapiens
  misc_feature 1..990: note = chr17:71948390-71949380
  misc_feature 1..990: note = hyper
  source 1..990: mol_type = genomic DNA
actccattcatctcccggttcctcgcattcatcccccaccgaacccacccacaaaatgctgaatcggtgggtgagatccccatagcaacggctccgatgccagaacccaggattacgacaccggatcagccagagacgcgctggaggggcccaggaggggctgcagcgcgccgcaaatcccccggggcttacgggagccgctctttaggagacagcgctggacgaaccgggcggggtggggatggataatcttcaggcgccaacgcaaaacggccgcaagacgtggccaggccaggaggctcctgggtcccgggcccgcgatgtggcccttgcgcggggacaaagacgaggccatcgccctcacgtgttcccaaagacgcccaacctcatcaggaggccgccccatccgccacctgggagcgtcccacacgcccgggcccttgaggatgtcccctcggcgatgtgcctgaccgggcgctccccgcccgccaacctccaacctccaacctccgccctccaccctccaccctccttgctctgtccgcgtggacgcagcccccggttcagacactagcgggtgcgcggggccgcccaggacggcgggagaggacggggccctccctcccctctggtcccccaaagctccccggacgccgcggccgcgccccctgccggctccctccggccggctcccgcgtcccactggggctcctctcccgctgcaaggtcagcgcttccccgccccacgccctccacaactccccgcccttccgttcctgctgccgccgccctctccacccaggctcctgtcacccaccacgggagttcacacgctccagtccatcggcctcccccggcccgaccgccctggctcaggcaaatcccagcctgcacttcccgaaggaagtcccctccacgcacacaccctacacgcacgcacacatttacacacacgccctcacacatttacacacacgccctcacacacgc

SEQ ID NO: 80964 - DNA, 104 bp, Homo sapiens
  misc_feature 1..104: note = chr17:7197588-7197692
  misc_feature 1..104: note = hyper
  source 1..104: mol_type = genomic DNA
gggggttcccgagaccgccgtcgccggattgccaggggtgcgggagcccggcgccgagggggtcccagcagcggggcccgaggcggctccgcccccgccgcccg

SEQ ID NO: 80965 - DNA, 30 bp, Homo sapiens
  misc_feature 1..30: note = chr17:72111461-72111491
  misc_feature 1..30: note = hypo
  source 1..30: mol_type = genomic DNA
atttggggtggggggcggtgaggaggaagt

SEQ ID NO: 80966 - DNA, 30 bp, Homo sapiens
  misc_feature 1..30: note = chr17:7219436-7219466
  misc_feature 1..30: note = hypo
  source 1..30: mol_type = genomic DNA
acccctcattccacccgtaccagcagggca

SEQ ID NO: 80967 - DNA, 35 bp, Homo sapiens
  misc_feature 1..35: note = chr17:72203913-72203948
  misc_feature 1..35: note = hypo
  source 1..35: mol_type = genomic DNA
ggattacaggcgtgaaccaccgcacccaactgaat

SEQ ID NO: 80968 - DNA, 30 bp, Homo sapiens
  misc_feature 1..30: note = chr17:72207414-72207444
  misc_feature 1..30: note = hypo
  source 1..30: mol_type = genomic DNA
cagctgctggtgtgccgactgtcctccaac

SEQ ID NO: 80969 - DNA, 307 bp, Homo sapiens
  misc_feature 1..307: note = chr17:72208361-72208668
  misc_feature 1..307: note = hyper
  source 1..307: mol_type = genomic DNA
gtgggatcacggccacgaggagaggccccgaggccaggacttcctctaatggacacagggcctttgagcaccgggtgactggggccccactccccagcagccatatgtgtttgcgagcgttttcagtcggtccgcatccacccggtcccttcagccagaaccctaggagccccgccccgtcctcccggggctcctttctcacccgcgtccctgccgcggtggatacgcacccctcaggctggctgcccagcgcggtttccacgcccaatctgccgcgaccccatcactccaccgcacctacccctga

SEQ ID NO: 80970 - DNA, 176 bp, Homo sapiens
  misc_feature 1..176: note = chr17:72209140-72209316
  misc_feature 1..176: note = hyper
  source 1..176: mol_type = genomic DNA
ttgtcctcactcaggcgtcctgcaggcggcttcagcgagttgttggggcagatgcgccgggagctcccgagggcagggacggcgtcttatttctctttttaagtccacagggcttgcacaatagatgcccaaaaaatgagagtgaatttagaatgagtgaccgagtggctgaagat

SEQ ID NO: 80971 - DNA, 44 bp, Homo sapiens
  misc_feature 1..44: note = chr17:72220254-72220298
  misc_feature 1..44: note = hypo
  source 1..44: mol_type = genomic DNA
atcctcctgcatggccgggcgcggtgactcatgcctgtaatccc

SEQ ID NO: 80972 - DNA, 30 bp, Homo sapiens
  misc_feature 1..30: note = chr17:72222074-72222104
  misc_feature 1..30: note = hypo
  source 1..30: mol_type = genomic DNA
gggcttacacctgggcgtgggcagtgacca

SEQ ID NO: 80973 - DNA, 213 bp, Homo sapiens
  misc_feature 1..213: note = chr17:72233492-72233705
  misc_feature 1..213: note = hypo
  source 1..213: mol_type = genomic DNA
gagatctttgctgcccggggcgattacctgcagaccctgaagttcatacagcagatggcgggcagcgttgttgttcagctctcaggactgcccgtgtggagggaggtcaccatggagctgaccaagctatccgaccagactggctacgtggagtactacaggtgaaggaccggtgggaggcagagggaggggcagcagcggctacatcagctt

SEQ ID NO: 80974 - DNA, 30 bp, Homo sapiens
  misc_feature 1..30: note = chr17:72249016-72249046
  misc_feature 1..30: note = hypo
  source 1..30: mol_type = genomic DNA
cctggaagagctggtcgtgaagctgggaat

SEQ ID NO: 80975 - DNA, 30 bp, Homo sapiens
  misc_feature 1..30: note = chr17:72249492-72249522
  misc_feature 1..30: note = hypo
  source 1..30: mol_type = genomic DNA
gcatccaaggccacccgtggtccccactac

SEQ ID NO: 80976 - DNA, 80 bp, Homo sapiens
  misc_feature 1..80: note = chr17:72269879-72269959
  misc_feature 1..80: note = hypo
  source 1..80: mol_type = genomic DNA
actccgtctcaaaaaaaaaaaaattccccagcttctactcccaaggagtttccattctggtggtgcgggaagatgtcttt

SEQ ID NO: 80977 - DNA, 351 bp, Homo sapiens
  misc_feature 1..351: note = chr17:72270174-72270525
  misc_feature 1..351: note = hyper
  source 1..351: mol_type = genomic DNA
gtaggcttggataagcgccttggcaacgcccctacaaatattcatgatcattattagtatgttaccaacctattggttaattcttctcctaactcaggagacctccaaaaagaagagggatggcctgcgcttccgacgtggcaggaaaggagtcacgtgctccggggtccttccgcgtcgccccgcgcgtccggagccaggccggggttgccaagcaaccggtaaacgccgccgtttgaggagcaccggagccgcgaccgtggattgaacgcttccccagagacccagaagcagaaggagcggacccagggtaaggggcgggcgccaggaggacgtcggaggctaaagact

SEQ ID NO: 80978 - DNA, 128 bp, Homo sapiens
  misc_feature 1..128: note = chr17:72278015-72278143
  misc_feature 1..128: note = hypo
  source 1..128: mol_type = genomic DNA
ctcggaccgccaggccgagctgaacatcgacatcatgcccaaccctgagctggccgagcagttcgtggagcggaacccagtggacacgggcatccagtgctcgatcagcatgtcggaacacgaggtgg

SEQ ID NO: 80979 - DNA, 35 bp, Homo sapiens
  misc_feature 1..35: note = chr17:72287189-72287224
  misc_feature 1..35: note = hypo
  source 1..35: mol_type = genomic DNA
gccatcgtctccactcgtgacgttggagttcaacc

SEQ ID NO: 80980 - DNA, 36 bp, Homo sapiens
  misc_feature 1..36: note = chr17:72296926-72296962
  misc_feature 1..36: note = hypo
  source 1..36: mol_type = genomic DNA
tttgattcagtaggtcgagggcgaggcctcagcatc

SEQ ID NO: 80981 - DNA, 210 bp, Homo sapiens
  misc_feature 1..210: note = chr17:72321933-72322143
  misc_feature 1..210: note = hyper
  source 1..210: mol_type = genomic DNA
cacaggcacctgctgcgatgcacgcggcgcccacggaaacccgaggctgccagccgccgccctggagaccccagagacagcggcagatgcgtgtgcttcaaggggcagcgtggctgctggggcgctccctaaagggcagtggcacggggtcgcgccgcgagcagaggggcgcgggtgggcgcgcaggagttagcgaactgacacggaggc

SEQ ID NO: 80982 - DNA, 414 bp, Homo sapiens
  misc_feature 1..414: note = chr17:72322144-72322558
  misc_feature 1..414: note = hyper
  source 1..414: mol_type = genomic DNA
ccaggcggacgcacggacgcaccgagggccgcagggccgcacagccgggcacacatcgtcgcgcagcggttcaggctcgggggcctcctcggcggaggcggccaactctcaccctcagcgcggggaggggcgggcgccgggggcggggcggcgccgtccgggccctccccctgccccgcctcgggtcggcgtccttagccgctggcgcgttgttggtttcgggttgtcaggcagcgcgcgaggcggcgggcagctagcagctggcggacgcgacccggaggcggtgggggtgcggctgagccatgcccggtggcgcggcctgagcccctccacctgctgcaatcatgaaggacagcggggactccaaggaccagcaactcatggtgagacccttttagaccctcctccccaccc

SEQ ID NO: 80983 - DNA, 41 bp, Homo sapiens
  misc_feature 1..41: note = chr17:72322611-72322652
  misc_feature 1..41: note = hyper
  source 1..41: mol_type = genomic DNA
cgccaccccactgagaggacaggcaacgaccagggccggga

SEQ ID NO: 80984 - DNA, 36 bp, Homo sapiens
  misc_feature 1..36: note = chr17:72346588-72346624
  misc_feature 1..36: note = hypo
  source 1..36: mol_type = genomic DNA
gcttcgggagcagctcgccagcgccttccaggagca

SEQ ID NO: 80985 - DNA, 113 bp, Homo sapiens
  misc_feature 1..113: note = chr17:72353147-72353260
  misc_feature 1..113: note = hyper
  source 1..113: mol_type = genomic DNA
ggcgagaagagcacgttccaggtgacccggcggcccgcgtcgtggccactcgggcccagctgcgtctggaagctggtgctgcggtcgtcgcgggccgggttgttgatgaccca

SEQ ID NO: 80986 - DNA, 21 bp, Homo sapiens
  misc_feature 1..21: note = chr17:72353416-72353437
  misc_feature 1..21: note = hyper
  source 1..21: mol_type = genomic DNA
cgagcgcgcctgcagctggaa

SEQ ID NO: 80987 - DNA, 236 bp, Homo sapiens
  misc_feature 1..236: note = chr17:72356203-72356439
  misc_feature 1..236: note = hypo
  source 1..236: mol_type = genomic DNA
agtcccagcagcaggcggtgggcgtggaatacccggacctcatcggtgcccgcagcctgcacccgcagaaccacatcgctggcgttgccctgccgcagcagctcctgcaagcgctggagcaccgcctgggagtggttgatggaggtgccagctgcctccccgccaacatcggctctctgtgctgcagcaggaaggaacacagcatagcctgagaaggtgcccgggcccagaacctc

SEQ ID NO: 80988 - DNA, 67 bp, Homo sapiens
  misc_feature 1..67: note = chr17:72368063-72368130
  misc_feature 1..67: note = hypo
  source 1..67: mol_type = genomic DNA
gtttgctgccaaccacgcctcagtctggatcgccatcctgctcacggttgaccgctacactgccctg

SEQ ID NO: 80989 - DNA, 30 bp, Homo sapiens; identical to SEQ ID NO: 16232
  misc_feature 1..30: note = chr17:72370768-72370798
  misc_feature 1..30: note = hypo
  source 1..30: mol_type = genomic DNA

SEQ ID NO: 80990 - DNA, 502 bp, Homo sapiens
  misc_feature 1..502: note = chr17:72427092-72427594
  misc_feature 1..502: note = hyper
  source 1..502: mol_type = genomic DNA
ccggcgcaccgctggcgatcccccaggcaattcggcgtcatgagaaccggcaccccgagactcggcgccctgccctccctccgcgtctccagggccctggccaggcccaacaacctctccctcctctgtgcgcctcagcccctacgggcctctggcgcgggctaactaggcctcgctgcgggcccccaggactgcgcaccccaccccccgcgaggccagcagccccgggggaaggcggccggaaaatctcttgtttatcgggctggataagtaccagcctggattcgcttcccaatttctgcggtccagcttcagcagattcctggggccggaggggaaagggtggcaacccacagatccaccccggaacagggagtggggggtggggctggtgggaacctgacctcctggaaaggacggactcggagtcagagccaacgtgtcccggagcgcagaggcccagggggtcgcgctaaacactgtacctcggggaacaaaaccg

SEQ ID NO: 80991 - DNA, 59 bp, Homo sapiens
  misc_feature 1..59: note = chr17:72427813-72427872
  misc_feature 1..59: note = hyper
  source 1..59: mol_type = genomic DNA
gtcccagagaaggaccgtgcgtgcaaaaggcgaacctcggtgtgcggtgtgtccacgtg

SEQ ID NO: 80992 - DNA, 158 bp, Homo sapiens
  misc_feature 1..158: note = chr17:72428331-72428489
  misc_feature 1..158: note = hyper
  source 1..158: mol_type = genomic DNA
cgcacgtacctggagcgcggcgggcgcccgattagcgccctgaatggaggtgatgtaacggtgatgcaggctccagcccaccctcgccgaaagcaaggagccctgcctggggacaggcccgcgcgagagcgagcaacccagcgcgcctggctcagcct

SEQ ID NO: 80993 - DNA, 43 bp, Homo sapiens
  misc_feature 1..43: note = chr17:72428829-72428872
  misc_feature 1..43: note = hyper
  source 1..43: mol_type = genomic DNA
gggggtgggggagcccggcgctgcggctcgggctggagggagg

SEQ ID NO: 80994 - DNA, 28 bp, Homo sapiens
  misc_feature 1..28: note = chr17:7243860-7243888
  misc_feature 1..28: note = hypo
  source 1..28: mol_type = genomic DNA
gataagatttgatctcggtcaggccagg

SEQ ID NO: 80995 - DNA, 30 bp, Homo sapiens
  misc_feature 1..30: note = chr17:72539052-72539082
  misc_feature 1..30: note = hypo
  source 1..30: mol_type = genomic DNA
gtgcacgggcagcttcgtgggaggacctga

SEQ ID NO: 80996 - DNA, 30 bp, Homo sapiens
  misc_feature 1..30: note = chr17:72560329-72560359
  misc_feature 1..30: note = hypo
  source 1..30: mol_type = genomic DNA
tatttctcttcataccgacactgaacactc

SEQ ID NO: 80997 - DNA, 199 bp, Homo sapiens
  misc_feature 1..199: note = chr17:72667283-72667482
  misc_feature 1..199: note = hyper
  source 1..199: mol_type = genomic DNA
gctcgggatcaggaacggtgagctcctgggaccgcaatgccctgagaacgcagccgggtgctgagcctccggagtccggtagctgaatgaaatacgcagggatcaccagccggacccaaatcttgcgtccctgccagcatcctggagtcctaagaggcagggattggagcggacaggatctcagaactctggtcccggg

SEQ ID NO: 80998 - DNA, 30 bp, Homo sapiens; identical to SEQ ID NO: 45160
  misc_feature 1..30: note = chr17:72731669-72731699
  misc_feature 1..30: note = hypo
  source 1..30: mol_type = genomic DNA

SEQ ID NO: 80999 - DNA, 74 bp, Homo sapiens
  misc_feature 1..74: note = chr17:72733981-72734055
  misc_feature 1..74: note = hyper
  source 1..74: mol_type = genomic DNA
ccctcccattccacccgctggaggcactgcctcccaccttcctccctgcagtcggaagccgctcctcccagaag

SEQ ID NO: 81000 - DNA, 30 bp, Homo sapiens
  misc_feature 1..30: note = chr17:72773643-72773673
  misc_feature 1..30: note = hypo
  source 1..30: mol_type = genomic DNA
agttccatggggcagcgactacagtgctgc

SEQ ID NO: 81001 - DNA, 30 bp, Homo sapiens; identical to SEQ ID NO: 45161
  misc_feature 1..30: note = chr17:72800435-72800465
  misc_feature 1..30: note = hypo
  source 1..30: mol_type = genomic DNA

SEQ ID NO: 81002 - DNA, 211 bp, Homo sapiens
  misc_feature 1..211: note = chr17:72838894-72839105
  misc_feature 1..211: note = hyper
  source 1..211: mol_type = genomic DNA
gatcggcaagcacatcgactgcgcctgcgccaagcgcctgcaggccgagtggccgtcggggcgggcgcaggcggggccggtgcacccagcgggcagcgagctgggccgagcgaaggcctcggccacggagctgggcagggaagcgtgacgcgggcgcgagccccgggcccaggccgcgtgcagcagggcctcccgccgggccagctgctcc

SEQ ID NO: 81003 - DNA, 74 bp, Homo sapiens
  misc_feature 1..74: note = chr17:72839514-72839588
  misc_feature 1..74: note = hyper
  source 1..74: mol_type = genomic DNA
cgatggtgcgagtggcgcggtccagggagctgcttacgcccgccgtggtcaccatgtcgcgggctgcctgcagc

SEQ ID NO: 81004 - DNA, 61 bp, Homo sapiens
  misc_feature 1..61: note = chr17:72848164-72848225
  misc_feature 1..61: note = hypo
  source 1..61: mol_type = genomic DNA
cccgggcagggctgacgggcccagggtgaacacggcagtccccggccggggctggcagggt

SEQ ID NO: 81005 - DNA, 349 bp, Homo sapiens
  misc_feature 1..349: note = chr17:72848502-72848851
  misc_feature 1..349: note = hyper
  source 1..349: mol_type = genomic DNA
agcaggcgctgcgtgcgcgcgcgcggccctcccgggcccagctccagcgtgaccacgtccagcagccgccaactcacgtggctggcgtcggcgacggcgcgcacgccctccaggaagagcgcgtggcccgggtgcaggctggtgatgacggcgaaggcgctccagtcgtactcttccagcaccttgaacagcacctgcagctgctgctccagggacacgcccagctgcaggaaggcggagcccggctcctgggggcgggcggggcctgagcggggcgggagggccgagcccctcctcccgccccttccccgacctcggcccctccatcagctcccaggcgcccttgcgc

SEQ ID NO: 81006 - DNA, 402 bp, Homo sapiens
  misc_feature 1..402: note = chr17:72848870-72849272
  misc_feature 1..402: note = hyper
  source 1..402: mol_type = genomic DNA
cgggagccctctggcctgcgcctccctcccgccccaatgtggttccccgctgcctagtagcatggtcatgcccggcccccagcccaccacgctggcccgcagacccgcagcatcagcaccactggggagtttgtcagaaatgcagattctcaggtcgcaccccacaccgactggatcggagtcgctgggtatgccgcctggcatctgtattctcacaagctcttcagccgatccttgagcccgctagactgagaagcgctgccccagaccaactgaatctgaattccagaggtgcaaagccaggcgtccgtatttcctaagagcacgatgagggttgagagccaatgtcctgagatcttatgccggggccccaagaggacggggaaacgccaccctggttga

SEQ ID NO: 81007 - DNA, 30 bp, Homo sapiens
  misc_feature 1..30: note = chr17:7285270-7285300
  misc_feature 1..30: note = hypo
  source 1..30: mol_type = genomic DNA
gctgaaatgtctcagcgttaagacgacata

SEQ ID NO: 81008 - DNA, 539 bp, Homo sapiens
  misc_feature 1..539: note = chr17:72855927-72856466
  misc_feature 1..539: note = hyper
  source 1..539: mol_type = genomic DNA
gcatcaggctccccccgcgggaggagggggcgcgagcagcgagagccaccgtcacccgcggctcaaggacactcgcgatgcggcggcggcggcggcggcggcggctccgggcggggacccgcgccacgcctcctggcggccaagctgagcaccacgcacccggcgccccccgccccacgctgccccccgccggcgtccgcggctccggggcccccacccccactcccccaagctgggtcgtgaccccgagtcccgcagtggggggaccaagccagcctggcaggcggccccagtaccatcccaggcccgcccgggggccctgggcgaacccaggtgtcccggacctgcctacctgcccctggcacgctcttattcttcgggagtttagaaacaggctcaaagtcactagcaccgccaagacctggacgggctctgaaatacagccagcggaatggtaccctccccaaataagtgtctttcctcgattttcctgtggcccggggtcagggactgaactaagataacgccaccatccgagg

SEQ ID NO: 81009 - DNA, 1084 bp, Homo sapiens
  misc_feature 1..1084: note = chr17:72856941-72858025
  misc_feature 1..1084: note = hyper
  source 1..1084: mol_type = genomic DNA
tggaaggggaagaagcgggactcgcggcgggggaaggggtctgggcgccgaggcgagtgcgcagcaggtgcccagcagacctagggaaactggggcactgggctggggagccgcacagccccctttcaccttctcgactcctttccaacccctcgctctggtggatcccagccccggcccccactcccggccctgttccccgctctccgccccggcggcttccagcagcaacagtttgggtccgcggcagcccagactcccctggtcccgcggtgctgccgcgccaagcgaaggaggaggagggctcggcgaccctggggacgaacgtcttggacgcttcgcccgcgtccttctctcgcgtccgccgcgcgcctgtctgctcggcctcttcttcgccttctctccggccgcccgggtcaaaacccaaggccaggttcttgagggtccgggtcctccagccgccccctccttgagccccgagagtcctgcgtgggtccaaccccccgggtgtcccgcctctgtctccgccgtccttgctcgcgcgccgcgggaacccagccccaagttggcggcgaagttggtgcccctcgcccgccgctcgccacttaccgaggggaaggggcgctgcgcccgcgacgagagcccgcgccggccgcctccctcgcggtgtctgtcccagagcctcggccccggagggctggcgcgctcagtctcagctccgcgggcgccggagcccgggcgcggcggggcgggggcgggggcgggtggcgcggcctggtccgctggccccgacccgcccctgcgccccgcgaccctcccgaggctcgcacggcgcccggctccgtcccgggctgggctgcgcaccgcgcctcctgctcccagagctcgcagccgactgtgcgggagctctcaccgccgcccgcgagggcccgccccgccggggcccgccacctccgccccggcccggcccggcccgctgcccctcgaggcccctcccgccgcattcccgggcccctctcccctctccggaaccgcgtccccagacctgacactcggggcaagtgcgcctcggaggacacaccag

SEQ ID NO: 81010 - DNA, 50 bp, Homo sapiens
  misc_feature 1..50: note = chr17:72889307-72889357
  misc_feature 1..50: note = hyper
  source 1..50: mol_type = genomic DNA
ccagactctcaggttcggggtgtgaccctccatccttgggtgcggggccc

SEQ ID NO: 81011 - DNA, 663 bp, Homo sapiens
  misc_feature 1..663: note = chr17:72889430-72890093
  misc_feature 1..663: note = hyper
  source 1..663: mol_type = genomic DNA
cgcgccgccacctccgccgcaccccgcccccacccgcagcccggccgggacgccgggtccccgcgttcctcacctgccggcaaggcgaagaggctgagcgcgaggatggcgcagtccacgccgtggcgctcccaccaggagctcgtcctcaccacgtcctgcaccagcacctccagctcccgcagcagcgcctcgcccccacggtgcgcgctccgcgccggttccatgggctccgtaggttccatgggctccgtgggttccatggactctgtgggctcgggcccgacgcgcacggaggactggaggactggggcgtgtgtctgcggtgcaggcgaggcggggcgggccggggcggagtcacgcgccgcctggggacacccgcccccggggtcaaggtgcgagacaccctggctcctctgctgcgggcgctggcgacccaggcccggctcaggcgcgcgaccctggcaggcggcatcagaaccgccgcggagggaggagccaggccgatgagctgagagtggctaggcggggaggcgaccctgcggtgagacccagcccaggtagtagggacggaggcgtcaggggcacggagaccccagtggagacaccccccacccccgccccgccccgagggccttccctgacctccgacctcaaataact

SEQ ID NO: 81012 - DNA, 791 bp, Homo sapiens
  misc_feature 1..791: note = chr17:72919501-72920292
  misc_feature 1..791: note = hyper
  source 1..791: mol_type = genomic DNA
caaaagtgcccaccccggggccgcgcactgtgacgcccagtccggggacagtcagagatctgtcctcactagagcctggggcgctgtggctccgtatttctccacctgtcagtggaacgaaccgagagctggggaggggtgccggagggcggggtgggggagccgtcctgagccccaggacagtggacctaagaaggggcaccgtgaccgaccgcggttcggtcagcgagtgggacgggccaggccgccgccgcctgaacggagtccctcgaccgcactccagcagggggcgctggaggactggcagcggctccgcgtgccgcgtggaacttcgcacccaagccccggagtccaacggagcgcgggccggcggcgggggcgggcagggcggtgggatagaggaaaggggagcttggatcactgcgaggaccgtgggggagaggggaactggggttgccatcccaggcaggagcacaggagcacaggattcagggtgcgccgcggctggagggcgtcagggtgcccgcaggctttttggacgtctcttgagcttagctctcggggctctgggcgcctggaatgctgcgcgccagggcgcggtgggcaccaggggcggggtgccctctaggtgccgcagtgcggggccgcgcccgagcctggccgcaccggggtgacggagtggggtcgcctctcaaagggtaaatatgaatcttgccttatctggctccagcgggctcttccctaaattcaccttggagaaagatggatcatgtgagcgggactgagagctt

SEQ ID NO: 81013 - DNA, 30 bp, Homo sapiens; identical to SEQ ID NO: 36757
  misc_feature 1..30: note = chr17:72920550-72920580
  misc_feature 1..30: note = hyper
  source 1..30: mol_type = genomic DNA

SEQ ID NO: 81014 - DNA, 278 bp, Homo sapiens
  misc_feature 1..278: note = chr17:72920796-72921074
  misc_feature 1..278: note = hyper
  source 1..278: mol_type = genomic DNA
tggaagaagggtggccgcctgctgtcggtgctgctggcggtgaacgtgctgctcctcgcctgcacgctcatcagcggcggagccttcaacaaggtggccgtgtacgacaccgacgtgttcgcgctgctcactgcgatgatgctgctggcaacgctctggatcctcttctacctcctccgaaccgtgcgctgcccctgcgcggtaccctaccgggacgcgcacgctggccccatctggctccgaggtgccaggggaggtgggggcgaggtagggtgggc

SEQ ID NO: 81015 - DNA, 39 bp, Homo sapiens
  misc_feature 1..39: note = chr17:72931909-72931948
  misc_feature 1..39: note = hyper
  source 1..39: mol_type = genomic DNA
cccgagcggcggctgcgcagtcccgctgggggagggcgt

SEQ ID NO: 81016 - DNA, 654 bp, Homo sapiens
  misc_feature 1..654: note = chr17:72932011-72932665
  misc_feature 1..654: note = hyper
  source 1..654: mol_type = genomic DNA
cggcgatgcctctcccggcctcaggtaagcccggagcgccggcggaactttcccagcttgcgcaccccagacactggcacatactacccacccccccaaaaggggggttcacaagtaggggctgcagggattggaacgggaaagcggggtgactgtggagaggtgaactccctttaatctgaggccggcccctccacccgccccgcaacccgcgctccgcgcccctactcctttccgtggacccggggagcacagagggcctcagggcgcgactcctcccggccgggtccacacagcagaaagcgcggaggcctggggtgtgaggttggttggggctgtctggacgcccggtctggggcacgcaggaagcggctgccccggccccgcagtccctaaaatggctcggaaggaaatcccgagggcgcccgcactcagcagcctcctcggagccggccctgcgctgctgggccgggcgccgggcccgacggctccgcggctttcatcgccaatccagccgagacccacaaaccagtccagtgtcccggccctcccttggactggcgtcgcgcccaggggcgtgccagggggcggcagagtactgcttgtcagttccaggtgcccttgccccagccttctgcccgagacccctaaatg

SEQ ID NO: 81017 - DNA, 30 bp, Homo sapiens
  misc_feature 1..30: note = chr17:72937996-72938026
  misc_feature 1..30: note = hypo
  source 1..30: mol_type = genomic DNA
ttccctagtgctcttcggcagctgcacctt

SEQ ID NO: 81018 - DNA, 76 bp, Homo sapiens
  misc_feature 1..76: note = chr17:72950368-72950444
  misc_feature 1..76: note = hypo
  source 1..76: mol_type = genomic DNA
cttgtgaatggtgggcgggtccgtgggcaggttggccagctggtggaagatgctgcgcttgcggatgatggcgtag

SEQ ID NO: 81019 - DNA, 30 bp, Homo sapiens; identical to SEQ ID NO: 45162
  misc_feature 1..30: note = chr17:72969610-72969640
  misc_feature 1..30: note = hypo
  source 1..30: mol_type = genomic DNA

SEQ ID NO: 81020 - DNA, 157 bp, Homo sapiens
  misc_feature 1..157: note = chr17:72971503-72971660
  misc_feature 1..157: note = hypo
  source 1..157: mol_type = genomic DNA
aaagcatcgggattacaagcaggagccaccgtgctcagccttcaaaaagaagaaaaaataataaaggcaagtgaaggtatgaagaaggaggaggagaagaaggagaagaaaagaattgagaactcttgctaaccagccactccgggtgaaattttga

SEQ ID NO: 81021 - DNA, 39 bp, Homo sapiens
  misc_feature 1..39: note = chr17:73031580-73031619
  misc_feature 1..39: note = hypo
  source 1..39: mol_type = genomic DNA
tatgtttcagtctatcgttatgaagttaaacagcagaca

SEQ ID NO: 81022 - DNA, 255 bp, Homo sapiens
  misc_feature 1..255: note = chr17:73073429-73073684
  misc_feature 1..255: note = hyper
  source 1..255: mol_type = genomic DNA
cgcagatgctgtgctcgcgcggcctgtccgagggccgccactaggacgggaggtggaggtgtccaactcgtgggtgtgcctgggcgtcacctacccccgcagctccccgctcggcggccgcccgagccgcagcgtggtctacctgctgggccgcaaccccttctcgtggtgcctggagtgggacgacaacgcgcagaccgtgctgcacggcgcctaccaccgcacgctgggcgtggcgctcgactgcgacgccgg

SEQ ID NO: 81023 - DNA, 24 bp, Homo sapiens
  misc_feature 1..24: note = chr17:73083439-73083463
  misc_feature 1..24: note = hypo
  source 1..24: mol_type = genomic DNA
cgagactcccggccaactgagtac

SEQ ID NO: 81024 - DNA, 504 bp, Homo sapiens
  misc_feature 1..504: note = chr17:73089623-73090127
  misc_feature 1..504: note = hypo
  source 1..504: mol_type = genomic DNA
gtgggccaggagagacggacagcctgctgaccaccaggctccattctgtcccctccccaggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaattgcaatgggagttccaggccagcaacagcgagacctcttggttcccctccatcctcacggctgtgctccacatggcaggtgagcggcctagggaggggccgatgagaaagtcctaggggttgcggggaagccacaacctccctggccttctgattccctctctctgaggccacaggctttgcctcctgggtgaattcctaaggtttcaccagatttcaccaggggcccctggctggaatccagctggactgggctggagccggggagagagtggg

SEQ ID NO: 81025 - DNA, 105 bp, Homo sapiens; identical to SEQ ID NO: 45166
  misc_feature 1..105: note = chr17:73091075-73091180
  misc_feature 1..105: note = hypo
  source 1..105: mol_type = genomic DNA

SEQ ID NO: 81026 - DNA, 30 bp, Homo sapiens; identical to SEQ ID NO: 45167
  misc_feature 1..30: note = chr17:73091437-73091467
  misc_feature 1..30: note = hypo
  source 1..30: mol_type = genomic DNA

SEQ ID NO: 81027 - DNA, 30 bp, Homo sapiens; identical to SEQ ID NO: 45168
  misc_feature 1..30: note = chr17:73124882-73124912
  misc_feature 1..30: note = hypo
  source 1..30: mol_type = genomic DNA

SEQ ID NO: 81028 - DNA, 39 bp, Homo sapiens
  misc_feature 1..39: note = chr17:73128817-73128856
  misc_feature 1..39: note = hypo
  source 1..39: mol_type = genomic DNA
gaacagggccaggtgcggtggctcacgcctataatccca

SEQ ID NO: 81029 - DNA, 120 bp, Homo sapiens
  misc_feature 1..120: note = chr17:73135899-73136019
  misc_feature 1..120: note = hypo
  source 1..120: mol_type = genomic DNA
aagactccgtctcaaaaataaataaatgtctgtccagtcagaagtactccacccacagaggagggaggtttgtttgtttccagcccataatgagataagtacaggaattgagagtaagtg

SEQ ID NO: 81030 - DNA, 25 bp, Homo sapiens
  misc_feature 1..25: note = chr17:73138356-73138381
  misc_feature 1..25: note = hypo
  source 1..25: mol_type = genomic DNA
agaaagcagtagaaccggccgggcc

SEQ ID NO: 81031 - DNA, 35 bp, Homo sapiens
  misc_feature 1..35: note = chr17:73145732-73145767
  misc_feature 1..35: note = hypo
  source 1..35: mol_type = genomic DNA
attacaggcatgagccaccacgcccagccaaaaaa

SEQ ID NO: 81032 - DNA, 35 bp, Homo sapiens
  misc_feature 1..35: note = chr17:73179829-73179864
  misc_feature 1..35: note = hypo
  source 1..35: mol_type = genomic DNA
caggcgtgagccaccgcgcccggcctacagtgtct

SEQ ID NO: 81033 - DNA, 101 bp, Homo sapiens
  misc_feature 1..101: note = chr17:73236201-73236302
  misc_feature 1..101: note = hypo
  source 1..101: mol_type = genomic DNA
gaaagggtggtgagccgagggcgggtggggagggcctgccgctggaacggggcgcagccctccaaggactgcacggaagacagccccggaggcactcattg

SEQ ID NO: 81034 - DNA, 45 bp, Homo sapiens
  misc_feature 1..45: note = chr17:7343074-7343119
  misc_feature 1..45: note = hyper
  source 1..45: mol_type = genomic DNA
ctgctgtccaaggtgcgactgtgcggggggcggcccgcgcggccg

SEQ ID NO: 81035 - DNA, 123 bp, Homo sapiens
  misc_feature 1..123: note = chr17:73464698-73464821
  misc_feature 1..123: note = hypo
  source 1..123: mol_type = genomic DNA
ctgtatctgagccttcgaggctggctcagctttgaaaggcaggggtggaagagacgtggttgctcagcctagggcaccagcatgggtgccaccttgagaggaattgggcggggttttggagtg

SEQ ID NO: 81036 - DNA, 226 bp, Homo sapiens
  misc_feature 1..226: note = chr17:7348747-7348973
  misc_feature 1..226: note = hyper
  source 1..226: mol_type = genomic DNA
ggaggtcaggccagccgaccggccgggggcgtggctttaggcaaggccggaccagggacaggctgggggcggggcctgggacgagaccaggctgagatggaccagcctttggtgaagattggatcgaaatcagaccaatggacaagctctggccgtgggtggtggacgggcctggagtagaactgggtagggtgaaggacggacctgtgatcggaccttaaagtgg

SEQ ID NO: 81037 - DNA, 33 bp, Homo sapiens
  misc_feature 1..33: note = chr17:7349226-7349259
  misc_feature 1..33: note = hyper
  source 1..33: mol_type = genomic DNA
caggtcttaaactaacgccgcttctgggaggtg

SEQ ID NO: 81038 - DNA, 63 bp, Homo sapiens
  misc_feature 1..63: note = chr17:73518223-73518286
  misc_feature 1..63: note = hypo
  source 1..63: mol_type = genomic DNA
gcaccacgcggaggccgcgcagttccaggaagatgtcaacgccgatcccgaggtgcagcggtg

SEQ ID NO: 81039 - DNA, 15 bp, Homo sapiens
  misc_feature 1..15: note = chr17:73522412-73522427
  misc_feature 1..15: note = hyper
  source 1..15: mol_type = genomic DNA
ccgcgggagggactt

SEQ ID NO: 81040 - DNA, 117 bp, Homo sapiens
  misc_feature 1..117: note = chr17:73545911-73546028
  misc_feature 1..117: note = hypo
  source 1..117: mol_type = genomic DNA
cagcctttgcccactcgctccccttccgggacctggaaaggagtcccagagcccaggagagacgggccttctcccctactccaggctaacgttgcagtctggcggcttctgcaaatc

SEQ ID NO: 81041 - DNA, 14 bp, Homo sapiens
  misc_feature 1..14: note = chr17:73584937-73584951
  misc_feature 1..14: note = hyper
  source 1..14: mol_type = genomic DNA
gggctcctcgggac

SEQ ID NO: 81042 - DNA, 559 bp, Homo sapiens
  misc_feature 1..559: note = chr17:73585942-73586501
  misc_feature 1..559: note = hypo
  source 1..559: mol_type = genomic DNA
gctccctccttgccccgactgcacccgacgggccttccctcgacgagagcggctccagcagtgaggcggagttggagaccctcaatgacgagcccccggtgcgctgggcgcagggctcaggcccccacgagggtcctaggcttggcgccgccgtgctgctaccccgactctccttggagacccgcctgcagcaggagggagacccgggcctccgtgggtccctgagggagctgtgggaacccgaggatgaggacgaggcggtgctggagagggacctggagctgagcctccggccgggcctggaggcgccacccttccccggtgccaagggcaggagcctcggagacggcctggaagacatggaggacctggcgcggttgcggttagcgggcgcggtgccaaagctgccatccccggctcacagctcctcatatccaccctgccctcatctttatgaattgcgtgtagacccttattgaatccttagaaggatgggcttgaaccctcctggcaggaaggggcaggtaaggggcaacaggtgctacgtccccaggaccgc

SEQ ID NO: 81043 - DNA, 48 bp, Homo sapiens; identical to SEQ ID NO: 45172
  misc_feature 1..48: note = chr17:73592635-73592683
  misc_feature 1..48: note = hypo
  source 1..48: mol_type = genomic DNA

SEQ ID NO: 81044 - DNA, 79 bp, Homo sapiens
  misc_feature 1..79: note = chr17:73606380-73606459
  misc_feature 1..79: note = hypo
  source 1..79: mol_type = genomic DNA
gctgcctgagctggccgagctggccaaatcccagcagcgttgaccctctcagcccggcctcgcacgggctgtggcttca

SEQ ID NO: 81045 - DNA, 109 bp, Homo sapiens
  misc_feature 1..109: note = chr17:73608267-73608376
  misc_feature 1..109: note = hypo
  source 1..109: mol_type = genomic DNA
tgtctcaccatagagcgttactggagataacagttggtgttattgaatgggagacgttatttagatccacgatgccacacctttgttgtacctgcggtagtgccctgct

SEQ ID NO: 81046 - DNA, 62 bp, Homo sapiens
  misc_feature 1..62: note = chr17:73613362-73613424
  misc_feature 1..62: note = hypo
  source 1..62: mol_type = genomic DNA
accctttcagcagagcgtcgttgtaaggaaccacatttctcctgcgccgtgggcttcactgg

SEQ ID NO: 81047 - DNA, 658 bp, Homo sapiens
  misc_feature 1..658: note = chr17:73615929-73616587
  misc_feature 1..658: note = hypo
  source 1..658: mol_type = genomic DNA
acctcagttcatgcccgatccctgcgcagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggtaagtgtggggcacgggttgagaggccgggcagacagccctcaccgatgctgcatctccctgtccgtcttccctgtgggggcaggggctgggagtttgggccaaatccctggaagtctggggtgctaggtggaggggcaggccagcagggggagcaggtgggcaggcaggacagggaggcacaggcagacttgctgctccaggccctcgcctgcttgcccacaggactccggctatgtcatcgccctgcgcagctacatcactgacaactgcagcctcctcagcttccaccgtggggacctcatcaagctgctgccggtggccaccctggagccaggtatcgccagaggccggcaggggctcacacagggagggcatccacttggcagaggctgcccgggggcagagggtccagtgggtgagccacatccctgggtgccttccaggctggcagtttggctctgccgggggccgttccggactcttt

SEQ ID NO: 81048 - DNA, 30 bp, Homo sapiens; identical to SEQ ID NO: 45176
  misc_feature 1..30: note = chr17:73635801-73635831
  misc_feature 1..30: note = hypo
  source 1..30: mol_type = genomic DNA

SEQ ID NO: 81049 - DNA, 359 bp, Homo sapiens
  misc_feature 1..359: note = chr17:73636032-73636391
  misc_feature 1..359: note = hypo
  source 1..359: mol_type = genomic DNA
tctcactgtcctcaccggcttcctccaccctgagctgtgtcagctgggtggggactgagggccaccactaggtggaagtcaccaggggtgcaatgtgtgagacctgacaaacttgttctgcgggctgcggatgggtgcgagggtggaatctcggtgctgcgacgagtgtggggccagccgtggaggctccaggtgttctctctgccccagcagagcccggcaggagccccaacaggaagccagcgcggcatggctgccaccgacttcgtgcaggagatgcgcgccgtgggcgagaggctgctgctcaagctgcagagactgccccaggctgagcccgtggagatcgtggccttctcagt

SEQ ID NO: 81050 - DNA, 37 bp, Homo sapiens; identical to SEQ ID NO: 16241
  misc_feature 1..37: note = chr17:73638388-73638425
  misc_feature 1..37: note = hypo
  source 1..37: mol_type = genomic DNA

SEQ ID NO: 81051 - DNA, 30 bp, Homo sapiens
  misc_feature 1..30: note = chr17:73639482-73639512
  misc_feature 1..30: note = hypo
  source 1..30: mol_type = genomic DNA
aacaactgctgagtccgcacaggattcggt

SEQ ID NO: 81052 - DNA, 30 bp, Homo sapiens
  misc_feature 1..30: note = chr17:73641552-73641582
  misc_feature 1..30: note = hypo
  source 1..30: mol_type = genomic DNA
tgcttcattggttcccgggatgttaaattc

SEQ ID NO: 81053 - DNA, 275 bp, Homo sapiens
  misc_feature 1..275: note = chr17:7368947-7369222
  misc_feature 1..275: note = hypo
  source 1..275: mol_type = genomic DNA
agccccacccactgccgcccttgttcctatgaccgctgagtgccagcctccagccgctcccccgccagcctggatcactcacctgcgctcccccgtgtgccacacttcatgcttcgtgcggtactccgccagagcaaacactttctcacaatagcggcaggggtacttcctccgccacgagtgtacattgctgtgtctcttcagactggacagggtcacgtaggaacgctcgcaggccgcgcacacatacagcacgtggccgcccaccaccttca

SEQ ID NO: 81054 - DNA, 259 bp, Homo sapiens
  misc_feature 1..259: note = chr17:73690259-73690518
  misc_feature 1..259: note = hypo
  source 1..259: mol_type = genomic DNA
ggctcctgcctcctgcggtcttgcctcggtggctcactgactccagccctgggggttctgagcccagggaccacctggaagcgctgccccagtagtcagtccttcccacccaggcttcctcccagtagggcctttctgctgggagttctgctacaaagcctgttctccttttccagaactaaaggagctaggaatcgttcattctatttgtcttttgaagaaggattgggtgggaacacggtaacgctgagcagcccag

SEQ ID NO: 81055 - DNA, 35 bp, Homo sapiens
  misc_feature 1..35: note = chr17:73693131-73693166
  misc_feature 1..35: note = hypo
  source 1..35: mol_type = genomic DNA
caggtgtgagccaccgcgcccggcccctcctctta

SEQ ID NO: 81056 - DNA, 138 bp, Homo sapiens
  misc_feature 1..138: note = chr17:73719889-73720027
  misc_feature 1..138: note = hypo
  source 1..138: mol_type = genomic DNA
tgctcacctttgccccggccttgcaggcctggatggctctgccgccagcctcttttcttgtccaggcttcaggctgagcatctcttagagggcctcagggatgtccagtcctgccctgaaggccgctgaggacttagg

SEQ ID NO: 81057 - DNA, 30 bp, Homo sapiens
  misc_feature 1..30: note = chr17:73805937-73805967
  misc_feature 1..30: note = hypo
  source 1..30: mol_type = genomic DNA
aaccagcggcgccgccggtccatccgccgt

SEQ ID NO: 81058 - DNA, 30 bp, Homo sapiens
  misc_feature 1..30: note = chr17:73811184-73811214
  misc_feature 1..30: note = hypo
  source 1..30: mol_type = genomic DNA
gaaggggagcctgcccggccttccctcagg

SEQ ID NO: 81059 - DNA, 47 bp, Homo sapiens
  misc_feature 1..47: note = chr17:73879974-73880021
  misc_feature 1..47: note = hypo
  source 1..47: mol_type = genomic DNA
taaacaggccaggtgcggtggctcatctgtgacgaggagtttgagac

SEQ ID NO: 81060 - DNA, 30 bp, Homo sapiens
  misc_feature 1..30: note = chr17:73895697-73895727
  misc_feature 1..30: note = hypo
  source 1..30: mol_type = genomic DNA
ggggaggtagggacacgtcacctgtccttc

SEQ ID NO: 81061 - DNA, 216 bp, Homo sapiens
  misc_feature 1..216: note = chr17:73909942-73910158
  misc_feature 1..216: note = hypo
  source 1..216: mol_type = genomic DNA
ggaggctgggggtgccgggggcaggggcgccatacactcagggagccttgcctggtgcatgtgctgctcctgcttccgcagccgctcctgctgttgctgcaccgcctgcaaccgggcctgctgctctgcctgcacctgctgggcctcgcgcaatgcccgctccccctcctcgtacttctcggaggccacctgcagggaggccgcctgggtcagggc

SEQ ID NO: 81062 - DNA, 110 bp, Homo sapiens
  misc_feature 1..110: note = chr17:73913787-73913897
  misc_feature 1..110: note = hypo
  source 1..110: mol_type = genomic DNA
ggagggccaggaggacgggcctcacctgctccagcagccggctctgctcattcagccgtgcctccatcttcccgatgacctcctgttgccggctccgctcctcctccatg

SEQ ID NO: 81063 - DNA, 30 bp, Homo sapiens; identical to SEQ ID NO: 45180
  misc_feature 1..30: note = chr17:73931814-73931844
  misc_feature 1..30: note = hypo
  source 1..30: mol_type = genomic DNA

SEQ ID NO: 81064 - DNA, 30 bp, Homo sapiens
  misc_feature 1..30: note = chr17:73934350-73934380
  misc_feature 1..30: note = hypo
  source 1..30: mol_type = genomic DNA
gtagctttggctgggcgccatggctcacgc

SEQ ID NO: 81065 - DNA, 149 bp, Homo sapiens
  misc_feature 1..149: note = chr17:73993427-73993576
  misc_feature 1..149: note = hyper
  source 1..149: mol_type = genomic DNA
ccacacccccctccccggcgccaccacagctagtccagaaattcccctgcctcacaagaacccacttcctctcctcccctgtccctcccggcttattgctttatgagccagctagaatcgaggccacaggcagccgttcttcctcctac

SEQ ID NO: 81066 - DNA, 69 bp, Homo sapiens
  misc_feature 1..69: note = chr17:73996851-73996920
  misc_feature 1..69: note = hypo
  source 1..69: mol_type = genomic DNA
tcagaggaggctgagcgtcgtcacacgggccgggctgaggccctgggccctgaccgtgcagcctaagac

SEQ ID NO: 81067 - DNA, 42 bp, Homo sapiens; identical to SEQ ID NO: 45181
  misc_feature 1..42: note = chr17:74005455-74005497
  misc_feature 1..42: note = hypo
  source 1..42: mol_type = genomic DNA

SEQ ID NO: 81068 - DNA, 74 bp, Homo sapiens
  misc_feature 1..74: note = chr17:74028304-74028378
  misc_feature 1..74: note = hypo
  source 1..74: mol_type = genomic DNA
aggttagagatgaaacgatccctggggctgctcaaccctctgccagccatgactttgcgcggcagcttactcac

SEQ ID NO: 81069 - DNA, 154 bp, Homo sapiens
  misc_feature 1..154: note = chr17:74047840-74047994
  misc_feature 1..154: note = hypo
  source 1..154: mol_type = genomic DNA
ctagtaaagcaaacacggccaccattcactcctggaaccaccagagcagcaccatccaatagaactctctgccacgggcaatgtcctctacgtgcaccgtccaatgaacacctgagcactcggaagttttattaatttatctatctttttatta

SEQ ID NO: 81070 - DNA, 30 bp, Homo sapiens; identical to SEQ ID NO: 45183
  misc_feature 1..30: note = chr17:74062044-74062074
  misc_feature 1..30: note = hypo
  source 1..30: mol_type = genomic DNA

SEQ ID NO: 81071 - DNA, 95 bp, Homo sapiens
  misc_feature 1..95: note = chr17:74070385-74070480
  misc_feature 1..95: note = hyper
  source 1..95: mol_type = genomic DNA
gactccggggcccctcatccgcctccgccccgcgtttcctccccccgatctcccaggggtcctcttttgagggcaccccagcccctcgacggtcc

SEQ ID NO: 81072 - DNA, 1020 bp, Homo sapiens
  misc_feature 1..1020: note = chr17:74070709-74071729
  misc_feature 1..1020: note = hyper
  source 1..1020: mol_type = genomic DNA
cgcgccgggaccactccgcagcccttcccccagcgccgccggccgctgctggggacaacctcgccctcctgtctcttgctcctcctcctgaccccagcgcacccccatccccgccccagatgaggcaaggctccctccgccttcagcccggcagagtcgcactaggagttgcagcggccgcagccccgggagcttcccgctcgcggagacccagacggctgcaggagcccgggcagcctcggggtcagcggcaccatgaacgtctcgggctgcccaggggccgggaacgcgagccaggcgggcggcgggggaggctggcaccccgaggcggtcatcgtgcccctgctcttcgcgctcatcttcctcgtgggcaccgtgggcaacacgctggtgctggcggtgctgctgcgcggcggccaggcggtcagcactaccaacctgttcatccttaacctgggcgtggccgacctgtgtttcatcctgtgctgcgtgcccttccaggccaccatctacaccctggacggctgggtgttcggctcgctgctgtgcaaggcggtgcacttcctcatcttcctcaccatgcacgccagcagcttcacgctggccgccgtctccctggacaggtgagccagcgccttggcctccctgggagatgggcatccacgcgggggatggagcgggaggcgggactggggaccaagaagggacgcgcagagtgggacaggacactaagaaggcagtggaagacaagcgggcgcggaggaggaaaaagaggaataagaatgggggaccgtggtgtccctcggttagatgcgtcctggggcctggaagcctggagaatgtggctctccagcgccgcccgtgcctgacaacgcgcagcgtttcccagtacgacgcgtttgtgcgcgttcatctcgcttgagcttaatgccctccgtgagggtgggataggacaaagtgcccaatatacagaagagttgagttcctaagtaactcgctcagagtcgccagccagggatc

SEQ ID NO: 81073 - DNA, 17 bp, Homo sapiens
  misc_feature 1..17: note = chr17:74072049-74072066
  misc_feature 1..17: note = hyper
  source 1..17: mol_type = genomic DNA
cgcgggactcaggtgga

SEQ ID NO: 81074 - DNA, 103 bp, Homo sapiens; identical to SEQ ID NO: 36765
  misc_feature 1..103: note = chr17:74072477-74072580
  misc_feature 1..103: note = hyper
  source 1..103: mol_type = genomic DNA

SEQ ID NO: 81075 - DNA, 473 bp, Homo sapiens
  misc_feature 1..473: note = chr17:74072998-74073471
  misc_feature 1..473: note = hyper
  source 1..473: mol_type = genomic DNA
cgtcgacccggtggccgcgggctcgggtgcccggcgcgccaagcgcaaggtgacacgcatgatcctcatcgtggccgcgctcttctgcctctgctggatgccccaccacgcgctcatcctctgcgtgtggttcggccagttcccgctcacgcgcgccacttatgcgcttcgcatcctctcgcacctggtctcctacgccaactcctgcgtcaaccccatcgtttacgcgctggtctccaagcacttccgcaaaggcttccgcacgatctgcgcgggcctgctgggccgtgccccaggccgagcctcgggccgtgtgtgcgctgccgcgcggggcacccacagtggcagcgtgttggagcgcgagtccagcgacctgttgcacatgagcgaggcggcgggggcccttcgtccctgccccggcgcttcccagccatgcatcctcgagccctgtcctggcccgtcctggcagggcc

SEQ ID NO: 81076 - DNA, 30 bp, Homo sapiens
  misc_feature 1..30: note = chr17:74076403-74076433
  misc_feature 1..30: note = hyper
  source 1..30: mol_type = genomic DNA
acctggccctcgccacggagaccaactgca

SEQ ID NO: 81077 - DNA, 30 bp, Homo sapiens
  misc_feature 1..30: note = chr17:74081696-74081726
  misc_feature 1..30: note = hypo
  source 1..30: mol_type = genomic DNA
gcacagctgcacagccgaggggaaggtgag

SEQ ID NO: 81078 - DNA, 193 bp, Homo sapiens
  misc_feature 1..193: note = chr17:74117868-74118061
  misc_feature 1..193: note = hyper
  source 1..193: mol_type = genomic DNA
gcatccagagggtcccgggaacgcgacctgggggttggacaggaaaccaggggtcggggcagcctgctgggggcgtctcgtgccccccaccctccattcctctgaaccagtccggaaggggggttcggctggcaagccgcggtggcgtcagcctctggcacccgctgctgcccggcccgtggctccaggcaac

SEQ ID NO: 81079 - DNA, 183 bp, Homo sapiens
  misc_feature 1..183: note = chr17:74128189-74128372
  misc_feature 1..183: note = hypo
  source 1..183: mol_type = genomic DNA
ctactttcctgggagcgcgggtcctggggctcagacctctctgtcctcagaacagggtggtgcggcccaagggcaggtgaggggctggtgggagtcagttcagggctgtactggaaggctatcaggggccagtagggagaccctcatccccgacagccccttccgttacggtcccccaacctc

SEQ ID NO: 81080 - DNA, 146 bp, Homo sapiens; identical to SEQ ID NO: 36768
  misc_feature 1..146: note = chr17:74136296-74136442
  misc_feature 1..146: note = hyper
  source 1..146: mol_type = genomic DNA

SEQ ID NO: 81081 - DNA, 176 bp, Homo sapiens
  misc_feature 1..176: note = chr17:74136570-74136746
  misc_feature 1..176: note = hyper
  source 1..176: mol_type = genomic DNA
cgttacacggcctcccggacgcgcgcttccatctcgcgaccccgggggcgcctcctccgaataagtatgtggtgcctgcgaggaccacggtgggagctgagcactaccccacccccgaggggacagtgtgtgtacggggacgccctctctaacatcatccccgcagctggggagga

SEQ ID NO: 81082 - DNA, 74 bp, Homo sapiens
  misc_feature 1..74: note = chr17:74172769-74172843
  misc_feature 1..74: note = hypo
  source 1..74: mol_type = genomic DNA
ccagcagaggagcagcgtggcagaagagcagcgcggtagggcaaagaggagccccgaggcggagctgggccttg

SEQ ID NO: 81083 - DNA, 37 bp, Homo sapiens
  misc_feature 1..37: note = chr17:74187103-74187140
  misc_feature 1..37: note = hypo
  source 1..37: mol_type = genomic DNA
aaaaagaaaaaaaaaaaagttacgatatggattagca

SEQ ID NO: 81084 - DNA, 30 bp, Homo sapiens
  misc_feature 1..30: note = chr17:7419628-7419658
  misc_feature 1..30: note = hypo
  source 1..30: mol_type = genomic DNA
aatgcccacctatggcggtgcaagagaacc

SEQ ID NO: 81085 - DNA, 74 bp, Homo sapiens
  misc_feature 1..74: note = chr17:74269861-74269935
  misc_feature 1..74: note = hypo
  source 1..74: mol_type = genomic DNA
cggcccagctggtcccggggccaggagtctccctgtccccagtgcagtgtccagccctccgaagccccggcgcc

SEQ ID NO: 81086 - DNA, 37 bp, Homo sapiens
  misc_feature 1..37: note = chr17:74299237-74299274
  misc_feature 1..37: note = hypo
  source 1..37: mol_type = genomic DNA
tacaggctggagccaccgcgcccggcccctcttgcaa

SEQ ID NO: 81087 - DNA, 22 bp, Homo sapiens
  misc_feature 1..22: note = chr17:74299969-74299991
  misc_feature 1..22: note = hypo
  source 1..22: mol_type = genomic DNA
aaaaagtcgccaccagcaaagg

SEQ ID NO: 81088 - DNA, 30 bp, Homo sapiens; identical to SEQ ID NO: 45185
  misc_feature 1..30: note = chr17:74362291-74362321
  misc_feature 1..30: note = hypo
  source 1..30: mol_type = genomic DNA

SEQ ID NO: 81089 - DNA, 68 bp, Homo sapiens
  misc_feature 1..68: note = chr17:74378890-74378958
  misc_feature 1..68: note = hyper
  source 1..68: mol_type = genomic DNA
cgcagccagtaccctcgaaggctgagatctcggggagcacagcctccgattcgcgttttctaggcacc

SEQ ID NO: 81090 - DNA, 96 bp, Homo sapiens
  misc_feature 1..96: note = chr17:74390363-74390459
  misc_feature 1..96: note = hypo
  source 1..96: mol_type = genomic DNA
gcatagtgcttggctcgatgcacaggcccagtaagggactgcggagtcaacaaggtggcaggcaaacgggcttgcctgttccggaaggatgcactc

SEQ ID NO: 81091 - DNA, 38 bp, Homo sapiens
  misc_feature 1..38: note = chr17:74459661-74459699
  misc_feature 1..38: note = hypo
  source 1..38: mol_type = genomic DNA
ttacaggtgtgagccaccgtgcccggccttttctggaa

SEQ ID NO: 81092 - DNA, 70 bp, Homo sapiens
  misc_feature 1..70: note = chr17:74533488-74533558
  misc_feature 1..70: note = hyper
  source 1..70: mol_type = genomic DNA
ggatggccacccccacgtcctcgcagttggcatagagccgggcccacatagcctgcaccgccttcctctc

SEQ ID NO: 81093 - DNA, 689 bp, Homo sapiens
  misc_feature 1..689: note = chr17:74533674-74534363
  misc_feature 1..689: note = hyper
  source 1..689: mol_type = genomic DNA
cgcggggcgcggggcgcggggcgccgggagccggggccggctgcgtgcgcggcgggcgggcgaggggtagagcgcggagggagggagcgtgtgtctgtgcgcgccgggtgtgtgtgtgtgtgtgcgtgcgtgtgtgcagggtatatgtgcggggggcgggggacagccagcggtggggcggggatgtggtctgctggaaaatgtttaaaaaaacaaatccgctccaaacccccagccccgtgtgggtaagagccaatgccggcaaggtgaaggctgcgcggggtgggggcgacgcgactgccgcccgcccacccgcaggccacggcggagttgcaccgcggggcggggctcgggtaggtgtggccggggcgctgggggtcccgggaggaatgggcggtcacgcggcgctgggcggcgcgggccgcacaggagtgcgctggggcgggcgcgggccgggagcgctgggttccgggtcccagtgcttgcggcgtcgcgagtgtgcgcgtgcggacccttcccgcggcggggaactgactcaaagtccaacactcccgagctttcgcggcgaggccgaccgccagcccgcccgtgggggcgaacaggagcccctccggcggccgccgtggacctagctgggctcccctcgcccgggcctctccccgcgcccccgagccagccgctgggggccg

SEQ ID NO: 81094 - DNA, 46 bp, Homo sapiens; identical to SEQ ID NO: 36774
  misc_feature 1..46: note = chr17:74534387-74534433
  misc_feature 1..46: note = hyper
  source 1..46: mol_type = genomic DNA

SEQ ID NO: 81095 - DNA, 190 bp, Homo sapiens
  misc_feature 1..190: note = chr17:745634-745824
  misc_feature 1..190: note = hypo
  source 1..190: mol_type = genomic DNA
agtgctgcacatggccgggagcccgggtccggctgtgggctgcagttccgtgatcccggcggggaaggccacgtgggttactggggaggatgaaggatgaacacggggccgcgtctcacatgcaacccaccttcgaagacgccaaccagaggcacctacggcacatcccgagacacgtgggggcccgtct

SEQ ID NO: 81096 - DNA, 658 bp, Homo sapiens
  misc_feature 1..658: note = chr17:74581043-74581701
  misc_feature 1..658: note = hyper
  source 1..658: mol_type = genomic DNA
ccacctgctagaggccggctcccaggttctcctcgtgggacacccaggaaagtgcctagggaggaggagggagtggagcgcaggacgcggcgcggggaggagaacgcggatggagccaggagtcacccctctttccctcgggcgcccgcctcttcgcggatcgcgcccgcactgggcttatccagacacggcgagcggaagccggggagaagggagcgggcgcggggcggacagagaccgcagcgggcgggaaaggcgactggccgcggcccgacggagggtccccgcgaagttggaaaccggagacttgggcccctgcccaaaaagcagaatctgacgttaccgagggagagttcccgacaaaaaaggaagtttttatctgcttcggggacccagccagatttcgacaatagaaagtgtacttatcaggccggggaggacttcaccaacaaggggcaccggggcgggtcgccagtgcacaggggcgaggtcttccttggacccaggcaaaggccgcggggtccgggcagcgcgaggtcaaggctgggagagggttctggcgacaaagggccgcggccgagtcctcgctgagagctgccccagaggggtccacgcggaggttgggctgagggctgcgggccgccggggagccctgggc

SEQ ID NO: 81097 - DNA, 30 bp, Homo sapiens
  misc_feature 1..30: note = chr17:7460469-7460499
  misc_feature 1..30: note = hypo
  source 1..30: mol_type = genomic DNA
ggtgtgctggccctgcgctgcctggaggaa

SEQ ID NO: 81098 - DNA, 30 bp, Homo sapiens
  misc_feature 1..30: note = chr17:74636168-74636198
  misc_feature 1..30: note = hypo
  source 1..30: mol_type = genomic DNA
tcctttctaggatcacgtctcccactgccc

SEQ ID NO: 81099 - DNA, 270 bp, Homo sapiens
  misc_feature 1..270: note = chr17:7466705-7466975
  misc_feature 1..270: note = hypo
  source 1..270: mol_type = genomic DNA
ctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctcca

SEQ ID NO: 81100 - DNA, 35 bp, Homo sapiens
  misc_feature 1..35: note = chr17:74823893-74823928
  misc_feature 1..35: note = hypo
  source 1..35: mol_type = genomic DNA
ggccctttgccgtgccgtgccgtgccgtgccatgc

SEQ ID NO: 81101 - DNA, 43 bp, Homo sapiens
  misc_feature 1..43: note = chr17:74835961-74836004
  misc_feature 1..43: note = hyper
  source 1..43: mol_type = genomic DNA
gctggctgctggctgcggtgttggacagcgcctcctaggaggc

SEQ ID NO: 81102 - DNA, 38 bp, Homo sapiens
  misc_feature 1..38: note = chr17:74854240-74854278
  misc_feature 1..38: note = hypo
  source 1..38: mol_type = genomic DNA
acaaaaattaataaaataaaattcgaagatccccccaa

SEQ ID NO: 81103 - DNA, 425 bp, Homo sapiens
  misc_feature 1..425: note = chr17:74864643-74865068
  misc_feature 1..425: note = hyper
  source 1..425: mol_type = genomic DNA
cgcggggctgaggatcggcgcggcccggaggcgctggggaccggggcgcgggcccggggccgcctttagccggcaccgagggcgcggggccggggatgagggcgcccgccgcggggagcccgtctgcgcgccgcggcaccttcccgcccagcgagcgagcccgagcaggcagacgcgcggccggcggtctgggggcgcgccgcctcccggtccccaaaatgtgaagcggggagggcggagacgcagagacggcccggccgggcgccctcgccgccctccggcagccgcgccgctccctccgctgcacgcccaggcctgagcagcgaggccaccgggccgcgcgctcccagcttcgctcggacgcggcttcggcccgcagagggttcgtggcccggacgcggcgagagctgggcccaggacggtgc

SEQ ID NO: 81104 - DNA, 225 bp, Homo sapiens
  misc_feature 1..225: note = chr17:74865069-74865294
  misc_feature 1..225: note = hyper
  source 1..225: mol_type = genomic DNA
tccggcctcgcccgcggctgctcgcaccaacaagtttgaacaatgatcaccgtcaaccccgatgggaagataatggtcagaagatgcctggtcaccctgagaccctttcggtaaagttccctcctggttggttttttccccaggggggcgccgggtggaggtgggcgaggtcggttcctgcgaacgttcaagtcctggtggcagagggggcggttcacacttcaa

SEQ ID NO: 81105 - DNA, 800 bp, Homo sapiens
  misc_feature 1..800: note = chr17:74865520-74866320
  misc_feature 1..800: note = hyper
  source 1..800: mol_type = genomic DNA
tcctcaccccgcggacggtcccatccgggtggcaaagttagtgtgcggcgccttggagctccccctccggtccctcccgtcccgcccgtctgcccctaggtcggctaccccccaacccctccgcctgtgccaccctctccccagcctttggtggcactgctctcctccccgcggggctcgggcctggctccgacgagagggtcccgagattagagcgaggactcgctcatcccaggattcgcccccgatcgcaggcgtcggagaggcgggggcaggggcggcgctgcagggctacggggcggctggagccgaggctgcggcggagcgtggtgggcgggcggtggcgaaggcgacacgcttcgggcggccaacacctgggggcccaggccaggcagggctggggccgcgcgggactcactggacccagccaggggcccccagggcccagcggtgccggggcagccccctctcctcccaggcatccgcggaaccggcccgcagcggggtggggagggggcgctgcccagtggacgcccggcggggcccgagtgtcaccccgtgggtagctgggcagcgaggaagctgggggagtgaccgccccggcgcgggggccggactcgggacgtggccacaggtgggctccgggcgcgggaaggagcccgagaaggcggagcttgcaggggccctgaactcttgccctccaggtctcggcccagccccactgtggtccccctgccggctccagacggggatgggggcggggagacggtggctcacctggagcccgcctcccagcacac

SEQ ID NO: 81106 - DNA, 84 bp, Homo sapiens
  misc_feature 1..84: note = chr17:74908730-74908814
  misc_feature 1..84: note = hypo
  source 1..84: mol_type = genomic DNA
ggctcactggagtgacgtttggggcaatgtgcaggatctacatctggctttgctgctgcaagatgcttccggggtgagggaggt

SEQ ID NO: 81107 - DNA, 30 bp, Homo sapiens
  misc_feature 1..30: note = chr17:7491930-7491960
  misc_feature 1..30: note = hypo
  source 1..30: mol_type = genomic DNA
gcagacagggtagagcgtgccacccaccca

SEQ ID NO: 81108 - DNA, 52 bp, Homo sapiens
  misc_feature 1..52: note = chr17:74920557-74920609
  misc_feature 1..52: note = hypo
  source 1..52: mol_type = genomic DNA
tggcctgcagcagctcgcggcctcagccagccctgggcgccaggagctcagt

SEQ ID NO: 81109 - DNA, 33 bp, Homo sapiens
  misc_feature 1..33: note = chr17:7493033-7493066
  misc_feature 1..33: note = hypo
  source 1..33: mol_type = genomic DNA
cccctcaacgtgaagcgtcgatcctgaaaatgg

SEQ ID NO: 81110 - DNA, 506 bp, Homo sapiens
  misc_feature 1..506: note = chr17:74965247-74965753
  misc_feature 1..506: note = hyper
  source 1..506: mol_type = genomic DNA
gctccgggtcacctgcggtgttgatgaggtattcaagaggaaaaagcgccggagcggcagcttcatttgcaagggaaatgacttgacgaggcccttcatttgcatctttcggcccagaggttctgattagctgcggaggaaaagcccgcctgttttatgcatgaggagctctgcctggagaccctcggctgctcacccgccccagccctgccttctcctcctaagtcggggaggaggagaggggtccccagagggcaggatccaaggctgaagcctaagaccaacccttggtggtgaaaatagaaatttcttgaggcaaggctgccataaagtgcagtgagactcatcggtgaggggggcactgtgcgatctccatccggggtcttcagggcaattgcatgagctcagcctgctaagagcctggcaggcagcgcgagctcccctggagttccggccgctccgcccagtggctctgtgcagcgcttcccgcccggagaacctagtgc

SEQ ID NO: 81111 - DNA, 18 bp, Homo sapiens
  misc_feature 1..18: note = chr17:75047191-75047209
  misc_feature 1..18: note = hypo
  source 1..18: mol_type = genomic DNA
aatcatccgcttggccgg

SEQ ID NO: 81112 - DNA, 291 bp, Homo sapiens
  misc_feature 1..291: note = chr17:75049728-75050019
  misc_feature 1..291: note = hypo
  source 1..291: mol_type = genomic DNA
agccaccaccacttccgtcatggtcggtatcatatagcggggcagagattgggctttggagcccagagaggcctgtgttcaaatcgactctgctctgacttgtggtgtggacttggccgcgggactgagcgcggggcctgctcaggggccagcgtcacagggaagacagtccgagcaagcatgggtcagggcgctgaggcttcctcctgcgagccaaagggaaactcagccacggggactcagggaggcctgtggggcaagtctgagcctccctctcggtggccagtgggc

SEQ ID NO: 81113 - DNA, 30 bp, Homo sapiens
  misc_feature 1..30: note = chr17:75054527-75054557
  misc_feature 1..30: note = hypo
  source 1..30: mol_type = genomic DNA
cgtgcttagacttgccgtataagtactcat

SEQ ID NO: 81114 - DNA, 30 bp, Homo sapiens; identical to SEQ ID NO: 45189
  misc_feature 1..30: note = chr17:75207839-75207869
  misc_feature 1..30: note = hypo
  source 1..30: mol_type = genomic DNA

SEQ ID NO: 81115 - DNA, 30 bp, Homo sapiens
  misc_feature 1..30: note = chr17:75326544-75326574
  misc_feature 1..30: note = hypo
  source 1..30: mol_type = genomic DNA
tgctcttggcgatggcgtggactcagccag

SEQ ID NO: 81116 - DNA, 187 bp, Homo sapiens; identical to SEQ ID NO: 36780
  misc_feature 1..187: note = chr17:75368715-75368902
  misc_feature 1..187: note = hyper
  source 1..187: mol_type = genomic DNA

SEQ ID NO: 81117 - DNA, 188 bp, Homo sapiens; identical to SEQ ID NO: 12903
  misc_feature 1..188: note = chr17:75368903-75369091
  misc_feature 1..188: note = hyper
  source 1..188: mol_type = genomic DNA

SEQ ID NO: 81118 - DNA, 366 bp, Homo sapiens; identical to SEQ ID NO: 36782
  misc_feature 1..366: note = chr17:75369092-75369458
  misc_feature 1..366: note = hyper
  source 1..366: mol_type = genomic DNA

SEQ ID NO: 81119 - DNA, 418 bp, Homo sapiens
  misc_feature 1..418: note = chr17:75369492-75369910
  misc_feature 1..418: note = hyper
  source 1..418: mol_type = genomic DNA
cgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaaggtgggtgctgggctggctgctgcggccgcggacgtgctggagaggaccctgcgggtgggcctggcgcgggacgggggtgcgctgaggggagacgggagtgcgctgaggggagacgggacccctaatccaggcgccctcccgctgagagcgccgcgcgcccccggccccgtgcccgcgccgcctacgtgggggaccctgttaggggcacccgcgtagaccctgcgcgccctcacaggaccctgtgctcgttctgcgcactgccgcctgggtttcctt

SEQ ID NO: 81120 - DNA, 157 bp, Homo sapiens
  misc_feature 1..157: note = chr17:75370185-75370342
  misc_feature 1..157: note = hyper
  source 1..157: mol_type = genomic DNA
cgtgggccgggagcaccgaacggacacagcccaggtcgtggcagggtctagagtgggatgtcccatggcccccatccaggcctggggatatcctcatccgcctcccagaatcgggccgtgggggacagaaggggcctgcgtgcgggcagggagagta

SEQ ID NO: 81121 - DNA, 253 bp, Homo sapiens
  misc_feature 1..253: note = chr17:75370564-75370817
  misc_feature 1..253: note = hyper
  source 1..253: mol_type = genomic DNA
agggcttctgaggggcgggcctgcctctgccgggacctggagcccccgcccctcggagaggctcctaggctgacttgggcagagccctctggtgggccgggagggggaaaggctgtgttgaaatgagcaaactgtccaggtgtcaggccaagctgggaggtgaccagcctgaggtcctccccgctccatggccagaaccagggctgacatctgggtgtcctgagcccagctgcccacacggcccacctggggt

SEQ ID NO: 81122 - DNA, 30 bp, Homo sapiens
  misc_feature 1..30: note = chr17:75385196-75385226
  misc_feature 1..30: note = hyper
  source 1..30: mol_type = genomic DNA
catgggaagaagcaccgagcagccttgctg

SEQ ID NO: 81123 - DNA, 30 bp, Homo sapiens
  misc_feature 1..30: note = chr17:75411816-75411846
  misc_feature 1..30: note = hypo
  source 1..30: mol_type = genomic DNA
cctgtctggagctgacgtgcgaccaaggca

SEQ ID NO: 81124 - DNA, 30 bp, Homo sapiens
  misc_feature 1..30: note = chr17:75413782-75413812
  misc_feature 1..30: note = hypo
  source 1..30: mol_type = genomic DNA
ttcacaaatgtttgccgtcttttctgtcta

SEQ ID NO: 81125 - DNA, 265 bp, Homo sapiens
  misc_feature 1..265: note = chr17:75447462-75447727
  misc_feature 1..265: note = hyper
  source 1..265: mol_type = genomic DNA
tccctacctctgccccgcgctctgggaggctccttgttccgcgaccacaaagcccctttgatcctctgctcggctctgagccatgtgacccggtgggcgggccgcggctctcggcgcgtccagcgcagcccgacgttccgctgctggggtgagtcctgctcctttgttcttcccagccttgcaccactggctcgggggctctcaggtggcgcggccgcgaggcggaccctgatggccatggtggcggtgccgggagccacgctgt

SEQ ID NO: 81126 - DNA, 257 bp, Homo sapiens
  misc_feature 1..257: note = chr17:75523015-75523272
  misc_feature 1..257: note = hypo
  source 1..257: mol_type = genomic DNA
cctgggctcgggctgcgagcagccattttggaacatgtgaaacggattttaaattccctctttgcagtttgagaagatggcggcctgaaccggagtccttcttcccctcctccctctccgctgctgcaatgcccaggccccccgcaacgttcctcgtctgtaatggtgccagaggctttaaatcttgcagaagccacatctgctgcctgcaggtaaacctccctggctgagcccactgcgcacgcctccacgttctg

SEQ ID NO: 81127 - DNA, 419 bp, Homo sapiens
  misc_feature 1..419: note = chr17:75524585-75525004
  misc_feature 1..419: note = hyper
  source 1..419: mol_type = genomic DNA
cccccgaccccctctcgtggtcgccagggtaggggtgggaggaatctggaagccacgtgcgatgctcggagctgcgtcctctgtcctggggcgtgggtccgcgagcgccgcgcagcctcccggaccgccctgagctgctgcgcccggcgctgctcctccttccccagctccgcgccttcccctcgcgatccccctcctgcctcttcggtcctggaagcgtcccaagatggggtgggggcatggagggagagaggggaggagggagctgcccgggggcagtgccgccaggaagtgggacggggactctggcgcccctccaggctgctgcgcgcgggctggggaccgtgcaccgctttgcgcgccagacgatgcatcttctggaacggcagctgaggcaatgcggggtgtgaagtggcggc

SEQ ID NO: 81128 - DNA, 189 bp, Homo sapiens
  misc_feature 1..189: note = chr17:75525005-75525194
  misc_feature 1..189: note = hyper
  source 1..189: mol_type = genomic DNA
ggcagaggggctcgcaggggctgggatccgcgtgcccctctctgcctcggtgcggagcacgatgtgcccgggcgggggcgaggacgtccgggaggggctgggctgcgcacgctcgcggggccgtcgcagatgggcggtttggaggcgctgcagtccctgggaaatgggagcctccgtcctgttctctct

SEQ ID NO: 81129 - DNA, 102 bp, Homo sapiens
  misc_feature 1..102: note = chr17:75544144-75544246
  misc_feature 1..102: note = hypo
  source 1..102: mol_type = genomic DNA
caggcgtgagccaccgcacccggccaagctggatcttaagcttgcttaccggtgacttgttgacctcatcttggctcaaagaagacacggccccaggtgagt

SEQ ID NO: 81130 - DNA, 202 bp, Homo sapiens
  misc_feature 1..202: note = chr17:7554591-7554793
  misc_feature 1..202: note = hyper
  source 1..202: mol_type = genomic DNA
agcaccccttttcatcgcagttggggggcctaggatcggtgcatcttccgccgcgctgccagcaccccgcagcgcgtggtcgtgcaccccggaatctgcagcagctgcatatctgaggggggtctcctttgcccgcgccgccttcgctccccgtgcttttgggtgtgtggagggcttcagcgcgcggcgcccccgcttctcc

SEQ ID NO: 81131 - DNA, 33 bp, Homo sapiens
  misc_feature 1..33: note = chr17:75548384-75548417
  misc_feature 1..33: note = hypo
  source 1..33: mol_type = genomic DNA
tagaatttgtaacatcgacgagtgcaaacctga

SEQ ID NO: 81132 - DNA, 66 bp, Homo sapiens
  misc_feature 1..66: note = chr17:7555185-7555251
  misc_feature 1..66: note = hyper
  source 1..66: mol_type = genomic DNA
gggggtcgccagctccgcctgcgtgtccgcgccggcgctcacactccctctcggggcctgtccgct

SEQ ID NO: 81133 - DNA, 79 bp, Homo sapiens
  misc_feature 1..79: note = chr17:75557167-75557246
  misc_feature 1..79: note = hypo
  source 1..79: mol_type = genomic DNA
tttgaatttcaaagacgttcaaatccccatctggctgttacacttttaggctattgagagtgaaaacaagcactgacat

SEQ ID NO: 81134 - DNA, 30 bp, Homo sapiens
  misc_feature 1..30: note = chr17:75587520-75587550
  misc_feature 1..30: note = hypo
  source 1..30: mol_type = genomic DNA
agtgccccggattggcgcatctgaagctga

SEQ ID NO: 81135 - DNA, 56 bp, Homo sapiens; identical to SEQ ID NO: 45192
  misc_feature 1..56: note = chr17:75630378-75630434
  misc_feature 1..56: note = hypo
  source 1..56: mol_type = genomic DNA

SEQ ID NO: 81136 - DNA, 41 bp, Homo sapiens; identical to SEQ ID NO: 45193
  misc_feature 1..41: note = chr17:75733967-75734008
  misc_feature 1..41: note = hypo
  source 1..41: mol_type = genomic DNA

SEQ ID NO: 81137 - DNA, 30 bp, Homo sapiens
  misc_feature 1..30: note = chr17:75748192-75748222
  misc_feature 1..30: note = hypo
  source 1..30: mol_type = genomic DNA
ttccattcccacagtcgctttgggtggcca

SEQ ID NO: 81138 - DNA, 33 bp, Homo sapiens; identical to SEQ ID NO: 45194
  misc_feature 1..33: note = chr17:75770731-75770764
  misc_feature 1..33: note = hypo
  source 1..33: mol_type = genomic DNA

SEQ ID NO: 81139 - DNA, 30 bp, Homo sapiens
  misc_feature 1..30: note = chr17:75792358-75792388
  misc_feature 1..30: note = hypo
  source 1..30: mol_type = genomic DNA
tgatggagtacgtgtcggccctgaagcggg

SEQ ID NO: 81140 - DNA, 30 bp, Homo sapiens
  misc_feature 1..30: note = chr17:75797195-75797225
  misc_feature 1..30: note = hypo
  source 1..30: mol_type = genomic DNA
ttcctgaccagatgacgccaacaactgtaa

SEQ ID NO: 81141 - DNA, 30 bp, Homo sapiens; identical to SEQ ID NO: 45195
  misc_feature 1..30: note = chr17:75840791-75840821
  misc_feature 1..30: note = hypo
  source 1..30: mol_type = genomic DNA

SEQ ID NO: 81142 - DNA, 30 bp, Homo sapiens
  misc_feature 1..30: note = chr17:75849397-75849427
  misc_feature 1..30: note = hypo
  source 1..30: mol_type = genomic DNA
cccccagactccaaacgttcccagccaagc

SEQ ID NO: 81143 - DNA, 91 bp, Homo sapiens
  misc_feature 1..91: note = chr17:75893341-75893432
  misc_feature 1..91: note = hypo
  source 1..91: mol_type = genomic DNA
catgagaccctacctcggcctctccttctcgctgagacatctcctccctccctggtcctccaccttcaggtcctcacggctgagagcccct

SEQ ID NO: 81144 - DNA, 30 bp, Homo sapiens
  misc_feature 1..30: note = chr17:75895459-75895489
  misc_feature 1..30: note = hypo
  source 1..30: mol_type = genomic DNA
aggttgaatgctcagcgacttcgggaatgc

SEQ ID NO: 81145 - DNA, 43 bp, Homo sapiens; identical to SEQ ID NO: 45196
  misc_feature 1..43: note = chr17:75905178-75905221
  misc_feature 1..43: note = hypo
  source 1..43: mol_type = genomic DNA

SEQ ID NO: 81146 - DNA, 30 bp, Homo sapiens
  misc_feature 1..30: note = chr17:75925908-75925938
  misc_feature 1..30: note = hypo
  source 1..30: mol_type = genomic DNA
gatcttccaaagccccgaactgctccgtag

SEQ ID NO: 81147 - DNA, 30 bp, Homo sapiens
  misc_feature 1..30: note = chr17:75927761-75927791
  misc_feature 1..30: note = hypo
  source 1..30: mol_type = genomic DNA
gcagcagggaagaggcgggtccaggccctg

SEQ ID NO: 81148 - DNA, 238 bp, Homo sapiens
  misc_feature 1..238: note = chr17:75953744-75953982
  misc_feature 1..238: note = hyper
  source 1..238: mol_type = genomic DNA
gctagcctgcttctgcgaccttgcatgaaaatggagaaaattcttggtttcaaaatcttctcctggcttgaaccgaaagttaaaaagggacttttcgaattgcacattgcgcctgaccttacctaccactaatgaataatggatatcgaggagccgtggaatggaggatcacggcggcgtacggagcaccggggaggaatcgtggggtgcgtaggcgccggagcgcccgggttcggcc

SEQ ID NO: 81149 - DNA, 57 bp, Homo sapiens
  misc_feature 1..57: note = chr17:75955156-75955213
  misc_feature 1..57: note = hyper
  source 1..57: mol_type = genomic DNA
actcgcccgcgccgccgccgcagccgccgccgccgcccgcgccgggacctgagtccg

SEQ ID NO: 81150 - DNA, 79 bp, Homo sapiens; identical to SEQ ID NO: 45197
  misc_feature 1..79: note = chr17:76021242-76021321
  misc_feature 1..79: note = hypo
  source 1..79: mol_type = genomic DNA

SEQ ID NO: 81151 - DNA, 27 bp, Homo sapiens
  misc_feature 1..27: note = chr17:76026881-76026908
  misc_feature 1..27: note = hypo
  source 1..27: mol_type = genomic DNA
tagaaatgcaaattccggccgggcatg

SEQ ID NO: 81152 - DNA, 30 bp, Homo sapiens
  misc_feature 1..30: note = chr17:76034067-76034097
  misc_feature 1..30: note = hypo
  source 1..30: mol_type = genomic DNA
aaacagatgtatacacggagagttgcagat

SEQ ID NO: 81153 - DNA, 30 bp, Homo sapiens
  misc_feature 1..30: note = chr17:76073363-76073393
  misc_feature 1..30: note = hypo
  source 1..30: mol_type = genomic DNA
gggtgggattgcctccgggctgggcatgca

SEQ ID NO: 81154 - DNA, 30 bp, Homo sapiens
  misc_feature 1..30: note = chr17:7608216-7608246
  misc_feature 1..30: note = hyper
  source 1..30: mol_type = genomic DNA
gagcctttctggattcgagagaggaagatt

SEQ ID NO: 81155 - DNA, 97 bp, Homo sapiens
  misc_feature 1..97: note = chr17:7608731-7608828
  misc_feature 1..97: note = hyper
  source 1..97: mol_type = genomic DNA
tctggtggggctgagcgctctgccgcgggggcgcgggcacagcaggaagcaggtccgcgtgggcgctgggggcatcagctaccggggtggtccgggc

SEQ ID NO: 81156 - DNA, 205 bp, Homo sapiens
  misc_feature 1..205: note = chr17:76098484-76098689
  misc_feature 1..205: note = hypo
  source 1..205: mol_type = genomic DNA
agaagtggggagggccgcactatccactggcacggggccttgtcaaccaggttctcccctcttgttgcaggttctgcctggagcaccgacacctcaggaagaaccagcagctggctcgttcttcgaaacctcactccccaggtgcaatatggtgcccctgcatcactgagcatgatccagggagggttcccgcttggcccccaat

SEQ ID NO: 81157 - DNA, 91 bp, Homo sapiens
  misc_feature 1..91: note = chr17:76101037-76101128
  misc_feature 1..91: note = hypo
  source 1..91: mol_type = genomic DNA
gtccaggactgaagacgaaccttggccgcagtccttgcgaactgttcgcaaaacagtgcgggctgcggtgggtcagcgtcacatgctaatg

SEQ ID NO: 81158 - DNA, 34 bp, Homo sapiens
  misc_feature 1..34: note = chr17:76123797-76123831
  misc_feature 1..34: note = hyper
  source 1..34: mol_type = genomic DNA
ctcagggctcaaagtcggccgggttgaagggcgc

SEQ ID NO: 81159 - DNA, 30 bp, Homo sapiens
  misc_feature 1..30: note = chr17:76131445-76131475
  misc_feature 1..30: note = hypo
  source 1..30: mol_type = genomic DNA
aaccctcacgtgacccgtgaagtccagacc

SEQ ID NO: 81160 - DNA, 92 bp, Homo sapiens; identical to SEQ ID NO: 45199
  misc_feature 1..92: note = chr17:76134317-76134409
  misc_feature 1..92: note = hypo
  source 1..92: mol_type = genomic DNA

SEQ ID NO: 81161 - DNA, 122 bp, Homo sapiens
  misc_feature 1..122: note = chr17:76134633-76134755
  misc_feature 1..122: note = hypo
  source 1..122: mol_type = genomic DNA
cacttggccatctctcgccagcatccactcctcctgggactgcggcctcttcaccaactactcagcaccctggcaagtggtcccggagctggtggcccttgggctcccgcccattggccagc

SEQ ID NO: 81162 - DNA, 87 bp, Homo sapiens
  misc_feature 1..87: note = chr17:76135474-76135561
  misc_feature 1..87: note = hypo
  source 1..87: mol_type = genomic DNA
aggaagagaacagctcgggctcctgagaccaggagccagacctggtaagtacatgaccttaggggctgggcctttgcctgtaatccc

SEQ ID NO: 81163 - DNA, 87 bp, Homo sapiens
  misc_feature 1..87: note = chr17:76136101-76136188
  misc_feature 1..87: note = hypo
  source 1..87: mol_type = genomic DNA
aacaagagcaaaactccgtctcaaaaaaggaaaaaaggataacatggctgagtgcagtggctcacgccgaggcgtgaagagtgcttg

SEQ ID NO: 81164 - DNA, 333 bp, Homo sapiens
  misc_feature 1..333: note = chr17:76137857-76138190
  misc_feature 1..333: note = hypo
  source 1..333: mol_type = genomic DNA
tcagcctctccctggcgggaatcctctccgtccagtcttctaacctagcagcctcacgtccacagagctgccttgtgaaactcagcagagccctggcttcctgcagagccgtgttctcccagcctgcttcatggctccctggttgagccaagcttgcggatccgtggggtgaaggtacccgcaccgcctgggccttagtggtatgtacgggcctgcatcgtgagcagcgggcgggggcccaggcaggtgaggcagctggccacaagggcagggcccggcccccctcccaaggctgtgtctgatattcttgagcctgttcgagtttccttttcc

SEQ ID NO: 81165 - DNA, 120 bp, Homo sapiens
  misc_feature 1..120: note = chr17:76138614-76138734
  misc_feature 1..120: note = hypo
  source 1..120: mol_type = genomic DNA
gttcaccaacaaacacgattcagtgctgctagtgctgggtcctgttctgggggctggtgatgaggccaagagggaaagagggagctctgtgttccatcgagggggcgacaagcctggacc

SEQ ID NO: 81166 - DNA, 19 bp, Homo sapiens
  misc_feature 1..19: note = chr17:76146895-76146914
  misc_feature 1..19: note = hypo
  source 1..19: mol_type = genomic DNA
agcctacactccaaacggc

SEQ ID NO: 81167 - DNA, 39 bp, Homo sapiens
  misc_feature 1..39: note = chr17:76211240-76211279
  misc_feature 1..39: note = hypo
  source 1..39: mol_type = genomic DNA
tgcacttcacactttcggaggctgaggcgggcggatcac

SEQ ID NO: 81168 - DNA, 99 bp, Homo sapiens
  misc_feature 1..99: note = chr17:76211519-76211618
  misc_feature 1..99: note = hypo
  source 1..99: mol_type = genomic DNA
aaaaagaaagaaagcatatacttcagtgttgttctggatttttttcttcaagatgcctagttaatgacaatgaaattctgtactcggatggtatctgtc

SEQ ID NO: 81169 - DNA, 89 bp, Homo sapiens
  misc_feature 1..89: note = chr17:76211992-76212081
  misc_feature 1..89: note = hypo
  source 1..89: mol_type = genomic DNA
gtcccttggggaacccggggcaataatgcccttctctgcccttaatccttacagtgggccgggcacggtggcttacgcctgtaatacca

SEQ ID NO: 81170 - DNA, 58 bp, Homo sapiens
  misc_feature 1..58: note = chr17:7621433-7621491
  misc_feature 1..58: note = hyper
  source 1..58: mol_type = genomic DNA
tactgctggcccctgcggtatttcctagtactagagtgagccccgacttagcagagca

SEQ ID NO: 81171 - DNA, 55 bp, Homo sapiens
  misc_feature 1..55: note = chr17:76217079-76217134
  misc_feature 1..55: note = hypo
  source 1..55: mol_type = genomic DNA
gtggaagctgaggcccggccatccagggcgatgcattgggcgctgattcttgttc

SEQ ID NO: 81172 - DNA, 413 bp, Homo sapiens
  misc_feature 1..413: note = chr17:76227749-76228162
  misc_feature 1..413: note = hyper
  source 1..413: mol_type = genomic DNA
tggctgctgaggagccgggggttcagggaaattaaggaacgtgcccagggacccggggccagcccgtggggacgctgggattggagcccaagccccaggttcgccgcgcggctctcgacttcctctcctttcccccaggggcgagctcagcgaccgcagagaggtggggtcgatctccctgcgaccccagggggcccgcgaggccagtgcgcgggcaggagcggggacgtgctcagaagagccgggcgccgccgcgcccgcccgccccccgtcccccggctcccggctccgcgcgccccccgccgcccccggggccctgctacccccgacccgtcccctcccgccggccgcccccatggcccggctgggcgcgctgctcctggccgccgccctgggtgcactgctcagcttcg

SEQ ID NO: 81173 - DNA, 161 bp, Homo sapiens
  misc_feature 1..161: note = chr17:76228213-76228374
  misc_feature 1..161: note = hyper
  source 1..161: mol_type = genomic DNA
cggacgccggcaatggcagcgcctggcccgggcgcgcagagctgctctcctcgcactcggggctctggcgcatctgcgaaggtaaccggccaccgcgccggccctcctccctccgcgacctcgtccctccgacacccccttaaccccgccctgctcgtgtt

SEQ ID NO: 81174 - DNA, 18 bp, Homo sapiens
  misc_feature 1..18: note = chr17:76254836-76254854
  misc_feature 1..18: note = hyper
  source 1..18: mol_type = genomic DNA
cgccggggaggctgctgc

SEQ ID NO: 81175 - DNA, 125 bp, Homo sapiens; identical to SEQ ID NO: 45208
  misc_feature 1..125: note = chr17:76395588-76395713
  misc_feature 1..125: note = hypo
  source 1..125: mol_type = genomic DNA

SEQ ID NO: 81176 - DNA, 66 bp, Homo sapiens
  misc_feature 1..66: note = chr17:76396807-76396873
  misc_feature 1..66: note = hypo
  source 1..66: mol_type = genomic DNA
tcctgcaggactgtgcggagattgccgacttcttcacggagctggtggacgcggtgggggatgtgt

SEQ ID NO: 81177 - DNA, 44 bp, Homo sapiens; identical to SEQ ID NO: 45209
  misc_feature 1..44: note = chr17:76404759-76404803
  misc_feature 1..44: note = hypo
  source 1..44: mol_type = genomic DNA

SEQ ID NO: 81178 - DNA, 35 bp, Homo sapiens
  misc_feature 1..35: note = chr17:76405095-76405130
  misc_feature 1..35: note = hypo
  source 1..35: mol_type = genomic DNA
ggttgccagtaagctcgcttcgaggtcttgagagg

SEQ ID NO: 81179 - DNA, 114 bp, Homo sapiens
  misc_feature 1..114: note = chr17:76419325-76419439
  misc_feature 1..114: note = hypo
  source 1..114: mol_type = genomic DNA
tggccacctcactgccgtgtcctgcatcagcccagccacagagtcctacaggtccggggcttgcttgtgggaacggcttgttcttctagactctgggggcgggggcttgggtgt

SEQ ID NO: 81180 - DNA, 23 bp, Homo sapiens
  misc_feature 1..23: note = chr17:76441957-76441980
  misc_feature 1..23: note = hypo
  source 1..23: mol_type = genomic DNA
attgaccattttggccgggcaca

SEQ ID NO: 81181 - DNA, 165 bp, Homo sapiens
  misc_feature 1..165: note = chr17:76455024-76455189
  misc_feature 1..165: note = hypo
  source 1..165: mol_type = genomic DNA
ggcagcgcgagcaagcggctctggtgtttcgcagggacgggagcgagccggcacttacggcaatcttgtttttgatccgggacagcttctcttgtgcctctgccagctctgcattagcctcctccagtgcctgcctcttgggcgccacgtcgcagtagacctcgt

SEQ ID NO: 81182 - DNA, 30 bp, Homo sapiens
  misc_feature 1..30: note = chr17:76458828-76458858
  misc_feature 1..30: note = hypo
  source 1..30: mol_type = genomic DNA
ccagtgtgaccagcccgtggatgcctgtga

SEQ ID NO: 81183 - DNA, 94 bp, Homo sapiens
  misc_feature 1..94: note = chr17:76490678-76490772
  misc_feature 1..94: note = hypo
  source 1..94: mol_type = genomic DNA
tcaaaattcaggtcccgtttccgaggcacgtccagagccgggaagaggtccccgatcagtcccatgaatacgggcaggtcgtctgtcacaatct

SEQ ID NO: 81184 - DNA, 83 bp, Homo sapiens
  misc_feature 1..83: note = chr17:76498516-76498599
  misc_feature 1..83: note = hypo
  source 1..83: mol_type = genomic DNA
tttggcctgtggaaacgacggttttgcggggctcagcctccgagaagaagccgctccaggtactcgcccggcaggtttcagaa

SEQ ID NO: 81185 - DNA, 71 bp, Homo sapiens
  misc_feature 1..71: note = chr17:76498901-76498972
  misc_feature 1..71: note = hypo
  source 1..71: mol_type = genomic DNA
gaacgcaaagaaactcgccccttatctcagccacgaggcgccgccgagcccccacccgcctcagacctggg

SEQ ID NO: 81186 - DNA, 329 bp, Homo sapiens
  misc_feature 1..329: note = chr17:76501454-76501783
  misc_feature 1..329: note = hypo
  source 1..329: mol_type = genomic DNA
gtttgtcactggcatcgagccggaacttcagtttacacaggctatcgaagagtttggacaggtggcggctcacctgggaggaggcaagaagcgggaattatgcaacgggggatttgaaaggcatgtgcgtggcttgggctttccgtgggtggttttaggcatcgttctttttggaatatactccccatctttgatcaacgttgactaaacatgactaagtcaacaaaaggaaccagcgaagactgctctgagtcaggacacagaaaccaggccaggaaccgcagcccttctaagccaaacatccattctggaagatttctttttggtgg

SEQ ID NO: 81187 - DNA, 66 bp, Homo sapiens
  misc_feature 1..66: note = chr17:76526194-76526260
  misc_feature 1..66: note = hypo
  source 1..66: mol_type = genomic DNA
gacagagcaggtgctcggtacaccgggtttggagaagggataatgtttgctcgcagcccggtgaca

SEQ ID NO: 81188 - DNA, 63 bp, Homo sapiens
  misc_feature 1..63: note = chr17:76526566-76526629
  misc_feature 1..63: note = hypo
  source 1..63: mol_type = genomic DNA
cctcatacagcttctcgtaggagtcgatctggaaaacacggccaccggcggcctgtcatagcc

SEQ ID NO: 81189 - DNA, 86 bp, Homo sapiens
  misc_feature 1..86: note = chr17:76557425-76557511
  misc_feature 1..86: note = hypo
  source 1..86: mol_type = genomic DNA
ctgcagccgtccctgcgtccaccgtgaagcctccccggcccctggctgtccaggagacttggccaagtgcacgcaacagtggctca

SEQ ID NO: 81190 - DNA, 30 bp, Homo sapiens
  misc_feature 1..30: note = chr17:76562886-76562916
  misc_feature 1..30: note = hypo
  source 1..30: mol_type = genomic DNA
cctgctgagaggactcgggactgaggcgca

SEQ ID NO: 81191 - DNA, 109 bp, Homo sapiens
  misc_feature 1..109: note = chr17:76670709-76670818
  misc_feature 1..109: note = hypo
  source 1..109: mol_type = genomic DNA
ggccctgtgaaaacccgcagctcctccacctgcctcctcagggctgcgccctgcaccgccctggtccagggtcctgtggaggggcggggcgagacggccagacagccag

SEQ ID NO: 81192 - DNA, 172 bp, Homo sapiens
  misc_feature 1..172: note = chr17:76676165-76676337
  misc_feature 1..172: note = hypo
  source 1..172: mol_type = genomic DNA
agcacagaagagatgcgggcggcatgtttaaccactaagatgatcaacacctggtgaggtgagggctgcaccaggcgcgcactgccctttctcagcagtcacttacttaatgcacttaatccactcctccttctcctcgggcgtcggagctgagatccggtaaacagtgtgg

SEQ ID NO: 81193 - DNA, 30 bp, Homo sapiens
  misc_feature 1..30: note = chr17:76702385-76702415
  misc_feature 1..30: note = hypo
  source 1..30: mol_type = genomic DNA
ccccagcaaccacctcggaggcagcactgt

SEQ ID NO: 81194 - DNA, 21 bp, Homo sapiens
  misc_feature 1..21: note = chr17:76779848-76779869
  misc_feature 1..21: note = hypo
  source 1..21: mol_type = genomic DNA
ccaccacgcctggctggattc

SEQ ID NO: 81195 - DNA, 185 bp, Homo sapiens
  misc_feature 1..185: note = chr17:76897086-76897271
  misc_feature 1..185: note = hypo
  source 1..185: mol_type = genomic DNA
ctgtggtgcccaggacgccggcaggcacagcgccacgtccacgggcaccgcccgttcccaccctgcaggacgccacagcatcagacgagacggcccgtgtgaagcgccgagaacagagtctggcttccgggagggctcaggaaatgccgagagctcggcagagacacccacgtggtgctggattc

SEQ ID NO: 81196 - DNA, 30 bp, Homo sapiens
  misc_feature 1..30: note = chr17:76932264-76932294
  misc_feature 1..30: note = hypo
  source 1..30: mol_type = genomic DNA
gactcactgctactccgatgattggaaaca

SEQ ID NO: 81197 - DNA, 33 bp, Homo sapiens; identical to SEQ ID NO: 45218
  misc_feature 1..33: note = chr17:76958740-76958773
  misc_feature 1..33: note = hypo
  source 1..33: mol_type = genomic DNA

SEQ ID NO: 81198 - DNA, 36 bp, Homo sapiens
  misc_feature 1..36: note = chr17:76967407-76967443
  misc_feature 1..36: note = hyper
  source 1..36: mol_type = genomic DNA
atcccagagcaacctcgagggcgtcctggtgcttac

SEQ ID NO: 81199 - DNA, 30 bp, Homo sapiens
  misc_feature 1..30: note = chr17:76970826-76970856
  misc_feature 1..30: note = hypo
  source 1..30: mol_type = genomic DNA
ccagggacttgcagtcggccagtgaggcct

SEQ ID NO: 81200 - DNA, 36 bp, Homo sapiens
  misc_feature 1..36: note = chr17:76972067-76972103
  misc_feature 1..36: note = hypo
  source 1..36: mol_type = genomic DNA
ccagagcctgggtggcgttctcgaagcccagggccc

SEQ ID NO: 81201 - DNA, 374 bp, Homo sapiens
  misc_feature 1..374: note = chr17:76974125-76974499
  misc_feature 1..374: note = hypo
  source 1..374: mol_type = genomic DNA
atggtttctctggctcggtaagaatcctgtgatacctgacactgtcccctcagttcagcaagcctggggcaggcctctgggtggcactgctgtgggcaccggctgggagtctgggcctggtgaccttgaggctgcttggagggggcctggtggacggctgcaatggcatccccagagcttgtcggaaatgcagtcatggctggccttgccctagcccctctgcatgggagtctgcatgaacaagcgccctgggagctgggtgcactggctggtgagcagctttgctctgggactcgtgctcgctggcactgtgcagccaccccttgtcggggctccccgggcaccactggaggccttaccgtgaccctgagaac

SEQ ID NO: 81202 - DNA, 30 bp, Homo sapiens
  misc_feature 1..30: note = chr17:76975153-76975183
  misc_feature 1..30: note = hypo
  source 1..30: mol_type = genomic DNA
aaggggggggggcaacgaagcacctggcag

SEQ ID NO: 81203 - DNA, 38 bp, Homo sapiens
  misc_feature 1..38: note = chr17:76975538-76975576
  misc_feature 1..38: note = hypo
  source 1..38: mol_type = genomic DNA
gaggggtgccctggccgggcgcggtggctcacacctgt

SEQ ID NO: 81204 - DNA, 190 bp, Homo sapiens
  misc_feature 1..190: note = chr17:76991522-76991712
  misc_feature 1..190: note = hypo
  source 1..190: mol_type = genomic DNA
tgatccccaactccccgctcctcaagctgtaaccccaaccttaggattatccttaaaggctagaaaagctgaaaagtgacagcactctgaaggggcacgtgtgtcccaggggagtgcgggtgctgccctcggccacacctgaggtctcaccgagcatcactctaactccagtggccggagaggggcttgg

SEQ ID NO: 81205 - DNA, 61 bp, Homo sapiens
  misc_feature 1..61: note = chr17:76993358-76993419
  misc_feature 1..61: note = hypo
  source 1..61: mol_type = genomic DNA
ctgtgtccaggtctgcgataactgcgattcgataccgaatcccagccggtgtcctttgtgg

SEQ ID NO: 81206 - DNA, 85 bp, Homo sapiens
  misc_feature 1..85: note = chr17:76996482-76996567
  misc_feature 1..85: note = hypo
  source 1..85: mol_type = genomic DNA
ctcaccatgccatgccggctgcctccctccacccctcctgcctctccgcccctgacactcccataccccccgccatgaagttgcc

SEQ ID NO: 81207 - DNA, 62 bp, Homo sapiens
  misc_feature 1..62: note = chr17:76996979-76997041
  misc_feature 1..62: note = hypo
  source 1..62: mol_type = genomic DNA
agccccagcacctgacgcactgccaggcagggagcagacagtctgcacgcattggctgaagg

SEQ ID NO: 81208 - DNA, 30 bp, Homo sapiens; identical to SEQ ID NO: 45221
  misc_feature 1..30: note = chr17:76997571-76997601
  misc_feature 1..30: note = hypo
  source 1..30: mol_type = genomic DNA

SEQ ID NO: 81209 - DNA, 526 bp, Homo sapiens
  misc_feature 1..526: note = chr17:77002640-77003166
  misc_feature 1..526: note = hypo
  source 1..526: mol_type = genomic DNA
tgtctatggtgtgggcgcacagcttcagaaccctctacggtttgcagttactgccttgtaaagaggctgtgtctgcttaatttgtatcatcgatgttacacctggaggaattttagccaaaaggcgaccttctcagttgaaaggcacattccaaatggcaccacacatctgggaaggtgtccttttccagagtgtgtgaaaataacgggatgggatcatcgccccatggacctggatcagggctgccttccacaccgcggtggcacctgcacgagcccacctgcttactgccaccttctctcctcacgctttcctccaggctcggctcccgggacacaaaggccgaatcgccaggactttcactcaacccggcaacaccctcagagccattctggggggtcccagtctcacctctgccccactcccacatggtggcatcacgcactgtcttaagtcttaagccagacttcaacgccttcttcacttcccataaaaccatcccagaggaacgcggggagcagcgtcc

SEQ ID NO: 81210 - DNA, 69 bp, Homo sapiens
  misc_feature 1..69: note = chr17:77020197-77020266
  misc_feature 1..69: note = hyper
  source 1..69: mol_type = genomic DNA
cggctgctgtttggacgaaaagcgctgggggtgttggaggctcctcgctgctcacatctggctgggctt

SEQ ID NO: 81211 - DNA, 113 bp, Homo sapiens
  misc_feature 1..113: note = chr17:77020313-77020426
  misc_feature 1..113: note = hyper
  source 1..113: mol_type = genomic DNA
cgagaaaccgcgcttccgcttctggtcgcagagacctcggagaccgcgccggggagacggaggtgctgtgggtgggggggacctgtggctgctcgtaccgccccccaccctcc

SEQ ID NO: 81212 - DNA, 30 bp, Homo sapiens
  misc_feature 1..30: note = chr17:77084562-77084592
  misc_feature 1..30: note = hypo
  source 1..30: mol_type = genomic DNA
ggctccccagcccaccgccatgcagggctc

SEQ ID NO: 81213 - DNA, 203 bp, Homo sapiens
  misc_feature 1..203: note = chr17:77104080-77104283
  misc_feature 1..203: note = hypo
  source 1..203: mol_type = genomic DNA
tttattggcttccttcgccttcccgcctcaattccatgctgccccttaggggttttgggagatcatctcccaaatacaccctgtgcatttgaatctttggctctgggcctcctgacactcccagtggacagctggagaccacacacggagaacccctcctcagaggccatgtggcttctgggacaggacgccagccgaaggta

SEQ ID NO: 81214 - DNA, 235 bp, Homo sapiens
  misc_feature 1..235: note = chr17:77104986-77105221
  misc_feature 1..235: note = hypo
  source 1..235: mol_type = genomic DNA
gggctgtggagcacacgtgtccacgttcctgatgcagctctgtcccctgcgttgaacagcgaggatgcagcacacaccccacagcgtgggaaccgctgtcccgatgctcacctgggcatgcgctgcaggacctgtctcagcagacgcgccatgtggtatgctgtcccaattccgacaagcatgtgttctgagctgtacgtgttcccaaggtgtgaggctccgggtggatcctgca

SEQ ID NO: 81215 - DNA, 30 bp, Homo sapiens
  misc_feature 1..30: note = chr17:77114143-77114173
  misc_feature 1..30: note = hypo
  source 1..30: mol_type = genomic DNA
cctgggcaacccagccgtgccctgctccct

SEQ ID NO: 81216 - DNA, 48 bp, Homo sapiens
  misc_feature 1..48: note = chr17:77126443-77126491
  misc_feature 1..48: note = hypo
  source 1..48: mol_type = genomic DNA
gggtgagcagggctccgaggcccacagtcacttcgcaagccaacaacc

SEQ ID NO: 81217 - DNA, 30 bp, Homo sapiens; identical to SEQ ID NO: 45226
  misc_feature 1..30: note = chr17:77126850-77126880
  misc_feature 1..30: note = hypo
  source 1..30: mol_type = genomic DNA

SEQ ID NO: 81218 - DNA, 53 bp, Homo sapiens
  misc_feature 1..53: note = chr17:77127124-77127177
  misc_feature 1..53: note = hypo
  source 1..53: mol_type = genomic DNA
tgtacttgtgtgtaccgtgagccatgtgctgcgtgtcccgtgtgtgctgtgtg

SEQ ID NO: 81219 - DNA, 30 bp, Homo sapiens
  misc_feature 1..30: note = chr17:77135204-77135234
  misc_feature 1..30: note = hypo
  source 1..30: mol_type = genomic DNA
cagcacatgcgttcacggtcctgccttggc

SEQ ID NO: 81220 - DNA, 72 bp, Homo sapiens; identical to SEQ ID NO: 45228
  misc_feature 1..72: note = chr17:77135878-77135950
  misc_feature 1..72: note = hypo
  source 1..72: mol_type = genomic DNA

SEQ ID NO: 81221 - DNA, 212 bp, Homo sapiens
  misc_feature 1..212: note = chr17:77143891-77144103
  misc_feature 1..212: note = hypo
  source 1..212: mol_type = genomic DNA
gcaagctttgccaagcgccttcgatccagcctctctctcatgctaatgactgtcaacatgaaacagaggctgtgaaggggaagaaaattactccctgaaaaggaattgactgatccccatcatttctcaaggaatcactgacctgtgaatatttcattacccaaaatgctgcaccatccatccagagccgccgctgccgtggggccccgggg

SEQ ID NO: 81222 - DNA, 154 bp, Homo sapiens; identical to SEQ ID NO: 45230
  misc_feature 1..154: note = chr17:77145129-77145283
  misc_feature 1..154: note = hypo
  source 1..154: mol_type = genomic DNA

SEQ ID NO: 81223 - DNA, 233 bp, Homo sapiens
  misc_feature 1..233: note = chr17:77147053-77147286
  misc_feature 1..233: note = hypo
  source 1..233: mol_type = genomic DNA
tgctggtggccgccccgctgctgtgcggctctcaccagggcaaggccacctccccagtccacgctccgcaagtgctcagcacacacacatccctccaccatgctgggccctggactctcagaaccacaataaatgcagctcttggcgcagattctgggtttgatcctcgcgctgctccccctactcggggcaagcaacaaagccggcatcagaccctgcgtgctgaccacccc

SEQ ID NO: 81224 - DNA, 182 bp, Homo sapiens
  misc_feature 1..182: note = chr17:77174854-77175036
  misc_feature 1..182: note = hypo
  source 1..182: mol_type = genomic DNA
cccagggagtgagggcgcaggaccgctgcgtgggttcattcagaataaacatcacccgacctcaactacttgtctggttaaattctccagtgaacaggacaatttttcggatgtggctgcagccagcagaccagacctgggcagcaatggatgctgccgcgggtgcacgagctgctgttcag

SEQ ID NO: 81225 - DNA, 292 bp, Homo sapiens
  misc_feature 1..292: note = chr17:77178580-77178872
  misc_feature 1..292: note = hyper
  source 1..292: mol_type = genomic DNA
cgcattgggtggcagcgcaggacccccgtcccctcccccaacgccccggccggccggcgggcaggcggctgctgatgctctgtgcgcacctccccacggggcatcctggggatctggtggctcagagtcgccgactttcctgcccccacccaaccccaactcgccagccggagcttcctgcgcagcccccaagattgcaaaagtctggccccagccccctccccggccagagctcctggggcctccctcgccaggcgggtggcccacctcccccgcctccccggaggcccgg

SEQ ID NO: 81226 - DNA, 102 bp, Homo sapiens; identical to SEQ ID NO: 4505
  misc_feature 1..102: note = chr17:77178962-77179064
  misc_feature 1..102: note = hyper
  source 1..102: mol_type = genomic DNA

SEQ ID NO: 81227 - DNA, 249 bp, Homo sapiens; identical to SEQ ID NO: 4506
  misc_feature 1..249: note = chr17:77179081-77179330
  misc_feature 1..249: note = hyper
  source 1..249: mol_type = genomic DNA

SEQ ID NO: 81228 - DNA, 75 bp, Homo sapiens; identical to SEQ ID NO: 4507
  misc_feature 1..75: note = chr17:77179380-77179455
  misc_feature 1..75: note = hyper
  source 1..75: mol_type = genomic DNA

SEQ ID NO: 81229 - DNA, 27 bp, Homo sapiens
  misc_feature 1..27: note = chr17:77179456-77179483
  misc_feature 1..27: note = hyper
  source 1..27: mol_type = genomic DNA
gcaggggggcgcccggcggcggctctg

SEQ ID NO: 81230 - DNA, 92 bp, Homo sapiens; identical to SEQ ID NO: 4509
  misc_feature 1..92: note = chr17:77179617-77179709
  misc_feature 1..92: note = hyper
  source 1..92: mol_type = genomic DNA

SEQ ID NO: 81231 - DNA, 67 bp, Homo sapiens; identical to SEQ ID NO: 36799
  misc_feature 1..67: note = chr17:77179710-77179777
  misc_feature 1..67: note = hyper
  source 1..67: mol_type = genomic DNA

SEQ ID NO: 81232 - DNA, 443 bp, Homo sapiens
  misc_feature 1..443: note = chr17:77179799-77180242
  misc_feature 1..443: note = hyper
  source 1..443: mol_type = genomic DNA
cgtgtgcgcgcgtgtgtagcggtgggagggggagtccctggcgtactccaacatcaaacggagccccgcgcggagggaagagaatccggagcgacggcacaacagctgatcccacacttaacccctcgcccgccggcaccggggcagccctccctcgcgccctcccacgctcgggcccctgcgcgcccctcctcccccccgttgccagcacttgctcctggcctggggggtctggaatctccctttgcccccgctccgttctccggccgctgcggagaggaggagccgctccgccggctctgcggccgaccgaccggaaggcgcctcgtcctgtttcgcgttcagagaagcgcctttcctaagggaggccggctcagtggcggggatgtcggtgatgtaatccgagggcatctacgcagaggcttccgcgctggggaaggctt

SEQ ID NO: 81233 - DNA, 211 bp, Homo sapiens
  misc_feature 1..211: note = chr17:77188723-77188934
  misc_feature 1..211: note = hyper
  source 1..211: mol_type = genomic DNA
gagagctggaaggaccgggcacgagagtgagaccgtcagcaccagggacagctccagccagaccctggagccgccgtggctgcctacacctctgtctccctgggcccaaacaagcacgggtgtcagtgaactctctgttttgcaggggtggccagcggctagccctgctgatggccaccttttaccaaaacatcctcgcctgttgagttag

SEQ ID NO: 81234 - DNA, 65 bp, Homo sapiens
  misc_feature 1..65: note = chr17:77200378-77200443
  misc_feature 1..65: note = hypo
  source 1..65: mol_type = genomic DNA
gcgggcgccggggagcgggtacacaccagcgggtgccggggagcagggggcgtaggtggggttgg

SEQ ID NO: 81235 - DNA, 179 bp, Homo sapiens
  misc_feature 1..179: note = chr17:77216294-77216473
  misc_feature 1..179: note = hyper
  source 1..179: mol_type = genomic DNA
tccacagcaggctcccggggaggaggggaggagacccaatcagggaagcggccgctggcggcaggttggtgggggtaggggcttggtcccccaacgctggcactcagtttagctgtcacttgcagctgtcttaggaagtgcggctctcctctctgcctcccgctcgctcctgctcactc

SEQ ID NO: 81236 - DNA, 198 bp, Homo sapiens
  misc_feature 1..198: note = chr17:77240121-77240319
  misc_feature 1..198: note = hypo
  source 1..198: mol_type = genomic DNA
tgaaggagataccaccgcacagggcagaatggtgtccccagagtccatgtccatccggaaccttatttggaaacaggttctttgcaaatgtaattagtgaagatgaggtcatagtggaacagactgggccctacatccaatgcccggggtcctcatcagttgaggagaggacacagagagacacgcattgggtgaggg

SEQ ID NO: 81237 - DNA, 93 bp, Homo sapiens
  misc_feature 1..93: note = chr17:7727249-7727342
  misc_feature 1..93: note = hypo
  source 1..93: mol_type = genomic DNA
accaaccttggctcccgcttcatcgagccgcctgtgctgaatatgaagtcggtcggtggctcggcttccttgtccccacggcccatgggtctt

SEQ ID NO: 81238 - DNA, 143 bp, Homo sapiens
  misc_feature 1..143: note = chr17:77290782-77290925
  misc_feature 1..143: note = hyper
  source 1..143: mol_type = genomic DNA
cacgcggccgaactccggactgggggccacgtggaggaggccttggttcagctctgccccatgcctcacgggacacacatttatcacctggaaacagcggccagtgctcaggaaggctcatgccattgcggatctgccttcat

SEQ ID NO: 81239 - DNA, 30 bp, Homo sapiens
  misc_feature 1..30: note = chr17:77306065-77306095
  misc_feature 1..30: note = hypo
  source 1..30: mol_type = genomic DNA
ttcatttgtgcacaacgccctaaaacggaa

SEQ ID NO: 81240 - DNA, 40 bp, Homo sapiens
  misc_feature 1..40: note = chr17:77356491-77356531
  misc_feature 1..40: note = hypo
  source 1..40: mol_type = genomic DNA
gctgctcaccagccccgccaagcgccgcaccctggggccc

SEQ ID NO: 81241 - DNA, 183 bp, Homo sapiens
  misc_feature 1..183: note = chr17:77365331-77365514
  misc_feature 1..183: note = hypo
  source 1..183: mol_type = genomic DNA
ccacctccccaggcacggcgccacctccacatctgtacccaaaggcaccggagtttctaccacagtctgcccccactccccggggaggggctgatgggggctcaccagaggggttgccctggaccctgaccgtgacccttgccgtgactgctgggggcaaaggacacgcgtttcggagggttt

SEQ ID NO: 81242 - DNA, 45 bp, Homo sapiens
  misc_feature 1..45: note = chr17:77390958-77391003
  misc_feature 1..45: note = hypo
  source 1..45: mol_type = genomic DNA
agaagggcctggagacgcaacacaggcgctcggggcgtgtgcagg

SEQ ID NO: 81243 - DNA, 171 bp, Homo sapiens
  misc_feature 1..171: note = chr17:77772124-77772295
  misc_feature 1..171: note = hyper
  source 1..171: mol_type = genomic DNA
ccagtgcgggctgggcgagagggtctcacgcgcgaagatggcgggctcctggaaagggacaagggccggccgcgaccgccttgccgtgcgcacacaagcacgtgcaccgccgaccctgccgccagctaggctaccggtgacccgtggcgggggcggcgctggggacagcag

SEQ ID NO: 81244 - DNA, 364 bp, Homo sapiens
  misc_feature 1..364: note = chr17:77772527-77772891
  misc_feature 1..364: note = hyper
  source 1..364: mol_type = genomic DNA
gcaggaagcccagagcggaaaactggcctcctgtccaaagtgaggcgcgcgcaggcggcggcagccgcgaggtcctcgacccgccgggcaagcggggcgcttcgcccatcttccctcccagtcgtgccccagcctctggaaacacgggtttcaggttttggccttgttcctaaacttcacaaggtggccgcttgtcgaacagtcccatctctccggccgttctgtctgaacgaacagcgcgtcgaggacgctcagatctcccagtgaccctcgcgggccgcccgtgggaggccgccgacggccgcgtccttaatcataaaaagtcattcccggtaacaaatagtttcgtcggccggtgccagcg

SEQ ID NO: 81245 - DNA, 30 bp, Homo sapiens
  misc_feature 1..30: note = chr17:77773662-77773692
  misc_feature 1..30: note = hyper
  source 1..30: mol_type = genomic DNA
caaaactatcgcttgcgaaaagtctgagtt

SEQ ID NO: 81246 - DNA, 52 bp, Homo sapiens
  misc_feature 1..52: note = chr17:77774368-77774420
  misc_feature 1..52: note = hyper
  source 1..52: mol_type = genomic DNA
ccgctgctcaggctgcggctgccaggttggcgtgcgccgcctctgcagtaaa

SEQ ID NO: 81247 - DNA, 165 bp, Homo sapiens
  misc_feature 1..165: note = chr17:77774622-77774787
  misc_feature 1..165: note = hyper
  source 1..165: mol_type = genomic DNA
ttacggaaatgcgggcgcccgccctcctagggacacctgcttcccaaacccctaggtctccggccctgttccgcactcttctggcgacctgggcgcacggcccgcgactgcccttcccgacaaagggtctgcgacctgctcccgggagcccgccctacccttggc

SEQ ID NO: 81248 - DNA, 39 bp, Homo sapiens
  misc_feature 1..39: note = chr17:77775268-77775307
  misc_feature 1..39: note = hyper
  source 1..39: mol_type = genomic DNA
gcctgccgcctgctgcgggaatgccgcagggtgacccga

SEQ ID NO: 81249 - DNA, 27 bp, Homo sapiens
  misc_feature 1..27: note = chr17:77776539-77776566
  misc_feature 1..27: note = hyper
  source 1..27: mol_type = genomic DNA
cttgggcatctggaccggttgggccac

SEQ ID NO: 81250 - DNA, 317 bp, Homo sapiens; identical to SEQ ID NO: 36806
  misc_feature 1..317: note = chr17:77776679-77776996
  misc_feature 1..317: note = hyper
  source 1..317: mol_type = genomic DNA

SEQ ID NO: 81251 - DNA, 597 bp, Homo sapiens
  misc_feature 1..597: note = chr17:77777052-77777649
  misc_feature 1..597: note = hyper
  source 1..597: mol_type = genomic DNA
cgttatcagaaacctccagccccaacccctgcctggagatgcccggggcgcgctgactctgttctcgcatcaccccgggccctggctcaacgcgtgagcagcctgtggttccagataccccgagtggagagtttgaccccagattctgcctgcactgacaggcttggcctggcggttacgagccacggttgatgagcgcccctcctcccgtgacccagctcatgagaaaggcggggagcaccaaccctcccacgggaaaacacggggagaggctgggcgagtcaaggaatggtggcaccagagcctgggcgcagagaggcagctggacctcctgggctcccttgagccggagctccgccagggtgggcacttctgcctccagcgatgctgggtgccacagtcctcccgcctcctcctggaccacacgcggctctccagagtcccagggaagctccagggactcctcggactccgcctggcgcttcccgttttttcatttcctaccccacccccatgcagaaggaattgaagtgacttttttgctgggacgtcgggacctcaagtcagttccaaagtgggagtctctcagccggtgcc

SEQ ID NO: 81252 - DNA, 254 bp, Homo sapiens; identical to SEQ ID NO: 4512
  misc_feature 1..254: note = chr17:77777650-77777904
  misc_feature 1..254: note = hyper
  source 1..254: mol_type = genomic DNA

SEQ ID NO: 81253 - DNA, 88 bp, Homo sapiens
  misc_feature 1..88: note = chr17:77777943-77778031
  misc_feature 1..88: note = hyper
  source 1..88: mol_type = genomic DNA
cgacgcctttcctcgcagccccggtacagggcttcctcggtgcacccctagccgttgccccgggaggaggcgccgtctgggacacgaa

SEQ ID NO: 81254 - DNA, 624 bp, Homo sapiens
  misc_feature 1..624: note = chr17:77778434-77779058
  misc_feature 1..624: note = hyper
  source 1..624: mol_type = genomic DNA
catctggggctgtcccgcgccgctaccggcaccgtcttattcatcctgagagccgcactccctcatttgcataataatggcttatctagaataacacagcaatcagaggcaaaattaattttcttcagctagtccttgagatcctaaaaacagaggaggcttatggcaagaaaagccggtttagcagagggtgtagggttcctgaccaggaccaaggagagagaaagtttaaagcagtggaaatgtgatgttcacgctgagtttctgtatttttctagtttcaacctcagagcttactttttggccaaacggatgaaggggtaagccaccgtggaagtcccagcagatacccccaccatcgccccatccatcctgggaggttcggtggccctcgaggcagagacatggactgtggctggggtattgggggcagatgttcaatgtgttggggtgtggagagggtagattggcagcctactgaggattaaaggggtgtcctgcaaaccagctccggggtctgggtccggaccttccagggactcagttccgcaccctttgaacagatcaagacagagcacttccttgctctgggatggtcgcctcagccaccgagacagcagaagt

SEQ ID NO: 81255 - DNA, 30 bp, Homo sapiens
  misc_feature 1..30: note = chr17:77786072-77786102
  misc_feature 1..30: note = hyper
  source 1..30: mol_type = genomic DNA
ccccaggagcagaagcgctcccgaatctgg

SEQ ID NO: 81256 - DNA, 338 bp, Homo sapiens
  misc_feature 1..338: note = chr17:77786467-77786805
  misc_feature 1..338: note = hyper
  source 1..338: mol_type = genomic DNA
tcccctgccctggtgcgcccccgggccctgccctgagcccatgccccaggccgggtgtccagttcaccctgagctccccttggcgcccggagaagggtgctcgggcccgggtgctggggagcggcggggtggccgccggcgcctcttcggcgcggatggctctcggcggggccgaggagggggtcgcagagcggctccccgccgagaggagggtgggcgctcggcacctgctgagctacggtggtggctgcggtttatggcgcccgaggatccacccggatcttctccgcggagttccgggcttggctcgtctgtagtcagcacgcacacagctttgt

SEQ ID NO: 81257 - DNA, 27 bp, Homo sapiens
  misc_feature 1..27: note = chr17:77789473-77789500
  misc_feature 1..27: note = hyper
  source 1..27: mol_type = genomic DNA
cgtccagccagccgccttgtccatgag

SEQ ID NO: 81258 - DNA, 569 bp, Homo sapiens
  misc_feature 1..569: note = chr17:77807459-77808028
  misc_feature 1..569: note = hypo
  source 1..569: mol_type = genomic DNA
ctagaactctgaggccgggcgcagagctgccctgtccgttccgggggtccatctccagcggggaagggcaggagagggcgagccccgccggcaccgcgtggaaggggcctccgcccaggtctgacagccgccgcagggggaacatggttacctccgctccgggcgtcctcaccctgggggccagcctgggtctctcgcggttggcgggttggcgagaggggagcccgccccgaggccccaggtgctcagctccccgcccccccgcgggaatggcgcttccccttccgacgccctccggctacaccgtcacgtactccttgaaagtaacggtgaggcagttcgcggtgacgtcggtgataattatattcccaaagaagggcttgaactcgctcagcgactctgcaggttcgtcctgggcctcggctggaggcttctccgccgtcgtggtgggtgccgctgccgccgccaccgccaccgccgccgacgccggtgtctcgggcttcacctggagggagctgggcggctccccggcctcgctgcgcgtcttgacgcagcgcaagtctatgggt

SEQ ID NO: 81259 - DNA, 375 bp, Homo sapiens
  misc_feature 1..375: note = chr17:77808375-77808750
  misc_feature 1..375: note = hypo
  source 1..375: mol_type = genomic DNA
aaaggcctccttggtcggggacagcttgcgggagccggcatcctggggctgcggatcgctaaccccggacacctcctcctccctcctcttgggcggcgcctccaccttcttctcctctgcgcccgccgcctttttaaaagtcctgtcggcaggagggtggcgctcgtcggctgcccgcttcttgtggctgggggagcgagcctccccctctgccacctcgccggacttgatcttcaccgcctgcatgccgttctccatgtatttgctcatcacgatcacgatgcgtccgttcttgttcttgttcttgactatcttcatcttgcccccaatcccgttgcccgtcacagcctctttgggggccggcatcattccgtt

SEQ ID NO: 81260 - DNA, 80 bp, Homo sapiens
  misc_feature 1..80: note = chr17:77809064-77809144
  misc_feature 1..80: note = hypo
  source 1..80: mol_type = genomic DNA
tcttgctgttgagctcgtactgatgcccctggcccttcccctgcgcgcccaaatccagcttggcacggttgtcagtggag

SEQ ID NO: 81261 - DNA, 121 bp, Homo sapiens
  misc_feature 1..121: note = chr17:77814048-77814169
  misc_feature 1..121: note = hyper
  source 1..121: mol_type = genomic DNA
aagctaggcgagaggcgtaggaggcagagagagcgggcgcgggaggccagggtccgcctgggggcctgaggggacttcgtggggtcccgggagtggcctagaaacagggagctgggagggc

SEQ ID NO: 81262 - DNA, 179 bp, Homo sapiens
  misc_feature 1..179: note = chr17:77814750-77814929
  misc_feature 1..179: note = hyper
  source 1..179: mol_type = genomic DNA
ggagggaggagcctgcgcggggctcgtgttcgcccaggaatcccggagaagctcgaagacggtctggtgttgaacgcacacgtggactccatttcattaccaccttgcagctcttgcgccacggaggctgctgctgcccggcggctgctacccaccgagacccacgtggcccctcccca

SEQ ID NO: 81263 - DNA, 785 bp, Homo sapiens
  misc_feature 1..785: note = chr17:77815150-77815935
  misc_feature 1..785: note = hyper
  source 1..785: mol_type = genomic DNA
atatttttctcctgccgtgtttggctttttcctggcatttttgcccagggcgaagaactgtcgcgcggggcagctccaccgcggagggagaggggtcgcgaggctggcgcgggaagcgctgtaggtggcagtcatccgtccacgccgcacaggccgtctgcgccgtcggaccatcgggaggtctgcagcaactttgtcccggccagtccccttgtccgggaaggggctgagcttcccgacactctaccctccccctcttgaaaatcccctggaaaatctgtttgcaatgggtgtttccgcggcgtccaggtctgggctgccgggggaggccgagcggctgctgcagcctccctgctgccaggggcgtcggactccgcttcgctcactacgcccaggcccctcaggggcccacgctcaggacttcggggccacacagcaggacccggtgccccgacgacgagtttgcgcaggacccgggctgggccagccgcggagctggggaggaaggggcgggggtcggtgcagcggatcttttctgttgctgcctgtgcggcggcaggaagcgtcttgaggctccccaagactacctgaggggccgcccaagcacttcagaagcccaaggagcccccggccacccccgctcctggcctttttgccaacgactttgaaagtgaaatgcacaagcaccagcaattgacttcccttccgtggttatttattttgtctttgtggatggtgggcagatggggagagaggcccctacctaacctcggtggctggtccct

SEQ ID NO: 81264 - DNA, 30 bp, Homo sapiens
  misc_feature 1..30: note = chr17:77818158-77818188
  misc_feature 1..30: note = hyper
  source 1..30: mol_type = genomic DNA
acacctggggggtcccgatgcctctgcagg

SEQ ID NO: 81265 - DNA, 534 bp, Homo sapiens
  misc_feature 1..534: note = chr17:77825231-77825765
  misc_feature 1..534: note = hypo
  source 1..534: mol_type = genomic DNA
accacctgatcactacggtcccagccctgtccccaccaacactcccaatctccttattcctgcttacatagcaccctcacctccttacagacagtatcctctggatgttgatggtgtttccagcctgcatctcctgttggaacataagagctgcaagcgtcggggcgtgtccacacccttgtccgacgtgtccctggcatctggcacagtgcccagcacgtacctgtcagatgaatgttgaattaataggatttgtgtgaggaccgagtgagctcacacagccagatgaagctggtccacccgtacgggctggcaagagccgttggccacattctcagacattttgtgaacccgttgttgaacccagccatgattacaaattaaatgattggcatttacaattaaattatgtaaagaacaacaataataaatgctcactactgactccttcctagtgatttcctcagattcacatgttcccgggttctttgtgtcccctgtgtgtggtggaaaacgccacgcaggggcagctgc

SEQ ID NO: 81266 - DNA, 44 bp, Homo sapiens
  misc_feature 1..44: note = chr17:77827279-77827323
  misc_feature 1..44: note = hypo
  source 1..44: mol_type = genomic DNA
gactggcctattttattatttgtgaatggcgtgctatgcatcct

SEQ ID NO: 81267 - DNA, 23 bp, Homo sapiens
  misc_feature 1..23: note = chr17:77837400-77837423
  misc_feature 1..23: note = hypo
  source 1..23: mol_type = genomic DNA
gagacagagtcttgccgtatcgt

SEQ ID NO: 81268 - DNA, 30 bp, Homo sapiens
  misc_feature 1..30: note = chr17:77899529-77899559
  misc_feature 1..30: note = hypo
  source 1..30: mol_type = genomic DNA
gccacatagctatgccgcccaggggctggg

SEQ ID NO: 81269 - DNA, 313 bp, Homo sapiens
  misc_feature 1..313: note = chr17:77904151-77904464
  misc_feature 1..313: note = hyper
  source 1..313: mol_type = genomic DNA
cggctcggtggggttcgcggcgcacggaccccgcccccaaggcctcaggtgggccgggggctccgggaggcctccgccgccctccgtcccaggagagcagttcccggtgagaagcccgggctctgcagacaccccacagcagttctgcgtctcggaaaacgcggcgccttcatcaggaccgcacgaaggagggggtggggaggcgggtccagcctcgcgaggagccggccggggtctggggggccgtggcagaggggagtcccgctttctgtctaagcctccctgtgccaagtaggcccgaaccccacctttg

SEQ ID NO: 81270 - DNA, 106 bp, Homo sapiens
  misc_feature 1..106: note = chr17:77926452-77926558
  misc_feature 1..106: note = hypo
  source 1..106: mol_type = genomic DNA
tacctgaagaaaaggcggagggagcgcatgtggcccaggtccacgcggaacacgccgcaaatctgctccagggcgcacacccgctgcggctcgtcccagcgtgggg

SEQ ID NO: 81271 - DNA, 221 bp, Homo sapiens
  misc_feature 1..221: note = chr17:77948898-77949119
  misc_feature 1..221: note = hypo
  source 1..221: mol_type = genomic DNA
aaggccacaaacacccggaacaatccgccaggccgcgtcactcctcaccctccagcagggctttggatttttggacagcgagttctgtttcattttgttttgtttttccctttgcatttggtgaactccgtgtcaggaaagctagtctttgggattcaaggaagaacaaaacaaacccgatctcctgtaatctacctggattggaacgcccagctttgtac

SEQ ID NO: 81272 - DNA, 181 bp, Homo sapiens
  misc_feature 1..181: note = chr17:78010865-78011046
  misc_feature 1..181: note = hyper
  source 1..181: mol_type = genomic DNA
ggggctgttggataccgcccctgaccttgctccggggccactcgctgtggccggagaccagcccggccccgcgcctccctcctgcaaggacagatcccctctcgcaggcttgggggtgacccgcgatgggaggggtccctgcggttaggcggcccgcgatagtccgcggtcaccgtcctgg

SEQ ID NO: 81273 - DNA, 30 bp, Homo sapiens
  misc_feature 1..30: note = chr17:78041466-78041496
  misc_feature 1..30: note = hypo
  source 1..30: mol_type = genomic DNA
atccgcgaatgctaacgctcaccaggatgc

SEQ ID NO: 81274 - DNA, 159 bp, Homo sapiens; identical to SEQ ID NO: 36819
  misc_feature 1..159: note = chr17:78045491-78045650
  misc_feature 1..159: note = hyper
  source 1..159: mol_type = genomic DNA

SEQ ID NO: 81275 - DNA, 138 bp, Homo sapiens
  misc_feature 1..138: note = chr17:78059751-78059889
  misc_feature 1..138: note = hypo
  source 1..138: mol_type = genomic DNA
agtcactgcgcccagccctaattttgctttttgatgaatatccggtctagggggaagaagtggggcccctggagcttgaaatcaaaaggctgagcaagctgatcgacgagcacgatggcaaggcggtccaggcccagg

SEQ ID NO: 81276 - DNA, 71 bp, Homo sapiens
  misc_feature 1..71: note = chr17:78073436-78073507
  misc_feature 1..71: note = hypo
  source 1..71: mol_type = genomic DNA
cagcgcctggacaagcgactggctctcatcgccaccatcctggaccgcgtgcgggacgagtacccccagtt

SEQ ID NO: 81277 - DNA, 279 bp, Homo sapiens
  misc_feature 1..279: note = chr17:78078871-78079150
  misc_feature 1..279: note = hypo
  source 1..279: mol_type = genomic DNA
gacatcctgaccctgcggctggacgtgatgatggagactgagaaccgcctccacttcacggtgggcagggcaggggcgggggcggcggccagggcagagggtgcgcgtggacatcgacacccacgcacctcacaagggtggggtgcatgttgcaccactgtgtgctgggcccttgctgggagcggaggtgtgagcagacaatggcagcgcccctcggggagcagtggggacaccacggtgacaggtactccagaaggcagggctcggggctcattcatc

SEQ ID NO: 81278 - DNA, 71 bp, Homo sapiens
  misc_feature 1..71: note = chr17:78083747-78083818
  misc_feature 1..71: note = hypo
  source 1..71: mol_type = genomic DNA
ctgccatcagcagctcgggccctgccgggagctacaggccctacgacgagggtctgcggaggggggttttc

SEQ ID NO: 81279 - DNA, 93 bp, Homo sapiens
  misc_feature 1..93: note = chr17:78112862-78112955
  misc_feature 1..93: note = hypo
  source 1..93: mol_type = genomic DNA
tcatctccagaatctcgtgtggcagcgtggcactgatgagaaccacctgtgtggctggaggcaggtacctgtatacatcgtaaatctgctctt

SEQ ID NO: 81280 - DNA, 30 bp, Homo sapiens
  misc_feature 1..30: note = chr17:78122014-78122044
  misc_feature 1..30: note = hypo
  source 1..30: mol_type = genomic DNA
tgctttttgtttgttcgtttgtttgttttg

SEQ ID NO: 81281 - DNA, 89 bp, Homo sapiens
  misc_feature 1..89: note = chr17:78122164-78122253
  misc_feature 1..89: note = hypo
  source 1..89: mol_type = genomic DNA
aggtgtccacgcgcagccactaaccgctttcttatctgacactttaagtgcttcttcgtacccagctcctctaacgccttttgaagcag

SEQ ID NO: 81282 - DNA, 81 bp, Homo sapiens
  misc_feature 1..81: note = chr17:78143912-78143993
  misc_feature 1..81: note = hypo
  source 1..81: mol_type = genomic DNA
acggaggggctcagccgacacaggtctgatggggcccgagagtggtcccaggggagtgggaggggccggcatcttcctcat

SEQ ID NO: 81283 - DNA, 178 bp, Homo sapiens
  misc_feature 1..178: note = chr17:78151768-78151946
  misc_feature 1..178: note = hypo
  source 1..178: mol_type = genomic DNA
ttcagcattcttttgcggggggccacaatcagtgacaccctgactcgcaagcctcaatcacctgttccagtgagaaacaggactgagatcagaaggaatgaggcagagctgccctcgattggttctcctctcctcctcacctgcccaccccggcctctgcgcccgtcactgtcctctc

SEQ ID NO: 81284 - DNA, 58 bp, Homo sapiens
  misc_feature 1..58: note = chr17:78152480-78152538
  misc_feature 1..58: note = hypo
  source 1..58: mol_type = genomic DNA
tgggacggcttctggcgctgctcctgcacacacgactctccaacgatcattttccatg

SEQ ID NO: 81285 - DNA, 30 bp, Homo sapiens
  misc_feature 1..30: note = chr17:78439146-78439176
  misc_feature 1..30: note = hypo
  source 1..30: mol_type = genomic DNA
cagaagtgtgcaagccgagaacagtttcag

SEQ ID NO: 81286 - DNA, 63 bp, Homo sapiens
  misc_feature 1..63: note = chr17:78447061-78447124
  misc_feature 1..63: note = hypo
  source 1..63: mol_type = genomic DNA
cctggccgggcacagcgtaggagaagggcgtgcccacacctggcgtggcgctggacttgagcc

SEQ ID NO: 81287 - DNA, 30 bp, Homo sapiens
  misc_feature 1..30: note = chr17:78447361-78447391
  misc_feature 1..30: note = hypo
  source 1..30: mol_type = genomic DNA
tctggagacgcagagcgggtagcttcccag

SEQ ID NO: 81288 - DNA, 1512 bp, Homo sapiens
  misc_feature 1..1512: note = chr17:78449408-78450920
  misc_feature 1..1512: note = hyper
  source 1..1512: mol_type = genomic DNA
tccagggtgttcacccgggacagcacctgcctctccagctcatcgatcttgctctgcagcagatccttgaggctgttggtctggctggaggaattgaggcggctgtactgctgcggggtgcaagggcgggggaaaccacaccgttaggcgaggcgcggggaccgtgctggaaggcccgcggcgcggtcccctctgggcgactgcgggggcggcctggcagggagctggggcgagtggccgccgcggggcctcgcaggcgcggggaggcaccggccgggcacccgcgcggctgaggcgagggcgggggatgcctggccgggtagggaacggggtgggggagggcagaggggcgagcgagccggagggggaaccggagccgagggcgcgcgcggacctcgaggttctccaggcgggttttgagcgattgcaaagtttgcccgagttggctgagcgtctcggcggccggtgtccgggacaggtcgcccatggtgttcttgcccgagccgggctgcttgcggccgccgcccgcccgggcctcgccggctccggggtccagcgtgctctggctctcgcagcggcccagcttggcggtcagctcgcggatggtctccttctggctcaggatggtctccttctgctgcagcaccgtctcgcggagctgcagcacgctgctccggagctcctcggcgccgccggcggccacggacgcggcgcacatgtcggcgtccacgggcaccgaggtgcagatgaagcgcgtcggcccgaaatcctgggccccggcgcccaggaggcagagggcgagcagcgcacaggtgcgcgcggcgcggccggccggcatggctgcgggcaccgggcgctccgggcccggctcggctcggctggggctcggctccggctgggacccggctcgggctgtggctccgcgagcggcccgcgctctgggcgccgcgctcttcggccgcgcggtccacaccgccgcgctatcaggcccccactgccgcctgcgctgcggagcccgcgccttttatgccgccgcgggaggggcctcgagccgccgacgtcagcgggggaggaatcccgctttaattgtccgcggcccgggcccgcggcgcggcgggggtctcacgagcgcgccaccggggctgcctccgctcgcgtcccccccgcccttctgggagctgccgcggccccctcctcccccgcccccgcctgggccggcgctgctgccccgaaggctccgagagctcagggggaaggaagtcgggctccggccccggactcgaggatggaccacctgcgtggtgtccccgaacctccgacggggctccaggcgggcgggaaaccaccgcgtccgggagatagaattcggttcggccctcctggctgcactgaacacccttgggccggggtcgtttggagccgggctgggtgcccaaggacccaggtcgtcaacacccgagtgcccggtggtcaacggctcggagtggggcctcgcggcgccactaagtccag

SEQ ID NO: 81289 - DNA, 652 bp, Homo sapiens
  misc_feature 1..652: note = chr17:78451302-78451954
  misc_feature 1..652: note = hyper
  source 1..652: mol_type = genomic DNA
gggtgtccacctgtgcgtggggggctgtttcccgtctgtccagccgcgcccacttctcaggcccaaaggccagcaggaagggtcccggaggtggctgggggcgtccacctgagaagctccgctctcgctcagacaccccacccggcacccgcgcactcgcgccttcatctggaccgcggggctcggctcccgagatcgcggtccgggttccggcgccgggctgggggctcaggaccagggctggcgcagccgccccgccccgccccgccccggggctatcagagcggtcaaagcctcggaaatccctccgtccacgctcccgtggtacagagaaggaaactgaggctccgagactgcggggccgggctacagccgtggccccccgacccctccccgccgcccccggcttctctggtctctgcgttctgcagcctttccctgcgcgcagccgggggctgggggtccccagccagcagggacccacgggcagtcccgggtgccgggatcgggcgtccgcccctcgggcgggagcagaggccggctcgatggagacctttttgagaaatggcggcctctacccgccccccagcccccgagcgcccgccgtctgcgttcagcatctcagcttttaagcctccctgagccggggctg

SEQ ID NO: 81290 - DNA, 877 bp, Homo sapiens
  misc_feature 1..877: note = chr17:78452108-78452985
  misc_feature 1..877: note = hyper
  source 1..877: mol_type = genomic DNA
cggccccttgcgtgctctgccgaccccgggccgcaggaggggttagcctcgccggtccccacgcggggtctgcgccggcagcgccacgggctggaacgcgcctcgggagaaattacccgcgcggggtcgcggcgtcttctgccccaactcccgtagggagccgctaggcgggtgccctcctggccccagcgctttggcctcgccgccctcccgcacgcgtccagtggggaggccgcgcccgtcaggcctggagccggaccgtgcccagccgagagcgcgcgggcgcgggagaggagccctgccctgcccagggcaggctgtttagacggggcgggaacccttagcctggccccgcgtctctatccccagcagccgtggagccttcctagccgcccaaggccagggaccctgcctggcttttcctccagggcagcagatctcagcggcctggcacctcggcacagaggagcgtgtcccccttccgcagaggaagggagtggacggcgtcagaaagggaggggagcctggggcggtgtctggggctagcgggacctctgggcactgtggggccccaggagaggagaccctcgggtccagcctgcaactgttgtgcaggaggcgctgggcgggacacctgcaggcgctgcacacacacgcgagggccaccatgccgcgtttctccttcacaagaccctgggcaagcggagggtcgtatttaggattccctcggcctccccagtgttctgaaagtatctgagagggagggagcaggaaaacgaagggccgccctgcccaaactcatcggggtgtctggttactaggtcggaagaggggggatggtgttgtgaacagccagtgatcccggccctgcctgagt

SEQ ID NO: 81291 - DNA, 79 bp, Homo sapiens
  misc_feature 1..79: note = chr17:78496397-78496476
  misc_feature 1..79: note = hypo
  source 1..79: mol_type = genomic DNA
tgtttcactgcttttcgaggctaaataaggttccattgtatggagacaccaagttttgcgtatccgttcacctagcaat

SEQ ID NO: 81292 - DNA, 33 bp, Homo sapiens
  misc_feature 1..33: note = chr17:78517569-78517602
  misc_feature 1..33: note = hypo
  source 1..33: mol_type = genomic DNA
gattataggcgtgagccacggtgccctgcctac

SEQ ID NO: 81293 - DNA, 145 bp, Homo sapiens
  misc_feature 1..145: note = chr17:78518203-78518348
  misc_feature 1..145: note = hypo
  source 1..145: mol_type = genomic DNA
tatgaaaaaattaaagagaaaatctgattgacactgtggaggacactacactccaaaaaaaaaagtactatattttctaatattatcagtgctttttaatattttctaatattatcagtgaagcttttgccgctttttcaaaatc

SEQ ID NO: 81294 - DNA, 33 bp, Homo sapiens
  misc_feature 1..33: note = chr17:78539654-78539687
  misc_feature 1..33: note = hypo
  source 1..33: mol_type = genomic DNA
tctttgggtgttaagcggcgagccaggagctgc

SEQ ID NO: 81295 - DNA, 75 bp, Homo sapiens
  misc_feature 1..75: note = chr17:7856906-7856981
  misc_feature 1..75: note = hypo
  source 1..75: mol_type = genomic DNA
tgctcgcttgaccgccgctcacctcgtgctttgcagtccgattccaaacagtccacagaccgctactgattggtg

SEQ ID NO: 81296 - DNA, 153 bp, Homo sapiens
  misc_feature 1..153: note = chr17:78587674-78587827
  misc_feature 1..153: note = hypo
  source 1..153: mol_type = genomic DNA
agtggctgtggagcacgatgaagcgtctatcgcagcatcatctctgcacccagatgtggccgtgctgagtggattcctgccccagatcttgggaagaaggttggctttcctcctggtgttggtggaaggcctccccggcgacactgctgcact

SEQ ID NO: 81297 - DNA, 346 bp, Homo sapiens
  misc_feature 1..346: note = chr17:78599426-78599772
  misc_feature 1..346: note = hypo
  source 1..346: mol_type = genomic DNA
ggaaaaacacataaacgagttccatattgaaatatttatttatttttttctgttgtgttttcagatgaagacagtcagtgttgccttagttttgtgcctgaatgttggtgtggaccctcccgatgtggtgaagaccacgccctgtgcacgcttggaatgctggatcggtgagtatgcctccctcacgcgctgccacaaaggccgtctggccggctctggcctgggcggggctcgccaagcctgtggtctggtccaggggcccgtctccagctgtgcaaatctgaggggtttttctttctggagtcacatcacctttgagtaatttccgatgcgctcacctgtgatt

SEQ ID NO: 81298 - DNA, 370 bp, Homo sapiens
  misc_feature 1..370: note = chr17:78667873-78668243
  misc_feature 1..370: note = hypo
  source 1..370: mol_type = genomic DNA
cgagctgaagatttgcgtttacagctgtagagcaaatacaggcggctctgacatctcagcttttgtttgccactgctgcagcctcaggtgcctcatctggggcttcattcagagtgggtggggaggcgacaggtcgaggcagttgccccgtgctcacgaatccctgacacagctggtgacctctccaggtgacctcttcaagcctggtcccaggggcaggcatgcccgggcatggccctcgcagatggctttgctggcctggtctggcaaccgttgaataaatactgatttcccacccaggtgaggcgcatggtagatgtttgttctgtgcattgcgttggtcggcctccacagtcgcacaatctctcag

SEQ ID NO: 81299 - DNA, 52 bp, Homo sapiens
  misc_feature 1..52: note = chr17:78772792-78772844
  misc_feature 1..52: note = hypo
  source 1..52: mol_type = genomic DNA
cgttcacatctgtgccggcatgacctccctggggaagcgtttgcattgctgc

SEQ ID NO: 81300 - DNA, 49 bp, Homo sapiens
  misc_feature 1..49: note = chr17:78773568-78773617
  misc_feature 1..49: note = hypo
  source 1..49: mol_type = genomic DNA
caccccttccctccccggcgaccctcgttgggagcgtgtgaaggatggt

SEQ ID NO: 81301 - DNA, 30 bp, Homo sapiens
  misc_feature 1..30: note = chr17:78792696-78792726
  misc_feature 1..30: note = hypo
  source 1..30: mol_type = genomic DNA
tggggtgtgggacctcgtgggaagctcttt

SEQ ID NO: 81302 - DNA, 30 bp, Homo sapiens
  misc_feature 1..30: note = chr17:78794230-78794260
  misc_feature 1..30: note = hypo
  source 1..30: mol_type = genomic DNA
gcagccacccctgttcgcgctggcgcttga

SEQ ID NO: 81303 - DNA, 65 bp, Homo sapiens
  misc_feature 1..65: note = chr17:78820077-78820142
  misc_feature 1..65: note = hypo
  source 1..65: mol_type = genomic DNA
tcccttcgtgcaccccgcaggctctccctctttggcatgcccagagcgcccgcttctcagccgcc

SEQ ID NO: 81304 - DNA, 42 bp, Homo sapiens
  misc_feature 1..42: note = chr17:78861192-78861234
  misc_feature 1..42: note = hypo
  source 1..42: mol_type = genomic DNA
ctgactccaggggtgcgcctccatcctcgtcatagagtcctg

SEQ ID NO: 81305 - DNA, 65 bp, Homo sapiens
  misc_feature 1..65: note = chr17:78867045-78867110
  misc_feature 1..65: note = hypo
  source 1..65: mol_type = genomic DNA
gtgccagggtgtgtgcgccagggtgcgtgtgtaccagggtgtgtgtgcgccgggtgtgtgtgtgc

SEQ ID NO: 81306 - DNA, 30 bp, Homo sapiens
  misc_feature 1..30: note = chr17:78869491-78869521
  misc_feature 1..30: note = hypo
  source 1..30: mol_type = genomic DNA
gccccaggccttccacgggatcctctgttc

SEQ ID NO: 81307 - DNA, 96 bp, Homo sapiens
  misc_feature 1..96: note = chr17:78872638-78872734
  misc_feature 1..96: note = hypo
  source 1..96: mol_type = genomic DNA
ggttcctggggatggcggtccagccacaatgacagcagcgcatgacaggagcccaaagacccgaaacagacgcagggcatccgccaaggcagttcc

SEQ ID NO: 81308 - DNA, 158 bp, Homo sapiens
  misc_feature 1..158: note = chr17:78874417-78874575
  misc_feature 1..158: note = hypo
  source 1..158: mol_type = genomic DNA
ccttcttctttcacaggaagcgacagcagcatcacccctcggtgctcacctggtgaccgtctgccaagggcctggtggccccgccaccctacctggcccatgctccatggggttctcggttcactctcgtccctccactcacacgtatctggccatca

SEQ ID NO: 81309 - DNA, 83 bp, Homo sapiens
  misc_feature 1..83: note = chr17:78897683-78897766
  misc_feature 1..83: note = hypo
  source 1..83: mol_type = genomic DNA
ctgctgggtgtgtcccggtccctctgcctgcactctttaggagcactgctgggtgtgtcccggttctccgcccctggttctgg

SEQ ID NO: 81310 - DNA, 39 bp, Homo sapiens
  misc_feature 1..39: note = chr17:78946490-78946529
  misc_feature 1..39: note = hypo
  source 1..39: mol_type = genomic DNA
tgaaagccctgaccacgtgcaggatgcccatcctcacag

SEQ ID NO: 81311 - DNA, 30 bp, Homo sapiens
  misc_feature 1..30: note = chr17:78957836-78957866
  misc_feature 1..30: note = hypo
  source 1..30: mol_type = genomic DNA
aaccttagagcagagcggggggaagtgggg

SEQ ID NO: 81312 - DNA, 43 bp, Homo sapiens
  misc_feature 1..43: note = chr17:78968896-78968939
  misc_feature 1..43: note = hypo
  source 1..43: mol_type = genomic DNA
ggaggccatggtaggcggccgggtgcttcgccctggagtgcag

SEQ ID NO: 81313 - DNA, 77 bp, Homo sapiens
  misc_feature 1..77: note = chr17:78975561-78975638
  misc_feature 1..77: note = hypo
  source 1..77: mol_type = genomic DNA
aggctgcagacacttcgctggaaggcacacttgccacggggcaggcagtgtggcagtcagaaatgtgtgggatggaa

SEQ ID NO: 81314 - DNA, 16 bp, Homo sapiens
  misc_feature 1..16: note = chr17:78975938-78975954
  misc_feature 1..16: note = hypo
  source 1..16: mol_type = genomic DNA
gcgggtccatcctgga

SEQ ID NO: 81315 - DNA, 15 bp, Homo sapiens
  misc_feature 1..15: note = chr17:78977598-78977613
  misc_feature 1..15: note = hyper
  source 1..15: mol_type = genomic DNA
gctgggtaatactcc

SEQ ID NO: 81316 - DNA, 131 bp, Homo sapiens
  misc_feature 1..131: note = chr17:78977693-78977824
  misc_feature 1..131: note = hyper
  source 1..131: mol_type = genomic DNA
cggggctgtgagagcggagtttcctctctccggtgaccctgagctgcgcctttctcagccgcctcccgaggccccaggcgctctgcgggggctctggcggggttggtgggggtgggcgttctcgttgtttc

SEQ ID NO: 81317 - DNA, 392 bp, Homo sapiens
  misc_feature 1..392: note = chr17:78978124-78978516
  misc_feature 1..392: note = hyper
  source 1..392: mol_type = genomic DNA
cgcccttcctggctgcggctggacccggctgcgcggggcgcgaggctgcctttcccgggatcaccagggaccacccggcgcgctccccgggaatccgcacccctggccccagcgctccggagcgacccgggtcagcccctggctgcctgcaatgggcccccgggcgaaccccgggcggacccaggagtgagcacccggtgcgcggcaacgatgatcccgcaagggaagctcacgggaggcaggagctgtggcagccgccccaggatggggcgcggggagcgcgctgagctgtcctttcccgcagcggccccgcggttgaagcgtgggcttgggttttggtttttcttctgtggcaacagttctgttgagatattactcgcctgccatacaac

SEQ ID NO: 81318 - DNA, 30 bp, Homo sapiens; identical to SEQ ID NO: 45252
  misc_feature 1..30: note = chr17:79001034-79001064
  misc_feature 1..30: note = hypo
  source 1..30: mol_type = genomic DNA

SEQ ID NO: 81319 - DNA, 30 bp, Homo sapiens
  misc_feature 1..30: note = chr17:79001300-79001330
  misc_feature 1..30: note = hypo
  source 1..30: mol_type = genomic DNA
actaattatactgagcgttaagcaaagttc

SEQ ID NO: 81320 - DNA, 52 bp, Homo sapiens
  misc_feature 1..52: note = chr17:79001565-79001617
  misc_feature 1..52: note = hypo
  source 1..52: mol_type = genomic DNA
ctgcccagctccagacgtgtggctgaagcggccagctcggccagttcgtccc

SEQ ID NO: 81321 - DNA, 96 bp, Homo sapiens
  misc_feature 1..96: note = chr17:79009595-79009691
  misc_feature 1..96: note = hyper
  source 1..96: mol_type = genomic DNA
tggggctcctccaggcgcggttgcgcgagcctcgggcacttcattctcaacaggctttcccttcccacaactcctgcccggcgcccatgctggggc

SEQ ID NO: 81322 - DNA, 74 bp, Homo sapiens
  misc_feature 1..74: note = chr17:79035028-79035102
  misc_feature 1..74: note = hypo
  source 1..74: mol_type = genomic DNA
gtttaaactcatgtacggtgttatctgatgatataaattcttttcatggctaaggcagacggtgtattatgatg

SEQ ID NO: 81323 - DNA, 30 bp, Homo sapiens
  misc_feature 1..30: note = chr17:79048658-79048688
  misc_feature 1..30: note = hypo
  source 1..30: mol_type = genomic DNA
tgtggcaaagcacaccgccagggaacctcg

SEQ ID NO: 81324 - DNA, 160 bp, Homo sapiens
  misc_feature 1..160: note = chr17:7906254-7906414
  misc_feature 1..160: note = hyper
  source 1..160: mol_type = genomic DNA
atcccatgggttactcgggcttggagaaactcggggttacggggagaaccctaggggaggccggggtctcagtcgctcagcctgctccgtctgtgttcgcagaagccggcaatgaccgcctgcgcccgccgagcgggtgggcttccggaccccgggctct

SEQ ID NO: 81325 - DNA, 142 bp, Homo sapiens
  misc_feature 1..142: note = chr17:79066660-79066802
  misc_feature 1..142: note = hypo
  source 1..142: mol_type = genomic DNA
gtttatcagtgtgtccgcggggcgtggtcacagcctggtccagctcctccttagaacagaggggtgtggctgtgtccacagggcccggaatggggctgagagcagagcccagcctgtgcccaccgctcgggggcagggagca

SEQ ID NO: 81326 - DNA, 525 bp, Homo sapiens
  misc_feature 1..525: note = chr17:79093956-79094481
  misc_feature 1..525: note = hypo
  source 1..525: mol_type = genomic DNA
cgcgacccccagccccgggcagaccccgggtggcggcggcccacctggtcaaagaggtagacggtgacgtcgtcgaagaaggacacggccttcttcttgcgttccaggtcctcgcagaaggtctcggacagcaggctgggcatcttgagcaggctgcgcaggttgcgcgcgctctggctctcagccaccaccacgggcaccgccggcgcctcctcttcgctgtcctcgctaggctcctggacgctgtagcagcggagctcctcgtcagactcgtcgctgtcctcactgtcctcctcctcctcctccggccggccctccaaggccgcagggaggccgggcagagccaggcggagtggggctctgggggtgcctgggccccccatccgcttttgtggggccggccctgacaacagtcctgggggcccctggaactcagagctgttgccttctgatctcagcggaaccggggtcagcaggaaaaactgggagcagctggggctgggcccaggccgcaccttggctggg

SEQ ID NO: 81327 - DNA, 46 bp, Homo sapiens; identical to SEQ ID NO: 45255
  misc_feature 1..46: note = chr17:79094742-79094788
  misc_feature 1..46: note = hypo
  source 1..46: mol_type = genomic DNA

SEQ ID NO: 81328 - DNA, 317 bp, Homo sapiens
  misc_feature 1..317: note = chr17:79096940-79097257
  misc_feature 1..317: note = hypo
  source 1..317: mol_type = genomic DNA
caggataccccatctcggcctggctgtccgggacagggcagtggggccctcaccagcggtccgacagggtcagctgcagctggggcttgggcagcttgagctgctgctcccggaccgtgtacgccagcacctgctggtccgagtgctggggatagggctgcgtgcccagctcaaagagctcccagatggtcacgcccagggacctgtggggcgacagccgtgagccagggctgggcacagcctgccacagcaaggaccgcgcaggatccccggggcgccgaatggggcagctcccgccatcacgccagtgcctcagg

SEQ ID NO: 81329 - DNA, 48 bp, Homo sapiens; identical to SEQ ID NO: 45257
  misc_feature 1..48: note = chr17:79098155-79098203
  misc_feature 1..48: note = hypo
  source 1..48: mol_type = genomic DNA

SEQ ID NO: 81330 - DNA, 188 bp, Homo sapiens
  misc_feature 1..188: note = chr17:79099741-79099929
  misc_feature 1..188: note = hypo
  source 1..188: mol_type = genomic DNA
gttggagaggacagccgtgcggcgtctggggctgacggggccacgtgtccttcgccacttcttccagcatgtccccccggggtccccaggggctgggcatcctggcccaagcaggacagaaccctccctccagggtccttcgaagcagggtctgtctccctcaagccccaaagcgagggcttagcaga

SEQ ID NO: 81331 - DNA, 75 bp, Homo sapiens; identical to SEQ ID NO: 45259
  misc_feature 1..75: note = chr17:79100184-79100259
  misc_feature 1..75: note = hypo
  source 1..75: mol_type = genomic DNA

SEQ ID NO: 81332 - DNA, 352 bp, Homo sapiens
  misc_feature 1..352: note = chr17:79104807-79105159
  misc_feature 1..352: note = hypo
  source 1..352: mol_type = genomic DNA
ccagcacctgggccccggagggaggccaccccatctccccacccagccctcacctgagcgcccaggctgcttggccatgggcaaggagacctccgtgagtggcaggacgtacacgtcgggcccgttctgtgctgccgtggccggggagccctgcgccaggtcggctgcgtactcgtccccctccgcattctcaaactcctgcgggccgggccgggcatgagcggggcttctcgcaggtcaaggaagggtgtggctgggcctggaaaggcccctttcttccagggccgagctcccagggcagggcaggagggggtgctcggcccagagttggagccaccgcccctgcaggcca

SEQ ID NO: 81333 - DNA, 30 bp, Homo sapiens; identical to SEQ ID NO: 16265
  misc_feature 1..30: note = chr17:79107633-79107663
  misc_feature 1..30: note = hypo
  source 1..30: mol_type = genomic DNA

SEQ ID NO: 81334 - DNA, 84 bp, Homo sapiens
  misc_feature 1..84: note = chr17:79127888-79127972
  misc_feature 1..84: note = hypo
  source 1..84: mol_type = genomic DNA
aaaacaaaacagagcagtgccatgtagaagatgaatgtgagcgtcttctccaaggagagccacagcctacgagaaaaaaagcag

SEQ ID NO: 81335 - DNA, 30 bp, Homo sapiens
  misc_feature 1..30: note = chr17:79130785-79130815
  misc_feature 1..30: note = hypo
  source 1..30: mol_type = genomic DNA
cctctgggacagcaacggtgcccccacagg

SEQ ID NO: 81336 - DNA, 141 bp, Homo sapiens
  misc_feature 1..141: note = chr17:79131533-79131674
  misc_feature 1..141: note = hypo
  source 1..141: mol_type = genomic DNA
cacctggaatgcccccggttccccaggaggctgatccctgacagtggagaagcctccaaggggcaggcagctccagctaaggtcccacagcccccatctcttcgctcctggcctgtctctgctcgacgcacactgtccccc

SEQ ID NO: 81337 - DNA, 30 bp, Homo sapiens
  misc_feature 1..30: note = chr17:79133024-79133054
  misc_feature 1..30: note = hypo
  source 1..30: mol_type = genomic DNA
gggccctcactccagcgtccacgatagcag

SEQ ID NO: 81338 - DNA, 256 bp, Homo sapiens
  misc_feature 1..256: note = chr17:79139708-79139964
  misc_feature 1..256: note = hyper
  source 1..256: mol_type = genomic DNA
gcgcgcaggccgggccgccagggactcaccggggtcgaagtgcgagctgaaggcgaagctggggttgaagaaggacgacgacatggccgggccagcggccggcgggcatcccgggagggcgctgcgctcaggacgcccgcggccccggcccgagccgccgcatcacccagcggccgccgcaggtgcggagcgcgccggcccccgcgccccgcgccccccgccgcagccgcagagcccgcaccggtgggggcggcgg

SEQ ID NO: 81339 - DNA, 105 bp, Homo sapiens
  misc_feature 1..105: note = chr17:79155470-79155575
  misc_feature 1..105: note = hypo
  source 1..105: mol_type = genomic DNA
cttcattgagtggaacgagatcaagtaatggctggcggccacggaggggtggggcccaggccacccagaccacgccgaatgcccacatggcggacccggccttcc

SEQ ID NO: 81340 - DNA, 168 bp, Homo sapiens
  misc_feature 1..168: note = chr17:79158112-79158280
  misc_feature 1..168: note = hypo
  source 1..168: mol_type = genomic DNA
ctcctgatgcagccacgtggcccccttgcctcctcagccaggcgccaccttgccctggggcctttgcacctccagccctcagcctggcatgctcttccctagacatccggctgcaagacagactctctcttcttcgatgttttctgcaaatgtcgaatcccaatgagg

SEQ ID NO: 81341 - DNA, 256 bp, Homo sapiens
  misc_feature 1..256: note = chr17:79166315-79166571
  misc_feature 1..256: note = hypo
  source 1..256: mol_type = genomic DNA
tcagccctcagggctcgggtcagtgcagagctgctctcctccagctgctgcctcagctcttccagctccgcccgctgcctgcggccagggaggagtcagcaggtgaggggtcatcgagtaaggagtcagggatgggagaggtcagcgggtgagggggcgggggggaggggtcagccagcgaggggtccctgggagagggcgtggtgcccccgggcggcacctggctgcctgctggcccagccgctccctctcctca

SEQ ID NO: 81342 - DNA, 30 bp, Homo sapiens
  misc_feature 1..30: note = chr17:79178454-79178484
  misc_feature 1..30: note = hypo
  source 1..30: mol_type = genomic DNA
gagcagagcaatgcacgaaacctgctcctg

SEQ ID NO: 81343 - DNA, 43 bp, Homo sapiens
  misc_feature 1..43: note = chr17:7919589-7919632
  misc_feature 1..43: note = hyper
  source 1..43: mol_type = genomic DNA
cgcctgacctgcaaccggggtgaggggccggcctccgcggcag

SEQ ID NO: 81344 - DNA, 40 bp, Homo sapiens
  misc_feature 1..40: note = chr17:79197382-79197422
  misc_feature 1..40: note = hyper
  source 1..40: mol_type = genomic DNA
tctccaaagttttaacgctgcgccccgtgcgtagccgctc

SEQ ID NO: 81345 - DNA, 212 bp, Homo sapiens
  misc_feature 1..212: note = chr17:79205207-79205419
  misc_feature 1..212: note = hypo
  source 1..212: mol_type = genomic DNA
cattcactggtcccacgcaggtggcaggtcagcagctgcagcacggcctcacagttgagcagtccacacctgcacagaggggacacctgggtggcgggtgcggcccgttccctcctccctcgcccacggttggggctgaggcagagcagggcgggtccgggcgcactcacgctttgatgaagtgctgtgcctcctcgcggctcaggaaggcg

SEQ ID NO: 81346 - DNA, 125 bp, Homo sapiens; identical to SEQ ID NO: 45263
  misc_feature 1..125: note = chr17:79211706-79211831
  misc_feature 1..125: note = hypo
  source 1..125: mol_type = genomic DNA

SEQ ID NO: 81347 - DNA, 30 bp, Homo sapiens
  misc_feature 1..30: note = chr17:79220179-79220209
  misc_feature 1..30: note = hypo
  source 1..30: mol_type = genomic DNA
cagctgccctgggggcggcatccttctggc

SEQ ID NO: 81348 - DNA, 30 bp, Homo sapiens
  misc_feature 1..30: note = chr17:79220690-79220720
  misc_feature 1..30: note = hypo
  source 1..30: mol_type = genomic DNA
tgggtttatcctcctcgtcctcctgcctct

SEQ ID NO: 81349 - DNA, 30 bp, Homo sapiens; identical to SEQ ID NO: 45264
  misc_feature 1..30: note = chr17:79226304-79226334
  misc_feature 1..30: note = hypo
  source 1..30: mol_type = genomic DNA

SEQ ID NO: 81350 - DNA, 39 bp, Homo sapiens
  misc_feature 1..39: note = chr17:79257246-79257285
  misc_feature 1..39: note = hypo
  source 1..39: mol_type = genomic DNA
agtcgccgatcacgacgtagaaggcgatgcaggtgccca

SEQ ID NO: 81351 - DNA, 18 bp, Homo sapiens
  misc_feature 1..18: note = chr17:79292579-79292597
  misc_feature 1..18: note = hypo
  source 1..18: mol_type = genomic DNA
ggccgggcatggtggcgg

SEQ ID NO: 81352 - DNA, 77 bp, Homo sapiens
  misc_feature 1..77: note = chr17:79292717-79292794
  misc_feature 1..77: note = hypo
  source 1..77: mol_type = genomic DNA
gtctcaaaaaaaaaaaagaaaagtttcccacggcctggggttttcagtgctaataccgggatcgccctgggcaaact

SEQ ID NO: 81353 - DNA, 38 bp, Homo sapiens
  misc_feature 1..38: note = chr17:79309612-79309650
  misc_feature 1..38: note = hypo
  source 1..38: mol_type = genomic DNA
atgggtaggcatggccgagggcacgaggtggtcacagg

SEQ ID NO: 81354 - DNA, 390 bp, Homo sapiens
  misc_feature 1..390: note = chr17:79316623-79317013
  misc_feature 1..390: note = hyper
  source 1..390: mol_type = genomic DNA
gagccggggccgcctcgggagcccctcgctggctcctgggcgccccactcggctcagcaatgtccgggccagacaaaggagtcgccagggaggggttaatccgcccctcacccttctccgtccttccttccgcccccttctcaggcggcgcggaggagagaagatgcggcccctaataatgtgtttggtttaacctgcggggtgtgggtatttgctgcgctttcttgggtgagggttgggccccttcccttccaccttcctccactcctgtgcatgataccctggctggggcctggggcgtcctgcgctggccagaagtcagggtcaccagggactctccgttctcgctcccgaagaggggacttgcgcggacggcgaggaggatcgatg

SEQ ID NO: 81355 - DNA, 94 bp, Homo sapiens
  misc_feature 1..94: note = chr17:79317370-79317464
  misc_feature 1..94: note = hyper
  source 1..94: mol_type = genomic DNA
ggtggcccttctagccgctaggcccacgacaggacttctagggaggggtccctgcaaatgcccttgggcgaagagaggacggaaagaatattct

SEQ ID NO: 81356 - DNA, 57 bp, Homo sapiens; identical to SEQ ID NO: 36829
  misc_feature 1..57: note = chr17:79317833-79317890
  misc_feature 1..57: note = hyper
  source 1..57: mol_type = genomic DNA

SEQ ID NO: 81357 - DNA, 36 bp, Homo sapiens
  misc_feature 1..36: note = chr17:79318173-79318209
  misc_feature 1..36: note = hyper
  source 1..36: mol_type = genomic DNA
ataacattcttctttcgactccggcttccgagccca

SEQ ID NO: 81358 - DNA, 41 bp, Homo sapiens
  misc_feature 1..41: note = chr17:79505417-79505458
  misc_feature 1..41: note = hypo
  source 1..41: mol_type = genomic DNA
ggccacaccgtggtccgcaggctccccgagaagctgattgt

SEQ ID NO: 81359 - DNA, 221 bp, Homo sapiens
  misc_feature 1..221: note = chr17:79544089-79544310
  misc_feature 1..221: note = hypo
  source 1..221: mol_type = genomic DNA
tgccaacaaaccccacggcctgctgagtaagcaatgcctggccacagcaaggggcagtgggttcctcagagataccctctggcccctccacagctggctccttgaaggaacgctgttcccttgctgctcctatgtcccctcagctccccacggcgctctgacccgccccaccccatcactgtgtagtcctcgccagactgcctgtccgcacagctctccag

SEQ ID NO: 81360 - DNA, 161 bp, Homo sapiens
  misc_feature 1..161: note = chr17:79609256-79609417
  misc_feature 1..161: note = hypo
  source 1..161: mol_type = genomic DNA
actcaactgtgactccggcatctgggtagggctcgcacctcccccattcccatgcccagggctgcactgttcacagactagcccagggccgcagtcaggaccagcccagcagcccagccacagaggagccagcgaacctctcccggcgcctgtgctggggg

SEQ ID NO: 81361 - DNA, 48 bp, Homo sapiens
  misc_feature 1..48: note = chr17:79612764-79612812
  misc_feature 1..48: note = hypo
  source 1..48: mol_type = genomic DNA
ccacatgcatgcacacgtatacccacatgtacacgcatatccacactg

SEQ ID NO: 81362 - DNA, 34 bp, Homo sapiens
  misc_feature 1..34: note = chr17:79615102-79615136
  misc_feature 1..34: note = hyper
  source 1..34: mol_type = genomic DNA
ctccggcggtggctgcgcgcgaacctggctgcct

SEQ ID NO: 81363 - DNA, 28 bp, Homo sapiens
  misc_feature 1..28: note = chr17:79615434-79615462
  misc_feature 1..28: note = hyper
  source 1..28: mol_type = genomic DNA
cgggtgacttcgccgcaggacctaccca

SEQ ID NO: 81364 - DNA, 256 bp, Homo sapiens
  misc_feature 1..256: note = chr17:79619054-79619310
  misc_feature 1..256: note = hypo
  source 1..256: mol_type = genomic DNA
tgtgagtgtgcctcacgtgcatatgtggaggtgtgagcgtgtttgtgcataagagtgtcatgcccgtgtgtgcgcacacgtgtgagtggacactcctcggtgcgttgatgggagcgcggtgcctgtgtgcgcacacgagtgagtggacactcctcggtgcactgatgggagcgagatgcccgtgtgtgcgcatgtgtgagtggacactcctcggtgcattgtgccatggctgtccctgggtggcagtggttgtatt

SEQ ID NO: 81365 - DNA, 104 bp, Homo sapiens
  misc_feature 1..104: note = chr17:79626311-79626415
  misc_feature 1..104: note = hypo
  source 1..104: mol_type = genomic DNA
acctgggtgacagagcgagacctcaactctgaaatagtaaaataggccaggcatggtggctcatccctgtacttttggaggacgaggtggctggaccacctgag

SEQ ID NO: 81366 - DNA, 104 bp, Homo sapiens
  misc_feature 1..104: note = chr17:79626655-79626759
  misc_feature 1..104: note = hypo
  source 1..104: mol_type = genomic DNA
ttaaacggtgatgtggaacactctttaaattgtcgttcaccacattttcatatcttcacaataatgcaaaacacagtcacttgcagaaccggttctgatgactt

SEQ ID NO: 81367 - DNA, 82 bp, Homo sapiens
  misc_feature 1..82: note = chr17:79634674-79634756
  misc_feature 1..82: note = hypo
  source 1..82: mol_type = genomic DNA
tgccagacccaactattgtttctcttactgattctgcttgtgctttacttgggacgggtctcacccccgtgttctttctccc

SEQ ID NO: 81368 - DNA, 30 bp, Homo sapiens
  misc_feature 1..30: note = chr17:79635057-79635087
  misc_feature 1..30: note = hypo
  source 1..30: mol_type = genomic DNA
cgctgtggttccagacgaggcttggaagga

SEQ ID NO: 81369 - DNA, 30 bp, Homo sapiens; identical to SEQ ID NO: 45271
  misc_feature 1..30: note = chr17:79643888-79643918
  misc_feature 1..30: note = hypo
  source 1..30: mol_type = genomic DNA

SEQ ID NO: 81370 - DNA, 37 bp, Homo sapiens
  misc_feature 1..37: note = chr17:79663023-79663060
  misc_feature 1..37: note = hypo
  source 1..37: mol_type = genomic DNA
gcaggcgtaggtgcccgcgccacggggcctcggctca

SEQ ID NO: 81371 - DNA, 87 bp, Homo sapiens
  misc_feature 1..87: note = chr17:79668241-79668328
  misc_feature 1..87: note = hypo
  source 1..87: mol_type = genomic DNA
cagtggggattgtcccgtacgtctgctcacagggggagacgcatacccgaggccccttctcagcagacagaacgaggacacaagtct

SEQ ID NO: 81372 - DNA, 145 bp, Homo sapiens; identical to SEQ ID NO: 45272
  misc_feature 1..145: note = chr17:79668589-79668734
  misc_feature 1..145: note = hypo
  source 1..145: mol_type = genomic DNA

SEQ ID NO: 81373 - DNA, 226 bp, Homo sapiens
  misc_feature 1..226: note = chr17:79677781-79678007
  misc_feature 1..226: note = hyper
  source 1..226: mol_type = genomic DNA
agcccaggcttggtgcgggcagtgctgcactgcactctcctggttgcctcctgagcacctccacccgcttccccaccaggcgtggctgtgttttcacccccagtgtccatctggcacccttctcgattgccaggtagttacggtctgtgtgggcaacacctgagggacccaaccaaaccaaggtccaggacacacttccgggcaggggtaccgcctctggttagct

SEQ ID NO: 81374 - DNA, 30 bp, Homo sapiens
  misc_feature 1..30: note = chr17:79691709-79691739
  misc_feature 1..30: note = hypo
  source 1..30: mol_type = genomic DNA
ccactatggcctgagcgtctgccttatcat

SEQ ID NO: 81375 - DNA, 36 bp, Homo sapiens
  misc_feature 1..36: note = chr17:79695465-79695501
  misc_feature 1..36: note = hypo
  source 1..36: mol_type = genomic DNA
ggccagctctagctggttttacgggtgaatttttac

SEQ ID NO: 81376 - DNA, 228 bp, Homo sapiens
  misc_feature 1..228: note = chr17:79761585-79761813
  misc_feature 1..228: note = hyper
  source 1..228: mol_type = genomic DNA
aagggggcgagggggcgcccagggaggcggagggagcgagaggaaggggggctgagccacggcccccacgcccgcgcgcccctccgcgtcccagggcgtcccctcccggagctgggacccaccgcgaccaccacctgctgggccagggtccgcgggctcaggggtctgcaggattagggtctgcggaaccaggacccgtgggacaaaggtctgtggggcgcgggtccg

SEQ ID NO: 81377 - DNA, 839 bp, Homo sapiens
  misc_feature 1..839: note = chr17:79761833-79762672
  misc_feature 1..839: note = hyper
  source 1..839: mol_type = genomic DNA
cgagtctgcgtatggccggggtacgaggcgctccctgcgcagggtgggcaggaccgaagctcgccgggaggctgcgcggagggcgggcggggaccctcggctgccgctcccacccccgcggggccgcccccgagcccgccctccgccgccgccctcgccctgcgtcgccgccggaaagtttgcaccgaccccgatctggcagcgccgcgaagacgagcggtcaccggcgcccgacccgagcgcgcccagaggacggcggggagccaagccgacccccgagcagcgccgcgcggtgagcacctgggccgcggccccgaggggacgttggggagtcgacccggtggggacagagaccgcggggcgggcgcggcggggccgggggcgcggggagcggggagccggccgggcggtctccggggtccgggctggtgcgctcctcagtcccgtcagacacccccgttcccaaccccggctcggacaccacccggtcctgcaccgtcgggcaggtccaggggtctcagcccctcccccgttctctggtcctggggggcgcggctgggggcgggggtgtcgctggccgcctggcgccctgcggcggccacactgcagcggccacactccccactcagggccccgggccccgccgccctggggagcgcacaaagcgccgcggacgcgtccccgaggcgcggggtctcaccagcgctgtctcccctcggtgggctcctgccccgaggactgcccggtggcaccggcgcggcccaggatggggtgaggggtgtctgcgccccgcctggccgctcctcttccgcggcccacactggcgactttgaccccgg

SEQ ID NO: 81378 - DNA, 49 bp, Homo sapiens; identical to SEQ ID NO: 36363
  misc_feature 1..49: note = chr17:7976269-7976318
  misc_feature 1..49: note = hyper
  source 1..49: mol_type = genomic DNA

SEQ ID NO: 81379 - DNA, 455 bp, Homo sapiens
  misc_feature 1..455: note = chr17:79769238-79769693
  misc_feature 1..455: note = hypo
  source 1..455: mol_type = genomic DNA
ggacagggaggaggacgggcgctgactggctgtgcccacagcaagctgcactgcacccgcaatgccatccacgcgaatctgtttgcgtccttcgtgctgaaagccagctccgtgctggtcattgatgggctgctcaggacccgctacagccagaaaattggcgacgacctcagtgtcagcacctggctcagtgatggagtgagcccccctcggcggccccaggcaggtgggtgggtgggcagccaggcaggtggccacgtagccgcgctcacactgcacctgtaccaggcggtggctggctgccgtgtggccgcggtgttcatgcaatatggcatcgtggccaactactgctggctgctggtggagggcctgtacctgcacaacctgctgggcctggccaccctccccgagaggagcttcttcagcctctacctgggcatcggctggggtgagtg

SEQ ID NO: 81380 - DNA, 95 bp, Homo sapiens
  misc_feature 1..95: note = chr17:79774960-79775055
  misc_feature 1..95: note = hypo
  source 1..95: mol_type = genomic DNA
atcaagaataattcacgttagaaataaaaatacagagcaaaatttaaaaatgcaaagaatgaggtgaagagttcaaagtggtcacctcggggccg

SEQ ID NO: 81381 - DNA, 125 bp, Homo sapiens
  misc_feature 1..125: note = chr17:7982585-7982710
  misc_feature 1..125: note = hyper
  source 1..125: mol_type = genomic DNA
atctctcaaggataacgagagacggctgaatacatgcaggtccacacgctcacataagcgcgcgcacactcggaggagcattcgcgcacacagaggctcagcggcagcgccgcctgcagcccagg

SEQ ID NO: 81382 - DNA, 52 bp, Homo sapiens
  misc_feature 1..52: note = chr17:79826977-79827029
  misc_feature 1..52: note = hypo
  source 1..52: mol_type = genomic DNA
gcggccccgcttccccgcctggcagcacgcacccaagcggccccctctgccc

SEQ ID NO: 81383 - DNA, 34 bp, Homo sapiens
  misc_feature 1..34: note = chr17:79847763-79847797
  misc_feature 1..34: note = hypo
  source 1..34: mol_type = genomic DNA
agtgtggggatactccggccgcaggcacacagcg

SEQ ID NO: 81384 - DNA, 751 bp, Homo sapiens
  misc_feature 1..751: note = chr17:79859940-79860691
  misc_feature 1..751: note = hyper
  source 1..751: mol_type = genomic DNA
cttgcgcgcctccagcgctcgcccgcgcggctggttcctttgggatgcggaggtgcgacggctcctccgcgcgcgcccgctgcaccccagcccgcccgccgcccctcccggccctccgcagcctcggcccgccctcgccgcagatataaggcggcccaggcggtggctgctccgagcccggacgccgccgcccaccagtcagccggcgtccccatggcccggtccgcgacactggcggccgccgccctggcgctgtgcctgctgctggcgccgcctggcctcgcgtggtacaagccagcggcggggcacagctcctactcggtgggccgcgccgcggggctgctgtccggcctccgcaggtccccgtacgcgcggcgctcccagccctacagaggggcggaacccccgggcggggccggcgcctccccggagctgcaactgcaccccaggctgcggagcctcgtgagtccggcgtgccggggactgatggggggcggcggcaggacgtgggtgggggtgcggcggcccctcagcctttgcttgcctgccccccaggctgtgtgcgtccaggacgtcgccccaaacctgcagaggtgcgagcggctccccgacggccgcgggacctaccagtgcaaggcgaacgtcttcctgtccctgcgcgcagccgactgcctcgccgcctgagcccggacctctcctggcaccgctgggggccccccgcccccaccgtcccactcggtgaccccaggcc

SEQ ID NO: 81385 - DNA, 147 bp, Homo sapiens
  misc_feature 1..147: note = chr17:79870402-79870549
  misc_feature 1..147: note = hypo
  source 1..147: mol_type = genomic DNA
tctgcttctgcacagcgacttccgactgtggctgccttcttcaccagcacgcaggggagtcgccagtgagaaaatgggatcctgccacctgccaaaaagggaaagcggcatcaggcgggcctgggagcctctcgcagtcacacctgc

SEQ ID NO: 81386 - DNA, 391 bp, Homo sapiens
  misc_feature 1..391: note = chr17:79874636-79875027
  misc_feature 1..391: note = hypo
  source 1..391: mol_type = genomic DNA
agcatgactggacttttacatgtgacttgtggagggaggagactaaaccccagggctccgggtatttgagtcagtagtgaactccctttttgcattcttgctgctgagcctctgctgttctttgcttggagtgcctcattccaaccttctgtaaatctcacccatccttcaaggcccaatcaaggccacctcccacaaaaagccaacgcaggtgggtttcccaactccaagagcgcagagtgtgtgtctgagtttgctctagcgacccagcacagccagctttacagtatggttatttgttcacatgcctgatccttgtcacctaaaagcttcctgagaacagaaatcacctgggttcagatctgctaggccgacgcgtgcccaacacccc

SEQ ID NO: 81387 - DNA, 58 bp, Homo sapiens
  misc_feature 1..58: note = chr17:79886467-79886525
  misc_feature 1..58: note = hyper
  source 1..58: mol_type = genomic DNA
ccgagccccacagcacgttgtcgccgtgtgcgctgtggggctgcgtgtggttcttacg

SEQ ID NO: 81388 - DNA, 30 bp, Homo sapiens
  misc_feature 1..30: note = chr17:79887265-79887295
  misc_feature 1..30: note = hypo
  source 1..30: mol_type = genomic DNA
ttgtagaaagagtatcgagggaggggaggt

SEQ ID NO: 81389 - DNA, 259 bp, Homo sapiens
  misc_feature 1..259: note = chr17:79887590-79887849
  misc_feature 1..259: note = hypo
  source 1..259: mol_type = genomic DNA
gcacactcatctccacgaccggctttaagtgcggccttgaggcctggctccctgtttggacttctctgcacctccaggagctcacttcccgtcacagctggatgcctcctcccgcaggcacctcccgggcatcctcccgccccaggctgcaccttctgtgggactggcccccgcaggcacctcccgggcaccctcccgccccaggctgcagcttctgtgggactgagccccgcaggcacctccccggcatcctcccgcc

SEQ ID NO: 81390 - DNA, 77 bp, Homo sapiens
  misc_feature 1..77: note = chr17:79892813-79892890
  misc_feature 1..77: note = hypo
  source 1..77: mol_type = genomic DNA
gctgccactgagccccgtgacggcatcaatcaggtcctcttccacctccgtgcagaagcccacgctgctcagcagct

SEQ ID NO: 81391 - DNA, 97 bp, Homo sapiens
  misc_feature 1..97: note = chr17:79899293-79899390
  misc_feature 1..97: note = hypo
  source 1..97: mol_type = genomic DNA
cagcggatacaggaccgcagccgtcgcgcatagcagggtggccagcatggcgaaggcggcggtgaagttgccccaggagagccgcaggcagccgtgg

SEQ ID NO: 81392 - DNA, 23 bp, Homo sapiens
  misc_feature 1..23: note = chr17:79913143-79913166
  misc_feature 1..23: note = hypo
  source 1..23: mol_type = genomic DNA
actgcgcccggcctacaagacct

SEQ ID NO: 81393 - DNA, 30 bp, Homo sapiens
  misc_feature 1..30: note = chr17:79913444-79913474
  misc_feature 1..30: note = hypo
  source 1..30: mol_type = genomic DNA
gcctcccctgacccccgctgctgcccccac

SEQ ID NO: 81394 - DNA, 197 bp, Homo sapiens
  misc_feature 1..197: note = chr17:79914766-79914963
  misc_feature 1..197: note = hypo
  source 1..197: mol_type = genomic DNA
acggcggatggcctccgtgggcgcgcacgtgatcgtgtcgacgcagtctgtgtggcgatactgcttgttgtccaggaaccagccggagtcagccaggcctcgcacctggatggctgggtagcccagcttctccagctgctcagccacacggtccacattcaggagcaccccggtgccccccgcgctgcaaggagggc

SEQ ID NO: 81395 - DNA, 66 bp, Homo sapiens
  misc_feature 1..66: note = chr17:79917369-79917435
  misc_feature 1..66: note = hyper
  source 1..66: mol_type = genomic DNA
cgggagctcatgaggcgccgcatggtgtcgtatctggagtcgcagttctcgcggttgaagcagtac

SEQ ID NO: 81396 - DNA, 140 bp, Homo sapiens
  misc_feature 1..140: note = chr17:79918501-79918641
  misc_feature 1..140: note = hyper
  source 1..140: mol_type = genomic DNA
agtaggaggtgcaggcgcaggtcctcgttgagctgctgcgcggagcaggggtacagggactgcgccaggctcttgacttgcgccatgaagctgtccatgttaccctccacggccgtgaagtccagcgggaagctctccac

SEQ ID NO: 81397 - DNA, 30 bp, Homo sapiens
  misc_feature 1..30: note = chr17:79926633-79926663
  misc_feature 1..30: note = hypo
  source 1..30: mol_type = genomic DNA
ggtagaaactagattcgtttaatgaaataa

SEQ ID NO: 81398 - DNA, 87 bp, Homo sapiens
  misc_feature 1..87: note = chr17:79950224-79950311
  misc_feature 1..87: note = hypo
  source 1..87: mol_type = genomic DNA
ccctccctgagatcccgcatgagggagggaatctgatccctctggaggagccgcacatcaaagccgggctggcgtttgatgtcacgc

SEQ ID NO: 81399 - DNA, 30 bp, Homo sapiens
  misc_feature 1..30: note = chr17:79952351-79952381
  misc_feature 1..30: note = hypo
  source 1..30: mol_type = genomic DNA
ggagccagtgctgctcgcccctcctgtgcg

SEQ ID NO: 81400 - DNA, 30 bp, Homo sapiens
  misc_feature 1..30: note = chr17:7996014-7996044
  misc_feature 1..30: note = hypo
  source 1..30: mol_type = genomic DNA
tccctccctgaccaccgtccctcatgtttc

SEQ ID NO: 81401 - DNA, 76 bp, Homo sapiens
  misc_feature 1..76: note = chr17:79973168-79973244
  misc_feature 1..76: note = hypo
  source 1..76: mol_type = genomic DNA
tcgtccgagcagtggcgatccctcccgagtcaaggctgggcacaagcacgtggggacaggccgggtaggctgcctg

SEQ ID NO: 81402 - DNA, 30 bp, Homo sapiens
  misc_feature 1..30: note = chr17:79977416-79977446
  misc_feature 1..30: note = hypo
  source 1..30: mol_type = genomic DNA
ggcccttgtgggaaacgggaaaacacgtct

SEQ ID NO: 81403 - DNA, 30 bp, Homo sapiens
  misc_feature 1..30: note = chr17:79982080-79982110
  misc_feature 1..30: note = hypo
  source 1..30: mol_type = genomic DNA
ctgaaaaggggcccacggggagggccttgg

SEQ ID NO: 81404 - DNA, 54 bp, Homo sapiens
  misc_feature 1..54: note = chr17:79987004-79987058
  misc_feature 1..54: note = hypo
  source 1..54: mol_type = genomic DNA
aaggccatgcaggagcgggtgcagaggctggaggcggcgcggctgtccctggag

SEQ ID NO: 81405 - DNA, 622 bp, Homo sapiens
  misc_feature 1..622: note = chr17:79988475-79989097
  misc_feature 1..622: note = hyper
  source 1..622: mol_type = genomic DNA
gccctgcagtgatggcgagcgaccaccgagaggcgctgctggacagggagagcgagaacgcgtctctccgggagaagctgcggctccgggaggcggagatcgcccgcatccgggacgaggaggcccagagggcgagcttcctgcagaacgccgtcctggcttacgtgcaggcgtcccccgtgaggaccctgagccccccaaagtgagacaggccgggaggacccgggcgcagtaggagtgcatcaggcggcgcccgagatggaccaggggctgcgtcccgcccgcgccgcctctttgagacccgggtcgtctgttccacgcggcggttgcggcgactgttggtggtgtcgcggctgcgggggaaccccgtgggaggcgcctgggaagggctccctaccggccccttcttcccggtcgacgccacgtgggagcacaccgggaaggggtcccgcgggcgcgtctccccctcgccttttgcgatgtcaccgtgaacgctgcggccgcctgcgcgcggcggggtttggaaatacagcgcgtttgcactttgtgatacattctggccccgcctctccctccaaacgcgcgaccgtccgtgcctctccaaacgcgcggccctctgccc

SEQ ID NO: 81406 - DNA, 30 bp, Homo sapiens; identical to SEQ ID NO: 45281
  misc_feature 1..30: note = chr17:80163670-80163700
  misc_feature 1..30: note = hypo
  source 1..30: mol_type = genomic DNA

SEQ ID NO: 81407 - DNA, 63 bp, Homo sapiens
  misc_feature 1..63: note = chr17:80186555-80186618
  misc_feature 1..63: note = hyper
  source 1..63: mol_type = genomic DNA
gacgttgggacctgccgcgctgcgctccgaggcggggaaacggagggacggcggggcggaggg

SEQ ID NO: 81408 - DNA, 231 bp, Homo sapiens
  misc_feature 1..231: note = chr17:80188720-80188951
  misc_feature 1..231: note = hyper
  source 1..231: mol_type = genomic DNA
gccacgccgggcagccgcacgcaacggaaccgaaccgccgggctcctgctccgagacccgcagttcacgagtcgacgcccccgagtcccgagccgcgcccactggtcccacctctgcagcaagtggagtcggccccgccctgtggcttcgaggccccgacgcctggcgcggctcccgggctccgctgaccccggtggacccgcgcgccggcaattacggtagcgtccagta

SEQ ID NO: 81409 - DNA, 30 bp, Homo sapiens
  misc_feature 1..30: note = chr17:80192672-80192702
  misc_feature 1..30: note = hypo
  source 1..30: mol_type = genomic DNA
aggggtctgcggacacgcttgcaggaggaa

SEQ ID NO: 81410 - DNA, 30 bp, Homo sapiens
  misc_feature 1..30: note = chr17:80193470-80193500
  misc_feature 1..30: note = hypo
  source 1..30: mol_type = genomic DNA
cagaatcatggtgtgcgtggtccctgccca

SEQ ID NO: 81411 - DNA, 157 bp, Homo sapiens
  misc_feature 1..157: note = chr17:80194730-80194887
  misc_feature 1..157: note = hypo
  source 1..157: mol_type = genomic DNA
ccactggggtcatcacgggtgagtggggccggccggtgggccgcacgtgccaggaggggcaggggccgtgcacttctgctcctgggtccaggcctctggaggacagcagggcgggtggctgcggggtgtcccggccccacctcgttgtccccctctc

SEQ ID NO: 81412 - DNA, 30 bp, Homo sapiens; identical to SEQ ID NO: 45282
  misc_feature 1..30: note = chr17:80201941-80201971
  misc_feature 1..30: note = hypo
  source 1..30: mol_type = genomic DNA

SEQ ID NO: 81413 - DNA, 30 bp, Homo sapiens
  misc_feature 1..30: note = chr17:8021183-8021213
  misc_feature 1..30: note = hyper
  source 1..30: mol_type = genomic DNA
cccattcgatctagccgctgcttggggctt

SEQ ID NO: 81414 - DNA, 30 bp, Homo sapiens
  misc_feature 1..30: note = chr17:80222132-80222162
  misc_feature 1..30: note = hypo
  source 1..30: mol_type = genomic DNA
ggagggctccacagacgtggcacagccact

SEQ ID NO: 81415 - DNA, 90 bp, Homo sapiens
  misc_feature 1..90: note = chr17:80229870-80229960
  misc_feature 1..90: note = hypo
  source 1..90: mol_type = genomic DNA
gatcttggaataactcgtgcattgcacaatcccactaacaagtgcggaaaattaagttactttaaaattacaaacttgggccaggcgcgg

SEQ ID NO: 81416 - DNA, 29 bp, Homo sapiens
  misc_feature 1..29: note = chr17:80230200-80230229
  misc_feature 1..29: note = hypo
  source 1..29: mol_type = genomic DNA
caagagcgaaactccgtctcaggaaaaaa

SEQ ID NO: 81417 - DNA, 252 bp, Homo sapiens
  misc_feature 1..252: note = chr17:80240815-80241067
  misc_feature 1..252: note = hypo
  source 1..252: mol_type = genomic DNA
gttccaccctccctgcgcagggctgggcacaccgggcgccgtcagtacactgtctgcaatggccgagaaggcagcgctccatgcaggaggaacgatgcgtccttgccactgccctcatttgtgacttgggacagctgctcccagcaggatggtgtcctttcctccagagccaggggaggagtgaggcctggtgcccgggcggtacctgcctcacccaggtcgcagagagctattcctcggcagcctctgcca

SEQ ID NO: 81418 - DNA, 46 bp, Homo sapiens
  misc_feature 1..46: note = chr17:80246775-80246821
  misc_feature 1..46: note = hypo
  source 1..46: mol_type = genomic DNA
cagagggacaccctccgacacacctggccagcgctcctcaaaactg

SEQ ID NO: 81419 - DNA, 99 bp, Homo sapiens
  misc_feature 1..99: note = chr17:80251905-80252004
  misc_feature 1..99: note = hypo
  source 1..99: mol_type = genomic DNA
tgacttaggtatatacgcatggggggaatcctcgtaaggcaagaacgtgctgcacattctggggactgggacaggataagcacacgagtagatctaagt

SEQ ID NO: 81420 - DNA, 259 bp, Homo sapiens
  misc_feature 1..259: note = chr17:80254257-80254516
  misc_feature 1..259: note = hypo
  source 1..259: mol_type = genomic DNA
ctgcgggacagacccggcattcttcgttatccattcattcgttgacggacacttaggcgagttccgtaccttgattgcagtgactaatgctgccctaatggcatttcattggaaatgaactattacaggagggtttttgaagtggcttatgatccagaaaaggaatcttccaatacctctgtgccccaaaaccttgggtaaaataccaacagtgcagttggtctaaaaggcaccacttaaattgcgttgcagatgacgt

SEQ ID NO: 81421 - DNA, 30 bp, Homo sapiens
  misc_feature 1..30: note = chr17:80268179-80268209
  misc_feature 1..30: note = hypo
  source 1..30: mol_type = genomic DNA
gaatcttggggagcacgggcctgagcacaa

SEQ ID NO: 81422 - DNA, 30 bp, Homo sapiens
  misc_feature 1..30: note = chr17:80272271-80272301
  misc_feature 1..30: note = hypo
  source 1..30: mol_type = genomic DNA
gcagcatgggagctgcgctggctggggaag

SEQ ID NO: 81423 - DNA, 63 bp, Homo sapiens
  misc_feature 1..63: note = chr17:80274115-80274178
  misc_feature 1..63: note = hyper
  source 1..63: mol_type = genomic DNA
gaggaaggagatcaccgccagggccgcagggagggcagaggctgctggcgggtcagggagggc

SEQ ID NO: 81424 - DNA, 35 bp, Homo sapiens
  misc_feature 1..35: note = chr17:80277765-80277800
  misc_feature 1..35: note = hypo
  source 1..35: mol_type = genomic DNA
tgtgtgcagagaagggtgcacgtgactcacgcgtg

SEQ ID NO: 81425 - DNA, 50 bp, Homo sapiens
  misc_feature 1..50: note = chr17:8027872-8027922
  misc_feature 1..50: note = hyper
  source 1..50: mol_type = genomic DNA
ctgggtgaatctgtccgactcaaccgaagctctgccgggaggttggagag

SEQ ID NO: 81426 - DNA, 80 bp, Homo sapiens
  misc_feature 1..80: note = chr17:80281051-80281131
  misc_feature 1..80: note = hypo
  source 1..80: mol_type = genomic DNA
caggaggagagggggcgcaggaccagaggtggaaggagacccagagcgcaggtgtgtcggggcagcgagggaaacatcta

SEQ ID NO: 81427 - DNA, 156 bp, Homo sapiens
  misc_feature 1..156: note = chr17:80287972-80288128
  misc_feature 1..156: note = hypo
  source 1..156: mol_type = genomic DNA
cagggggcctgggtccggctccctcaccccacgctccacgatgccagctcagccacccaccttggaaccgtgcagatggacagcagggagggtcggggctgctgggggctcccccactgctctccgcaccaccccgccgaccgtgtccgggagggg

SEQ ID NO: 81428 - DNA, 497 bp, Homo sapiens
  misc_feature 1..497: note = chr17:80289234-80289731
  misc_feature 1..497: note = hypo
  source 1..497: mol_type = genomic DNA
ggcagcaggtgtcagcgactttgggttgctgtgggaatttgctccgtttatcagaagaaaacgcaccctggcaacacaggcccctctcaggtcaccaggcacatctggtcacatctgagtctcagataaacaaccaatgatgtcctggtgaaagcttgtcccgtgggacactcgggacacacttatattaaaacacgattaacgatctcaaactcagatgttactgggtatcctgcgtttttgttggcagctctgccactctgcccgtctgcctgagtcctctcctgccatcctcctgaccagaggcgtgggcttgagttgaatgccacgcagtggctaaaaatcagagagagggcaggcggcagggcgcggccccagggaaagtggccaggtgggcggtgactggccgggcagctccgtgtgtggcacagggagacctggcacagggagaccaggtacagggagacgaggcgcacggagcctcaaaacttctagag

SEQ ID NO: 81429 - DNA, 76 bp, Homo sapiens
  misc_feature 1..76: note = chr17:80290031-80290107
  misc_feature 1..76: note = hypo
  source 1..76: mol_type = genomic DNA
caaaaaacaaacttctagagcgggaaaagatggaggcggcaatcagatttctctcaaaccacgaacacaggggtcg

SEQ ID NO: 81430 - DNA, 43 bp, Homo sapiens
  misc_feature 1..43: note = chr17:80291659-80291702
  misc_feature 1..43: note = hyper
  source 1..43: mol_type = genomic DNA
gggccagggaggaggcggcggacccgcgcgggacccacctccc

SEQ ID NO: 81431 - DNA, 30 bp, Homo sapiens
  misc_feature 1..30: note = chr17:80294443-80294473
  misc_feature 1..30: note = hypo
  source 1..30: mol_type = genomic DNA
gagccactgtgctggcggcatttgcttttc

SEQ ID NO: 81432 - DNA, 135 bp, Homo sapiens; identical to SEQ ID NO: 45289
  misc_feature 1..135: note = chr17:80300182-80300317
  misc_feature 1..135: note = hypo
  source 1..135: mol_type = genomic DNA

SEQ ID NO: 81433 - DNA, 750 bp, Homo sapiens
  misc_feature 1..750: note = chr17:80329251-80330001
  misc_feature 1..750: note = hyper
  source 1..750: mol_type = genomic DNA
tttctatgaccctctcggggtttaggggtgttcctgccccccacctgcgcgcgggcgggtccagggcttggtggacacggagaatcccaggctccgtgccctgcaaacacgggcgtgaggggcgcaggggtgaacgctggaggcggagaacccaagaggggctgcggggtcagccttggggcagccgggctggaggcagcttcgctccgcagacgcagacgcgagacccgcctgggaccctccgccgaccccgctgcggccccgcgacccccgcgtcttcccggcgccgcgcggtcagcgccgccccctagacacccggcgccgtcccctccgcgcgcctgctgcccgctggggttattttaataccgggccctggcgcggggcgcggcgcattcccagctggcggcgggcaggtggcggcggcgcagagacccggcgcggggcggggggcgcggctttggtggcgggactggcgggcgcccctgccgtgtgctctggaagccgaggccaccgcggagcccctcgcgccccctctgcgctgggacaggggagcgcgcctcggaaagttccccgcggccccgctgcgcgaggagtttggagccgcgagcggctgcccccacgcgcgaccccaggctcggcgggcaggtctggccgctcagtgaccggaggcaggtgggtcctcggtgggtgaccgggagcgcgcggggactgccgggtctgtgcccttcggggccctccgcagggctgggc

SEQ ID NO: 81434 - DNA, 57 bp, Homo sapiens
  misc_feature 1..57: note = chr17:80330164-80330221
  misc_feature 1..57: note = hyper
  source 1..57: mol_type = genomic DNA
cgcgcacaactggggagcccggtgcaccctcggcttctgcgccgtcccctgggtgag

SEQ ID NO: 81435 - DNA, 43 bp, Homo sapiens
  misc_feature 1..43: note = chr17:80332249-80332292
  misc_feature 1..43: note = hypo
  source 1..43: mol_type = genomic DNA
ctggcagctctgtgccggagccgcctggcggccccaacgcaac

SEQ ID NO: 81436 - DNA, 191 bp, Homo sapiens
  misc_feature 1..191: note = chr17:80333050-80333241
  misc_feature 1..191: note = hyper
  source 1..191: mol_type = genomic DNA
accaggccccgctggcgccgcggacggcgcgcatcgtcaactacctgaccacctgcctcacctacggcaacagctgcgccaaccccttcctctacacgctgctcaccaggaactaccgcgaccacctgcgcggccgcgtgcggggcccgggcagcgggggaggccgggggcccgttccctccctgcagccc

SEQ ID NO: 81437 - DNA, 30 bp, Homo sapiens
  misc_feature 1..30: note = chr17:80336816-80336846
  misc_feature 1..30: note = hypo
  source 1..30: mol_type = genomic DNA
atgtcagcacggggccgatgaggacagaat

SEQ ID NO: 81438 - DNA, 151 bp, Homo sapiens; identical to SEQ ID NO: 45290
  misc_feature 1..151: note = chr17:80338743-80338894
  misc_feature 1..151: note = hypo
  source 1..151: mol_type = genomic DNA

SEQ ID NO: 81439 - DNA, 30 bp, Homo sapiens
  misc_feature 1..30: note = chr17:80344822-80344852
  misc_feature 1..30: note = hypo
  source 1..30: mol_type = genomic DNA
cctcacaaggggctacgggggaaggaaagc

SEQ ID NO: 81440 - DNA, 49 bp, Homo sapiens
  misc_feature 1..49: note = chr17:80394753-80394802
  misc_feature 1..49: note = hypo
  source 1..49: mol_type = genomic DNA
cagcccatggtgcctcgggacggccaccgtgcaccggtgcctcacctcc

SEQ ID NO: 81441 - DNA, 46 bp, Homo sapiens
  misc_feature 1..46: note = chr17:80395100-80395146
  misc_feature 1..46: note = hypo
  source 1..46: mol_type = genomic DNA
ccttcaagggtgccacggggcccagccaggccgtgccccctgttga

SEQ ID NO: 81442 - DNA, 216 bp, Homo sapiens
  misc_feature 1..216: note = chr17:80447977-80448193
  misc_feature 1..216: note = hypo
  source 1..216: mol_type = genomic DNA
acaggcgtgagccactgcacctggcaaaaaatttttttttaaaaaggagaaagcagtttaaccacaaacagtgaaacagagctggcagacgcctgaaactccatggaaccatgcagctgtaccctagggctcctcccaggaaaagagagatgtcaacgtggcccaaggtgtcctgaagcactgggattggattaactcgagcgatggccttcccag

SEQ ID NO: 81443 - DNA, 53 bp, Homo sapiens
  misc_feature 1..53: note = chr17:80448677-80448730
  misc_feature 1..53: note = hypo
  source 1..53: mol_type = genomic DNA
ccacagctggcctgccgtgaagccgcccctgcaggtcgcgtggggaggccagg

SEQ ID NO: 81444 - DNA, 30 bp, Homo sapiens
  misc_feature 1..30: note = chr17:80453489-80453519
  misc_feature 1..30: note = hypo
  source 1..30: mol_type = genomic DNA
actgaaagtatgagccgggacactcaaagg

SEQ ID NO: 81445 - DNA, 30 bp, Homo sapiens
  misc_feature 1..30: note = chr17:80453917-80453947
  misc_feature 1..30: note = hypo
  source 1..30: mol_type = genomic DNA
acgttgccaagagcacgggagggaggggag

SEQ ID NO: 81446 - DNA, 56 bp, Homo sapiens
  misc_feature 1..56: note = chr17:80455848-80455904
  misc_feature 1..56: note = hyper
  source 1..56: mol_type = genomic DNA
gcgcagtgactggcccggaattccgcgcgtcttcccggtagcgtttttcctttgtc

SEQ ID NO: 81447 - DNA, 180 bp, Homo sapiens
  misc_feature 1..180: note = chr17:80479365-80479545
  misc_feature 1..180: note = hypo
  source 1..180: mol_type = genomic DNA
acgctttcggttgttggagatgctggtaagagctgttgcttttcttcttgacttgcgtgttgtgtgtgtgtgcatgcgctgttctgtttcttagcatggaaaggtgcaccagcatattccttaaactttggtagtagcattttaaagaatgttattttcaggccgggcgcggtggctcac

SEQ ID NO: 81448 - DNA, 32 bp, Homo sapiens
  misc_feature 1..32: note = chr17:80485937-80485969
  misc_feature 1..32: note = hypo
  source 1..32: mol_type = genomic DNA
tgctgggattacaggtgcgagccaccctgcct

SEQ ID NO: 81449 - DNA, 30 bp, Homo sapiens
  misc_feature 1..30: note = chr17:80517466-80517496
  misc_feature 1..30: note = hypo
  source 1..30: mol_type = genomic DNA
atcctgctggaacctcgtgccaggctggtc

SEQ ID NO: 81450 - DNA, 84 bp, Homo sapiens
  misc_feature 1..84: note = chr17:80518273-80518357
  misc_feature 1..84: note = hypo
  source 1..84: mol_type = genomic DNA
attacaggagtgggccaccgtgcccggccctcctcgctgttatttaagggaagcggtctcactgtgtggcgcaggctggctttg

SEQ ID NO: 81451 - DNA, 30 bp, Homo sapiens
  misc_feature 1..30: note = chr17:80526057-80526087
  misc_feature 1..30: note = hypo
  source 1..30: mol_type = genomic DNA
caggtggagacagcccgaaggtaaaggctt

SEQ ID NO: 81452 - DNA, 64 bp, Homo sapiens
  misc_feature 1..64: note = chr17:80535317-80535381
  misc_feature 1..64: note = hypo
  source 1..64: mol_type = genomic DNA
gcagggcgtggcgggcggccgggttaaggtctcgcagccaaagctgcggcgtgctcactgccca

SEQ ID NO: 81453 - DNA, 657 bp, Homo sapiens
  misc_feature 1..657: note = chr17:8055166-8055823
  misc_feature 1..657: note = hyper
  source 1..657: mol_type = genomic DNA
tgagcattttctgagcgccaggggaaaagggaaggttgtggccaacagcaggaaccagcgctgggaacgggatgttctagtccgaagtgggctgacatcacaggcggcgcagggccagggactggagaacagagacacggggagcgctgaaagcctaatagggtcctggtaccggggcaaacctggggcccctcgagtaacgagcaagaagaccggggcatgcccgctgagagtcggctgtggggccgggaaagctgggacggggaggtggggacaagctggaggtaagatgagtgggtcaggagtgcagactcccggtgcaagatttcgaggaggacttcggtccttgggggcagggagagggtgggtagcggtaaggacgacagtgtgccctctgcctgggccgaaagtagcccatcagattggaagtggcagcggtccggctcagggacggagatcggccccaggatggccgcagagatgcctacctggtcgcaggagtgtcctccgcacgcctgcccgccgccgctccagcccgcagccgagtggaagctccaccgggcgggcggggaggcgggttgcataatgccgggcactgccccctcattggcctcttgccgacggagccgcaggccccgcccccgattggctggggat

SEQ ID NO: 81454 - DNA, 75 bp, Homo sapiens
  misc_feature 1..75: note = chr17:80572274-80572349
  misc_feature 1..75: note = hypo
  source 1..75: mol_type = genomic DNA
tgaagctccaggctccgcacccagtgaccctggcttccaccttgtcctgtcacaggccggcgcctcttcaggccc

SEQ ID NO: 81455 - DNA, 95 bp, Homo sapiens
  misc_feature 1..95: note = chr17:80603615-80603710
  misc_feature 1..95: note = hypo
  source 1..95: mol_type = genomic DNA
agccaaaaactggaacgtacccaaatgcccaaccatggtagactggatatatgaattgttgtatgtctgcacaaaagaacattgtacatcaagaa

SEQ ID NO: 81456 - DNA, 444 bp, Homo sapiens
  misc_feature 1..444: note = chr17:80654726-80655170
  misc_feature 1..444: note = hypo
  source 1..444: mol_type = genomic DNA
tatctagaaatgtgacgaatggaagctttttgttttctttccttctaattacacttccacagccacacgtggctcatggcatcctactggacaccacggtcctagagacctgccaccgagcggggaggggggtaggacatgcgggggcagcggcgcctggggacaggtagagacgcaggctcccctcctgccccacggagcacactctgcacccaccagctgccagagactcccccgcatgctgcagtttcaggaggcctctgggtgctggtcgtgagcccaagcccatctcagctgctcccccaaactctgcccattcctcaccccgtcccctaagctgaggtgtggccgggcacctgagtcccaccccacgctccacagtctcaggccaccccctccagccgtgccacactcccttggtgctcacgccgcctgcctggagct

SEQ ID NO: 81457 - DNA, 222 bp, Homo sapiens
  misc_feature 1..222: note = chr17:80655505-80655727
  misc_feature 1..222: note = hyper
  source 1..222: mol_type = genomic DNA
ctcctcactcccagccgaggtgttcgcctctgcgcgttcccccttctcctgggttcctgcccccgcctttctttccccggagccgtccaccccctcgccgggcgccggctttcaagcctcaaacttgggggatccccgggctgcctgcctgggagctctgggcgctccggcctcccctcgccctggaacccgctctccggccgctgtcgtggggggtcccct

SEQ ID NO: 81458 - DNA, 47 bp, Homo sapiens
  misc_feature 1..47: note = chr17:80657047-80657094
  misc_feature 1..47: note = hyper
  source 1..47: mol_type = genomic DNA
ggtccagttggcggacgcggccggaaggcccccgcaggccgcctcgc

SEQ ID NO: 81459 - DNA, 21 bp, Homo sapiens
  misc_feature 1..21: note = chr17:80659786-80659807
  misc_feature 1..21: note = hypo
  source 1..21: mol_type = genomic DNA
agactccgtctcaaaaaaaaa

SEQ ID NO: 81460 - DNA, 30 bp, Homo sapiens
  misc_feature 1..30: note = chr17:80661495-80661525
  misc_feature 1..30: note = hypo
  source 1..30: mol_type = genomic DNA
gatgagtgcttggggcgcttctccatccac

SEQ ID NO: 81461 - DNA, 30 bp, Homo sapiens
  misc_feature 1..30: note = chr17:80673406-80673436
  misc_feature 1..30: note = hypo
  source 1..30: mol_type = genomic DNA
acacacagaaaagtgcgtgaacacacacat

SEQ ID NO: 81462 - DNA, 20 bp, Homo sapiens
  misc_feature 1..20: note = chr17:80692466-80692486
  misc_feature 1..20: note = hypo
  source 1..20: mol_type = genomic DNA
aacctcatgcatggccgggc

SEQ ID NO: 81463 - DNA, 80 bp, Homo sapiens
  misc_feature 1..80: note = chr17:80692846-80692926
  misc_feature 1..80: note = hypo
  source 1..80: mol_type = genomic DNA
tgcagcctgggagacagagactccatctcttaaaaacacaaaaaacaaacaataaaaaaacctcacgtcaaatgacttca

SEQ ID NO: 81464 - DNA, 76 bp, Homo sapiens
  misc_feature 1..76: note = chr17:80693424-80693500
  misc_feature 1..76: note = hyper
  source 1..76: mol_type = genomic DNA
cgcgccgcgcgctcccgccccgccccgccccgcagcgcctcagccgacaggggcttccgagcgagcagagtcccgc

SEQ ID NO: 81465 - DNA, 35 bp, Homo sapiens
  misc_feature 1..35: note = chr17:80712937-80712972
  misc_feature 1..35: note = hypo
  source 1..35: mol_type = genomic DNA
tgtaagatgtacattggtctcgtcagggaaggcgg

SEQ ID NO: 81466 - DNA, 44 bp, Homo sapiens
  misc_feature 1..44: note = chr17:80744257-80744301
  misc_feature 1..44: note = hypo
  source 1..44: mol_type = genomic DNA
ctctgcaggggaggccgttagccctgccccgagtgtgggtgctg

SEQ ID NO: 81467 - DNA, 232 bp, Homo sapiens
  misc_feature 1..232: note = chr17:80747022-80747254
  misc_feature 1..232: note = hypo
  source 1..232: mol_type = genomic DNA
agcatttgggtgaaacgaggtaccccaggccacgctggttcggtctcctcgtggcgttaaggaaagacctggagcagccagctcctaacactcatttcccatcactcagcattttatgtggggcgggcacagtgccgtgagtcttacagaaacctgcatggtgagccgcacgcctttgagtccccatcagccctggcccatccctgctgaggtggcgcgacctgctcacaga

SEQ ID NO: 81468 - DNA, 74 bp, Homo sapiens
  misc_feature 1..74: note = chr17:80747816-80747890
  misc_feature 1..74: note = hypo
  source 1..74: mol_type = genomic DNA
ggctcatccccgagacgccgtgttccctcccgctgtccgctcacacctgcctgtgtggacgtggctctgacatg

SEQ ID NO: 81469 - DNA, 18 bp, Homo sapiens
  misc_feature 1..18: note = chr17:8075326-8075344
  misc_feature 1..18: note = hypo
  source 1..18: mol_type = genomic DNA
aaacaagagatgggccgg

SEQ ID NO: 81470 - DNA, 69 bp, Homo sapiens
  misc_feature 1..69: note = chr17:80772872-80772941
  misc_feature 1..69: note = hypo
  source 1..69: mol_type = genomic DNA
ctgttgctgccatctcgactcgtggatggtgagtagctgaagcacggtcagctgcgtcaccaggctgtc

SEQ ID NO: 81471 - DNA, 1155 bp, Homo sapiens
  misc_feature 1..1155: note = chr17:80797664-80798819
  misc_feature 1..1155: note = hypo
  source 1..1155: mol_type = genomic DNA
gtcctgagtaatcctcggagcccagagcaaggcagagcagacacggagcaaacgctgcgttcagctgggtattttagatacgtctgagaagagttttaaaataaaacttgaatttgaaaagaaatagtgagtacttaccagaggtgggcagtgctgggatgtggccggtcttggtgccggtggctggcggtgctcaggaagcagtacctgttctcacgcttgctgggtgaaactggagcctgctgttccagtgggagggatttaagtgtaggagttgagccctcggggcgtagagatgcacctgatattcctcctgcccgcagctacgattcatgtgtttgcacccaccgagctgctgcgggcagcctccccagcactggacccagcaagcaagttatctcgccgactcccagcgctgtctccagactcaactgtctgtgagtgcggcgtcggtgctgcctggacggccatatgtcagagggctttcgatgtgtccgcagttagaatagagattactatattcatcagaatcacacccgatgaatatttggcgtcatgataaagacatgtgagactttcctttagaacttgagcatgtgtacgcaggaggcaaacacttggattgattctcaagcgcgcataccctgggaggcacagtattcatggcgtccttgccatgaggtccagtgaggcctttgaggatctgtggaccttccaccctctaccctgctcctgagagtctctgtccctggtcctcctcaggagctgagccggcagggagggagcttatcccagagcctggctgcagggacctgccggagcttgcccgacaccaggcaccgcaagagctgcggagcagggtgtgtgggtgcgggggagggggccagctgtgcactcccgcaaaccaccctccccccactttaaattgcagaggcacttaacttgggggccagtttttacctccacacccccccaccaaaactgcttgcttgcttaatcggaggccgcaccccagttgtagcgaaggctggcatgtggtgtcggtttgaggactgggaaaggaggtgggatgagctggtgtcaggcccttggatgagcctgaggctgcagggcagaggctgcagggctgtggcatagggacgagctggccaggac

SEQ ID NO: 81472 - DNA, 30 bp, Homo sapiens
  misc_feature 1..30: note = chr17:80820683-80820713
  misc_feature 1..30: note = hypo
  source 1..30: mol_type = genomic DNA
ttatggaagtccaggcggccaccccaggcc

SEQ ID NO: 81473 - DNA, 593 bp, Homo sapiens
  misc_feature 1..593: note = chr17:80832203-80832796
  misc_feature 1..593: note = hypo
  source 1..593: mol_type = genomic DNA
ctccccggcatgtggcggggccagcgttggcctgggtcccacttggctttgatctcgtggggctttggtttttggaggtcctgggtgcgtctccaccatggctcccgggttcccttgcgcacaccgagccagcagctgctggggcctcagggctcgcagctcacaggcttctgacgcctcagcctggagctggcgttgtgcccctcgcccctttacctgtgccatcccggccgcagacccaagggtgcccttggagccgtgcccgccggcctgggtgtcaggcttgtccaacgggttcttagagaacctgggccccatccctccttggcccacgcagactccaggcatccggccgggcgggctgtgagtcaggctgcaccaggtgagcgtgtgggatgctgctggtgcgagcctccctgcccaggagccctgcgcacccgggtatcggttggggtgtgcccttccagatctccctcccttggtttgtcataggtgaccacattttaattaccagcttttatgcccgtcaatttgggaacgtgatacaatcttgatttctctaactttcacaagttcttcggtgggtcctgtaa

SEQ ID NO: 81474 - DNA, 36 bp, Homo sapiens
  misc_feature 1..36: note = chr17:80847858-80847894
  misc_feature 1..36: note = hypo
  source 1..36: mol_type = genomic DNA
accagcctggccttgcggggacgcagacctgacccc

SEQ ID NO: 81475 - DNA, 38 bp, Homo sapiens
  misc_feature 1..38: note = chr17:80859827-80859865
  misc_feature 1..38: note = hypo
  source 1..38: mol_type = genomic DNA
ttacagatatatgcccgtagcgtcggagctgtgggact

SEQ ID NO: 81476 - DNA, 30 bp, Homo sapiens
  misc_feature 1..30: note = chr17:80879262-80879292
  misc_feature 1..30: note = hypo
  source 1..30: mol_type = genomic DNA
ctcaaaggttaccatcgactttaagattag

SEQ ID NO: 81477 - DNA, 41 bp, Homo sapiens
  misc_feature 1..41: note = chr17:80879980-80880021
  misc_feature 1..41: note = hypo
  source 1..41: mol_type = genomic DNA
aagaaaccatgggcccggcgcagtggcgggtggatcacttg

SEQ ID NO: 81478 - DNA, 95 bp, Homo sapiens
  misc_feature 1..95: note = chr17:80882906-80883001
  misc_feature 1..95: note = hypo
  source 1..95: mol_type = genomic DNA
ttccttctgaaaggccggctccagcaggtgaggctggccacgcgcagtggacggggcctagggcgagggtgtgggagcctcgtgtgttggggcat

SEQ ID NO: 81479 - DNA, 131 bp, Homo sapiens
  misc_feature 1..131: note = chr17:80965822-80965953
  misc_feature 1..131: note = hypo
  source 1..131: mol_type = genomic DNA
acagcagtaggaaggcgtggattccagacagaccaacagcgcccagccgcgatgctgccggcaccttcctctgcaggagacctcgcgctctcaagaggaggcgcagggaagaggcacgctctcaagaggag

SEQ ID NO: 81480 - DNA, 35 bp, Homo sapiens
  misc_feature 1..35: note = chr17:80970418-80970453
  misc_feature 1..35: note = hypo
  source 1..35: mol_type = genomic DNA
acggtttccagctcacgggccggcacagggtctgc

SEQ ID NO: 81481 - DNA, 57 bp, Homo sapiens
  misc_feature 1..57: note = chr17:80972313-80972370
  misc_feature 1..57: note = hypo
  source 1..57: mol_type = genomic DNA
ggaggccagtacttacgctcgacgggtgctgaacggcagcctcgtgttgcagcctca

SEQ ID NO: 81482 - DNA, 315 bp, Homo sapiens
  misc_feature 1..315: note = chr17:81008590-81008905
  misc_feature 1..315: note = hypo
  source 1..315: mol_type = genomic DNA
cacggggaaggtgttcggggcttaagggcaggtttttagggcacgtgtttggggtaagtgtgctgggcacacaggcaggtgtgtgggcacggaggaggtgtgcaggtaggtgtgtgggatgcgcaggcaggtgtgcacggcaggtgcacgggcaggtatggggcacgggcatgtatgcaggacgcagagcaggtgtgtgaagcaggtgtgcaggcacaagacgtgtgtgtggggcatgggcaagtgtgccgggaatgtgtgacggcagacgtgtggggtgcgaggttgtgtgggggcacacggacaggtgtgcag

SEQ ID NO: 81483 - DNA, 30 bp, Homo sapiens
  misc_feature 1..30: note = chr17:81014892-81014922
  misc_feature 1..30: note = hypo
  source 1..30: mol_type = genomic DNA
cccagaacgcagagccggagtcaggggctt

SEQ ID NO: 81484 - DNA, 166 bp, Homo sapiens; identical to SEQ ID NO: 45303
  misc_feature 1..166: note = chr17:81015300-81015466
  misc_feature 1..166: note = hypo
  source 1..166: mol_type = genomic DNA

SEQ ID NO: 81485 - DNA, 79 bp, Homo sapiens
  misc_feature 1..79: note = chr17:81015900-81015979
  misc_feature 1..79: note = hypo
  source 1..79: mol_type = genomic DNA
cacatctggacagtgcgtgaagccagtccaggggccacaccgggacctgccctcagctctgccacgtcctggccaagtg

SEQ ID NO: 81486 - DNA, 36 bp, Homo sapiens
  misc_feature 1..36: note = chr17:81021220-81021256
  misc_feature 1..36: note = hypo
  source 1..36: mol_type = genomic DNA
ctccagggcaggctgcgtgtccgggcagtcccagcc

SEQ ID NO: 81487 - DNA, 125 bp, Homo sapiens
  misc_feature 1..125: note = chr17:81024242-81024367
  misc_feature 1..125: note = hypo
  source 1..125: mol_type = genomic DNA
tgaagagctccagatcgcagacaccgtgccgtgcccgccacgcagatgcagtttccactcagccccacagtgcgggcttcctgggcccgtgtccggctggaggagcaccccgggtccgagccagc

SEQ ID NO: 81488 - DNA, 30 bp, Homo sapiens
  misc_feature 1..30: note = chr17:81032806-81032836
  misc_feature 1..30: note = hypo
  source 1..30: mol_type = genomic DNA
ggccggaccttagcacgtcatcactgggct

SEQ ID NO: 81489 - DNA, 30 bp, Homo sapiens; identical to SEQ ID NO: 45307
  misc_feature 1..30: note = chr17:81033487-81033517
  misc_feature 1..30: note = hypo
  source 1..30: mol_type = genomic DNA

SEQ ID NO: 81490 - DNA, 30 bp, Homo sapiens
  misc_feature 1..30: note = chr17:81034580-81034610
  misc_feature 1..30: note = hypo
  source 1..30: mol_type = genomic DNA
agctctccgattccacggctcagcctcaac

SEQ ID NO: 81491 - DNA, 37 bp, Homo sapiens
  misc_feature 1..37: note = chr17:81040640-81040677
  misc_feature 1..37: note = hypo
  source 1..37: mol_type = genomic DNA
acagaccatgagtctcggacttcgtgccgaggtctgc

SEQ ID NO: 81492 - DNA, 29 bp, Homo sapiens
  misc_feature 1..29: note = chr17:8104161-8104190
  misc_feature 1..29: note = hypo
  source 1..29: mol_type = genomic DNA
gggtgcggtggctcacggctgtaatccca

SEQ ID NO: 81493 - DNA, 167 bp, Homo sapiens
  misc_feature 1..167: note = chr17:81043026-81043193
  misc_feature 1..167: note = hypo
  source 1..167: mol_type = genomic DNA
actgctggtaccagacggggacggcaggcccggccgggtgcagtgttttggcctggagcagggcggcctgttcgtggaggccacgccgcagcaggatatcggccggaggaccacaggcttccagtacgagctggttaggaggcacagggcgtcggacctgcacgagc

SEQ ID NO: 81494 - DNA, 209 bp, Homo sapiens
  misc_feature 1..209: note = chr17:8104430-8104639
  misc_feature 1..209: note = hypo
  source 1..209: mol_type = genomic DNA
ttccgtcttgagaaaaagcaaaaaccttgcctttatctcgtttgaattcttgccctcgagaaaacagaggagagaggttgctgcagagttgcaactccggagtttcccggatagctgcaggcttacccgcaggtaacagtagaagtaggagtcagcgttaaggctgtgggaaaataggtgtccttcattattgccggtgggagtgtaaa

SEQ ID NO: 81495 - DNA, 59 bp, Homo sapiens
  misc_feature 1..59: note = chr17:81047898-81047957
  misc_feature 1..59: note = hypo
  source 1..59: mol_type = genomic DNA
gtgactcacagagggcgaagtgctagggcttgcataccctcacgcgcccaggccccggg

SEQ ID NO: 81496 - DNA, 30 bp, Homo sapiens
  misc_feature 1..30: note = chr17:81048443-81048473
  misc_feature 1..30: note = hypo
  source 1..30: mol_type = genomic DNA
cagtgaggggaccctcgggtggactggggt

SEQ ID NO: 81497 - DNA, 251 bp, Homo sapiens
  misc_feature 1..251: note = chr17:81048783-81049034
  misc_feature 1..251: note = hypo
  source 1..251: mol_type = genomic DNA
gggtgggccacaccccggggcccccataggagagcgcaccgggcggcttccagcttgggggtcaggaggcccccgtggtgggggctgcagtgtgagtctgtacacatcagcaggaaggggatttggccagaagctcccattctggagggttgctgggatggcagaggtgcccccccagtgccaggctggaccggcctcaaggtgctcagcagtgccaggctggaccggcctcgaggcgcccccagtgccag

SEQ ID NO: 81498 - DNA, 28 bp, Homo sapiens
  misc_feature 1..28: note = chr17:8104911-8104939
  misc_feature 1..28: note = hypo
  source 1..28: mol_type = genomic DNA
tataggctgaaaggccgggcgcggtggc

SEQ ID NO: 81499 - DNA, 317 bp, Homo sapiens
  misc_feature 1..317: note = chr17:81050023-81050340
  misc_feature 1..317: note = hypo
  source 1..317: mol_type = genomic DNA
atccggggaaggggccgggccgatggccctgactggaactcactgccctgctgggtgaggccccacgccggtggcaggtggacgcgtcgctgcctgcttagggatccccttcctggaatcttggcctcgctggcccttccagccacatggggggtcccgcgggatgggatcctccttttgggtgccgctgccgtcgcgacccagggaagtgggcagcagagctgtggggagtgtctgcccttcgaggaagctgggaaatgagggtggtcccggcgccgtgggccgtggaggtgggttgggggcgactctgggaggtg

SEQ ID NO: 81500 - DNA, 63 bp, Homo sapiens
  misc_feature 1..63: note = chr17:81050653-81050716
  misc_feature 1..63: note = hypo
  source 1..63: mol_type = genomic DNA
tggtccaggtggggccgaggggtcccctgggtgagaccccgtcgtggtcgaggttgtgttttc

SEQ ID NO: 81501 - DNA, 78 bp, Homo sapiens
  misc_feature 1..78: note = chr17:81050921-81050999
  misc_feature 1..78: note = hypo
  source 1..78: mol_type = genomic DNA
tccctgcagtgacaccgaggtgctcctagccgtctgcaccagcgacttcggtgagtgtctgctcggcagcttctacct

SEQ ID NO: 81502 - DNA, 294 bp, Homo sapiens
  misc_feature 1..294: note = chr17:81062099-81062393
  misc_feature 1..294: note = hypo
  source 1..294: mol_type = genomic DNA
gagaggaaaggatcacgcgaccatgggtacgttggccacctgaaggttgagtcccgcagcctagagactggagcgtggggaccaggaggagcttcttagcggaactgggctggggctcatgcagccctccaggagcccccgacgcgacgccctggctcatcccgggtgaagaggctgctgagtctgaactgatgacagtggacgggtggccgccggttcccaacgcatggttgggcctggaacccaggtgactctgggagatgtggtcacagtcacagccgtctgtgggccttt

SEQ ID NO: 81503 - DNA, 102 bp, Homo sapiens
  misc_feature 1..102: note = chr17:81065766-81065868
  misc_feature 1..102: note = hypo
  source 1..102: mol_type = genomic DNA
tgcacgatccttcctcgctgcaggatccttcctcgctgcacgatcattcctggttgcacgatccttcctcgctgcacgatccttcctcgctgcatgatgatt

SEQ ID NO: 81504 - DNA, 138 bp, Homo sapiens
  misc_feature 1..138: note = chr17:81068653-81068791
  misc_feature 1..138: note = hypo
  source 1..138: mol_type = genomic DNA
agcgggcagggctgacgggcgcgaaactgggagcgtagctctgggaggtggcctcggggaaccattttcccaccgggcgggcccttttgttctcctgtctgtgcgcgcagggcagccaggtcccgggatggaccctat

SEQ ID NO: 81505 - DNA, 82 bp, Homo sapiens; identical to SEQ ID NO: 45316
  misc_feature 1..82: note = chr17:81076347-81076429
  misc_feature 1..82: note = hypo
  source 1..82: mol_type = genomic DNA

SEQ ID NO: 81506 - DNA, 33 bp, Homo sapiens
  misc_feature 1..33: note = chr17:81081890-81081923
  misc_feature 1..33: note = hypo
  source 1..33: mol_type = genomic DNA
gggcgacgctcagggcggccgtgcgggcatccg

SEQ ID NO: 81507 - DNA, 30 bp, Homo sapiens
  misc_feature 1..30: note = chr17:81084673-81084703
  misc_feature 1..30: note = hypo
  source 1..30: mol_type = genomic DNA
cgcttcattaatacccgggggaaggtcctg

SEQ ID NO: 81508 - DNA, 138 bp, Homo sapiens
  misc_feature 1..138: note = chr17:81087463-81087601
  misc_feature 1..138: note = hypo
  source 1..138: mol_type = genomic DNA
ggcagaagttgcttacgagctcgctcagtggcttggcaggggttgttggggttccccaaggctgttctcctgagggccgcgggtcccgactggctgtttgctggaggcttctcctgagggccgcgggtcctcactggc

SEQ ID NO: 81509 - DNA, 120 bp, Homo sapiens
  misc_feature 1..120: note = chr17:81087901-81088021
  misc_feature 1..120: note = hypo
  source 1..120: mol_type = genomic DNA
tgctggaggcttctcctgagggccgcgggtcctcactggctgttctcctgagggccacgggtcctggctggctgttctcctgagggccgtgggtcctggctggctgtttgctggaggctt

SEQ ID NO: 81510 - DNA, 78 bp, Homo sapiens
  misc_feature 1..78: note = chr17:81088141-81088219
  misc_feature 1..78: note = hypo
  source 1..78: mol_type = genomic DNA
tggctgttctcctgagggccgtgggtcctggctggctgtttgctggaggcttcgcctgagggccgcgggccctcgctg

SEQ ID NO: 81511 - DNA, 25 bp, Homo sapiens
  misc_feature 1..25: note = chr17:8123524-8123549
  misc_feature 1..25: note = hypo
  source 1..25: mol_type = genomic DNA
cccatcccaccggttttgtttttca

SEQ ID NO: 81512 - DNA, 392 bp, Homo sapiens
  misc_feature 1..392: note = chr17:8229958-8230350
  misc_feature 1..392: note = hyper
  source 1..392: mol_type = genomic DNA
gccctcttccccccacgccccggcccccaagcctgctcactagctctctcctcctccttccacccgcaaggaaccctccagcccacttcctgtgatcctttccggagcccttcagcctggctggctctccagccatctcggaaagcttctctttcctaaaccctccatactcgcaggttcagctacagaggtaactgcaggctcaggttctccagggtggccagcccaccagcccaccgtcccggtgcagcagtgcctctccagcgacagctccaccgcgagcctggcgggctcccgaccttgctccccagcacgtcgtctccaagccacggtctcaccaccctccatcagcctcgggcgacaccaaggggaacagagcgctggagctcctc

SEQ ID NO: 81513 - DNA, 491 bp, Homo sapiens
  misc_feature 1..491: note = chr17:8230351-8230842
  misc_feature 1..491: note = hyper
  source 1..491: mol_type = genomic DNA
aagtcctcccgaccttagcggggctccgttcatcctcccggacgtggccaggccccgctctggccccgcgcccgcccctcccgcggggctgcccctgtctctctgccggagacccggactcagtgagtgagcgcagcgcggccatagggcttcctgcagcggggtctcagcacgtcttctggctggactctggggtctcctggcctggctgtgtctcctggttctcagcgctcgcctcccacgcggggcggagtatgggagtgggctgctcccgcggaagaatcctggggaagttgaggcactggctcccgctgttcagaacactgcccgacgtccccagagctagccactcctccttcccacccacccgcagcactctcgaggtcgcaacggcagtcaccaggtcccggggcctgcgttcagctgcttgatccgactaggtttggcttcggacccgaatgggtcagctccacgcccgatggagtttttca

SEQ ID NO: 81514 - DNA, 37 bp, Homo sapiens
  misc_feature 1..37: note = chr17:8287722-8287759
  misc_feature 1..37: note = hypo
  source 1..37: mol_type = genomic DNA
ctgcaaatggtttctgaggcagcggcagtgcagcagg

SEQ ID NO: 81515 - DNA, 186 bp, Homo sapiens
  misc_feature 1..186: note = chr17:8296142-8296328
  misc_feature 1..186: note = hypo
  source 1..186: mol_type = genomic DNA
cccagggcaggatggcggccaccacggccaccacagcgatgagcgtgatgagcagcagggcccgcgatcggcagcagaaggcgcgggcggagcggggcgccagggaggcctccgagagctctgccaggctgcggcggggcagcacgctgtcctgctcccccaggggcatcccgtggcggctgatga

SEQ ID NO: 81516 - DNA, 30 bp, Homo sapiens
  misc_feature 1..30: note = chr17:8328350-8328380
  misc_feature 1..30: note = hypo
  source 1..30: mol_type = genomic DNA
ccttagcccttttcacgagggtgctcgttt

SEQ ID NO: 81517 - DNA, 45 bp, Homo sapiens
  misc_feature 1..45: note = chr17:8338095-8338140
  misc_feature 1..45: note = hypo
  source 1..45: mol_type = genomic DNA
aatgcaagatggggccgggcgctgtgtctcacgcctgtaatccca

SEQ ID NO: 81518 - DNA, 30 bp, Homo sapiens
  misc_feature 1..30: note = chr17:835911-835941
  misc_feature 1..30: note = hypo
  source 1..30: mol_type = genomic DNA
gcttctgagaggcaccgacttttgccatca

SEQ ID NO: 81519 - DNA, 30 bp, Homo sapiens
  misc_feature 1..30: note = chr17:8365197-8365227
  misc_feature 1..30: note = hypo
  source 1..30: mol_type = genomic DNA
cataaatggataggtcggacaggtgcctgt

SEQ ID NO: 81520 - DNA, 391 bp, Homo sapiens
  misc_feature 1..391: note = chr17:8384513-8384904
  misc_feature 1..391: note = hypo
  source 1..391: mol_type = genomic DNA
gcagcccaggcccagcgagggaggagcaaaccacccgctgatgccaggtgtgtggacacctccagccttctcagcagtgcgcgtgcctgagggcgaagaacccacccccggccgtgggagactcacttgccagaggcgctgttggtgatctcgtccgccagctcatctctctcctgctcggcgtgtcggcgggctcgctcagatgaggcaagttcctaagcagtggagactgcgttaagctctggctgtgaatagtttcctcacctgtggaatctgacagtgcctggagctacagcgaccttgctcctgtcactgtttacctgcacctcaagctgtcatttagatttgagaaattaaactgtcaagaaaatctgctcggtgcaggccagcc

SEQ ID NO: 81521 - DNA, 36 bp, Homo sapiens
  misc_feature 1..36: note = chr17:8397135-8397171
  misc_feature 1..36: note = hypo
  source 1..36: mol_type = genomic DNA
tcctcttccagctgccggatccgactgctcaggttt

SEQ ID NO: 81522 - DNA, 97 bp, Homo sapiens
  misc_feature 1..97: note = chr17:8398223-8398320
  misc_feature 1..97: note = hypo
  source 1..97: mol_type = genomic DNA
ctccgaggccacccacgtgcctgccagacacacgaaccccaggggctctacatcaagacactgagcttccagggagaaatcccgagtagcaaggctg

SEQ ID NO: 81523 - DNA, 44 bp, Homo sapiens
  misc_feature 1..44: note = chr17:8409685-8409729
  misc_feature 1..44: note = hypo
  source 1..44: mol_type = genomic DNA
gagctcatcaatctgcgcctgcagctctgcgatctggtcctgca

SEQ ID NO: 81524 - DNA, 30 bp, Homo sapiens
  misc_feature 1..30: note = chr17:8456005-8456035
  misc_feature 1..30: note = hypo
  source 1..30: mol_type = genomic DNA
tatatgagaggcactcgcccttcacactca

SEQ ID NO: 81525 - DNA, 18 bp, Homo sapiens
  misc_feature 1..18: note = chr17:8464515-8464533
  misc_feature 1..18: note = hypo
  source 1..18: mol_type = genomic DNA
ggggcctctcctctccgg

SEQ ID NO: 81526 - DNA, 30 bp, Homo sapiens
  misc_feature 1..30: note = chr17:851863-851893
  misc_feature 1..30: note = hypo
  source 1..30: mol_type = genomic DNA
gtgaaaaccatcactcggtgcttcacggaa

SEQ ID NO: 81527 - DNA, 30 bp, Homo sapiens
  misc_feature 1..30: note = chr17:8532918-8532948
  misc_feature 1..30: note = hyper
  source 1..30: mol_type = genomic DNA
gcttcaacttccctccgaaccaattccagt

SEQ ID NO: 81528 - DNA, 38 bp, Homo sapiens; identical to SEQ ID NO: 36367
  misc_feature 1..38: note = chr17:8533161-8533199
  misc_feature 1..38: note = hyper
  source 1..38: mol_type = genomic DNA

SEQ ID NO: 81529 - DNA, 170 bp, Homo sapiens
  misc_feature 1..170: note = chr17:8533692-8533862
  misc_feature 1..170: note = hyper
  source 1..170: mol_type = genomic DNA
aaggacttcattccccgctcctccgggagtctctccatctccacccactgaggtcccagtgcccccagcccaggaccctgctcaaactaacctaaggtccccgcagcacaaaccctacagctcagaagcccctctgtcttccccagctcccgcttcggtcccccgttcct

SEQ ID NO: 81530 - DNA, 88 bp, Homo sapiens
  misc_feature 1..88: note = chr17:8572343-8572431
  misc_feature 1..88: note = hypo
  source 1..88: mol_type = genomic DNA
ggtgctgctttacatttccgcattccctttccccacttgcacagttgttcttgaataaccgggcctggggaaacgtcagtgggtgagt

SEQ ID NO: 81531 - DNA, 76 bp, Homo sapiens
  misc_feature 1..76: note = chr17:8586787-8586863
  misc_feature 1..76: note = hypo
  source 1..76: mol_type = genomic DNA
attgtctttgatgtccagtttccattcttcctgcttttggtaatagtcgcccatttccatccggcaaaatacccct

SEQ ID NO: 81532 - DNA, 30 bp, Homo sapiens
  misc_feature 1..30: note = chr17:8624511-8624541
  misc_feature 1..30: note = hypo
  source 1..30: mol_type = genomic DNA
agatctcaccaccatcgctcacttgccttt

SEQ ID NO: 81533 - DNA, 30 bp, Homo sapiens; identical to SEQ ID NO: 44992
  misc_feature 1..30: note = chr17:8732186-8732216
  misc_feature 1..30: note = hypo
  source 1..30: mol_type = genomic DNA

SEQ ID NO: 81534 - DNA, 80 bp, Homo sapiens
  misc_feature 1..80: note = chr17:876820-876900
  misc_feature 1..80: note = hypo
  source 1..80: mol_type = genomic DNA
gtatcagtaatatcccgggactttaaggcactgtatttgttgtttcattcttctaggtctttcttcgcagttataatctc

SEQ ID NO: 81535 - DNA, 30 bp, Homo sapiens
  misc_feature 1..30: note = chr17:8774759-8774789
  misc_feature 1..30: note = hypo
  source 1..30: mol_type = genomic DNA
ctttacttccagcagcgttatttggcagag

SEQ ID NO: 81536 - DNA, 102 bp, Homo sapiens
  misc_feature 1..102: note = chr17:8789475-8789577
  misc_feature 1..102: note = hypo
  source 1..102: mol_type = genomic DNA
ctccacagagctccacgtttcgcgtcccaggccccgcctcaccgtctgtctctgctcaggcagtacccacctgacgccttgatggcacgtgtggcagcggag

SEQ ID NO: 81537 - DNA, 71 bp, Homo sapiens
  misc_feature 1..71: note = chr17:8789780-8789851
  misc_feature 1..71: note = hypo
  source 1..71: mol_type = genomic DNA
agggaggccttacctcggtctgatagacttgcagcagcaccggtctggcggcaaagcggcagtagtagagt

SEQ ID NO: 81538 - DNA, 30 bp, Homo sapiens
  misc_feature 1..30: note = chr17:8849594-8849624
  misc_feature 1..30: note = hypo
  source 1..30: mol_type = genomic DNA
gaagccactagaccacgtgttcagaaaagt

SEQ ID NO: 81539 - DNA, 86 bp, Homo sapiens; identical to SEQ ID NO: 36368
  misc_feature 1..86: note = chr17:8868582-8868668
  misc_feature 1..86: note = hyper
  source 1..86: mol_type = genomic DNA

SEQ ID NO: 81540 - DNA, 399 bp, Homo sapiens; identical to SEQ ID NO: 1275
  misc_feature 1..399: note = chr17:8868814-8869213
  misc_feature 1..399: note = hyper
  source 1..399: mol_type = genomic DNA

SEQ ID NO: 81541 - DNA, 257 bp, Homo sapiens; identical to SEQ ID NO: 36370
  misc_feature 1..257: note = chr17:8869214-8869471
  misc_feature 1..257: note = hyper
  source 1..257: mol_type = genomic DNA

SEQ ID NO: 81542 - DNA, 1025 bp, Homo sapiens
  misc_feature 1..1025: note = chr17:8906188-8907213
  misc_feature 1..1025: note = hyper
  source 1..1025: mol_type = genomic DNA
gtgtcccaagttacacgcatcctatcttggcccagctccactggagcccgagcggcggggcgcagggtgcgagcgggaggctggtgttctgcccgcgatgggcaggggagccgggtggccgcggggcgaggagccgcgagggccgggccggcgtgacaccacctggcggagtctcggggaagagtcttaaaggcgcgcgctcctccgtgccccgcgcactcgaacgggagccgcggagagctcgcctcccgctgccgccggcgcctcggggaggtaagtgccacccgcggatcccgagtcgcggccgggtgggggcggcccgcggctgccccgcgctcgggaagctctggctggggctgcggtcggagggcggcgcccaagttttcttgaaggcctcggagggcagctggagcggcgtagagcctgcgcggggatggcgggggtggccgcgggccggggccgtctgggggcggccatcccgggcggtgcgtggaaaagtaggcactggtgcgcggcgaggggcgcacgccagagccccagccccgcgtcctgcgcacttggcgcgctctggccgcggtcccggcgagccccagcctgctccgggccgcgaccccggctccgcgccttcctgcccgcccgggtcctttgtagcccgctggccccgcggtcgcgcacggtcacgccggcaggtcgcgctcggcggccggccaagccagccccggccctgccgcgcccgcgccccgggccaccccgcccggccccctcggcgctgcacccctcgctttccccatctccagccgctcgctattttcacacctcccggtgccccggccccggcgcctgattcagtgcttagtaattaatttggcgtttcagaatggtcagcgggctggataatgggtgcattcatcccccgggctaatctgaacagaggtgggaagaaaggctttcacagacagaaaatgccattcgccgagcgctcaaaggggctgtcactcccagaataaatcgccgccgcgcccgcc

SEQ ID NO: 81543 - DNA, 514 bp, Homo sapiens; identical to SEQ ID NO: 36372
  misc_feature 1..514: note = chr17:8907214-8907728
  misc_feature 1..514: note = hyper
  source 1..514: mol_type = genomic DNA

SEQ ID NO: 81544 - DNA, 62 bp, Homo sapiens
  misc_feature 1..62: note = chr17:8907776-8907838
  misc_feature 1..62: note = hyper
  source 1..62: mol_type = genomic DNA
cgggtgacggaggctttatcctttgatcccttctggatccggtgacgcgctaagtgttgggc

SEQ ID NO: 81545 - DNA, 30 bp, Homo sapiens
  misc_feature 1..30: note = chr17:8924243-8924273
  misc_feature 1..30: note = hyper
  source 1..30: mol_type = genomic DNA
ggaccccgggggcttcgggcaaaaatggag

SEQ ID NO: 81546 - DNA, 243 bp, Homo sapiens
  misc_feature 1..243: note = chr17:8925590-8925833
  misc_feature 1..243: note = hyper
  source 1..243: mol_type = genomic DNA
ggcgggctggctgagcgcagctcccttctctccgcaggcgccttctgcggcaggcggacagatcctcggcgcggcagggccggggcaagctggacgcagcatgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccaccc

SEQ ID NO: 81547 - DNA, 42 bp, Homo sapiens
  misc_feature 1..42: note = chr17:8926060-8926102
  misc_feature 1..42: note = hyper
  source 1..42: mol_type = genomic DNA
actacctgcagttcccgcacaacgtcacgctcacactgtccc

SEQ ID NO: 81548 - DNA, 63 bp, Homo sapiens
  misc_feature 1..63: note = chr17:896321-896384
  misc_feature 1..63: note = hypo
  source 1..63: mol_type = genomic DNA
ctggaggaccccatccggagcctggagtgctctttatcaccggctgcccgtgggaacccacga

SEQ ID NO: 81549 - DNA, 83 bp, Homo sapiens
  misc_feature 1..83: note = chr17:9029329-9029412
  misc_feature 1..83: note = hypo
  source 1..83: mol_type = genomic DNA
ggcagggccaggcatcgtccccagccagcctgattgcagaagcagagtcaggatggctgaatgaacgacgcatggggtggaga

SEQ ID NO: 81550 - DNA, 30 bp, Homo sapiens
  misc_feature 1..30: note = chr17:9065719-9065749
  misc_feature 1..30: note = hypo
  source 1..30: mol_type = genomic DNA
ctggcaacgtcctcacgggatctctcctcc

SEQ ID NO: 81551 - DNA, 44 bp, Homo sapiens
  misc_feature 1..44: note = chr17:9143066-9143110
  misc_feature 1..44: note = hyper
  source 1..44: mol_type = genomic DNA
cagagcctgtggatccgctcgcgggacatcgcctgcaagtgtcc

SEQ ID NO: 81552 - DNA, 39 bp, Homo sapiens
  misc_feature 1..39: note = chr17:9143465-9143504
  misc_feature 1..39: note = hyper
  source 1..39: mol_type = genomic DNA
cctgcgcgctctgggcgggagccgcgtgcacgcggggcg

SEQ ID NO: 81553 - DNA, 426 bp, Homo sapiens
  misc_feature 1..426: note = chr17:915591-916017
  misc_feature 1..426: note = hypo
  source 1..426: mol_type = genomic DNA
acacgtgccctttcccgaggggccgccagtccccgttggtgccgagcccaaacgtaggcccccggctgacagagcttcccgcttgttacgaggagcagacgatctgggatctcacaagagaccttccagcgtttaggtgctggctcgcgtgcttctgaagtgtcctgtgagcgcctctgcggccactctagatccacaccggccatctgccaccgccgagcggggggtaactgattaggtgccaggatgggcaccggcggggagggctggggggcccgggctgggggggacccggggcaccgacgccaggactgggagacccgaggcagcacctacttcgtcaccacgctgatcttcacaccgaagacgccggtctgctttttggacggggtcctcttcaggctcatatctcggctggtgaatttc

SEQ ID NO: 81554 - DNA, 192 bp, Homo sapiens
  misc_feature 1..192: note = chr17:938024-938216
  misc_feature 1..192: note = hypo
  source 1..192: mol_type = genomic DNA
atggtccccttccctcgggctgggtcccaggccacagggtgcagactgcgagaatgcacgcccctccctgccgccgggtgtgggggagaagggggccgtgtgaatcccgttcccaaggcccggcactcatctgtcttaggtaccacaggctcaatacttgtctaggtaaagcaagctcggactggatgaacg

SEQ ID NO: 81555 - DNA, 58 bp, Homo sapiens
  misc_feature 1..58: note = chr17:9547977-9548035
  misc_feature 1..58: note = hyper
  source 1..58: mol_type = genomic DNA
tcattcaacaaggatcgtgcgttaaggagtgaaccagaaaccgcgtagggggcgcgcc

SEQ ID NO: 81556 - DNA, 36 bp, Homo sapiens; identical to SEQ ID NO: 44995
  misc_feature 1..36: note = chr17:9808139-9808175
  misc_feature 1..36: note = hypo
  source 1..36: mol_type = genomic DNA

SEQ ID NO: 81557 - DNA, 188 bp, Homo sapiens
  misc_feature 1..188: note = chr17:9810166-9810354
  misc_feature 1..188: note = hypo
  source 1..188: mol_type = genomic DNA
ggaagggagggtgggcgtgcactttccttagcggagcgcagtgctcgaggggacacactcagaaccccagccttgccaccgtggatggagagttgtctctttttgccctggggtgagaatgatgaagaataaaccccacggtctccaggcaggtaaactggtttttttttagacggagtctccctctg

SEQ ID NO: 81558 - DNA, 42 bp, Homo sapiens
  misc_feature 1..42: note = chr17:9851040-9851082
  misc_feature 1..42: note = hypo
  source 1..42: mol_type = genomic DNA
tgagctgagatcatgccattgtacgaacgaaactatgtctca

SEQ ID NO: 81559 - DNA, 26 bp, Homo sapiens
  misc_feature 1..26: note = chr17:9913746-9913772
  misc_feature 1..26: note = hypo
  source 1..26: mol_type = genomic DNA
gcatgagccaccgcgcccagcctgat

SEQ ID NO: 81560 - DNA, 90 bp, Homo sapiens
  misc_feature 1..90: note = chr18:10132081-10132171
  misc_feature 1..90: note = hyper
  source 1..90: mol_type = genomic DNA
cagctgctgccgccccgcccgctccgccgcggcccccacacgctctgcaacgcgtccttggcaacctgaaagaatcggccttcttgtcct

SEQ ID NO: 81561 - DNA, 30 bp, Homo sapiens
  misc_feature 1..30: note = chr18:10414395-10414425
  misc_feature 1..30: note = hypo
  source 1..30: mol_type = genomic DNA
gagccacggcacttccggttgctgtccacg

SEQ ID NO: 81562 - DNA, 578 bp, Homo sapiens
  misc_feature 1..578: note = chr18:10454592-10455170
  misc_feature 1..578: note = hyper
  source 1..578: mol_type = genomic DNA
cgcggccaggctgcccggccggcggcgcgctggaaatatgaagagacgctgcagctgcggtggcggtggcggccactgcagctcagagcggcgcacgcggcggccggggcgggacgcggggccgggcgcggagaagtcggggcgggcggcagagaggccgggacgcggaccgggccggggcgcccacagccgcccgacggcgcccagagagcgcgcgccccgcagccccgcgcctagcccgccgggcatggggcgcgcggcagccgcctgaagccccggcctggcccggccgcacccggccggaggcggagggcagagcgcgcgcccagttgcccgggcaccaaatcggagcgcggcgtgcgggaggccccagagcaggactggaaatgtcctggccgcgccgcctcctgctcagatacctgttcccggccctcctgcttcacggtgagttcccgagggccactcgagcgctcccagccggcggaggcagcccgggcgccgcggagcccgcggaggcgtcgggtctggatcgcggcacggcctacactgtccccttggcggggcgggtccgaggggag

SEQ ID NO: 81563 - DNA, 46 bp, Homo sapiens
  misc_feature 1..46: note = chr18:10474416-10474462
  misc_feature 1..46: note = hypo
  source 1..46: mol_type = genomic DNA
aaacaccaaaaagcacggggagccttgagtgcgaggtctgagtgag

SEQ ID NO: 81564 - DNA, 30 bp, Homo sapiens
  misc_feature 1..30: note = chr18:10562257-10562287
  misc_feature 1..30: note = hypo
  source 1..30: mol_type = genomic DNA
gagttacacagagatcgttaggcagtaagt

SEQ ID NO: 81565 - DNA, 543 bp, Homo sapiens
  misc_feature 1..543: note = chr18:10589037-10589580
  misc_feature 1..543: note = hypo
  source 1..543: mol_type = genomic DNA
gaggcttgtgtttctcgtgtgctccgggagtgtgagccccagcttctgctttcactgaattctgctgccagccacgtccttgatactttgtgggtgatttatttcattggctcgctattacttggcagcggcggtggctcctcaagccagcgtgggctccaggtggccccgggccgggaggcgatggccccgggccaggaggcgtggccacggccgctcgccggcgtccgtccccaggaacggccagcactggggcagcggaggaggcagcggtggtggtggcaccgggtagaaggcggtggcactgggtagaaggcaccgccgccgcccgccgcgggaggcttccgcggagactcagggctgcagagccagcggaggctgaaggaagagaaaggtaattttcctactcgcatatattaatttcagtaaacagataaaacaattagtaaatcaaacatataaaacagaatttttaaagaaaataatctcccaaaatatataaaagtagaatagttaaaaaaacagaaccgaatattttaatgt

SEQ ID NO: 81566 - DNA, 30 bp, Homo sapiens; identical to SEQ ID NO: 45335
  misc_feature 1..30: note = chr18:10664802-10664832
  misc_feature 1..30: note = hypo
  source 1..30: mol_type = genomic DNA

SEQ ID NO: 81567 - DNA, 149 bp, Homo sapiens
  misc_feature 1..149: note = chr18:10696211-10696360
  misc_feature 1..149: note = hypo
  source 1..149: mol_type = genomic DNA
gaccatcaccaaaaacggccccgggacctggtcctctgacagtgaagaggtgatgtctgcagctgctgagtgtttctggggaagagacaacaaattcatgcccaagagaggcaattcatggcaggaagcgccatcgccatgggtcaggg

SEQ ID NO: 81568 - DNA, 25 bp, Homo sapiens
  misc_feature 1..25: note = chr18:10809544-10809569
  misc_feature 1..25: note = hypo
  source 1..25: mol_type = genomic DNA
tgtgagccaccgcacctggcatctc

SEQ ID NO: 81569 - DNA, 30 bp, Homo sapiens; identical to SEQ ID NO: 45337
  misc_feature 1..30: note = chr18:10832633-10832663
  misc_feature 1..30: note = hypo
  source 1..30: mol_type = genomic DNA

SEQ ID NO: 81570 - DNA, 25 bp, Homo sapiens
  misc_feature 1..25: note = chr18:10906877-10906902
  misc_feature 1..25: note = hypo
  source 1..25: mol_type = genomic DNA
tgtcttttgtcgccttcctgagccc

SEQ ID NO: 81571 - DNA, 89 bp, Homo sapiens
  misc_feature 1..89: note = chr18:10907451-10907540
  misc_feature 1..89: note = hypo
  source 1..89: mol_type = genomic DNA
aaaagatgtatttgtttcaagcatcatgttgagatgaaagcactgtgagaatgcagcctaccaatgacacaccccgtggaggcgagctg

SEQ ID NO: 81572 - DNA, 86 bp, Homo sapiens; identical to SEQ ID NO: 45339
  misc_feature 1..86: note = chr18:11009583-11009669
  misc_feature 1..86: note = hypo
  source 1..86: mol_type = genomic DNA

SEQ ID NO: 81573 - DNA, 87 bp, Homo sapiens
  misc_feature 1..87: note = chr18:11074158-11074245
  misc_feature 1..87: note = hypo
  source 1..87: mol_type = genomic DNA
tatcaagtgtgatactgcctttgttcaagatctggagacatttaaagcacattcattccttttcataacgagcgaccatattctcgc

SEQ ID NO: 81574 - DNA, 36 bp, Homo sapiens
  misc_feature 1..36: note = chr18:11103949-11103985
  misc_feature 1..36: note = hypo
  source 1..36: mol_type = genomic DNA
gagtagctggaactacaggcacgcaccaccacaccc

SEQ ID NO: 81575 - DNA, 35 bp, Homo sapiens
  misc_feature 1..35: note = chr18:11148401-11148436
  misc_feature 1..35: note = hyper
  source 1..35: mol_type = genomic DNA
acgccgctggcctcccgaatcgaaccccagagcac

SEQ ID NO: 81576 - DNA, 353 bp, Homo sapiens; identical to SEQ ID NO: 36899
  misc_feature 1..353: note = chr18:11148741-11149094
  misc_feature 1..353: note = hyper
  source 1..353: mol_type = genomic DNA

SEQ ID NO: 81577 - DNA, 141 bp, Homo sapiens; identical to SEQ ID NO: 36900
  misc_feature 1..141: note = chr18:11149115-11149256
  misc_feature 1..141: note = hyper
  source 1..141: mol_type = genomic DNA

SEQ ID NO: 81578 - DNA, 262 bp, Homo sapiens
  misc_feature 1..262: note = chr18:11149498-11149760
  misc_feature 1..262: note = hyper
  source 1..262: mol_type = genomic DNA
gccgccttgcagcctcgccctcgcggcgcagccggggctccccggcggcgcgcgcttctccaccttcaatgaaactttcgaagccctcactcggggacgggcgtgtcccccggccaatgggatggcggctccggggcctgcgcgcgcggagcccgcccctgagcggctggggaagtgagagccttgcaccggcgcggagggcaagcccccacccgcggctcccgcgcctgggagagacccggcctggcctgccagtgggctg

SEQ ID NO: 81579 - DNA, 213 bp, Homo sapiens; identical to SEQ ID NO: 36902
  misc_feature 1..213: note = chr18:11149779-11149992
  misc_feature 1..213: note = hyper
  source 1..213: mol_type = genomic DNA

SEQ ID NO: 81580 - DNA, 30 bp, Homo sapiens
  misc_feature 1..30: note = chr18:11211262-11211292
  misc_feature 1..30: note = hypo
  source 1..30: mol_type = genomic DNA
gttcatcagggactccgtaggcatcttcat

SEQ ID NO: 81581 - DNA, 30 bp, Homo sapiens
  misc_feature 1..30: note = chr18:11214264-11214294
  misc_feature 1..30: note = hypo
  source 1..30: mol_type = genomic DNA
atagagcccagtgcccgcagcaaacagttt

SEQ ID NO: 81582 - DNA, 88 bp, Homo sapiens
  misc_feature 1..88: note = chr18:11232104-11232192
  misc_feature 1..88: note = hypo
  source 1..88: mol_type = genomic DNA
aaaacaggcaatgaccgtgtattcaatcatcaaggatacaggagaatcattttactatcatgtgtatcttatatacttttttttgaga

SEQ ID NO: 81583 - DNA, 27 bp, Homo sapiens
  misc_feature 1..27: note = chr18:11263248-11263275
  misc_feature 1..27: note = hypo
  source 1..27: mol_type = genomic DNA
tgtgagccaccacgcccagcctaaaat

SEQ ID NO: 81584 - DNA, 30 bp, Homo sapiens
  misc_feature 1..30: note = chr18:11378497-11378527
  misc_feature 1..30: note = hypo
  source 1..30: mol_type = genomic DNA
tggtacagcaccattcggagggtggtaaga

SEQ ID NO: 81585 - DNA, 46 bp, Homo sapiens
  misc_feature 1..46: note = chr18:11379033-11379079
  misc_feature 1..46: note = hypo
  source 1..46: mol_type = genomic DNA
gcctgggggaaggggcgcacagatgagaggccgctcctcaggccct

SEQ ID NO: 81586 - DNA, 129 bp, Homo sapiens
  misc_feature 1..129: note = chr18:11401631-11401760
  misc_feature 1..129: note = hypo
  source 1..129: mol_type = genomic DNA
ttcaatcatcagagacgttgatcctatcatcctcctcccgccagcgaaggatattttgttggtccgctgcattagtgacatcacaaagatgggacctgatgctagaaaaatcatcggtaccttagatgc

SEQ ID NO: 81587 - DNA, 175 bp, Homo sapiens
  misc_feature 1..175: note = chr18:11430289-11430464
  misc_feature 1..175: note = hypo
  source 1..175: mol_type = genomic DNA
accagtatgccccatcgcggggggtgagggggaggcggggaggcaagaggataattccacctagcccagtttcaacccctactcatgtaaagcatgcagtacagggtccttggtatcgcccatcccagtccaacaccattggcacctaggcactactccccggggcccgggggcc

SEQ ID NO: 81588 - DNA, 458 bp, Homo sapiens
  misc_feature 1..458: note = chr18:11533257-11533715
  misc_feature 1..458: note = hypo
  source 1..458: mol_type = genomic DNA
tgtcactgccttcagcggggggctggttaggagtcctatccatggctgcatgggtcaccgcagggagagggttgggggcgctatccggggctgcgctgcccacagcaagagcaggttggggcgctatctggtgctgtaatgtcggaggcagggatgtgttggggtgctatgggctactacactgcgtggcgaggaggtggggtgttaggggcgctatcgggctgccctgccaacaggggcagaggttgcagcaacagcagtggtctccaagaaaggaggcttcctcctctccccagactccagactctagagggcgacctcctcctgctcctgctccagtggcacgcgtgcacaacgtttccacgggaatcctgggtacggcagggcccccacatccgccgtgattcccaggcctgcttcctctctctctgtgttgcagagaccggctgggacccctg

SEQ ID NO: 81589 - DNA, 173 bp, Homo sapiens
  misc_feature 1..173: note = chr18:11546891-11547064
  misc_feature 1..173: note = hypo
  source 1..173: mol_type = genomic DNA
agactcctcaagcttcggctgtgtgtagactagtcagcttccagtgtgactagagcagggcttgatgactcctcaatcttcagccttgtgtagactggccggcctcctgattggccagagcaggactgtcgtctttctctgcagtggtttggttccatcgcaggatcagtcag

SEQ ID NO: 81590 - DNA, 30 bp, Homo sapiens
  misc_feature 1..30: note = chr18:11571295-11571325
  misc_feature 1..30: note = hypo
  source 1..30: mol_type = genomic DNA
gagtccctgatgagacggacagcgggtggc

SEQ ID NO: 81591 - DNA, 82 bp, Homo sapiens
  misc_feature 1..82: note = chr18:11580091-11580173
  misc_feature 1..82: note = hypo
  source 1..82: mol_type = genomic DNA
attcggggtcgatgtcggccactggcgggcgggacacgggctcctgacacattttctcattataacccggagtcttgtgtta

SEQ ID NO: 81592 - DNA, 39 bp, Homo sapiens
  misc_feature 1..39: note = chr18:11689795-11689834
  misc_feature 1..39: note = hyper
  source 1..39: mol_type = genomic DNA
cgagcagctgagtgccgaggagcgcgaggcggccaagga

SEQ ID NO: 81593 - DNA, 30 bp, Homo sapiens
  misc_feature 1..30: note = chr18:11749664-11749694
  misc_feature 1..30: note = hypo
  source 1..30: mol_type = genomic DNA
gatgggtgagaccagcggagaatctggtgc

SEQ ID NO: 81594 - DNA, 235 bp, Homo sapiens
  misc_feature 1..235: note = chr18:11751397-11751632
  misc_feature 1..235: note = hyper
  source 1..235: mol_type = genomic DNA
actgcacaggagaaacgggggctggaggtaaagacaggaggctcgggaggcggcgacgtgggcgagctggaatagtctagaagctgagcagaacaaaggcggtgtgactggtgagcctcggagggatcctcctccctgctagaatatgcatgatcctccgcgagtcttcgcccgccaggagcagggacgcgtccgagccaacacggggcgcgcgcccagacgcactttcccggct

SEQ ID NO: 81595 - DNA, 478 bp, Homo sapiens; identical to SEQ ID NO: 36904
  misc_feature 1..478: note = chr18:11752127-11752605
  misc_feature 1..478: note = hyper
  source 1..478: mol_type = genomic DNA

SEQ ID NO: 81596 - DNA, 129 bp, Homo sapiens; identical to SEQ ID NO: 36905
  misc_feature 1..129: note = chr18:11752640-11752769
  misc_feature 1..129: note = hyper
  source 1..129: mol_type = genomic DNA

SEQ ID NO: 81597 - DNA, 36 bp, Homo sapiens
  misc_feature 1..36: note = chr18:11822332-11822368
  misc_feature 1..36: note = hypo
  source 1..36: mol_type = genomic DNA
gtggtacacacctgtcgtccccgctgctcgggagcc

SEQ ID NO: 81598 - DNA, 37 bp, Homo sapiens
  misc_feature 1..37: note = chr18:11877710-11877747
  misc_feature 1..37: note = hypo
  source 1..37: mol_type = genomic DNA
tgtggggcctttccacggggaccggcactccagcctg

SEQ ID NO: 81599 - DNA, 20 bp, Homo sapiens
  misc_feature 1..20: note = chr18:11921463-11921483
  misc_feature 1..20: note = hypo
  source 1..20: mol_type = genomic DNA
ctggccgacaggttctaatt

SEQ ID NO: 81600 - DNA, 18 bp, Homo sapiens
  misc_feature 1..18: note = chr18:11942728-11942746
  misc_feature 1..18: note = hypo
  source 1..18: mol_type = genomic DNA
tttttttttttgagacgg

SEQ ID NO: 81601 - DNA, 120 bp, Homo sapiens
  misc_feature 1..120: note = chr18:11942866-11942986
  misc_feature 1..120: note = hypo
  source 1..120: mol_type = genomic DNA
acccaccaccacaccctgctaaatttttttatgactcatgcatgagtcactgcacctggccattagtaaccaattataaactaaaaccaaggctgggcatggtggctcatgcttgtactc

SEQ ID NO: 81602 - DNA, 239 bp, Homo sapiens
  misc_feature 1..239: note = chr18:11947249-11947488
  misc_feature 1..239: note = hyper
  source 1..239: mol_type = genomic DNA
ggaggaaccacaaaccgcgtagactcaggccagccgctgggcctgggcctgtgtgtccctcaggcggcgacctttggcccacttcaggccggccgtatttaccagcttagaggcgccgcggcgttggcgagtcctttttcacccaccccttccctccgttctcaggcttgaacttgaacaggcactcatgactcagcaaacggtacttgatagggttctttacacgtcagtcaggctat

SEQ ID NO: 81603 - DNA, 30 bp, Homo sapiens; identical to SEQ ID NO: 16298
  misc_feature 1..30: note = chr18:11979044-11979074
  misc_feature 1..30: note = hypo
  source 1..30: mol_type = genomic DNA

SEQ ID NO: 81604 - DNA, 102 bp, Homo sapiens
  misc_feature 1..102: note = chr18:11979855-11979957
  misc_feature 1..102: note = hypo
  source 1..102: mol_type = genomic DNA
cgcacccggcctctgtcttaaacatcataaaaacataagaacccaaaaaagatggaggggagtgcgcccttagctgccccaaactggcgtggtgggaggcag

SEQ ID NO: 81605 - DNA, 168 bp, Homo sapiens
  misc_feature 1..168: note = chr18:11989272-11989440
  misc_feature 1..168: note = hypo
  source 1..168: mol_type = genomic DNA
cctgcctgggctgagcgcacctgtcgctggaggaagaggaggcaggagggggagaggaggcggtggtgatggcctccagctcctgcctcgcctggtccacacctgcagtgtttgcttagctctgcagggtggggtcagcctacgtgagaaattcgaaaactcaacaac

SEQ ID NO: 81606 - DNA, 30 bp, Homo sapiens
  misc_feature 1..30: note = chr18:11995477-11995507
  misc_feature 1..30: note = hyper
  source 1..30: mol_type = genomic DNA
gaaggggagactggacgtttggggtcaaat

SEQ ID NO: 81607 - DNA, 30 bp, Homo sapiens
  misc_feature 1..30: note = chr18:12005824-12005854
  misc_feature 1..30: note = hypo
  source 1..30: mol_type = genomic DNA
cagttttctttccaccgcttcagtttccta

SEQ ID NO: 81608 - DNA, 19 bp, Homo sapiens
  misc_feature 1..19: note = chr18:12072041-12072060
  misc_feature 1..19: note = hypo
  source 1..19: mol_type = genomic DNA
actccgtctcaaaacaaaa

SEQ ID NO: 81609 - DNA, 30 bp, Homo sapiens; identical to SEQ ID NO: 45345
  misc_feature 1..30: note = chr18:12076093-12076123
  misc_feature 1..30: note = hypo
  source 1..30: mol_type = genomic DNA

SEQ ID NO: 81610 - DNA, 151 bp, Homo sapiens
  misc_feature 1..151: note = chr18:12208462-12208613
  misc_feature 1..151: note = hypo
  source 1..151: mol_type = genomic DNA
tttggtcttttccaagtttattggcgtagtggtgagaactgtctctatgggcttatgagggtgccgcgttgtttaaagatgatctttcccaaaacaccttttctgcctctgcatctgccaaacatcacagcttctgcgttggattagtcag

SEQ ID NO: 81611 - DNA, 30 bp, Homo sapiens
  misc_feature 1..30: note = chr18:12245897-12245927
  misc_feature 1..30: note = hypo
  source 1..30: mol_type = genomic DNA
agccgggtgcagagccgccgcaaccccaca

SEQ ID NO: 81612 - DNA, 301 bp, Homo sapiens
  misc_feature 1..301: note = chr18:12253591-12253892
  misc_feature 1..301: note = hyper
  source 1..301: mol_type = genomic DNA
cctaattgcgtcttccgatgggaacaaccatgagagcagggtgtggacggaagtcccccagccccagcggggttcactctttgcctcctcactctgcgagggtcccttactacagctaaaaggcaattcatgcagtccaaaggctcctttcccctcccgttctgcatgcccttctcactgtccccaaatgctcatgacatggccttgagagcagcgcagcgggcaggaagcccaggcgcctcggagaacctgaagggctgcaggtcccggtgtctgcggcagcttccgcatccctgcaggg

SEQ ID NO: 81613 - DNA, 43 bp, Homo sapiens; identical to SEQ ID NO: 12992
  misc_feature 1..43: note = chr18:12254104-12254147
  misc_feature 1..43: note = hyper
  source 1..43: mol_type = genomic DNA

SEQ ID NO: 81614 - DNA, 326 bp, Homo sapiens
  misc_feature 1..326: note = chr18:12254304-12254630
  misc_feature 1..326: note = hyper
  source 1..326: mol_type = genomic DNA
cgggcgggggcggggccgccgcactttaagaggctgtgcaggcagacagacctccaggcccgctaggggatccgcgccatggaggccgcccgggactatgcaggagccctcatcaggcgagtgccccgcgtccccctgattgccgtgcgcttccaatcgccttgcgttcggtggcctcatattcccctgtgcgcctctagtaccgtaccccgctcccttcagccccctgctccccgcattctcttgcgctccgcgaccccgcgcacacacccatccgccccactggtgcccaagccgtccagccgcgcccgcgggcagagcccaat

SEQ ID NO: 81615 - DNA, 167 bp, Homo sapiens
  misc_feature 1..167: note = chr18:12258116-12258283
  misc_feature 1..167: note = hypo
  source 1..167: mol_type = genomic DNA
ttcctccagcagtgacgcagctcttggtttggaaatgctacaggtgagaacaataggtgttttttcactgacgatggcaatcttgagggcaggtgaaggcagggagaaccagaaatggttgccagctcttatcttgtcagacaggtaaagaccgcaggaacctggaa

SEQ ID NO: 81616 - DNA, 171 bp, Homo sapiens
  misc_feature 1..171: note = chr18:12287792-12287963
  misc_feature 1..171: note = hyper
  source 1..171: mol_type = genomic DNA
atgagctttggacaacgtggttcctcccgttgaatcaggttctgaccgagtccgctgcagctgcaggcgggggcgccctgccgagcagatacccagcggagctccggggccccgtttctactgtaagcagctgggggccaaatgtgcgcccgggcacgtctcttggcctct

SEQ ID NO: 81617 - DNA, 607 bp, Homo sapiens
  misc_feature 1..607: note = chr18:12307602-12308209
  misc_feature 1..607: note = hyper
  source 1..607: mol_type = genomic DNA
cgcgaggagtaggctgcatagacccggcgcaggaggtgttcattttcggatccagccctgtagtcactttagctaaacccggttccaaaggggtgggagtcgtcggagaggaatggcctctgtatctccggagacggaaacaccaggacgaagaggccctaagaacgtgtgcccggggtgcgaccggggggtggggggcagggggcagagaccctgaaaagctccaccgccgaaccccagggcagtgtcccggcttggctggactgggcgcgggcggctgcaatgctcccgggcgcggcgctgggaccccgcgggccacgtcggctccgctgccccgacgccagggcccgactcgcgtctccctctggcggggcaccacaaggggcagcgaaacggtggtgggggcgggcgccgcgctccttcccgtctcctccccgccagctccgggcccgtccttttccgcccggctcccggcaagggtcccccgactggcgcccgcgcgtcctccctcggctgctgcaggccgggccgcggcgtcgagcgggggcggcggggcggggcccgcagccattggcgagcggcggggcgggggcgggggcgcggaggg

SEQ ID NO: 81618 - DNA, 30 bp, Homo sapiens; identical to SEQ ID NO: 36912
  misc_feature 1..30: note = chr18:12308897-12308927
  misc_feature 1..30: note = hyper
  source 1..30: mol_type = genomic DNA

SEQ ID NO: 81619 - DNA, 27 bp, Homo sapiens
  misc_feature 1..27: note = chr18:12375267-12375294
  misc_feature 1..27: note = hypo
  source 1..27: mol_type = genomic DNA
ttaggagacagagtccgtcacccacgc

SEQ ID NO: 81620 - DNA, 120 bp, Homo sapiens
  misc_feature 1..120: note = chr18:12375354-12375474
  misc_feature 1..120: note = hypo
  source 1..120: mol_type = genomic DNA
gccttggccccccgagttgctgggactatagtcataagtcactgagcccaggtaagaaaaaaaaaaaaaaaacaatttgtagaggccaggagctgtggctcaggtctgtaattccaacac

SEQ ID NO: 81621 - DNA, 120 bp, Homo sapiens
  misc_feature 1..120: note = chr18:12375952-12376072
  misc_feature 1..120: note = hypo
  source 1..120: mol_type = genomic DNA
ctgggcgaagaagcaaaaccccgtctcttaaaaaataaaaataaaaataaaaatcgtagatcggagggtctgctaccctacccaagctggtttccaactcctggagtcaagcgattctcc

SEQ ID NO: 81622 - DNA, 29 bp, Homo sapiens
  misc_feature 1..29: note = chr18:12376132-12376161
  misc_feature 1..29: note = hypo
  source 1..29: mol_type = genomic DNA
ccttacagtgaagacgttgagctgactac

SEQ ID NO: 81623 - DNA, 96 bp, Homo sapiens
  misc_feature 1..96: note = chr18:12408021-12408117
  misc_feature 1..96: note = hyper
  source 1..96: mol_type = genomic DNA
gggccgcggtggggccgtccagacgccggctcctgctcccgagcccggctggagcggtccaggaaaggccggacctcacagcgggcctcgcggaga

SEQ ID NO: 81624 - DNA, 62 bp, Homo sapiens
  misc_feature 1..62: note = chr18:12420148-12420210
  misc_feature 1..62: note = hyper
  source 1..62: mol_type = genomic DNA
tgctgagccggcggccggggagggctcgcgggactcctcagatttgtcggaccagcctttca

SEQ ID NO: 81625 - DNA, 59 bp, Homo sapiens
  misc_feature 1..59: note = chr18:12657095-12657154
  misc_feature 1..59: note = hyper
  source 1..59: mol_type = genomic DNA
cccgcgtgaagcctgcgatgccctccccaccccgtgaacccggccgtgtgtcagcagcc

SEQ ID NO: 81626 - DNA, 30 bp, Homo sapiens
  misc_feature 1..30: note = chr18:12700987-12701017
  misc_feature 1..30: note = hypo
  source 1..30: mol_type = genomic DNA
tcaatgattcctcgacgtctaagggctttg

SEQ ID NO: 81627 - DNA, 30 bp, Homo sapiens; identical to SEQ ID NO: 16300
  misc_feature 1..30: note = chr18:12701811-12701841
  misc_feature 1..30: note = hypo
  source 1..30: mol_type = genomic DNA

SEQ ID NO: 81628 - DNA, 145 bp, Homo sapiens
  misc_feature 1..145: note = chr18:12911076-12911221
  misc_feature 1..145: note = hyper
  source 1..145: mol_type = genomic DNA
caggttggggcaggccgggtggggcccagcgagtgggcgggggcgcgagcgggagcggaagcgggcccgggccgcactgctgccgcgtctagccgcctcccaggctgcctgcgccgcgtggctcgcccccgggacttgccagcag

SEQ ID NO: 81629 - DNA, 157 bp, Homo sapiens
  misc_feature 1..157: note = chr18:12949178-12949335
  misc_feature 1..157: note = hypo
  source 1..157: mol_type = genomic DNA
tctaatgtggggatgctacatgagatttaggaacctcccagatgtgttgcaggatgaatgaaagctggagtgcggattatttggttctcgacaactccagagtaactggaaatctgaaggatagtttatcctttttcacattcgagtttgataccag

SEQ ID NO: 81630 - DNA, 35 bp, Homo sapiens
  misc_feature 1..35: note = chr18:13036778-13036813
  misc_feature 1..35: note = hypo
  source 1..35: mol_type = genomic DNA
ctcccagtctttgtccggaccggggtttcctggga

SEQ ID NO: 81631 - DNA, 19 bp, Homo sapiens
  misc_feature 1..19: note = chr18:13135175-13135194
  misc_feature 1..19: note = hypo
  source 1..19: mol_type = genomic DNA
gaggcgccaagagtgagcg

SEQ ID NO: 81632 - DNA, 28 bp, Homo sapiens
  misc_feature 1..28: note = chr18:13195551-13195579
  misc_feature 1..28: note = hypo
  source 1..28: mol_type = genomic DNA
ttttttctggtgtctcgctctgtcgccc

SEQ ID NO: 81633 - DNA, 27 bp, Homo sapiens
  misc_feature 1..27: note = chr18:13195819-13195846
  misc_feature 1..27: note = hypo
  source 1..27: mol_type = genomic DNA
agccaccgcacccggccaagaagtaca

SEQ ID NO: 81634 - DNA, 346 bp, Homo sapiens
  misc_feature 1..346: note = chr18:13218173-13218519
  misc_feature 1..346: note = hyper
  source 1..346: mol_type = genomic DNA
gggggactcgggaaccggacgctttgggaactggacgtccgcgagcctgcgccgtcggctggggccggagggagaagctgggcgccgagcgcgcgaggtctgtgaggcttggtccgggtgggcttgccggtgggcacggcggggatccggggctggcccgcgggcggggttacgccggtggagggacttcgccgacccccaccccgttttctgtttcctggtgccctggggcgcagggtgtcccgcggttgcaagactgaattctgcaccgcccggaggccaggatgggcgcgcggatggcagccccaactgtctccgcgcccctaggcctcggcgagccgtggcg

SEQ ID NO: 81635 - DNA, 30 bp, Homo sapiens
  misc_feature 1..30: note = chr18:13219094-13219124
  misc_feature 1..30: note = hyper
  source 1..30: mol_type = genomic DNA
aaggagaaggtttcccgatgaggcagaggt

SEQ ID NO: 81636 - DNA, 30 bp, Homo sapiens
  misc_feature 1..30: note = chr18:13228292-13228322
  misc_feature 1..30: note = hypo
  source 1..30: mol_type = genomic DNA
tgccacagtccttggcggttctccattttc

SEQ ID NO: 81637 - DNA, 119 bp, Homo sapiens
  misc_feature 1..119: note = chr18:13231199-13231318
  misc_feature 1..119: note = hypo
  source 1..119: mol_type = genomic DNA
tggtatgggaggaagcgggagggagaagggcaagaggggtctggaccggttttgcttgagaagaaatggcagtggacacatggctcgtgtgaaaggtgggtgcacgcagacaggccaga

SEQ ID NO: 81638 - DNA, 40 bp, Homo sapiens
  misc_feature 1..40: note = chr18:13233142-13233182
  misc_feature 1..40: note = hypo
  source 1..40: mol_type = genomic DNA
gcctgtcctgaaggacgtgagcgggcgaagtgctcttggg

SEQ ID NO: 81639 - DNA, 127 bp, Homo sapiens
  misc_feature 1..127: note = chr18:13241262-13241389
  misc_feature 1..127: note = hypo
  source 1..127: mol_type = genomic DNA
tggcacctcacagggcgctggtttataaagacccaaaccagtgtcgagttccatgctggccccggcgtctgctgtgtgctttcgctgtgtgtatacatgcggaagttcattccggaggcttccaggg

SEQ ID NO: 81640 - DNA, 102 bp, Homo sapiens
  misc_feature 1..102: note = chr18:13241775-13241877
  misc_feature 1..102: note = hypo
  source 1..102: mol_type = genomic DNA
tttcacagggacatgcgtgaaatgggtcctgcgccgtaattactcctgctggagaccgggattgcaaagatgactgtcatgttgtctcgtgcatcttacatc

SEQ ID NO: 81641 - DNA, 64 bp, Homo sapiens
  misc_feature 1..64: note = chr18:13277290-13277354
  misc_feature 1..64: note = hypo
  source 1..64: mol_type = genomic DNA
ctgcacactggagggcggggtgctgagaggcgcttgtggtgtctgaggccgagctttgctgagt

SEQ ID NO: 81642 - DNA, 35 bp, Homo sapiens
  misc_feature 1..35: note = chr18:13295972-13296007
  misc_feature 1..35: note = hypo
  source 1..35: mol_type = genomic DNA
gaagacctgaggctgcgaggcggggtgccttgccc
